US006905827B2

(12) United States Patent
Wohlgemuth et al.

(10) Patent No.: US 6,905,827 B2
(45) Date of Patent: Jun. 14, 2005

(54) METHODS AND COMPOSITIONS FOR DIAGNOSING OR MONITORING AUTO IMMUNE AND CHRONIC INFLAMMATORY DISEASES

(75) Inventors: Jay Wohlgemuth, Palo Alto, CA (US); Kirk Fry, Palo Alto, CA (US); Robert Woodward, Pleasanton, CA (US); Ngoc Ly, San Bruno, CA (US)

(73) Assignee: Expression Diagnostics, Inc., So. San Francisco, CA (US)

( * ) Notice: Subject to any disclaimer, the term of this patent is extended or adjusted under 35 U.S.C. 154(b) by 221 days.

(21) Appl. No.: 10/131,827

(22) Filed: Apr. 24, 2002

(65) Prior Publication Data

US 2004/0009479 A1 Jan. 15, 2004

Related U.S. Application Data

(63) Continuation-in-part of application No. 10/006,290, filed on Oct. 22, 2001.
(60) Provisional application No. 60/296,764, filed on Jun. 8, 2001.

(51) Int. Cl.[7] .............................................. C12Q 1/68
(52) U.S. Cl. .......................... 435/6; 435/7.1; 435/91.2
(58) Field of Search ............................ 435/6, 7.1, 91.2

(56) References Cited

U.S. PATENT DOCUMENTS

| | | | |
|---|---|---|---|
| 4,190,535 A | 2/1980 | Luderer et al. ............. 210/789 |
| 4,350,593 A | 9/1982 | Kessler ...................... 210/516 |
| 4,358,535 A | 11/1982 | Falkow et al. ................. 435/5 |
| 4,582,789 A | 4/1986 | Sheldon, III et al. ........... 435/6 |
| 4,683,195 A | 7/1987 | Mullis et al. .................. 435/6 |
| 4,683,202 A | 7/1987 | Mullis ....................... 435/91.2 |
| 4,751,001 A | 6/1988 | Saunders .................... 210/516 |
| 4,762,780 A | 8/1988 | Spector et al. ................. 435/6 |
| 4,789,630 A | 12/1988 | Bloch et al. ................... 435/5 |
| 4,800,159 A | 1/1989 | Mullis et al. ............... 435/91.2 |
| 4,818,418 A | 4/1989 | Saunders .................... 210/782 |
| 4,843,155 A | 6/1989 | Chomczynski ........... 536/25.41 |
| 4,889,818 A | 12/1989 | Gelfand et al. ............. 435/194 |
| 4,908,318 A | 3/1990 | Lerner ....................... 435/270 |
| 4,946,952 A | 8/1990 | Kiefer .................... 536/25.41 |
| 4,965,188 A | 10/1990 | Mullis et al. .................. 435/6 |
| 5,053,134 A | 10/1991 | Luderer et al. ............. 210/516 |
| 5,063,162 A | 11/1991 | Kiefer ....................... 435/270 |
| 5,066,584 A | 11/1991 | Gyllensten et al. ........ 435/91.2 |
| 5,075,216 A | 12/1991 | Innis et al. .................... 435/6 |
| 5,079,352 A | 1/1992 | Gelfand et al. ............ 536/23.2 |
| 5,091,310 A | 2/1992 | Innis ......................... 435/91.2 |
| 5,142,033 A | 8/1992 | Innis ......................... 536/23.1 |
| 5,143,854 A | 9/1992 | Pirrung et al. .............. 436/518 |
| 5,210,015 A | 5/1993 | Gelfand et al. ................. 435/6 |
| 5,212,071 A | 5/1993 | Fearon et al. ............. 435/69.1 |
| 5,215,882 A | 6/1993 | Bahl et al. ..................... 435/6 |
| 5,219,727 A | 6/1993 | Wang et al. ................... 435/6 |
| 5,264,351 A | 11/1993 | Harley .................... 435/70.21 |
| 5,278,043 A | 1/1994 | Bannwarth et al. ........ 536/23.1 |
| 5,310,652 A | 5/1994 | Gelfand et al. ................. 435/6 |
| 5,314,809 A | 5/1994 | Erlich et al. ............... 435/91.2 |
| 5,322,770 A | 6/1994 | Gelfand ......................... 435/6 |
| 5,340,720 A | 8/1994 | Stetler ........................ 435/7.4 |
| 5,352,600 A | 10/1994 | Gelfand et al. ............. 435/194 |
| 5,374,553 A | 12/1994 | Gelfand et al. .......... 435/252.3 |
| 5,385,824 A | 1/1995 | Hoet et al. ..................... 435/6 |
| 5,389,512 A | 2/1995 | Sninsky et al. ................ 435/5 |
| 5,393,672 A | 2/1995 | Ness et al. ..................... 436/94 |
| 5,405,774 A | 4/1995 | Abramson et al. ....... 435/252.3 |
| 5,407,800 A | 4/1995 | Gelfand et al. ................. 435/6 |
| 5,411,876 A | 5/1995 | Bloch et al. ............... 435/91.2 |
| 5,418,149 A | 5/1995 | Gelfand et al. ............ 435/91.2 |
| 5,420,029 A | 5/1995 | Gelfand et al. ............. 435/194 |
| 5,445,940 A | 8/1995 | Brenner et al. ............ 435/7.24 |
| 5,455,170 A | 10/1995 | Abramson et al. ....... 435/252.3 |
| 5,459,037 A | 10/1995 | Sutcliffe et al. ............... 435/6 |
| 5,466,591 A | 11/1995 | Abramson et al. .......... 435/194 |
| 5,468,613 A | 11/1995 | Erlich et al. .................... 435/6 |
| 5,476,774 A | 12/1995 | Wang et al. ............... 435/91.2 |
| 5,487,970 A | 1/1996 | Rowley et al. ................. 435/6 |
| 5,487,972 A | 1/1996 | Gelfand et al. ................. 435/6 |
| 5,491,063 A | 2/1996 | Fisher et al. ................... 435/6 |
| 5,491,086 A | 2/1996 | Gelfand et al. ............. 435/194 |
| 5,501,963 A | 3/1996 | Burckhardt ................ 435/91.2 |
| 5,512,462 A | 4/1996 | Cheng ....................... 435/91.2 |
| 5,514,556 A | 5/1996 | Shearer et al. ............. 435/7.24 |
| 5,538,848 A | 7/1996 | Livak et al. .................... 435/6 |
| 5,561,058 A | 10/1996 | Gelfand et al. ............ 435/91.2 |
| 5,565,339 A | 10/1996 | Bloch et al. ............... 435/91.2 |
| 5,569,583 A | 10/1996 | Greenberg et al. ............ 435/5 |
| 5,571,673 A | 11/1996 | Picone .......................... 435/6 |
| 5,573,906 A | 11/1996 | Bannworth et al. ............ 435/6 |
| 5,604,099 A | 2/1997 | Erlich et al. .................... 435/6 |
| 5,618,703 A | 4/1997 | Gelfand et al. ............ 435/91.2 |
| 5,618,711 A | 4/1997 | Gelfand et al. ............. 435/194 |
| 5,624,833 A | 4/1997 | Gelfand et al. ............. 435/194 |

(Continued)

FOREIGN PATENT DOCUMENTS

| | | |
|---|---|---|
| EP | 0 217 992 A2 | 4/1987 |
| EP | 1 077 254 A2 | 2/2001 |
| EP | 1 162 276 A2 | 12/2001 |
| WO | WO 91/18626 | 12/1991 |

(Continued)

OTHER PUBLICATIONS

Higuchi et al, Chemical Abstracts 129: 342625 (1998).*
Rebouillat et al, J. Biol. Chem. 274 (3), 1557 (1999).*

(Continued)

Primary Examiner—James Martinell
(74) Attorney, Agent, or Firm—Morrison & Foerster LLP

(57) ABSTRACT

Methods of diagnosing or monitoring an autoimmune or chronic inflammatory disease, particularly SLE in a patient by detecting the expression level of one or more genes or surrogates derived therefrom in the patient are described. Diagnostic oligonucleotides for diagnosing or monitoring chronic inflammatory disease, particularly SLE infection and kits or systems containing the same are also described.

9 Claims, 9 Drawing Sheets

U.S. PATENT DOCUMENTS

| | | | |
|---|---|---|---|
| 5,635,365 A | 6/1997 | Ansari et al. | 435/15 |
| 5,641,864 A | 6/1997 | Gelfand | 530/350 |
| 5,658,744 A | 8/1997 | Ochoa et al. | 435/7.24 |
| 5,665,551 A | 9/1997 | Gelfand et al. | 435/6 |
| 5,674,738 A | 10/1997 | Abramson et al. | 435/252.3 |
| 5,677,152 A | 10/1997 | Birch et al. | 435/91.2 |
| 5,693,517 A | 12/1997 | Gelfand et al. | 435/193 |
| 5,707,807 A | 1/1998 | Kato | 435/6 |
| 5,716,787 A | 2/1998 | Dunn et al. | 435/7.1 |
| 5,721,351 A | 2/1998 | Levinson | 536/23.4 |
| 5,766,585 A | 6/1998 | Evans et al. | 424/93.21 |
| 5,773,258 A | 6/1998 | Birch et al. | 435/91.2 |
| 5,789,224 A | 8/1998 | Gelfand et al. | 435/194 |
| 5,795,762 A | 8/1998 | Abramson et al. | 435/194 |
| 5,804,375 A | 9/1998 | Gelfand et al. | 435/6 |
| 5,807,522 A | 9/1998 | Brown et al. | 422/50 |
| 5,811,284 A | 9/1998 | Chang et al. | 435/252.3 |
| 5,837,832 A | 11/1998 | Chee et al. | 536/22.1 |
| 5,939,270 A | 8/1999 | Haunsø et al. | 435/7.1 |
| 5,939,292 A | 8/1999 | Gelfand et al. | 435/91.2 |
| 5,958,342 A | 9/1999 | Gamble et al. | 422/100 |
| 5,958,688 A | 9/1999 | Eberwine et al. | 435/6 |
| 5,965,366 A | 10/1999 | Ochoa et al. | 435/6 |
| 5,968,799 A | 10/1999 | Gelfand et al. | 435/194 |
| 5,973,137 A | 10/1999 | Heath | 536/25.4 |
| 5,981,481 A | 11/1999 | Fearon et al. | 514/12 |
| 5,994,056 A | 11/1999 | Higuchi | 435/6 |
| 5,994,076 A | 11/1999 | Chenchik et al. | 435/6 |
| 6,001,611 A | 12/1999 | Will | 435/91.2 |
| 6,004,755 A | 12/1999 | Wang | 435/6 |
| 6,010,853 A | 1/2000 | Kanteti et al. | 435/6 |
| 6,020,186 A | 2/2000 | Henco et al. | 435/287.2 |
| 6,033,860 A | 3/2000 | Lockhart et al. | 435/6 |
| 6,040,138 A | 3/2000 | Lockhart et al. | 435/6 |
| 6,040,166 A | 3/2000 | Erlich et al. | 435/194 |
| 6,045,996 A | 4/2000 | Cronin et al. | 435/6 |
| 6,048,695 A | 4/2000 | Bradley et al. | 435/6 |
| 6,048,709 A | 4/2000 | Falb | 435/69.1 |
| 6,060,240 A | 5/2000 | Kamb et al. | 435/6 |
| 6,066,322 A | 5/2000 | Levinson | 424/144.1 |
| 6,066,498 A | 5/2000 | Levinson | 435/320.1 |
| 6,084,083 A | 7/2000 | Levinson | 536/23.4 |
| 6,087,112 A | 7/2000 | Dale | 435/6 |
| 6,087,477 A | 7/2000 | Falb et al. | 530/350 |
| 6,090,556 A | 7/2000 | Kato | 435/6 |
| 6,099,823 A | 8/2000 | Falb | 424/9.1 |
| 6,124,433 A | 9/2000 | Falb et al. | 530/350 |
| 6,127,155 A | 10/2000 | Gelfand et al. | 435/188 |
| 6,146,828 A | 11/2000 | Lapidus et al. | 435/6 |
| 6,150,121 A | 11/2000 | Hamawy et al. | 435/7.24 |
| 6,156,887 A | 12/2000 | Levinson | 536/23.4 |
| 6,162,604 A | 12/2000 | Jacob | 435/6 |
| 6,168,933 B1 | 1/2001 | Kaser et al. | 435/91.1 |
| 6,171,785 B1 | 1/2001 | Higuchi | 435/6 |
| 6,177,254 B1 | 1/2001 | Rattner et al. | 435/7.1 |
| 6,187,534 B1 | 2/2001 | Strom et al. | 435/6 |
| 6,190,857 B1 | 2/2001 | Ralph et al. | 435/6 |
| 6,190,872 B1 | 2/2001 | Slotman | 435/7.92 |
| 6,194,158 B1 | 2/2001 | Kroes et al. | 435/6 |
| 6,197,563 B1 | 3/2001 | Erlich et al. | 435/194 |
| 6,204,371 B1 | 3/2001 | Levinson | 536/23.4 |
| 6,214,979 B1 | 4/2001 | Gelfand et al. | 536/22.1 |
| 6,218,122 B1 | 4/2001 | Friend et al. | 435/6 |
| 6,225,084 B1 | 5/2001 | Falb et al. | 435/69.1 |
| 6,225,093 B1 | 5/2001 | Grant et al. | 435/91.2 |
| 6,228,628 B1 | 5/2001 | Gelfand et al. | 435/194 |
| 6,242,185 B1 | 6/2001 | Kaser et al. | 435/6 |
| 6,245,334 B1 | 6/2001 | Seilhammer et al. | 424/185.1 |
| 6,245,526 B1 | 6/2001 | Yue et al. | 435/69.1 |
| 6,245,527 B1 | 6/2001 | Busfield et al. | 435/69.1 |
| 6,248,527 B1 | 6/2001 | Chen et al. | 435/6 |
| 6,248,528 B1 | 6/2001 | Chen et al. | 435/6 |
| 6,251,597 B1 | 6/2001 | Shyjan | 435/6 |
| 6,262,244 B1 | 7/2001 | Houchins et al. | 536/23.5 |
| 6,280,941 B1 | 8/2001 | Tsao et al. | 435/6 |
| 6,303,321 B1 | 10/2001 | Tracey et al. | 435/7.1 |
| 6,306,602 B1 | 10/2001 | Sillekens et al. | 435/6 |
| 6,365,352 B1 | 4/2002 | Yerramilli et al. | 435/6 |
| 6,403,304 B1 | 6/2002 | Stashenko et al. | 435/6 |
| 6,410,319 B1 | 6/2002 | Raubitschek et al. | 435/343.1 |
| 2002/0042386 A1 | 4/2002 | Rosen et al. | 514/44 |
| 2002/0128436 A1 | 9/2002 | Strom et al. | 530/350 |
| 2002/0132235 A1 | 9/2002 | Avihingsanon et al. | 435/6 |

FOREIGN PATENT DOCUMENTS

| | | |
|---|---|---|
| WO | WO 95/17506 | 6/1995 |
| WO | WO 96/39536 | 12/1996 |
| WO | WO 97/30065 | 8/1997 |
| WO | WO 98/24935 | 6/1998 |
| WO | WO 99/10536 | 3/1999 |
| WO | WO 99/11782 | 3/1999 |
| WO | WO 99/15700 | 4/1999 |
| WO | WO 99/52541 | 10/1999 |
| WO | WO 99/57130 | 11/1999 |
| WO | WO 00/04191 | 1/2000 |
| WO | WO 00/12753 | 3/2000 |
| WO | WO 00/23573 A3 | 4/2000 |
| WO | WO 00/46372 | 8/2000 |
| WO | WO 00/52209 | 9/2000 |
| WO | WO 00/55375 | 9/2000 |
| WO | WO 00/63372 | 10/2000 |
| WO | WO 00/73498 | 12/2000 |
| WO | WO 00/78808 | 12/2000 |
| WO | WO 01/20004 | 3/2001 |
| WO | WO 01/23426 | 4/2001 |
| WO | WO 01/23564 | 4/2001 |
| WO | WO 01/29269 | 4/2001 |
| WO | WO 01/32927 | 5/2001 |
| WO | WO 01/40302 A2 | 6/2001 |
| WO | WO 01/47944 A2 | 7/2001 |
| WO | WO 01/54733 A1 | 8/2001 |
| WO | WO 01/55164 A1 | 8/2001 |
| WO | WO 01/55201 A1 | 8/2001 |
| WO | WO 01/55203 A1 | 8/2001 |
| WO | WO 01/55205 A1 | 8/2001 |
| WO | WO 01/55328 A2 | 8/2001 |
| WO | WO 01/55368 A1 | 8/2001 |
| WO | WO 01/60860 A3 | 8/2001 |
| WO | WO 01/71005 A2 | 9/2001 |
| WO | WO 01/81916 | 11/2001 |
| WO | WO 01/86003 A2 | 11/2001 |
| WO | WO 02/00677 A1 | 1/2002 |
| WO | WO 02/00928 A2 | 1/2002 |
| WO | WO 02/28999 A2 | 4/2002 |

OTHER PUBLICATIONS

Ghosh et al. (2001) "A Specific Isozyme of 2'–5' Oligoadenylate Synthetase Is a Dual Function Proapoptotic Protein of the Bcl–2 Family," J. Biol. Chem. 276:27, 25477–25455, p. 25477.

Kumar et al. (2000) "Expansion and Molecular Evolution of the Interferon–Induced 2'–5' Oligoadenylate Synthetase Gene Family," Mol. Biol. Evol. 17, 738–750, p. 738.

Chebath et al. (1987) "Four Different Forms of Interferon–induced 2', 5'–Oligo(A) Synthetase Identified by Immunoblotting in Human Cells," J. Biol. Chem. 262, 3852–2857, p. 3856.

Kumar et al. (1994) "Cell Cycle–dependent Modulation of α–Interferon–inducible Gene Expression and Activation of Signaling Components in Daudi Cells," J. Biol. Chem. 269, No. 41, 25437–25441, p. 25438.

Yu et al. (2000) "Protein Synthesis–Dependent and Independent Induction of p69 2'–5'–Oligoadenylate Synthetase by Interferon–α," Cytokine, 11:10, 744–750, p. 747.

Ajjan, R. A. et al. (1996) "Intrathyroidal cytokine gene expression in Hashimoto's thyroiditis" Clin. Exp. Immunol. 105: 523–528.

Autieri MV, Kelemen S, Thomas BA, Feller ED, Goldman BI, Eisen HJ. (2002) "Allograft inflammatory factor–1 expression correlates with cardiac rejection and development of cardiac allograft vasculopathy" Circulation 106(17):2218–23.

Baechler, Emily C. et al. (2003) "Interferon–inducible gene expression signature in peripheral blood cells of patients with severe lupus" Proc. Natl. Acad. Sci. USA 100 (5): 2610–2615.

Bave, U. (2000) "The Combination of apoptotic U937 cells and lupus IgG is a potent IFN–alpha inducer" J. Immunol. 165: 3519–3526.

Bave, U. (2001) "Activation of natural interferon–alpha producing cells by apoptotic U937 cells combined with lupus IgG and its regulation by cytokines" J. Autoimmun. 17: 71–80.

Creemers P, Brink J, Wainwright H, Moore K, Shephard E, Kahn D. (2002) "Evaluation of peripheral blood CD4 and CD8 lumphocyte subsets, CD69 expression and histologic rejection grade as diagnostic markers for the presence of cardiac allograft rejection" Transpl Immunol. 10(4):285–92.

Doi, S. et al. (1994) "Polymerase chain reaction quantification of cytokine messenger RNA expression in peripheral blood monoculear cells of patients with acute exacerbations of asthma: effect of glucocorticoid therapy" Clinical and Experimental Allergy 24: 854–867.

Hooks, J.J. (1979) "Immune interferon in the circulation of patients with autoimmune disease" N. Engl. J. Med. 301: 5–8.

Hooks, J.J. et al. (1982) "Multiple interferons in the circulation of patients with systemic lupus erythematosus and vasculitis" Arthritis Rheum. 25: 396–400.

Magnusson, M. et al. (2001) "Importance of CpG dinucleotides in activation of natural IFN–alpha–producing cells by a lupus–related oligodeoxynucleotide" Scand. J. Immunol. 54: 543–550.

Preble, O.T. (1982) "Systemic lupus erythematosus: presence in human serum of an unusual acid–labile leukocyte interferon" Science 216: 429–431.

Schowengerdt et al (2000) "Increased expression of the lymphocyte early activation marker CD69 in peripheral blood correlates with histologic evidence of cardiac allograft rejection." Transplantation 69:(10):2102–7.

Shi, S.N. (1987) "Serum interferon in systemic lupus erythematosus" Br. J. Dermatol. 117:155–159.

Toogood, Giles J. et al. (1996) "The Immune Response Following Small Bowel Transplantation" Transplantation 62 (6): 851–855.

Vallin, H. (1999) "Anti–double–stranded DNA antibodies and immunostimulatory plasmid DNA in combination mimic the endogenous IFN–alpha inducer in systemic lupus erythematosus" J. Immunol. 163: 6306–6313.

Vandevyver, Caroline et al. (1998) "Cytokine mRNA Profile of Myelin Basic Protein Reactive T–Cell Clones in Patients with Multiple Sclerosis" Autoimmunity 28: 77–89.

Abdallah, A. N. et al. (1997) "Evaluation of plasma levels of tumour necrosis factor alpha and interleukin–6 as rejection markers in a cohort of 142 heart–grafted patients followed by endomyocardial biopsy" European Heart Journal 18: 1024–1029.

Akalin, Enver et al. (2001) "Gene Expression Analysis in Human Renal Allograft Biopsy Samples Using High–Density Oligoarray Technology" Transplantation 72 (5): 948–953.

Alizadeh, A. A. et al. "Distinct types of diffuse large B–cell lymphoma identified by gene expression profiling" Nature 403 (2000): 503–11.

Alizadeh, A. et al. "Probing Lymphocyte Biology by Genomic–Scale Gene Expression Analysis" J. Clin. Immun. 18 (1998): 373–379.

Alizadeh, A. et al. "The Lymphochip: A Specialized cDNA Microarray for the Genomic–scale Analysis of Gene Expression in Normal and Malignant Lymphocytes" Cold Spring Harbor Symposia on Quantitative Biology 54, (New York: Cold Spring Harbor Laboratory Press) (1999): 71–78.

Alpert, Susan et al. (1995) "The Relationship of Granzyme A and Perforin Expression to Cardiac Allograft Rejection and Dysfunction" Transplantation 60 (12): 1478–1485.

Arnett, F. C. et al. "The American Rheumatism Association 1987 revised criteria for the classification of rheumatoid arthritis" Arthritis Rheum 31 (1988): 315–24.

Bittner, M. et al. (2000) "Molecular classification of cutaneous malignant melanoma by gene expression profiling" Nature 406: 536–540.

Bombardier, C. et al. and the Committee on Prognosis Studies in SLE. "Derivation of the SLEDAI, A Disease Activity Index for Lupus Patients" Arthiritis Rheum. 35 (1992): 630–640.

Chang, D. M. et al. (1996) "Cytokines and Cell Surface Markers in Prediction of Cardiac Allograft Rejection" Immunological Investigations 25 (1&2): 13–21.

Damas, J. K. et al. "Enhanced gene expression of chemokines and their corresponding receptors in mononuclear blood cells in chronic heart failure—modulatory effect of intravenous immunoglobin" J. Am. Coll. Cardiol. 38 (2001): 187–93.

Database Gen Embl, US National Library of Medicine (Bathesda, MD, USA), No. AL 591031, 'Human DNA sequence from clone RP11–151d14 on chromosome 9q13–21.2, complete sequence', Sycamore, N., Oct. 10, 2001.

Davas, E.M. et al. (1999) "Serum IL–6, TNFalpha, p55 p75srTNFalpha, srIL–2alpha levels and disease activity in systemic lupus erythematosus" Clin Rheumatol 18 (1): 17–22.

Deng, Mario C. et al. (1995) "The Relation of Interleukin–6, Tumor Necrosis factor–α, IL–2, and IL–2 Receptor Levels to Cellular Rejection, Allograft Dysfunction, and Clinical Events Early After Cardiac Transplantation" Transplantation 60 (10): 1118–1124.

Dugré, Francine J. (2000) "Cytokine and Cytotoxic Molecule Gene Expression Determined in Peripheral Blood Mononuclear Cells in the Diagnosis of Acute Renal Rejection" Transplantation 70 (7): 1074–1080.

Edman, C. F. et al. "Electric field directed nucleic acid hybridization on microchips" *Nucleic Acids Res.* 25 (1997): 4907–14.

Eisen, Michael B. et al. (1998) "Cluster analysis and display of genome–wide expression patterns" *Proc. Natl. Acad. Sci. USA* 95: 14863–14868.

Felson, D. T. et al. "American College of Rheumatology. Preliminary definition of improvement in rheumatoid arthritis" *Arthritis Rheum.* 38 (1995): 727–35.

Fu, Guoliang et al. (2002) "Representational difference analysis in a lupus–prone mouse strain results in the identification of an unstable region of the genome on chromosome 11" *Nucleic Acids Research* 30 (6): 1394–1400.

Gabay C. et al. (1997) "Circulating levels of tumor necrosis factor soluble receptors in systemic lupus erythematosus are significantly higher than in other rheumatic diseases and correlate with disease activity" *J Rheumatol* 24(2): 303–8.

Golub, T. R. et al. "Molecular Classification of Cancer: Class Discovery and Class Prediction by Gene Expression Monitoring" *Science* 286 (1999): 531–7.

Grant, Simon C. D. et al. (1996) "Serum Cytokines in Human Heart Transplant Recipients" *Transplantation* 62 (4): 480–491.

Gullestad, L. et al. "Effect of High– Versus Low–Dose Angiotensin Converting Enzyme Inhibition on Cytokine Levels in Chronic Heart Failure" *J. Am. Coll. Cardiol.* 34 (1999): 2061–7.

Hastie, T. et al. "'Gene shaving'as a method for identifying distinct sets of genes with similar expression patterns" *Genome Biol.* 1 (2000): RESEARCH0003.

Hastie, Trevor et al. (2001) "Supervised harvesting of expression trees" *Genome Biology* 2 (1): http://genomebiology.com/2001/2/1/research/0003 (Apr. 25, 2002): 12 pages.

Heller, R. A. et al. "Discovery and analysis of inflammatory disease–related genes using cDNA microarrays" *Proc. Natl. Acad. Sci. U.S.A.* 94 (1997): 2150–2155.

Hendricks, DA et al. (1995) "Quantitation of HBV DNA in human serum using a branched DNA (bDNA) signal amplification assay" *Am J Clin Pathol* 104 (5): 537–46.

Hsieh, Hsian–Guey et al. (2001) "IL–17 expression as a possible predictive parameter for subclinical renal allograft rejection" *Tranpl Int* 14: 287–298.

Iida, K. et al. (1982) "Complement receptor (CR1) deficiency in erythrocytes from patients with systemic lupus erythematosus" *J. Exp. Med.* 155: 1427–1438.

Jagota, Arun (2000) *Data Analysis and Classification for Bioinformatics*. Bioinformatics By The Bay Press: 92–93.

Kasprzycka, Monika et al. (2002) "Expression of FasL gene in T cells of renal allograft recipients" *Immunol. Lett.* 80 (1): 9–13.

Katz, Mitchell H (1999) *Multivariable Analysis: A Practical Guide for Clinicians*. Cambridge University Press: 36–42.

Khan, J. et al. "Classification and diagnostic prediction of cancers using gene expression profiling and artificial neural networks" *Nat. Med.* 7 (2001): 673–9.

Kimball, P. et al. (1995) "Cytokine Panel Predicts Early Rejection of Therapeutic Response After Cardiac Transplantation" *Transplantation Proceedings* 27 (1): 1286–1287.

Kobashigawa, J. et al. (1998) "A Randomized Active–Controlled Trial of Mycophenolate Mofetil in Heart Transplant Recipients" *Transplantation* 66 (4): 507–515.

Legros–Maida, Sabine et al. (1994) "Granzyme B and perforin can be used as predictive markers of acute rejection in heart transplantation" *Eur. J. Immunol.* 24: 229–233.

Li, B. et al. "Noninvasive diagnosis of renal–allograft rejection by measurement of messenger RNA for perforin and granzyme B in urine" N. Engl J. Med. 344 (2001): 947–954

Liossis, S.N. (2001) "B–cell kinase lyn deficiency in patients with systemic lupus erythematosus" *J Investig Med.* 49 (2): 157–65.

Loftus. B.J. et al. Genome Duplications and Other Features in 12 Mb of DNA sequence from Human Chromosome 16p and 16q Genomics. vol. 60, pp. 295–308 Jul. 1999.

Marcelin, Anne–Genevieve et al. (2001) "Effects of Cyclosporine and Hydrocortisone on Kaposi's Sarcoma–Associated Herpesvirus Genome Replication and Cell Apoptosis Induction" *Transplantation* 72 (10): 1700–1708.

Melter, Michael et al. (2001) "Expression of the Chemokine Receptor CXCR3 and Its Ligand IP–10 During Human Cardiac Allograft Rejection" *Circulation 1 04*:2558–2564.

Mohler, E. R. 3rd et al. "Role of Cytokines in the Mechanism of Action of Amlodipine: The PRAISE Heart Failure Trial" *J. Am. Coll. Cardiol.* 30 (1997): 35–41.

Morita, Ken et al. (2001) "Early Chemokine Cascades in Murine Cardiac Grafts Regulate T Cell Recruitment and Progression of Acute Allograft Rejection" *J. Immunol.* 167: 2979–2984.

Nickel, Peter et al. (2001) "Cytotoxic Effector Molecule Gene Expression in Acute Renal Allograft Rejection" *Transplantation* 72 (6): 1158–1161.

Oh, Se–Il et al. (2001) "Correlation of Fas and Fas Ligand Expression with Rejection Status of Transplanted Heart in Human" *Transplantation* 71 (7): 906–909.

Perou, C. M. et al. "Molecular portraits of human breast tumours" *Nature* 406 (2000): 747–52.

Pruitt, K. D. et al. "Introducing RefSeq and LocusLink: curated human genome resources at the NCBI" *Trends Genet.* 16 (2000): 44–47.

Raychaudhuri, S. et al. "Basic microarray analysis: grouping and feature reduction" *Trends biotechnol.* 19 (2001): 189–193.

Rus, V et al. (2002) "Expression of cytokine– and chemokine–related genes in peripheral blood mononuclear cells from lupus patients by cDNA array" *Clin Immunol* 102 (3): 283–90.

Saiura, Akio et al. (2001) "A Comparision of Gene Expression in Murine Cardiac Allografts and Isografts by Means DNA Microarray Analysis" *Transplantation* 72 (2): 320–329.

Salmon, J. E. et al. (1996) "Fc–gamma–RIIA alleles are heritable risk factors for lupus nephritis in African Americans" *J. Clin. Invest.* 97: 1348–1354.

Schena, Mark et al. (1995) "Quantitative Monitoring of Gene Expression patterns with a Complementary DNA Microarray" *Science* 270: 467–470.

Schena, Mark et al. (1996) "Parallel human genome analysis: Microarray–based expression monitoring of 1000 genes" *Proc. Natl. Acad. Sci. USA* 93: 10614–10619.

Sharma, Vijay K. et al. (1996) "Molecular Executors of Cell Death—Differential Intrarenal Expression of Fas Ligand, Fas, Granzyme B, and Perforin During Acute and/or Chronic Rejection of Human Renal Allografts" *Transplantation* 62 (12): 1860–1866.

Shirali, G. S. et al. "Association of viral genome with graft loss in children after cardiac transplantation" *N. Engl. J. Med.* 344 (2001): 1498–503.

Shoker, Ahmed et al. (2000) "Heightened CD40 Ligand Gene Expression in Peripheral CD4+ Cells from Patients with Kidney Allograft Rejection" *Transplantation* 70 (3): 497–505.

Shulzhenko, Natalia et al. (2001) "Intragraft Activation of Genes Encoding Cytotoxic T Lymphocyte Effector Molecules Precedes the Histological Evidence of Rejection in Human Cardiac Transplantation" *Transplantation* 72 (10): 1705–1708.

Shulzhenko, Natalia et al. (2001) "Monitoring of Intragraft and Peripheral Blood TIRC7 Expression as a Diagnostic Tool for Acute Cardiac Rejection in Humans" *Human Immunology* 62: 342–347.

Staudt, L. M. and P. O. Brown. "Genomic Views of the Immune System" *Annu. Rev. Immunol.* 18 (2000): 829–859.

Strehlau, Jurgen et al. (1997) "Quantitative detection of immune activation transcripts as a diagnostic tool in kidney transplantation" *Proc. Natl. Acad. Sci. USA* 94: 695–700.

Tan, E. M. et al. "The 1982 revised criteria for the classification of systemic lupus erythermatosus" *Arthritis Rheum.* 25 (1982): 1271–7.

Tan, LamChin et al. "Sequential Monitoring of Peripheral T–Lymphocyte Cytokine Gene Expression in the Early Post Renal Allograft Period" *Transplantation* 71 (2001): 751–759.

Törönen, Petri et al. (1999) "Analysis of gene expression data using self–organizing maps" *FEBS Letters* 451: 142–146.

Torre–Amione, G. et al. "Proinflammatory cytokine levels in patients with depressed left ventricular ejection fraction: a report from the Studies of Left Ventricular Dysfunction (SOLVD)" *J. Am. Coll. Cardiol.* 27 (1996): 1201–6.

Tsutamoto, T. et al. "Angiotensin II Type 1 receptor antagonist decreases plasma levels of tumor necrosis factor alpha, interleukin–6 and soluble adhesion molecules in patients with chronic heart failure" *J. Am. Coll. Cardio.* 35 (2000): 714–21.

Tusher, Virginia Goss et al. (2001) "Significance analysis of microarrays applied to the ionizing radiation response" *PNAS* 98 (9) 5116–5121.

Umek, R. M. et al. "Electronic detection of nucleic acids: a versatile platform for molecular diagnostics" *J. Mol. Diagn.* 3 (2001): 74–84.

Vasconcellos, Lauro M. et al. "Cytotoxic Lymphocyte Gene Expression in Peripheral Blood Leukocytes Correlates with Rejecting Renal Allografts" *Transplantation* 66 (5): 562–566.

Vignali D. "Multiplexed particle–based flow cytometric assays" *J. Immun. Meth.* 243 (2000): 243–55.

Vincenti, F. et al. (2001) "Multicenter Trial Exploring Calcineurin Inhibitors Avoidance in Renal Transplantation" *Transplantation* 71 (9): 1282–1287.

Watanabe–Fukunaga, R. et al. (1992) "Lymphoproliferation disorder in mice explained by defects in Fas antigen that mediates apoptosis" *Nature* 356: 314–317.

Welsh, J. B. et al. "Analysis of gene expression profiles in normal and neoplastic ovarian tissue samples identifies candidate molecular markers of epithelial ovarian cancer" *Proc. Natl. Acad. Sci. U.S.A.* 98 (2001): 1176–81.

Westin L. et al. "Anchored multiplex amplification on a microelectronic chip array" *Nat. Biotechnol.* 18 (2000): 199–204.

Whitehead, John. 2002. An Introduction to Logistic Regression. (web page: http://personal.ecu.edu/whiteheadj/data/logit/). Apr. 25, 2002: 63 pages.

Wu, J. et al. (1996) "Fas ligand mutation in a patient with systemic lupus erythematosus and lymphoproliferative disease" *J. Clin. Invest.* 98: 1107–1113.

Xia, Dongyuan et al. (2001) "Real–Time Polymerase Chain Reaction Analysis Reveals an Evolution of Cytokine mRNA Production in Allograft Acceptor Mice" *Transplantation* 72 (5): 907–914.

Zucker, S. et al. (1999) "Increased serum stromelysin–1 levels in systemic lupus erythematosus: lack of correlation with disease activity." *J Rheumatol.* 26 (1): 78–80.

* cited by examiner

Figure 1: Novel Gene Sequence Analysis

Figure 2: Primer efficiency testing. A standard curve of Ct versus log of the starting RNA amount is shown for 2 genes.

Figure 4: SLE diagnostic genes and algorithms
A.
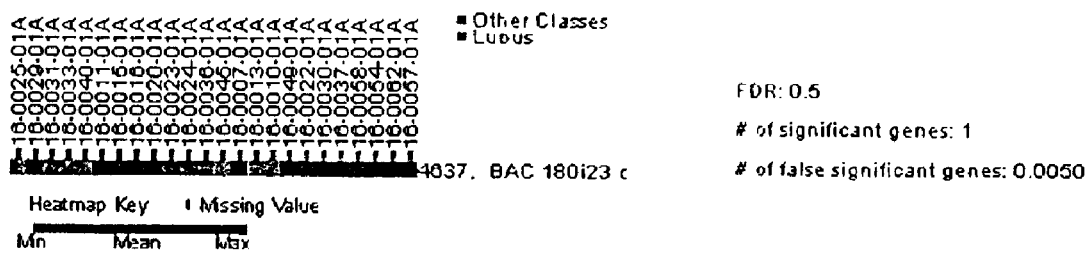
FDR: 0.5
# of significant genes: 1
# of false significant genes: 0.0050
B.
| Lupus | | Control | |
|---|---|---|---|
| Sample | Ratio | Sample | Ratio |
| 16-0022-01 | 1.05 | 16-0025-01 | 0.60 |
| 16-0030-01 | 0.96 | 16-0029-01 | 0.75 |
| 16-0037-01 | 0.87 | 16-0031-01 | 0.63 |
| 16-0058-01 | 1.05 | 16-0033-01 | 0.62 |
| 16-0054-01 | 0.99 | 16-0040-01 | 0.61 |
| 16-0062-01 | 0.98 | 16-0015-01 | 0.72 |
| 16-0057-01 | 1.14 | 16-0016-01 | 0.78 |
| | | 16-0020-01 | 0.79 |
| | | 16-0023-01 | 0.71 |
| | | 16-0024-01 | 0.69 |
| | | 16-0036-01 | 0.65 |
| | | 16-0045-01 | 0.59 |
| | | 16-0007-01 | 0.77 |
| | | 16-0013-01 | 0.60 |
| | | 16-0010-01 | 0.57 |
| | | 16-0049-01 | 0.75 |
| | Lupus | Controls |
|---|---|---|
| Average Ratio | 1.00 | 0.68 |
| Std Dev of Ratio | 0.08 | 0.08 |
| Fold Change | 1.48 | |
FIGURE 4A-B

C.

| Model | # genes | Relative Cost | SEQ/Oligo-ID | Locus | Nominal Description | CART Splitter | CART Value for Dx SLE |
|---|---|---|---|---|---|---|---|
| Model I | 2 | 0.118 | 2412 | NM_002946 | replication protein A2 (32kD) | co-1st | [(2412)*0.903 - (2648)*0.431] <= 0.1909 |
| | | | 2648 | NM_004510 | interferon-induced protein 75 | co-1st | [(2412)*0.903 - (2648)*0.431] <= 0.1909 |
| Model I | 3 | 0.125 | 2412 | NM_002946 | replication protein A2 (32kD) | co-1st | [(2412)*0.903 - (2648)*0.431] <= 0.1909 |
| | | | 2648 | NM_004510 | interferon-induced protein 75 | co-1st | [(2412)*0.903 - (2648)*0.431] <= 0.1909 |
| | | | 1436 | BC002409 | actin, beta (ACTB) | 2nd | (G1436) > 0.0868 |
| Model II | 1 | 0.612 | 5067 | W16552 | capicua protein (CIC) mRNA | 1st | (5067) > 0.1030 |
| Model II | 3 | 0.686 | 5067 | W16552 | capicua protein (CIC) mRNA | 1st | (5067) > 0.1030 |
| | | | 1025 | AK024756 | hypothetical protein FLJ21103 | 2nd | (G1025) <= 0.3968 |
| | | | 1035 | AK024969 | hypothetical protein DKFZp566I133 | 3rd | (G1035) <= 0.0073 |
| Model II | 5 | 0.745 | 5067 | W16552 | capicua protein (CIC) mRNA | 1st | (5067) > 0.1030 |
| | | | 1003 | AK024240 | cDNA FLJ14178 fis | 2nd | (G1003) > 0.2105 |
| | | | 1025 | AK024756 | hypothetical protein FLJ21103 | 2nd | (G1025) <= 0.3968 |
| | | | 1001 | AK024202 | heat shock 90kD protein 1, alpha | 3rd | (G1001) <= -0.3107 |
| | | | 1035 | AK024969 | hypothetical protein DKFZp566I133 | 3rd | (G1035) <= 0.0073 |

D.

| | Model | Sensitivity | Specificity | Relative Cost |
|---|---|---|---|---|
| Training Set | Model 1 (2 genes) | 100 | 94 | |
| | Model 1 (3 genes) | 100 | 100 | |
| 10-fold Cross Validation | Model 1 (2 genes) | 100 | 88 | 0.118 |
| | Model 1 (3 genes) | 93 | 94 | 0.125 |

FIGURE 4C-D

E.
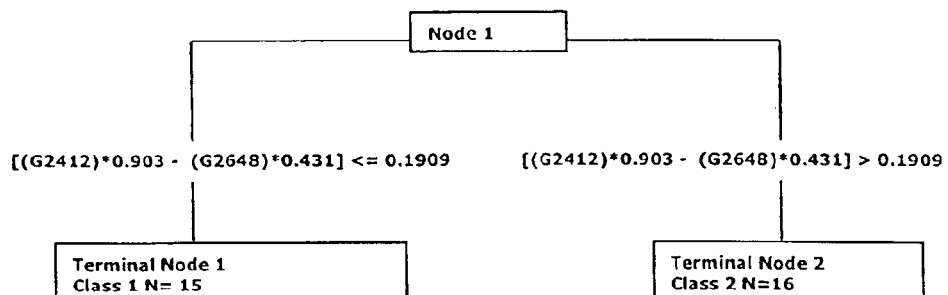
Model I (2 genes)
F
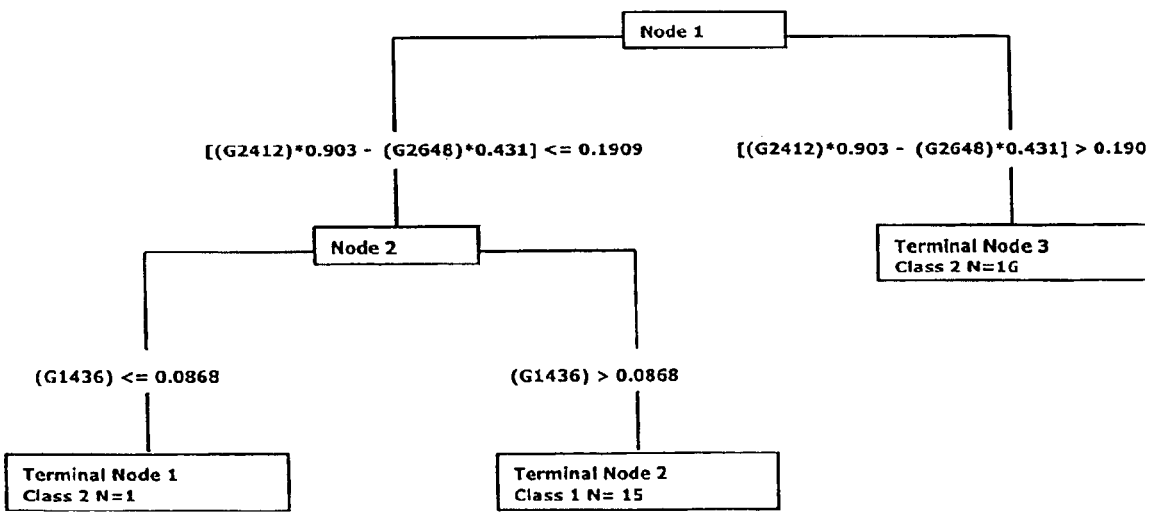
Model 1 (3 genes)
FIGURE 4E-F

Figure 5: Endpoint testing of PCR primers
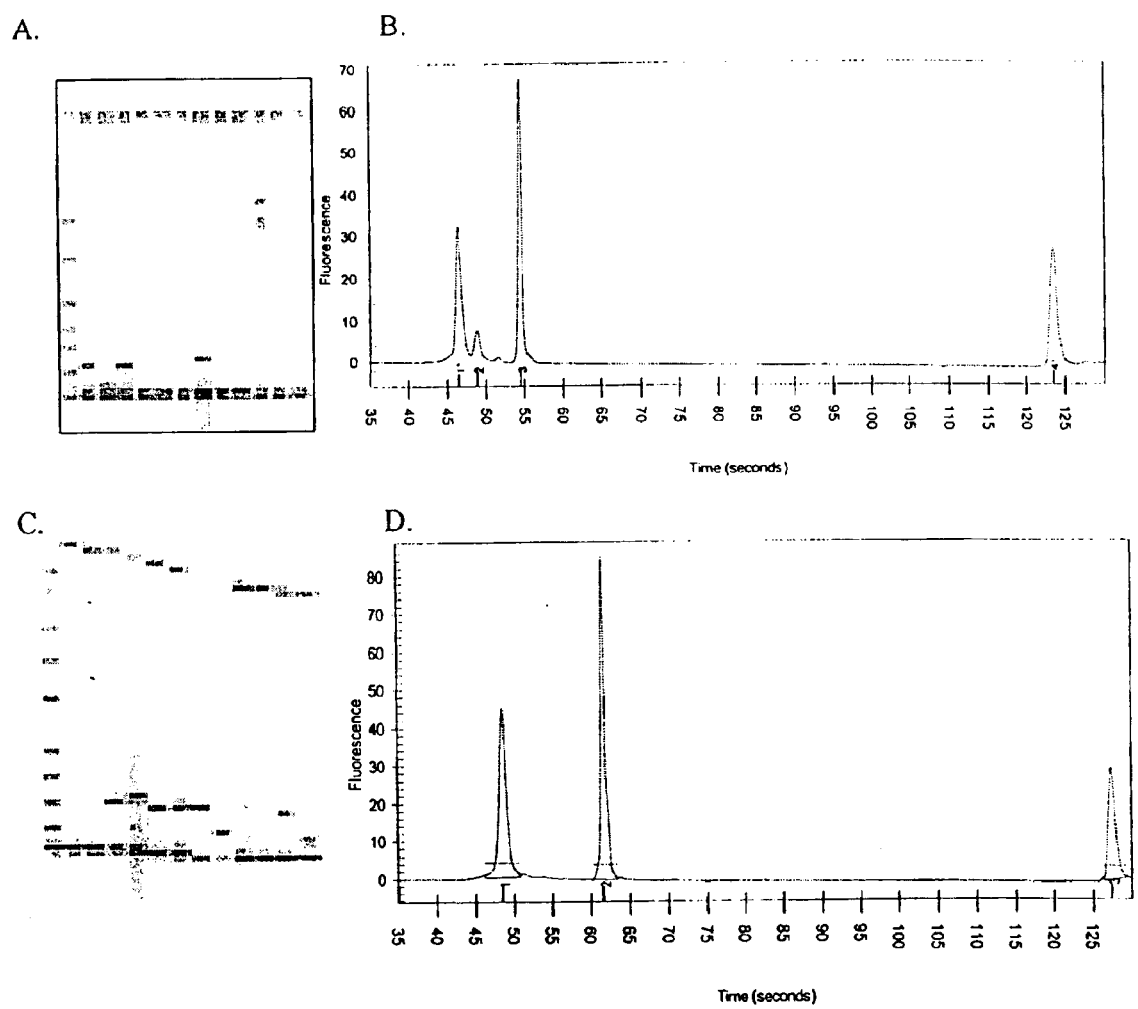

Figure 6: Validation of differential expression of Granzyme B in CMV patients using Real-time PCR

A.

METHODS AND COMPOSITIONS FOR DIAGNOSING OR MONITORING AUTO IMMUNE AND CHRONIC INFLAMMATORY DISEASES

RELATED APPLICATIONS

This application is a Continuation-in-Part application of Ser. No. 10/006,290 filed Oct. 22, 2001, which claims priority to U.S. provisional patent application No. 60/296,764 filed Jun. 8, 2001, both of which are hereby incorporated by reference in their entirety.

FIELD OF THE INVENTION

This application is in the field of chronic inflammatory diseases. In particular, this invention relates to methods and compositions for diagnosing or monitoring chronic inflammatory diseases.

BACKGROUND OF THE INVENTION

Many of the current shortcomings in diagnosis, prognosis, risk stratification and treatment of disease can be approached through the identification of the molecular mechanisms underlying a disease and through the discovery of nucleotide sequences (or sets of nucleotide sequences) whose expression patterns predict the occurrence or progression of disease states, or predict a patient's response to a particular therapeutic intervention. In particular, identification of nucleotide sequences and sets of nucleotide sequences with such predictive value from cells and tissues that are readily accessible would be extremely valuable. For example, peripheral blood is attainable from all patients and can easily be obtained at multiple time points at low cost. This is a desirable contrast to most other cell and tissue types, which are less readily accessible, or accessible only through invasive and aversive procedures. In addition, the various cell types present in circulating blood are ideal for expression profiling experiments as the many cell types in the blood specimen can be easily separated if desired prior to analysis of gene expression. While blood provides a very attractive substrate for the study of diseases using expression profiling techniques, and for the development of diagnostic technologies and the identification of therapeutic targets, the value of expression profiling in blood samples rests on the degree to which changes in gene expression in these cell types are associated with a predisposition to, and pathogenesis and progression of a disease.

There is an extensive literature supporting the role of leukocytes, e.g., T-and B-lymphocytes, monocytes and granulocytes, including neutrophils, in a wide range of disease processes, including such broad classes as cardiovascular diseases, inflammatory, autoimmune and rheumatic diseases, infectious diseases, transplant rejection, cancer and malignancy, and endocrine diseases.

Of particular interest is the role of leukocytes and leukocyte gene expression in chronic inflammatory diseases such as Systemic Lupus Erythematosis and Rheumatoid Arthritis. Systemic lupus erythematosis (SLE) and Rheumatoid Arthritis (RA) are chonic autoimmune and inflammatory disorders characterized by dysregulation of the immune system, which causes damage to a variety of organs. These diseases clearly involve differential expression of genes in leukocytes. Diagnostic and disease monitoring tools are severly lacking for these patients and their physicians. Leukocyte expression profiling can be applied to discover expression markers for SLE and RA and apply them as patient management tools in the clinical setting. In addition, osteoarthirtis is a degenerative joint disease that can be confused with RA. This disease also involves leukocytes and expression profiling of leukocytes associated with osteoarthritis may lead to the discovery of new diagnostic and therapeutic approaches to the disease.

The accuracy of technologies based on expression profiling for the diagnosis, prognosis, and monitoring of disease would be dramatically increased if numerous differentially expressed nucleotide sequences, each with a measure of sensitivity and specificity for a disease in question, could be identified and assayed in a concerted manner. Using the expression of multiple genes (gene sets) for diagnostic applications helps overcome assay and population variability. In order to achieve this improved accuracy, the appropriate sets of nucleotide sequences need to be identified and validated against numerous samples in combination with relevant clinical data.

SUMMARY OF THE INVENTION

In order to meet these needs, the present invention identifies genes and gene sets that have clinical utility as diagnostic tools for the management of transplant recipients, lupus patients and patients with a variety of chronic inflammatory and autoimmune diseases. The present invention is thus directed to a method of diagnosing or monitoring chronic autoimmune or inflammatory disease in a patient. The method of the invention involves detecting in a patient expression of one or more genes such as those genes depicted in Table 8 and Table 10A and surrogates derived therefrom. Exemplary surrogates are provided in Table 10C. The present invention is further directed to a method of diagnosing or monitoring an autoimmune or chronic inflammatory disease in a patient by detecting the expression level of one or more genes or surrogates derived therefrom in said patient to diagnose or monitor the autoimmune or chronic inflammatory disease in the patient wherein said genes include a nucleotide sequence selected from SEQ ID NO: 41; SEQ ID NO:328; SEQ ID NO:668; SEQ ID NO:855; SEQ ID NO:981; SEQ ID NO:1001; SEQ ID NO:1003; SEQ ID NO:1025; SEQ ID NO:1035; SEQ ID NO:1227; SEQ ID NO:1341; SEQ ID NO:1390; SEQ ID NO:1436; SEQ ID NO: 1535; SEQ ID NO: 1750; SEQ ID NO:2102; SEQ ID NO:2331; SEQ ID NO:2386; SEQ ID NO:2412; SEQ ID NO:2560; SEQ ID NO:2648; SEQ ID NO:2895, SEQ ID NO:3249; SEQ ID NO:3305; SEQ ID NO:3541; SEQ ID NO:3692; SEQ ID NO:3701; SEQ ID NO:3741; SEQ ID NO:3825; SEQ ID NO:3827; SEQ ID NO:3832; SEQ ID NO:4149; SEQ ID NO:4400; SEQ ID NO:4601; SEQ ID NO:4604; SEQ ID NO:4631; SEQ ID NO:4637; SEQ ID NO:5067; SEQ ID NO:5074; SEQ ID NO:5468; SEQ ID NO:5531; SEQ ID NO:5607; SEQ ID NO:6382; SEQ ID NO:6956; SEQ ID NO:7238; SEQ ID NO:7330; SEQ ID NO:7641; SEQ ID NO:8015 and SEQ ID NO:8095.

In the method of the invention, the chronic inflammatory disease or autoimmune disease may be systemic lupus erythematosis (SLE).

In one format, expression is detecting by measuring RNA levels or protein levels from the genes.

In the method of the invention, RNA may be isolated from the patient prior to detecting expression of a gene such as those depicted in Table 10A. RNA levels may be detected by PCR, hybridization such as hybridization to an oligonucleotide. The nucleotide sequence may include comprises DNA, cDNA, PNA, genomic DNA, or synthetic oligonucleotides.

In the methods of the invention, the RNA may be detected by hybridization to an oligonucleotide having a nucleotide sequence selected from SEQ ID NO: 41; SEQ ID NO:328; SEQ ID NO:668; SEQ ID NO:855; SEQ ID NO:981; SEQ ID NO:1001; SEQ ID NO:1003; SEQ ID NO:1025; SEQ ID NO:1035; SEQ ID NO:1227; SEQ ID NO:1341; SEQ II) NO:1390; SEQ ID NO: 1436; SEQ ID NO:1535; SEQ ID NO:1750; SEQ ID NO:2102; SEQ ID NO:2331; SEQ ID NO:2386; SEQ ID NO:2412; SEQ ID NO:2560; SEQ ID NO:2648; SEQ ID NO:2895; SEQ ID NO:3249; SEQ ID NO:3305; SEQ ID NO:3541; SEQ ID NO:3692; SEQ ID NO:3701; SEQ ID NO:3741; SEQ ID NO:3825; SEQ ID NO:3827; SEQ ID NO:3832; SEQ ID NO:4149; SEQ ID NO:4400; SEQ ID NO:4601; SEQ ID NO:4604; SEQ ID NO:4631; SEQ ID NO:4637; SEQ ID NO:5067; SEQ ID NO:5074; SEQ ID NO:5468; SEQ ID NO:5531; SEQ ID NO:5607; SEQ ID NO:6382; SEQ ID NO:6956; SEQ ID NO:7238; SEQ ID NO:7330; SEQ ID NO:7641; SEQ ID NO:8015 and SEQ ID NO:8095.

The present invention is further directed to a diagnostic oligonucleotide for detecting chronic or inflammatory disease wherein the oligonucleotide has a nucleotide sequence selected from SEQ ID NO: 4637. The diagnostic oligonucleotide of may include DNA, cDNA, PNA, genomic DNA, or synthetic oligonucleotides.

The present invention is further directed to a system or kit for diagnosing or monitoring chronic inflammatory or autoimmune disease in a patient comprising an isolated DNA molecule wherein the isolated DNA molecule detects expression of a gene listed in Table 10A. In the system of the invention, the DNA molecules may be synthetic DNA, genomic DNA, PNA or cDNA. The isolated DNA molecule may be immobilized on an array. Such arrays may include a chip array, a plate array, a bead array, a pin array, a membrane array, a solid surface array, a liquid array, an oligonucleotide array, polynucleotide array or a cDNA array, a microtiter plate, a membrane and a chip.

The present invention is further directed to a system or detecting differential gene expression. In one format, the system has one or more isolated DNA molecules wherein each isolated DNA molecule detects expression of a gene selected from the group of genes corresponding to the oligonucleotides depicted in the Sequence Listing. It is understood that the DNA sequences and oligonucleotides of the invention may have slightly different sequences than those identified herein. Such sequence variations are understood to those of ordinary skill in the art to be variations in the sequence which do not significantly affect the ability of the sequences to detect gene expression.

The sequences encompassed by the invention have at least 40–50, 50–60, 70–80, 80–85, 85–90, 90–95 or 95–100% sequence identity to the sequences disclosed herein. In some embodiments, DNA molecules are less than about any of the following lengths (in bases or base pairs): 10,000; 5,000; 2500; 2000; 1500; 1250; 1000; 750; 500; 300; 250; 200; 175; 150; 125; 100; 75; 50; 25; 10. In some embodiments, DNA molecule is greater than about any of the following lengths (in bases or base pairs): 10; 15; 20; 25; 30; 40; 50; 60; 75; 100; 125; 150; 175; 200; 250; 300; 350; 400; 500; 750; 1000; 2000; 5000; 7500; 10000; 20000; 50000. Alternately, a DNA molecule can be any of a range of sizes having an upper limit of 10,000; 5,000; 2500; 2000; 1500; 1250; 1000; 750; 500; 300; 250; 200; 175; 150; 125; 100; 75; 50; 25; or 10 and an independently selected lower limit of 10; 15; 20; 25; 30; 40; 50; 60; 75; 100; 125; 150; 175; 200; 250; 300; 350; 400; 500; 750; 1000; 2000; 5000; 7500 wherein the lower limit is less than the upper limit.

The gene expression system may be a candidate library, a diagnostic agent, a diagnostic oligonucleotide set or a diagnostic probe set. The DNA molecules may be genomic DNA, protein nucleic acid (PNA), cDNA or synthetic oligonucleotides.

In one format, the gene expression system is immobilized on an array. The array may be a chip array, a plate array, a bead array, a pin array, a membrane array, a solid surface array, a liquid array, an oligonucleotide array, a polynucleotide array, a cDNA array, a microfilter plate, a membrane or a chip.

BRIEF DESCRIPTION OF THE SEQUENCE LISTING

A brief description of the sequence listing is given below. There are 9090 entries. The Sequence Listing presents 50mer oligonucleotide sequences derived from human leukocyte, plant and viral genes. These are listed as SEQ IDs 1–8143. The 50mer sequences and their sources are also displayed in Table 8. Most of these 50mers were designed from sequences of genes in Tables 2, 3A, B and C and the Sequence listing.

SEQ IDs 8144–8766 are the cDNA sequences derived from human leukocytes that were not homologous to Uni-Gene sequences or sequences found in dbEST at the time they were searched. So me of these sequences match human genomic sequences and are listed in Tables 3B and C. The remaining clones are putative cDNA sequences that contained less than 50% masked nucleotides when submitted to RepeatMasker, were longer than 147 nucleotides, and did not have significant similarity to the UniGene Unique database, dbEST, the NR nucleotide database of Genbank or the assembled human genome of Genbank.

SEQ IDs 8767–8770, 8828–8830 and 8832 are sequences that appear in the specification (primer, masked sequences, exemplary sequences, etc.).

SEQ IDs 8845–8893 are the full length gene sequences for the genes identified by an accession number in Table 10A.

SEQ IDs 8894–9085 are the primer sequences for lupus genes identified in Table 10B.

BRIEF DESCRIPTION OF THE FIGURES

FIG. 1 is a schematic flow chart illustrating an instruction set for characterization of the nucleotide sequence and/or the predicted protein sequence of novel nucleotide sequences.

FIG. 2 shows PCR Primer efficiency testing. A standard curve of Ct versus log of the starting RNA amount is shown for 2 g enes.

FIG. 3 depicts a graph comparing the median background subtracted expression signals for various leukocyte reference RNAs.

FIG. 4: FIG. 4 depicts Diagnostic genes, gene sets and diagnostic algorithms for Systemic Lupus Erythematosis are identified. FIG. 4A shows the relative expression level of oligonucleotide and SEQ ID # 4637 (Sialyltransferase 4A) between Lupus and control samples is shown. The gene is identified as having a false detection rate for differential expression from the SAM algorithm of 0.5%. FIG. 4B shows the scaled ratios (non log) for Sialyltransferase (SEQ ID # 4637) are given for the samples in the analysis. The average ratio of each group along with the standard deviation of the ratio is shown. The average fold change from control to Lupus is 1.48. FIG. 4C shows CART gene expression models for diagnosis of SLE. For each model, the number of genes used, the relative cost with 10 fold cross validation, the SEQ ID, Locus accession number, the name and the position and values in the CART model are given. The CART values given are the expression level thresholds for classification of the sample as SLE after the node. For example, in the single gene model II, the first node of the decision tree asks if expression of gene 5067 is >0.103. If yes, the sample is placed in the lupus class. FIG. 4D shows the sensitivity and specificity of Model 1. The sensitivity and specificity are given for both the 2 and 3 gene models and both the training set and on cross validation. The relative cost is given for cross-validation. FIG. 4E shows the CART Model I, 2 genes. The model uses 2 genes in a single node to classify samples as Lupus (Class 1) or non-Lupus (Class 2). FIG. 4F shows CART Model 1, 3 genes. The model uses a second node to classify all samples correctly as lupus (class 1) or non-lupus (class 2) for the training set.

FIG. 5: FIG. 5 shows endpoint testing of PCR primers. Electrophoresis and microfluidics are used to assess the product of gene specific PCR primers. FIG. 5A is a β-GUS gel image. Lane 3 is the image for primers F178 and R242. Lanes 2 and 1 correspond to the no-template control and −RT control, respectively. FIG. 5B shows the electropherogram of β-GUS primers F178 and R242, a graphical representation of Lane 3 from the gel image. FIG. 5C shows a β-Actin gel image. Lane 3 is the image for primers F75 and R178. Lanes 2 and 1 correspond to the no-template control and −RT control, respectively. FIG. 5D shows the electropherogram of β-Actin primers F75 and R178, a graphical representation of Lave 3 from the gel image.

FIG. 6: FIG. 6 shows the validation of differential expression of a gene discovered using microarrays using Real-time PCR.

BRIEF DESCRIPTION OF THE TABLES

Figure 1:
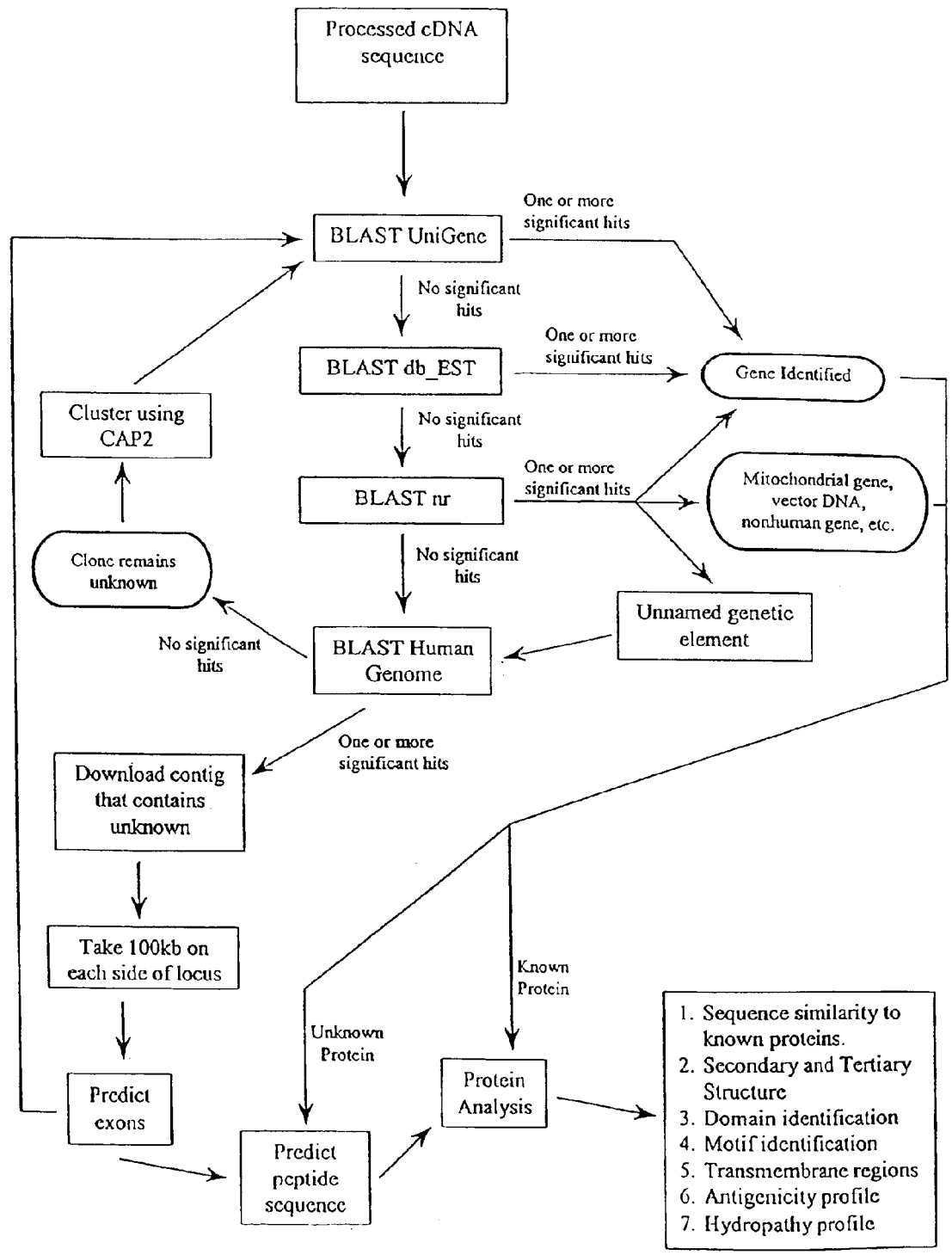
FIG. 1.

Table 1: Table 1 lists some of the diseases or conditions amenable to study by leukocyte profiling.

Table 2: Table 2 describes genes and other nucleotide sequences identified using data mining of publically available publication databases and nucleotide sequence databases. Corresponding Unigene (build 133) cluster numbers are listed with each gene or other nucleotide sequence.

Table 3A: Table 3A describes differentially expressed nucleotide sequences useful for the prediction of clinical outcomes. This table contains 4517 identified cDNAs and cDNA regions of genes that are members of a leukocyte candidate library, for use in measuring the expression of nucleotide sequences that could subsequently be correlated with human clinical conditions. The regions of similarity were found by searching three different databases for pair wise similarity using blastn. The three databases were UniGene Unique build Mar. 30, 2001, file Hs.seq.uniq.Z; the downloadable database located at the website ftp.ncbi.nlm.nih.com/blast/db/est human.Z with date Apr. 8, 2001 which is a section of Genbank version 122; and the non-redundant section of Genbank ver 123. The Hs.XXXXX numbers represent UniGene accession numbers from the Hs.seq.uniq.Z file of Mar. 30, 2001. The clone sequences are not in the sequence listing.

Table 3B: Table 3B describes Identified Genomic Regions that code for novel mRNAs. The table contains 591 identified genomic regions that are highly similar to the cDNA clones. Those regions that are within ~100 to 200 Kb of each other on the same contig are likely to represent exons of the same gene. The indicated clone is exemplary of the cDNA clones that match the indicated genomic region. The "number clones" column indicates how many clones were isolated from the libraries that are similar to the indicated region of the chromosome. The probability number is the likelihood that region of similarity would occur by chance on a random sequence. The Accession numbers are from the Mar. 15, 2001 build of the human genome. The file date for the downloaded data was Apr. 17, 2001. These sequences may prove useful for the prediction of clinical outcomes.

Table 3C: Table 3C describes 48 clones whose sequences align to two or more non-contiguous sequences on the same assembled human contig of genomic sequence. The Accession numbers are from the Mar. 15, 2001 build of the human genome. The file date for the downloaded data was Apr. 17, 2001. The alignments of the clone and the contig are indicated in the table. The start and stop offset of each matching region is indicated in the table. The sequence of the clones themselves is included in the sequence listing. The alignments of these clones strongly suggest that they are novel nucleotide sequences. Furthermore, no EST or mRNA aligning to the clone was found in the database. These sequences may prove useful for the prediction of clinical outcomes.

Table 4: Database mining. The Library Browser at the NCBI UniGene web site was used to identify genes that are specifically expressed in leukocyte cell populations. The table lists the library name and type, the number of sequences in each library and the number used for the array.

Table 5: Table 5 describes the nucleotide sequence databases used in the sequence analysis described herein.

Table 6: Table 6 describes the algorithms and software packages used for exon and polypeptide prediction used in the sequence analysis described herein.

Table 7: Table 7 describes the databases and algorithms used for the protein sequence analysis described herein.

Table 8: Table 8 provides a listing of all oligonucleotides designed for the arrays and their associated genes. In this table, the sequence ID is given which corresponds to the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. These data were obtained from the Unigene unique database, build 137. The name of the gene associated with the accession number is noted. The sequence of these genes as available from the databases are hereby incorporated by reference in their entirety. The strand is noted as −1 or 1, meaning that the probe was designed from the complement of the sequence (−1) or directly from the sequence (1). The nucleotide sequence of each probe is also given in the Sequence Listing.

Table 9: Table 9 shows viral genes for arrays. Viral genomes were used to design oligonucleotides for the microarrays. The accession numbers for the viral genomes used are given, along with the gene name and location of the region used for oligonucleotide design.

Table 10A. Table 10A shows Lupus gene expression markers. This table lists the oligonucleotides and associated genes identified as having value for the diagnosis and monitoring of lupus. The first column gives the SEQ ID that corresponds to the oligonuclotide in the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. The SEQ ID for the sequence listing for the full-length genes corresponding to the accession numbers in the table are also given (SEQ ID ACC). These data were obtained from the Unigene unique database, build ###. The name of the gene associated with the accession number is noted. The strand is noted as −1 or 1, meaning that the probe was designed from the complement of the sequence (−1) or directly from the sequence (1). Next, the nucleotide sequence of each probe is also given. For each gene, the false detection rate (FDR) from the significance analsysis described in example 10 is given if applicable. Also, those genes that were identified by CART as a diagnostic gene are noted with the model and position in the model (see example 10 and FIG. 5).

Table 10B. Table 10B shows primers for PCR. For each of the lupus gene expression markers identified in Table 10A, 2 sets of PCR primer pairs are shown that were derived by the methods described in example 15. The melting temperature (Tm) for each primer is shown, as is the corresponding SEQ ID number for the primer in the sequence listing.

Table 10C. Table 10C shows surrogates for the lupus gene expression markers disclosed herein. For some of the lupus marker genes identified in Table 10A, genes are identified by the SEQ ID number as surrogates. The surrogates are identified as such by the CART algorithm or by hierarchical clustering as detailed below.

Table 11: Table 11 describes kits useful for the practice of the invention. Table 11A describes the contents of a kit useful for the discovery of diagnostic nucleotide sets using microarrays. Table 11B describes the contents of a kit useful for the application of diagnostic nucleotide sets using microarrays. Table 11C describes contents of a kit useful for the application of diagnostic nucleotide sets using real-time PCR.

DETAILED DESCRIPTION OF THE INVENTION

Definitions

Unless defined otherwise, all scientific and technical terms are understood to have the same meaning as commonly used in the art to which they pertain. For the purpose of the present invention, the following terms are defined below.

In the context of the invention, the term "gene expression system" refers to any system, device or means to detect gene expression and includes diagnostic agents, candidate libraries oligonucleotide, oligonucleotide sets or probe sets.

The terms "diagnostic oligonucleotide" or "diagnostic oligonucleotide set" generally refers to an oligonucleotide or to a set of two or more oligonucleotides that, when evaluated for differential expression their corresponding diagnostic genes, collectively yields predictive data. Such predictive data typically relates to diagnosis, prognosis, monitoring of therapeutic outcomes, and the like. In general, the components of a diagnostic oligonucleotide or a diagnostic oligonucleotide set are distinguished from oligonucleotide sequences that are evaluated by analysis of the DNA to directly determine the genotype of an individual as it correlates with a specified trait or phenotype, such as a disease, in that it is the pattern of expression of the components of the diagnostic oligonucleotide set, rather than mutation or polymorphism of the DNA sequence that provides predictive value. It will be understood that a particular component (or member) of a diagnostic oligonucleotide set can, in some cases, also present one or more mutations, or polymorphisms that are amenable to direct genotyping by any of a variety of well known analysis methods, e.g., Southern blotting, RFLP, AFLP, SSCP, SNP, and the like.

A "diagnostic gene" is a gene whose expression is detected by a diagnostic oligonucleotide or diagnostic oligonucleotide set.

A "disease specific target oligonucleotide sequence" is a gene or other oligonucleotide that encodes a polypeptide, most typically a protein, or a subunit of a multi-subunit protein that is a therapeutic target for a disease, or group of diseases.

A "candidate library" or a "candidate oligonucleotide library" refers to a collection of oligonucleotide sequences (or gene sequences) that by one or more criteria have an increased probability of being associated with a particular disease or group of diseases. The criteria can be, for example, a differential expression pattern in a disease state or in activated or resting leukocytes in vitro as reported in the scientific or technical literature, tissue specific expression as reported in a sequence database, differential expression in a tissue or cell type of interest, or the like. Typically, a candidate library has at least 2 members or components; more typically, the library has in excess of about 10, or about 100, or about 1000, or even more, members or components.

The term "disease criterion" is used herein to designate an indicator of a disease, such as a diagnostic factor, a prognostic factor, a factor indicated by a medical or family history, a genetic factor, or a symptom, as well as an overt or confirmed diagnosis of a disease associated with several indicators such as those selected from the above list. A disease criterion includes data describing a patient's health status, including retrospective or prospective health data, e.g. in the form of the patient's medical history, laboratory test results, diagnostic test result, clinical events, medications, lists, response(s) to treatment and risk factors, etc.

An autoimmune disorder is defined as a disease state in which a patient's immune system recognizes an antigen in that patient's organs or tissues as foreign and becomes activated. The activated immune cells can then cause damage to the inciting organ or tissue or can damage other organs or tissues. In some cases, the disorder may be caused by a dysregulation of the immune system cells, rather than by the recognition as a self-antigen as foreign. Dysregulated immune cells can secrete inflammatory cytokines that cause systemic inflammation or they can recognize self-antigens as foreign.

Examples of autoimmune diseases include: Autoimmune hepatitis, Multiple Sclerosis, Myasthenia Gravis, Type I diabetes, Rheumatoid Arthritis, Psoriasis, Systemic Lupus Erythematosis, Hashimoto's Thyroiditis, Grave's disease, Ankylosing Spondylitis Sjogrens Disease, CREST syndrome, Scleroderma and many more.

Most of the autoimmune diseases are also chronic inflammatory diseases. This is defined as a disease process associated with long-term (>6 months) activation of inflammatory cells (leukocytes). The chronic inflammation leads to damage of patient organs or tissues. Many diseases are chronic inflammatory disorders, but are not know to have an autoimmune basis. For example, Atherosclerosis, Congestive Heart Failure, Crohn's disease, Ulcerative Colitis, Polyarteritis nodosa, Whipple's Disease, Primary Sclerosing Cholangitis and many more.

The terms "molecular signature" or "expression profile" refers to the collection of expression values for a plurality (e.g., at least 2, but frequently about 10, about 100, about 1000, or more) of members of a candidate library. In many cases, the molecular signature represents the expression pattern for all of the nucleotide sequences in a library or array of candidate or diagnostic nucleotide sequences or genes. Alternatively, the molecular signature represents the expression pattern for one or more subsets of the candidate library. The term "oligonucleotide" refers to two or more nucleotides. Nucleotides may be DNA or RNA, naturally occurring or synthetic.

The term "healthy individual," as used herein, is relative to a specified disease or disease criterion. That is, the individual does not exhibit the specified disease criterion or is not diagnosed with the specified disease. It will be understood, that the individual in question, can, of course, exhibit symptoms, or possess various indicator factors for another disease.

Similarly, an "individual diagnosed with a disease" refers to an individual diagnosed with a specified disease (or disease criterion). Such an individual may, or may not, also exhibit a disease criterion associated with, or be diagnosed with another (related or unrelated) disease.

The term "monitoring" is used herein to describe the use of gene sets to provide useful information about an individual or an individual's health or disease status. "Monitoring" can include, determination of prognosis, risk-stratification, selection of drug therapy, assessment of ongoing drug therapy, prediction of outcomes, determining response to therapy, diagnosis of a disease or disease complication, following progression of a disease or providing any information relating to a patients health status.

An "array" is a spatially or logically organized collection, e.g., of oligonucleotide sequences or nucleotide sequence products such as RNA or proteins encoded by an oligonucleotide sequence. In some embodiments, an array includes antibodies or other binding reagents specific for products of a candidate library.

When referring to a pattern of expression, a "qualitative" difference in gene expression refers to a difference that is not assigned a relative value. That is, such a difference is designated by an "all or nothing" valuation. Such an all or nothing variation can be, for example, expression above or below a threshold of detection (an on/off pattern of expression). Alternatively, a qualitative difference can refer to expression of different types of expression products, e.g., different alleles e.g., a mutant or polymorphic allele), variants (including sequence variants as well as post-translationally modified variants), etc.

In contrast, a "quantitative" difference, when referring to a pattern of gene expression, refers to a difference in expression that can be assigned a value on a graduated scale, (e.g., a 0–5 or 1–10 scale, a +–+++scale, a grade 1–grade 5 scale, or the like; it will be understood that the numbers selected for illustration are entirely arbitrary and in no-way are meant to be interpreted to limit the invention).

Gene Expression Systems and Methods of Detecting Gene Expression

The invention is directed to methods of detecting gene expression with a gene expression system having one or more DNA molecules wherein the one or more DNA molecules has a nucleotide sequence which detects expression of a gene corresponding to the oligonucleotides depicted in the Sequence Listing. In one format, the oligonucleotide detects expression of a gene that is differentially expressed in leukocytes. The gene expression system may be a candidate library, a diagnostic agent, a diagnostic oligonucleotide set or a diagnostic probe set. The DNA molecules may be genomic DNA, RNA, protein nucleic acid (PNA), cDNA or synthetic oligonucleotides. Following the procedures taught herein, one can identity sequences of interest for analyzing gene expression in leukocytes. Such sequences may be predictive of a disease state.

Diagnostic Oligonucleotides of the Invention

The invention relates to diagnostic oligonucleotides and diagnostic oligonucleotide set(s) comprising members of the leukocyte candidate library listed in Table 2, Table 3 and Tables 8–10 in the Sequence Listing, for which a correlation exists between the health status of an individual, and the individual's expression of RNA or protein products corresponding to the nucleotide sequence. In some instances, only one oligonucleotide is necessary for such detection. Members of a diagnostic oligonucleotide set may be identified by any means capable of detecting expression of RNA or protein products, including but not limited to differential expression screening, PCR, RT-PCR, SAGE analysis, high-throughput sequencing, microarrays, liquid or other arrays, protein-based methods (e.g., western blotting, proteomics, and other methods described herein), and data mining methods, as further described herein.

In one embodiment, a diagnostic oligonucleotide set comprises at least two oligonucleotide sequences listed in Table 2, Table 3 and Tables 8–10 or the Sequence Listing which are differentially expressed in leukocytes in an individual with at least one disease criterion for at least one leukocyte-implicated disease relative to the expression in individual without the at least one disease criterion, wherein expression of the two or more nucleotide sequences is correlated with at least one disease criterion, as described below.

In another embodiment, a diagnostic oligonucleotide set comprises at least one oligonucleotide having an oligonucleotide sequence listed in Table 2, 3 and Tables 8–10, or the Sequence Listing which is differentially expressed, and further wherein the differential expression/correlation has not previously been described. In some embodiments, the diagnostic oligonucleotide set is immobilized on an array.

In another embodiment, diagnostic oligonucleotides (or oligonucleotide sets) are related to the members of the leukocyte candidate library listed in Table 2, Table 3, Tables 8–10 and in the Sequence Listing, for which a correlation exists between the health status (or disease criterion) of an individual. The diagnostic oligonucleotides are partially or totally contained in (or derived from) full-length gene sequences (or predicted full-length gene sequences) for the members of the candidate library listed in Table 2, 3 and the Sequence Listing. This includes sequences from accession numbers and unigene numbers from Table 8. Table 8 shows the accession and unigene number (when known) for each oligonucleotide used on the 8134 gene leukocyte array described in examples 11–13. In some cases, oligonucleotide sequences are designed from EST or Chromosomal sequences from a public database. In these cases the full-length gene sequences may not be known. Full-length sequences in these cases can be predicted using gene prediction algorithms (Examples 4–6). Alternatively the full-length can be determined by cloning and sequencing the full-length gene or genes that contain the sequence of interest using standard molecular biology approaches described here. The same is true for olignonucleotides designed from our sequencing of cDNA libraries (see Examples 1–4) where the cDNA does not match any sequence in the public databases.

The diagnostic oligonucleotides may also be derived from other genes that are coexpressed with the correlated sequence or full-length gene. Genes may share expression patterns because they are regulated in the same molecular pathway. Because of the similarity of expression, behavior genes are identified as surrogates in that they can substitute for a diagnostic gene in a diagnostic gene set. Example 10 demonstrates the discovery of surrogates from the data and Table 10C and the sequence listing identify and give the sequence for surrogates for lupus diagnostic genes. Surrogate oligonucleotide and surrogate oligonucleotide sets can be utilized to detect expression of surrogate genes and thereby diagnose or monitor patients with a disease.

As used herein the term "gene cluster" or "cluster" refers to a group of genes related by expression pattern. In other words, a cluster of genes is a group of genes with similar regulation across different conditions, such as a patient having a chronic autoimmune or inflammatory disease or a patient without chronic autoimmune or inflammatory disease. The expression profile for each gene in a cluster should be correlated with the expression profile of at least one other gene in that cluster. Correlation may be evaluated using a variety of statistical methods. As used herein the term "surrogate" refers to a gene with an expression profile such that it can substitute for a diagnostic gene in a diagnostic assay. Such genes are often members of the same gene cluster as the diagnostic gene. For each member of a diagnostic gene set, a set of potential surrogates can be identified through identification of genes with similar expression patterns as described below.

Many statistical analyses produce a correlation coefficient to describe the relatedness between two gene expression patterns. Patterns may be considered correlated if the correlation coefficient is greater than or equal to 0.8. In preferred embodiments, the correlation coefficient should be greater than 0.85, 0.9 or 0.95. Other statistical methods produce a measure of mutual information to describe the relatedness between two gene expression patterns. Patterns may be considered correlated if the normalized mutual information value is greater than or equal to 0.7. In preferred embodiments, the normalized mutual information value should be greater than 0.8, 0.9 or 0.95. Patterns may also be considered similar if they cluster closely upon hierarchical clustering of gene expression data (Eisen et al. 1998). Similar patterns may be those genes that are among the 1, 2, 5, 10, 20, 50 or 100 nearest neighbors in a hierarchical clustering or have a similarity score (Eisen et al. 1998) of >0.5, 0.7, 0.8, 0.9, 0.95 or 0.99. Similar patterns may also be identified as those genes found to be surrogates in a classification tree by CART (Breiman et al. 1994). Often, but not always, members of a gene cluster have similar biological functions in addition to similar gene expression patterns.

Correlated genes, clusters and surrogates are identified for the diagnostic genes of the invention. These surrogates may be used as diagnostic genes in an assay instead of, or in addition to, the diagnostic genes for which they are surrogates.

The invention also provides diagnostic probe sets. It is understood that a probe includes any reagent capable of specifically identifying a nucleotide sequence of the diagnostic nucleotide set, including but not limited to amplified DNA, amplified RNA, cDNA, synthetic oligonucleotide, partial or full-length nucleic acid sequences. In addition, the probe may identify the protein product of a diagnostic nucleotide sequence, including, for example, antibodies and other affinity reagents.

It is also understood that each probe can correspond to one gene, or multiple probes can correspond to one gene, or both, or one probe can correspond to more than one gene.

Homologs and variants of the disclosed nucleic acid molecules may be used in the present invention. Homologs and variants of these nucleic acid molecules will possess a relatively high degree of sequence identity when aligned using standard methods. The sequences encompassed by the invention have at least 40–50, 50–60, 70–80, 80–85, 85–90, 90–95 or 95–100% sequence identity to the sequences disclosed herein.

It is understood that for expression profiling, variations in the disclosed sequences will still permit detection of gene expression. The degree of sequence identity required to detect gene expression varies depending on the length of the oligomer. For a 60 mer, (an oligonucleotide with 60 nucleotides) 6–8 random mutations or 6–8 random deletions in a 60 mer do not affect gene expression detection. Hughes, T R, et al. "Expression profiling using microarrays fabricated by an ink-jet oligonucleotide synthesizer. Nature Biotechnology, 19:343–347(2001). As the length of the DNA sequence is increased, the number of mutations or deletions permitted while still allowing gene expression detection is increased.

As will be appreciated by those skilled in the art, the sequences of the present invention may contain sequencing errors. That is, there may be incorrect nucleotides, frameshifts, unknown nucleotides, or other types of sequencing errors in any of the sequences; however, the correct sequences will fall within the homology and stringency definitions herein.

The minimum length of an oligonucleotide probe necessary for specific hybridization in the human genome can be estimated using two approaches. The first method uses a statistical argument that the probe will be unique in the human genome by chance. Briefly, the number of independent perfect matches (Po) expected for an oligonucleotide of length L in a genome of complexity C can be calculated from the equation (Laird CD, Chromosoma 32:378 (1971):

$$Po=(1/4)^{L}*2C$$

In the case of mammalian genomes, $2C=\sim3.6\times10^9$, and an oligonucleotide of 14–15 nucleotides is expected to be represented only once in the genome. However, the distribution of nucleotides in the coding sequence of mammalian genomes is nonrandom (Lathe, R. J. Mol. Biol. 183:1 (1985) and longer oligonucleotides may be preferred in order to in increase the specificity of hybridization. In practical terms, this works out to probes that are 19–40 nucleotides long (Sambrook J et al., infra). The second method for estimating the length of a specific probe is to use a probe long enough to hybridize under the chosen conditions and use a computer to search for that sequence or close matches to the sequence in the human genome and choose a unique match. Probe sequences are chosen based on the desired hybridization properties as described in Chapter 11 of Sambrook et al, infra. The PRIMER3 program is useful for designing these probes (S. Rozen and H. Skaletsky 1996,1997; Primer3 code available at genome.wi.mit.edu/genome_softwarelother/primer3.html, the website). The sequences of these probes are then compared pair wise against a database of the human genome sequences using a program such as BLAST or MEGABLAST (Madden, T. L et al.(1996) *Meth. Enzymol.* 266:131–141). Since most of the human genome is now contained in the database, the number of matches will be determined. Probe sequences are chosen that are unique to the desired target sequence.

In some embodiments, a diagnostic oligonucleotide or oligonucleotide probe set is immobilized on an array. The array is optionally comprises one or more of: a chip array, a plate array, a bead array, a pin array, a membrane array, a solid surface array, a liquid array, an oligonucleotide array, a polynucleotide array or a cDNA array, a microtiter plate, a pin array, a bead array, a membrane or a chip.

In some embodiments, the leukocyte-implicated disease is selected from the diseases listed in Table 1. In other embodiments, the disease is atherosclerosis or cardiac allograft rejection. In other embodiments, the disease is congestive heart failure, angina, myocardial infarction, chronic autoimmune and inflammatory diseases, systemic lupus erythematosis (SLE) and rheumatoid arthritis.

In some embodiments, diagnostic oligonucleotides of the invention are used as a diagnostic gene set in combination with genes that are know to be associated with a disease state ("known markers"). The use of the diagnostic oligonucleotides in combination with the known markers can provide information that is not obtainable through the known markers alone. The known markers include those identified by the prior art listing provided.

General Molecular Biology References

In the context of the invention, nucleic acids and/or proteins are manipulated according to well known molecular biology techniques. Detailed protocols for numerous such procedures are described in, e.g., in Ausubel et al. *Current Protocols in Molecular Biology* (supplemented through 2000) John Wiley & Sons, New York ("Ausubel"); Sambrook et al. *Molecular Cloning-A Laboratory Manual* (2nd Ed.), Vol. 1–3, Cold Spring Harbor Laboratory, Cold Spring Harbor, N.Y., 1989 ("Sambrook"), and Berger and Kimmel *Guide to Molecular Cloning Techniques, Methods in Enzymology* volume 152 Academic Press, Inc., San Diego, Calif. ("Berger").

In addition to the above references, protocols for in vitro amplification techniques, such as the polymerase chain reaction (PCR), the ligase chain reaction (LCR), Q-replicase amplification, and other RNA polymerase mediated techniques (e.g., NASBA), useful e.g., for amplifying cDNA probes of the invention, are found in Mullis et al. (1987) U.S. Pat. No. 4,683,202; *PCR Protocols A Guide to Methods and Applications* (Innis et al. eds) Academic Press Inc. San Diego, Calif. (1990) ("Innis"); Amheim and Levinson (1990) *C&EN* 36; *The Journal Of NIH Research* (1991) 3:81; Kwoh et al. (1989) *Proc Natl Acad Sci USA* 86, 1173; Guatelli et al. (1990) *Proc Natl Acad Sci USA* 87:1874; Lomell et al. (1989) *J Clin Chem* 35:1826; Landegren et al. (1988) *Science* 241:1077; Van Brunt (1990) *Biotechnology* 8:291; Wu and Wallace (1989) *Gene* 4: 560; Barringer et al. (1990) *Gene* 89:117, and Sooknanan and Malek (1995) *Biotechnology* 13:563. Additional methods, useful for cloning nucleic acids in the context of the present invention, include Wallace et al. U.S. Pat. No. 5,426,039. Improved methods of amplifying large nucleic acids by PCR are summarized in Cheng et al. (1994) *Nature* 369:684 and the references therein.

Certain polynucleotides of the invention, e.g., oligonucleotides can be synthesized utilizing various solid-phase strategies involving mononucleotide- and/or trinucleotide-based phosphoramidite coupling chemistry. For example, nucleic acid sequences can be synthesized by the sequential addition of activated monomers and/or trimers to an elongating polynucleotide chain. See e.g., Caruthers, M. H. et al. (1992) *Meth Enzymol* 211:3.

In lieu of synthesizing the desired sequences, essentially any nucleic acid can be custom ordered from any of a variety of commercial sources, such as The Midland Certified Reagent Company (mcrc@oligos.com), The Great American Gene Company (genco.com), ExpressGen, Inc. (expressgen.com), Operon Technologies, Inc. (operon.com), and many others.

Similarly, commercial sources for nucleic acid and protein micro arrays are avaiable, and include, e.g., Agilent Technologies, Palo Alto, Calif. and Affymetrix, Santa Clara, Calif.

Candidate Library

Libraries of candidate genes that are differentially expressed in leukocytes are substrates for the identification and evaluation of diagnostic oligonucleotides and oligonucleotide sets and disease specific target nucleotide sequences.

The term leukocyte is used generically to refer to any nucleated blood cell that is not a nucleated erythrocyte. More specifically, leukocytes can be subdivided into two broad classes. The first class includes granulocytes, including, most prevalently, neutrophils, as well as eosinophils and basophils at low frequency. The second class, the non-granular or mononuclear leukocytes, includes monocytes and lymphocytes (e.g., T cells and B cells). There is an extensive literature in the art implicating leukocytes, e.g., neutrophils, monocytes and lymphocytes in a wide variety of disease processes, including inflammatory and rheumatic diseases, neurodegenerative diseases (such as Alzheimer's dementia), cardiovascular disease, endocrine diseases, transplant rejection, malignancy and infectious diseases, and other diseases listed in Table 1. Mononuclear cells are involved in the chronic immune response, while granulocytes, which make up approximately 60% of the leukocytes, have a non-specific and stereotyped response to acute inflammatory stimuli and often have a life span of only 24 hours.

In addition to their widespread involvement and/or implication in numerous disease related processes, leukocytes are particularly attractive substrates for clinical and experimental evaluation for a variety of reasons. Most importantly, they are readily accessible at low cost from essentially every potential subject. Collection is minimally invasive and associated with little pain, disability or recovery time. Collection can be performed by minimally trained personnel (e.g., phlebotomists, medical technicians, etc.) in a variety of clinical and non-clinical settings without significant technological expenditure. Additionally, leukocytes are renewable, and thus available at multiple time points for a single subject.

Assembly of Candidate Libraries

At least two conceptually distinct approaches to the assembly of candidate libraries exist. Either, or both, or other, approaches can be favorably employed. The method of assembling, or identifying, candidate libraries is secondary to the criteria utilized for selecting appropriate library members. Most importantly, library members are assembled based on differential expression of RNA or protein products in leukocyte populations. More specifically, candidate nucleotide sequences are induced or suppressed, or expressed at increased or decreased levels in leukocytes from a subject with one or more disease or disease state (a disease criterion) relative to leukocytes from a subject lacking the specified disease criterion. Alternatively, or in addition, library members can be assembled from among nucleotide sequences that are differentially expressed in activated or resting leukocytes relative to other cell types.

Firstly, publication and sequence databases can be "mined" using a variety of search strategies. For example, currently available scientific and medical publication databases such as Medline, Current Contents, OMIM (online Mendelian inheritance in man) various Biological and Chemical Abstracts, Journal indexes, and the like can be searched using term or key-word searches, or by author, title, or other relevant search parameters. Many such databases are publicly available, and one of skill is well versed in strategies and procedures for identifying publications and their contents, e.g., genes, other nucleotide sequences, descriptions, indications, expression pattern, etc. Numerous databases are available through the internet for free or by subscription, see, e.g., the websites, ncbi.nlm.nih.gov/PubMed/; 3.infotrieve.com/; isinet.com/; sciencemag.org/. Additional or alternative publication or citation databases are also available that provide identical or similar types of information, any of which are favorably employed in the context of the invention. These databases can be searched for publications describing differential gene expression in leukocytes between patients with and without diseases or conditions listed in Table 1. We identified the nucleotide sequences listed in Table 2 and some of the sequences used to design oligonucleotides for microarrays (sequence listing), using data mining methods.

Alternatively, a variety of publicly available and proprietary sequence databases (including GenBank, dbEST, UniGene, and TIGR and SAGE databases) including sequences corresponding to expressed nucleotide sequences, such as expressed sequence tags (ESTs) are available. For example, the Genbank™ website located at ncbi.nlm.nih.gov/Genbank/among others, can be readily accessed and searched via the internet. These and other sequence and clone database resources are currently available; however, any number of additional or alternative databases comprising nucleotide sequence sequences, EST sequences, clone repositories, PCR primer sequences, and the like corresponding to individual nucleotide sequence sequences are also suitable for the purposes of the invention. Nucleotide sequences can be identified that are only found in libraries derived from leukocytes or sub-populations of leukocytes, for example see Table 2 and Example 2.

Alternatively, the representation, or relative frequency, of a nucleotide sequence may be determined in a leukocyte-derived nucleic acid library and compared to the representation of the sequence in non-leukocyte derived libraries. The representation of a nucleotide sequence correlates with the relative expression level of the nucleotide sequence in leukocytes and non-leukocytes. An oligonucleotide sequence that has increased or decreased representation in a leukocyte-derived nucleic acid library relative to a non-leukocyte-derived libraries is a candidate for a leukocyte-specific gene.

Nucleotide sequences identified as having specificity to activated or resting leukocytes or to leukocytes from patients or patient samples with a variety of disease types can be isolated for use in a candidate library for leukocyte expression profiling through a variety of mechanisms. These include, but are not limited to, the amplification of the nucleotide sequence from RNA or DNA using nucleotide sequence specific primers for PCR or RT-PCR, isolation of the nucleotide sequence using conventional cloning methods, the purchase of an IMAGE consortium cDNA clone (EST) with complimentary sequence or from the same expressed nucleotide sequence, design of oligonucleotides, preparation of synthetic nucleic acid sequence, or any other nucleic-acid based method. In addition, the protein product of the nucleotide sequence can be isolated or prepared, and represented in a candidate library, using standard methods in the art, as described further below.

While the above discussion related primarily to "genomics" approaches, it is appreciated that numerous, analogous "proteomics" approaches are suitable to the present invention. For example, a differentially expressed protein product can, for example, be detected using western analysis, two-dimensional gel analysis, chromatographic separation, mass spectrometric detection, protein-fusion reporter constructs, colorometric assays, binding to a protein array, or by characterization of polysomal mRNA. The protein is further characterized and the nucleotide sequence encoding the protein is identified using standard techniques, e.g. by screening a cDNA library using a probe based on protein sequence information.

The second approach involves the construction of a differential expression library by any of a variety of means. Any one or more of differential screening, differential display or subtractive hybridization procedures, or other techniques that preferentially identify, isolate or amplify differentially expressed nucleotide sequences can be employed to produce a library of differentially expressed candidate nucleotide sequences, a subset of such a library, a partial library, or the like. Such methods are well known in the art. For example, peripheral blood leukocytes, (i.e., a mixed population including lymphocytes, monocytes and neutrophils), from multiple donor samples are pooled to prevent bias due to a single-donor's unique genotype. The pooled leukocytes are cultured in standard medium and stimulated with individual cytokines or growth factors e.g., with IL-2, IL-1, MCPI, TNFα, and/or IL8 according to well known procedures (see, e.g., Tough et al. (1999); Winston et al. (1999); Hansson et al. (1989)). Typically, leukocytes are recovered from Buffy coat preparations produced by centrifugation of whole blood. Alternatively, mononuclear cells (monocytes and lymphocytes) can be obtained by density gradient centrifugation of whole blood, or specific cell types (such as a T lymphocyte) can be isolated using affinity reagents to cell specific surface markers. When affinity reagents are used to isolate specific cell types, it is desirable to isolate the cells using negative selection to avoid activation of the desired cell type by binding of the antibody. Leukocytes may also be stimulated by incubation with ionomycin, and phorbol myristate acetate (PMA). This stimulation protocol is intended to non-specifically mimic "activation" of numerous pathways due to variety of disease conditions rather than to simulate any single disease condition or paradigm.

Using well-known subtractive hybridization procedures (as described in, e.g., U.S. Pat. Nos. 5,958,738; 5589,339; 5,827,658; 5,712,127; 5,643,761) each of which are hereby incorporated by reference, a library is produced that is enriched for RNA species (messages) that are differentially expressed between test and control leukocyte populations. In some embodiments, the test population of leukocytes are simply stimulated as described above to emulate non-specific activation events, while in other embodiments the test population can be selected from subjects (or patients) with a specified disease or class of diseases. Typically, the control leukocyte population lacks the defining test condition, e.g., stimulation, disease state, diagnosis, genotype, etc. Alternatively, the total RNA from control and test leukocyte populations are prepared by established techniques, treated with DNAseI, and selected for messenger RNA with an intact 3' end (i.e., polyA(+) messenger RNA) e.g., using commercially available kits according to the manufacturer's instructions e.g. Clontech. Double stranded cDNA is synthesized utilizing reverse transcriptase. Double stranded cDNA is then cut with a first restriction enzyme (e.g., NlaIII, that cuts at the recognition site: CATG, and cuts the cDNA sequence at approximately 256 bp intervals) that cuts the cDNA molecules into conveniently sized fragments.

The cDNAs prepared from the test population of leukocytes are divided into (typically 2) "tester" pools, while cDNAs prepared from the control population of leukocytes are designated the "driver" pool. Typically, pooled populations of cells from multiple individual donors are utilized and in the case of stimulated versus unstimulated cells, the corresponding tester and driver pools for any single subtraction reaction are derived from the same donor pool.

A unique double-stranded adapter is ligated to each of the tester cDNA populations using unphosphorylated primers so that only the sense strand is covalently linked to the adapter. An initial hybridization is performed consisting of each of the tester pools of cDNA (each with its corresponding adapter) and an excess of the driver cDNA. Typically, an excess of about 10–100 fold driver relative to tester is employed, although significantly lower or higher ratios can be empirically determined to provide more favorable results. The initial hybridization results in an initial normalization of the cDNAs such that high and low abundance messages become more equally represented following hybridization due to a failure of driver/tester hybrids to amplify.

A second hybridization involves pooling un-hybridized sequences from initial hybridizations together with the addition of supplemental driver cDNA. In this step, the expressed sequences enriched in the two tester pools following the initial hybridization can hybridize. Hybrids resulting from the hybridization between members of each of the two tester pools are then recovered by amplification in a polymerase chain reaction (PCR) using primers specific for the unique adapters. Again, sequences originating in a tester pool that form hybrids with components of the driver pool are not amplified. Hybrids resulting between members of the same tester pool are eliminated by the formation of "panhandles" between their common 5' and 3' ends. For additional details, see, e.g., Lukyanov et al. (1997) *Biochem Biophys Res Commun* 230:285–8.

Typically, the tester and driver pools are designated in the alternative, such that the hybridization is performed in both directions to ensure recovery of messenger RNAs that are differentially expressed in either a positive or negative manner (i.e., that are turned on or turned off, up-regulated or down-regulated). Accordingly, it will be understood that the designation of test and control populations is to some extent arbitrary, and that a test population can just as easily be compared to leukocytes derived from a patient with the same of another disease of interest.

If so desired, the efficacy of the process can be assessed by such techniques as semi-quantitative PCR of known (i.e., control) nucleotide sequences, of varying abundance such as β-actin. The resulting PCR products representing partial cDNAs of differentially expressed nucleotide sequences are then cloned (i.e., ligated) into an appropriate vector (e.g., a commercially available TA cloning vector, such as pGEM from Promega) and, optionally, transformed into competent bacteria for selection and screening.

Either of the above approaches, or both in combination, or indeed, any procedure, which permits the assembly of a collection of nucleotide sequences that are expressed in leukocytes, is favorably employed to produce the libraries of candidates useful for the identification of diagnostic nucleotide sets and disease specific target nucleotides of the invention. Additionally, any method that permits the assembly of a collection of nucleotides that are expressed in leukocytes and preferentially associated with one or more disease or condition, whether or not the nucleotide sequences are differentially expressed, is favorably employed in the context of the invention. Typically, libraries of about 2,000–10,000 members are produced (although libraries in excess of 10,000 are not uncommon). Following additional evaluation procedures, as described below, the proportion of unique clones in the candidate library can approximate 100%.

A candidate oligonucleotide sequence may be represented in a candidate library by a full-length or partial nucleic acid sequence, deoxyribonucleic acid (DNA) sequence, cDNA sequence, RNA sequence, synthetic oligonucleotides, etc. The nucleic acid sequence can be at least 19 nucleotides in length, at least 25 nucleotides, at least 40 nucleotides, at least 100 nucleotides, or larger. Alternatively, the protein product of a candidate nucleotide sequence may be represented in a candidate library using standard methods, as further described below.

Characterization of Candidate Oliponucleotide Sequences

The sequence of individual members (e.g., clones, partial sequence listing in a database such as an EST, etc.) of the candidate oligonucleotide libraries is then determined by conventional sequencing methods well known in the art, e.g., by the dideoxy-chain termination method of Sanger et al. (1977) *Proc Natl Acad Sci USA* 74:5463–7; by chemical procedures, e.g., Maxam and Gilbert (1977) *Proc Natl Acad Sci USA* 74:560–4; or by polymerase chain reaction cycle sequencing methods, e.g., Olsen and Eckstein (1989) *Nuc Acid Res* 17:9613–20, DNA chip based sequencing techniques or variations, including automated variations (e.g., as described in Hunkapiller et al. (1991) *Science* 254:59–67; Pease et al. (1994) *Proc Natl Acad Sci USA* 91:5022–6), thereof. Numerous kits for performing the above procedures are commercially available and well known to those of skill in the art. Character strings corresponding to the resulting nucleotide sequences are then recorded (i.e., stored) in a database. Most commonly the character strings are recorded on a computer readable medium for processing by a computational device.

Generally, to facilitate subsequent analysis, a custom algorithm is employed to query existing databases in an ongoing fashion, to determine the identity, expression pattern and potential function of the particular members of a candidate library. The sequence is first processed, by removing low quality sequence. Next the vector sequences are identified and removed and sequence repeats are identified and masked. The remaining sequence is then used in a Blast algorithm against multiple publicly available, and/or proprietary databases, e.g., NCBI nucleotide, EST and protein databases, Unigene, and Human Genome Sequence. Sequences are also compared to all previously sequenced members of the candidate libraries to detect redundancy.

In some cases, sequences are of high quality, but do not match any sequence in the NCBI nr, human EST or Unigene databases. In this case the sequence is queried against the human genomic sequence. If a single chromosomal site is matched with a high degree of confidence, that region of genomic DNA is identified and subjected to further analysis with a gene prediction program such as GRAIL. This analysis may lead to the identification of a new gene in the genomic sequence. This sequence can then be translated to identify the protein sequence that is encoded and that sequence can be further analyzed using tools such as Pfam, Blast P, or other protein structure prediction programs, as illustrated in Table 7. Typically, the above analysis is directed towards the identification of putative coding regions, e.g., previously unidentified open reading frames, confirming the presence of known coding sequences, and determining structural motifs or sequence similarities of the predicted protein (i.e., the conceptual translation product) in relation to known sequences. In addition, it has become increasingly possible to assemble "virtual cDNAs" containing large portions of coding region, simply through the assembly of available expressed sequence tags (ESTs). In turn, these extended nucleic acid and amino acid sequences allow the rapid expansion of substrate sequences for homology searches and structural and functional motif characterization. The results of these analysis permits the categorization of sequences according to structural characteristics, e.g., as structural proteins, proteins involved in signal transduction, cell surface or secreted proteins etc.

It is understood that full-length nucleotide sequences may also be identified using conventional methods, for example, library screening, RT-PCR, chromosome walking, etc., as described in Sambrook and Ausubel, infra.

Candidate Nucleotide Library of the Invention

We identified members of a candidate nucleotide library that are differentially expressed in activated leukocytes and resting leukocytes. Accordingly, the invention provides the candidate leukocyte nucleotide library comprising the nucleotide sequences listed in Table 2, Table 3, Tables 8–10 and in the Sequence Listing. In another embodiment, the invention provides a candidate library comprising at least two nucleotide sequences listed in Table 2, Table 3, Tables 8–10 and the Sequence Listing. In another embodiment, at least two nucleotide sequences are 18 nucleotides in length, at least 35 nucleotides, at least 40 nucleotides or at least 100 nucleotides. In some embodiments, the nucleotide sequences comprises deoxyribonucleic acid (DNA) sequence, ribonucleic acid (RNA) sequence, synthetic oligonucleotide sequence, or genomic DNA sequence. It is understood that the nucleotide sequences may each correspond to one gene, or that several nucleotide sequences may correspond to one gene, or that a single nucleotide sequence may correspond to multiple genes.

The invention also provides probes to the candidate nucleotide library. In one embodiment of the invention, the probes comprise at least two nucleotide sequences listed in Table 2, Table 3, Tables 8–10, or the Sequence Listing which are differentially expressed in leukocytes in an individual with a least one disease criterion for at least one leukocyte-related disease and in leukocytes in an individual without the at least one disease criterion, wherein expression of the two or more nucleotide sequences is correlated with at least one disease criterion. It is understood that a probe may detect either the RNA expression or protein product expression of the candidate nucleotide library. Alternatively, or in addition, a probe can detect a genotype associated with a candidate nucleotide sequence, as further described below. In another embodiment, the probes for the candidate nucleotide library are immobilized on an array.

The candidate nucleotide library of the invention is useful in identifying diagnostic nucleotide sets of the invention, as described below. The candidate nucleotide sequences may be further characterized, and may be identified as a disease target nucleotide sequence and/or a novel nucleotide sequence, as described below. The candidate nucleotide sequences may also be suitable for use as imaging reagents, as described below.

Generation of Expression Patterns

RNA, DNA or Protein Sample Procurement

Following identification or assembly of a library of differentially expressed candidate nucleotide sequences, leukocyte expression profiles corresponding to multiple members of the candidate library are obtained. Leukocyte samples from one or more subjects are obtained by standard methods. Most typically, these methods involve transcutaneous venous sampling of peripheral blood. While sampling of circulating leukocytes from whole blood from the peripheral vasculature is generally the simplest, least invasive, and lowest cost alternative, it will be appreciated that numerous alternative sampling procedures exist, and are favorably employed in some circumstances. No pertinent distinction exists, in fact, between leukocytes sampled from the peripheral vasculature, and those obtained, e.g., from a central line, from a central artery, or indeed from a cardiac catheter, or during a surgical procedure which accesses the central vasculature. In addition, other body fluids and tissues that are, at least in part, composed of leukocytes are also desirable leukocyte samples. For example, fluid samples obtained from the lung during bronchoscopy may be rich in leukocytes, and amenable to expression profiling in the context of the invention, e.g., for the diagnosis, prognosis, or monitoring of lung transplant rejection, inflammatory lung diseases or infectious lung disease. Fluid samples from other tissues, e.g., obtained by endoscopy of the colon, sinuses, esophagus, stomach, small bowel, pancreatic duct, biliary tree, bladder, ureter, vagina, cervix or uterus, etc., are also suitable. Samples may also be obtained other sources containing leukocytes, e.g., from urine, bile, cerebrospinal fluid, feces, gastric or intestinal secretions, semen, or solid organ or joint biopsies.

Most frequently, mixed populations of leukocytes, such as are found in whole blood are utilized in the methods of the present invention. A crude separation, e.g., of mixed leukocytes from red blood cells, and/or concentration, e.g., over a sucrose, percoll or ficoll gradient, or by other methods known in the art, can be employed to facilitate the recovery of RNA or protein expression products at sufficient concentrations, and to reduce non-specific background. In some instances, it can be desirable to purify sub-populations of leukocytes, and methods for doing so, such as density or affinity gradients, flow cytometry, Fluorescence Activated Cell Sorting (FACS), immuno-magnetic separation, "panning," and the like, are described in the available literature and below.

Obtaining DNA, RNA and Protein Samples for Expression Profiling

A variety of techniques are available for the isolation of RNA from whole blood. Any technique that allows isolation of mRNA from cells (in the presence or absence of rRNA and tRNA) can be utilized. In brief, one method that allows reliable isolation of total RNA suitable for subsequent gene expression analysis is described as follows. Peripheral blood (either venous or arterial) is drawn from a subject, into one or more sterile, endotoxin free, tubes containing an anticoagulant (e.g., EDTA, citrate, heparin, etc.). Typically, the sample is divided into at least two portions. One portion, e.g., of 5–8 ml of whole blood is frozen and stored for future analysis, e.g., of DNA or protein. A second portion, e.g., of approximately 8 ml whole blood is processed for isolation of total RNA by any of a variety of techniques as described in, e.g, Sambook, Ausubel, below, as well as U.S. Pat. Nos: 5,728,822 and 4,843,155.

Typically, a subject sample of mononuclear leukocytes obtained from about 8 ml of whole blood, a quantity readily available from an adult human subject under most circumstances, yields 5–20 μg of total RNA. This amount is ample, e.g., for labeling and hybridization to at least two probe arrays. Labeled probes for analysis of expression patterns of nucleotides of the candidate libraries are prepared from the subject's sample of RNA using standard methods. In many cases, cDNA is synthesized from total RNA using a polyT primer and labeled, e.g., radioactive or fluorescent, nucleotides. The resulting labeled cDNA is then hybridized to probes corresponding to members of the candidate nucleotide library, and expression data is obtained for each nucleotide sequence in the library. RNA isolated from subject samples (e.g., peripheral blood leukocytes, or leukocytes obtained from other biological fluids and samples) is next used for analysis of expression patterns of nucleotides of the candidate libraries.

In some cases, however, the amount of RNA that is extracted from the leukocyte sample is limiting, and amplification of the RNA is desirable. Amplification may be accomplished by increasing the efficiency of probe labeling, or by amplifying the RNA sample prior to labeling. It is appreciated that care must be taken to select an amplification procedure that does not introduce any bias (with respect to gene expression levels) during the amplification process.

Several methods are available that increase the signal from limiting amounts of RNA, e.g. use of the Clontech (Glass Fluorescent Labeling Kit) or Stratagene (Fairplay Microarray Labeling Kit), or the Micromax kit (New England Nuclear, Inc.). Alternatively, cDNA is synthesized from RNA using a T7-polyT primer, in the absence of label, and DNA dendrimers from Genisphere (3DNA Submicro) are hybridized to the poly T sequence on the primer, or to a different "capture sequence" which is complementary to a fluorescently labeled sequence. Each 3DNA molecule has 250 fluorescent molecules and therefore can strongly label each cDNA.

Alternatively, the RNA sample is amplified prior to labeling. For example, linear amplification may be performed, as described in U.S. Pat. No. 6,132,997. A T7-polyT primer is used to generate the cDNA copy of the RNA. A second DNA strand is then made to complete the substrate for amplification. The T7 promoter incorporated into the primer is used by a T7 polymerase to produce numerous antisense copies of the original RNA. Fluorescent dye labeled nucleotides are directly incorporated into the RNA. Alternatively, amino allyl labeled nucleotides are incorporated into the RNA, and then fluorescent dyes are chemically coupled to the amino allyl groups, as described in Hughes et al. 2001. Other exemplary methods for amplification are described below.

It is appreciated that the RNA isolated must contain RNA derived from leukocytes, but may also contain RNA from other cell types to a variable degree. Additionally, the isolated RNA may come from subsets of leukocytes, e.g. monocytes and/or T-lymphocytes, as described above. Such consideration of cell type used for the derivation of RNA depends on the method of expression profiling used.

DNA samples may be obtained for analysis of the presence of DNA mutations, single nucleotide polymorphisms (SNPs), or other polymorphisms. DNA is isolated using standard techniques, e.g. *Maniatus*, supra.

Expression of products of candidate nucleotides may also be assessed using proteomics. Protein(s) are detected in samples of patient serum or from leukocyte cellular protein. Serum is prepared by centrifugation of whole blood, using standard methods. Proteins present in the serum may have been produced from any of a variety of leukocytes and non-leukocyte cells, and may include secreted proteins from leukocytes. Alternatively, leukocytes or a desired subpopulation of leukocytes are prepared as described above. Cellular protein is prepared from leukocyte samples using methods well known in the art, e.g., Trizol (Invitrogen Life Technologies, cat # 15596108; Chomczynski, P. and Sacchi, N. (1987) *Anal. Biochem.* 162, 156; Simms, D., Cizdziel, P. E., and Chomczynski, P. (1993) *Focus®* 15, 99; Chomczynski, P., Bowers-Finn, R., and Sabatini, L. (1987) J. of NIH Res. 6, 83; Chomczynski, P. (1993) Bio/Techniques 15, 532; Bracete, A. M., Fox, D. K., and Simms, D. (1998) Focus 20, 82; Sewall, A. and McRae, S. (1998) Focus 20, 36; Anal Biochem 1984 April;138(1):141–3, A method for the quantitative recovery of protein in dilute solution in the presence of detergents and lipids; Wessel D, Flugge Ul. (1984) Anal Biochem. 1984 April;138(1) :141–143.

Obtaining Expression Patterns

Expression patterns, or profiles, of a plurality of nucleotides corresponding to members of the candidate library are then evaluated in one or more samples of leukocytes. Typically, the leukocytes are derived from patient peripheral blood samples, although, as indicated above, many other sample sources are also suitable. These expression patterns constitute a set of relative or absolute expression values for some number of RNAs or protein products corresponding to the plurality of nucleotide sequences evaluated, which is referred to herein as the subject's "expression profile" for those nucleotide sequences. While expression patterns for as few as one independent member of the candidate library can be obtained, it is generally preferable to obtain expression patterns corresponding to a larger number of nucleotide sequences, e.g., about 2, about 5, about 10, about 20, about 50, about 100, about 200, about 500, or about 1000, or more. The expression pattern for each differentially expressed component member of the library provides a finite specificity and sensitivity with respect to predictive value, e.g., for diagnosis, prognosis, monitoring, and the like.

Clinical Studies, Data and Patient Groups

For the purpose of discussion, the term subject, or subject sample of leukocytes, refers to an individual regardless of health and/or disease status. A subject can be a patient, a study participant, a control subject, a screening subject, or any other class of individual from whom a leukocyte sample is obtained and assessed in the context of the invention. Accordingly, a subject can be diagnosed with a disease, can present with one or more symptom of a disease, or a predisposing factor, such as a family (genetic) or medical history (medical) factor, for a disease, or the like. Alternatively, a subject can be healthy with respect to any of the aforementioned factors or criteria. It will be appreciated that the term "healthy" as used herein, is relative to a specified disease, or disease factor, or disease criterion, as the term "healthy" cannot be defined to correspond to any absolute evaluation or status. Thus, an individual defined as healthy with reference to any specified disease or disease criterion, can in fact be diagnosed with any other one or more disease, or exhibit any other one or more disease criterion.

Furthermore, while the discussion of the invention focuses, and is exemplified using human sequences and samples, the invention is equally applicable, through construction or selection of appropriate candidate libraries, to non-human animals, such as laboratory animals, e.g., mice, rats, guinea pigs, rabbits; domesticated livestock, e.g., cows, horses, goats, sheep, chicken, etc.; and companion animals, e.g., dogs, cats, etc.

Methods for Obtaining Expression Data

Numerous methods for obtaining expression data are known, and any one or more of these techniques, singly or in combination, are suitable for determining expression profiles in the context of the present invention. For example, expression patterns can be evaluated by northern analysis, PCR, RT-PCR, Taq Man analysis, FRET detection, monitoring one or more molecular beacon, hybridization to an oligonucleotide array, hybridization to a cDNA array, hybridization to a polynucleotide array, hybridization to a liquid microarray, hybridization to a microelectric array, molecular beacons, cDNA sequencing, clone hybridization, cDNA fragment fingerprinting, serial analysis of gene expression (SAGE), subtractive hybridization, differential display and/or differential screening (see, e.g., Lockhart and Winzeler (2000) *Nature* 405:827–836, and references cited therein).

For example, specific PCR primers are designed to a member(s) of a candidate nucleotide library. cDNA is prepared from subject sample RNA by reverse transcription from a poly-dT oligonucleotide primer, and subjected to PCR. Double stranded cDNA may be prepared using primers suitable for reverse transcription of the PCR product, followed by amplification of the cDNA using in vitro transcription. The product of in vitro transcription is a sense-RNA corresponding to the original member(s) of the candidate library. PCR product may be also be evaluated in a number of ways known in the art, including real-time assessment using detection of labeled primers, e.g. TaqMan or molecular beacon probes. Technology platforms suitable for analysis of PCR products include the ABI 7700, 5700, or 7000 Sequence Detection Systems (Applied Biosystems, Foster City, Calif.), the MJ Research Opticon (MJ Research, Waltham, Mass.), the Roche Light Cycler (Roche Diagnositics, Indianapolis, Ind.), the Stratagene MX4000 (Stratagene, La Jolla, Calif.), and the Bio-Rad iCycler (Bio-Rad Laboratories, Hercules, Calif.). Alternatively, molecular beacons are used to detect presence of a nucleic acid sequence in an unamplified RNA or cDNA sample, or following amplification of the sequence using any method, e.g. IVT (In Vitro transcription) or NASBA (nucleic acid sequence based amplification). Molecular beacons are designed with sequences complementary to member(s) of a candidate nucleotide library, and are linked to fluorescent labels. Each probe has a different fluorescent label with non-overlapping emission wavelengths. For example, expression of ten genes may be assessed using ten different sequence-specific molecular beacons.

Alternatively, or in addition, molecular beacons are used to assess expression of multiple nucleotide sequences at once. Molecular beacons with sequence complimentary to the members of a diagnostic nucleotide set are designed and linked to fluorescent labels. Each fluorescent label used must have a non-overlapping emission wavelength. For example, 10 nucleotide sequences can be assessed by hybridizing 10 sequence specific molecular beacons (each labeled with a different fluorescent molecule) to an amplified or un-amplified RNA or cDNA sample. Such an assay bypasses the need for sample labeling procedures.

Alternatively, or in addition bead arrays can be used to assess expression of multiple sequences at once (See, e.g, LabMAP 100, Luminex Corp, Austin, Tex.). Alternatively, or in addition electric arrays are used to assess expression of multiple sequences, as exemplified by the e-Sensor technology of Motorola (Chicago, Ill.) or Nanochip technology of Nanogen (San Diego, Calif.)

Of course, the particular method elected will be dependent on such factors as quantity of RNA recovered, practitioner preference, available reagents and equipment, detectors, and the like. Typically, however, the elected method(s) will be appropriate for processing the number of samples and probes of interest. Methods for high-throughput expression analysis are discussed below.

Alternatively, expression at the level of protein products of gene expression is performed. For example, protein expression, in a sample of leukocytes, can be evaluated by one or more method selected from among: western analysis, two-dimensional gel analysis, chromatographic separation, mass spectrometric detection, protein-fusion reporter constructs, calorimetric assays, binding to a protein array and characterization of polysomal mRNA. One particularly favorable approach involves binding of labeled protein expression products to an array of antibodies specific for members of the candidate library. Methods for producing and evaluating antibodies are widespread in the art, see, e.g., Coligan, supra; and Harlow and Lane (1989) *Antibodies: A Laboratory Manual*, Cold Spring Harbor Press, NY ("Harlow and Lane"). Additional details regarding a variety of immunological and immunoassay procedures adaptable to the present invention by selection of antibody reagents specific for the products of candidate nucleotide sequences can be found in, e.g., Stites and Terr (eds.)(1991) *Basic and Clinical Immunology*, $7^{th}$ ed., and Paul, supra. Another approach uses systems for performing desorption spectrometry. Commercially available systems, e.g., from Ciphergen Biosystems, Inc. (Fremont, Calif.) are particularly well suited to quantitative analysis of protein expression. Indeed, Protein Chip(arrays (see, e.g., the website, ciphergen.com) used in desorption spectrometry approaches provide arrays for detection of protein expression. Alternatively, affinity reagents, (e.g., antibodies, small molecules, etc.) are developed that recognize epitopes of the protein product. Affinity assays are used in protein array assays, e.g. to detect the presence or absence of particular proteins. Alternatively, affinity reagents are used to detect expression using the methods described above. In the case of a protein that is expressed on the cell surface of leukocytes, labeled affinity reagents are bound to populations of leukocytes, and leukocytes expressing the protein are identified and counted using fluorescent activated cell sorting (FACS).

It is appreciated that the methods of expression evaluation discussed herein, although discussed in the context of discovery of diagnostic nucleotide sets, are also applicable for expression evaluation when using diagnostic nucleotide sets for, e.g. diagnosis of diseases, as further discussed below.

High Throughput Expression Assays

A number of suitable high throughput formats exist for evaluating gene expression. Typically, the term high throughput refers to a format that performs at least about 100 assays, or at least about 500 assays, or at least about 1000 assays, or at least about 5000 assays, or at least about 10,000 assays, or more per day. When enumerating assays, either the number of samples or the number of candidate nucleotide sequences evaluated can be considered. For example, a northern analysis of, e.g., about 100 samples performed in a gridded array, e.g., a dot blot, using a single probe corresponding to a candidate nucleotide sequence can be considered a high throughput assay. More typically, however, such an assay is performed as a series of duplicate blots, each evaluated with a distinct probe corresponding to a different member of the candidate library. Alternatively, methods that simultaneously evaluate expression of about 100 or more candidate nucleotide sequences in one or more samples, or in multiple samples, are considered high throughput.

Numerous technological platforms for performing high throughput expression analysis are known. Generally, such methods involve a logical or physical array of either the subject samples, or the candidate library, or both. Common array formats include both liquid and solid phase arrays. For example, assays employing liquid phase arrays, e.g., for hybridization of nucleic acids, binding of antibodies or other receptors to ligand, etc., can be performed in multiwell, or microtiter, plates. Microtiter plates with 96, 384 or 1536 wells are widely available, and even higher numbers of wells, e.g, 3456 and 9600 can be used. In general, the choice of microtiter plates is determined by the methods and equipment, e.g., robotic handling and loading systems, used for sample preparation and analysis. Exemplary systems include, e.g., the ORCA™ system from Beckman-Coulter, Inc. (Fullerton, Calif.) and the Zymate systems from Zymark Corporation (Hopkinton, Mass.).

Alternatively, a variety of solid phase arrays can favorably be employed in to determine expression patterns in the context of the invention. Exemplary formats include membrane or filter arrays (e.g, nitrocellulose, nylon), pin arrays, and bead arrays (e.g., in a liquid "slurry"). Typically, probes corresponding to nucleic acid or protein reagents that specifically interact with (e.g., hybridize to or bind to) an expression product corresponding to a member of the candidate library are immobilized, for example by direct or indirect cross-linking, to the solid support. Essentially any solid support capable of withstanding the reagents and conditions necessary for performing the particular expression assay can be utilized. For example, functionalized glass, silicon, silicon dioxide, modified silicon, any of a variety of polymers, such as (poly)tetrafluoroethylene, (poly)vinylidenedifluoride, polystyrene, polycarbonate, or combinations thereof can all serve as the substrate for a solid phase array.

In a preferred embodiment, the array is a "chip" composed, e.g., of one of the above-specified materials. Polynucleotide probes, e.g., RNA or DNA, such as cDNA, synthetic oligonucleotides, and the like, or binding proteins such as antibodies, that specifically interact with expression products of individual components of the candidate library are affixed to the chip in a logically ordered manner, i.e., in an array. In addition, any molecule with a specific affinity for either the sense or anti-sense sequence of the marker nucleotide sequence (depending on the design of the sample labeling), can be fixed to the array surface without loss of specific affinity for the marker and can be obtained and produced for array production, for example, proteins that specifically recognize the specific nucleic acid sequence of the marker, ribozymes, peptide nucleic acids (PNA), or other chemicals or molecules with specific affinity.

Detailed discussion of methods for linking nucleic acids and proteins to a chip substrate, are found in, e.g., U.S. Pat. No. 5,143,854 "Large Scale Photolithographic Solid Phase Synthesis Of Polypeptides And Receptor Binding Screening Thereof" to Pirrung et al., issued, Sep. 1, 1992; U.S. Pat. No. 5,837,832 "Arrays Of Nucleic Acid Probes On Biological Chips" to Chee et al., issued Nov. 17, 1998; U.S. Pat. No. 6,087,112 "Arrays With Modified Oligonucleotide And Polynucleotide Compositions" to Dale, issued Jul. 11, 2000; U.S. Pat. No. 5,215,882 "Method Of Immobilizing Nucleic Acid On A Solid Substrate For Use In Nucleic Acid Hybridization Assays" to Bahl et al., issued Jun. 1, 1993; U.S. Pat. No. 5,707,807 "Molecular Indexing For Expressed Gene Analysis" to Kato, issued Jan. 13, 1998; U.S. Pat. No. 5,807,522 "Methods For Fabricating Microarrays Of Biological Samples" to Brown et al., issued Sep. 15, 1998; U.S. Pat. No. 5,958,342 "Jet Droplet Device" to Gamble et al., issued Sep. 28, 1999; U.S. Pat. No. 5,994,076 "Methods Of Assaying Differential Expression" to Chenchik et al., issued Nov. 30, 1999; U.S. Pat. No. 6,004,755 "Quantitative Microarray Hybridization Assays" to Wang, issued Dec. 21, 1999; U.S. Pat. No. 6,048,695 "Chemically Modified Nucleic Acids And Method For Coupling Nucleic Acids To Solid Support" to Bradley et al., issued Apr. 11, 2000; U.S. Pat. No. 6,060,240 "Methods For Measuring Relative Amounts Of Nucleic Acids In A Complex Mixture And Retrieval Of Specific Sequences Therefrom" to Kamb et al., issued May 9, 2000; U.S. Pat. No. 6,090,556 "Method For Quantitatively Determining The Expression Of A Gene" to Kato, issued Jul. 18, 2000; and U.S. Pat. No. 6,040,138 "Expression Monitoring By Hybridization To High Density Oligonucleotide Arrays" to Lockhart et al., issued Mar. 21, 2000 each of which are hereby incorporated by reference in their entirety.

For example, cDNA inserts corresponding to candidate nucleotide sequences, in a standard TA cloning vector are amplified by a polymerase chain reaction for approximately 30–40 cycles. The amplified PCR products are then arrayed onto a glass support by any of a variety of well-known techniques, e.g., the VSLIPS™ technology described in U.S. Pat. No. 5,143,854. RNA, or cDNA corresponding to RNA, isolated from a subject sample of leukocytes is labeled, e.g., with a fluorescent tag, and a solution containing the RNA (or cDNA) is incubated under conditions favorable for hybridization, with the "probe" chip. Following incubation, and washing to eliminate non-specific hybridization, the labeled nucleic acid bound to the chip is detected qualitatively or quantitatively, and the resulting expression profile for the corresponding candidate nucleotide sequences is recorded. It is appreciated that the probe used for diagnostic purposes may be identical to the probe used during diagnostic nucleotide sequence discovery and validation. Alternatively, the probe sequence may be different than the sequence used in diagnostic nucleotide sequence discovery and validation. Multiple cDNAs from a nucleotide sequence that are non-overlapping or partially overlapping may also be used.

In another approach, oligonucleotides corresponding to members of a candidate nucleotide library are synthesized and spotted onto an array. Alternatively, oligonucleotides are synthesized onto the array using methods known in the art, e.g. Hughes, et al. supra. The oligonucleotide is designed to be complementary to any portion of the candidate nucleotide sequence. In addition, in the context of expression analysis for, e.g. diagnostic use of diagnostic nucleotide sets, an oligonucleotide can be designed to exhibit particular hybridization characteristics, or to exhibit a particular specificity and/or sensitivity, as further described below.

Oligonucleotide probes are also prepared using the DNA sequence information for the candidate genes identified by differential hybridization screening (listed in Tables 3, 8–10 and the Sequence Listing) and/or the sequence information for the genes identified by database mining (listed in Table 2) is used to design complimentary oligonucleotide probes. Oligo probes are designed on a contract basis by various companies (for example, Compugen, Mergen, Affymetrix, Telechem), or designed from the candidate sequences using a variety of parameters and algorithms as indicated at the website genome.wi.mit.edu/cgi-bin/primer/primer3.cgi. Briefly, the length of the oligonucleotide to be synthesized is determined, preferably at least 16 nucleotides, generally 18–24 nucleotides, 24–70 nucleotides and, in some circumstances, more than 70 nucleotides. The sequence analysis algorithms and tools described above are applied to the sequences to mask repetitive elements, vector sequences and low complexity sequences. Oligonucleotides are selected that are specific to the candidate nucleotide sequence (based on a Blast n search of the oligonucleotide sequence in question against gene sequences databases, such as the Human Genome Sequence, UniGene, dbEST or the non-redundant database at NCBI), and have <50% G content and 25–70% G+C content. Desired oligonucleotides are synthesized using well-known methods and apparatus, or ordered from a company (for example Sigma). Oligonucleotides are spotted onto microarrays. Alternatively, oligonucleotides are synthesized directly on the array surface, using a variety of techniques (Hughes et al. 2001, Yershov et al. 1996, Lockhart et al 1996).

Hybridization signal may be amplified using methods known in the art, and as described herein, for example use of the Clontech kit (Glass Fluorescent Labeling Kit), Stratagene kit (Fairplay Microarray Labeling Kit), the Micromax kit (New England Nuclear, Inc.), the Genisphere kit (3DNA Submicro), linear amplification, e.g. as described in U.S. Pat. No. 6,132,997 or described in Hughes, T R, et al., Nature Biotechnology, 19:343–347 (2001) and/or Westin et al. *Nat Biotech.* 18:199–204. In some cases, amplification techniques do not increase signal intensity, but allow assays to be done with small amounts of RNA.

Alternatively, fluorescently labeled cDNA are hybridized directly to the microarray using methods known in the art. For example, labeled cDNA are generated by reverse transcription using Cy3- and Cy5-conjugated deoxynucleotides, and the reaction products purified using standard methods. It is appreciated that the methods for signal amplification of expression data useful for identifying diagnostic nucleotide sets are also useful for amplification of expression data for diagnostic purposes.

Microarray expression may be detected by scanning the microarray with a variety of laser or CCD-based scanners, and extracting features with numerous software packages, for example, Imagene (Biodiscovery), Feature Extraction Software (Agilent), Scanalyze (Eisen, M. 1999. SCANALYZE User Manual; Stanford Univ., Stanford, Calif. Ver 2.32.), GenePix (Axon Instruments).

In another approach, hybridization to microelectric arrays is performed, e.g. as described in Umek et al (2001) *J Mol Diagn.* 3:74–84. An affinity probe, e.g. DNA, is deposited on a metal surface. The metal surface underlying each probe is connected to a metal wire and electrical signal detection system. Unlabelled RNA or cDNA is hybridized to the array, or alternatively, RNA or cDNA sample is amplified before hybridization, e.g. by PCR. Specific hybridization of sample RNA or cDNA results in generation of an electrical signal, which is transmitted to a detector. See Westin (2000) *Nat Biotech.* 18:199–204 (describing anchored multiplex amplification of a microelectronic chip array); Edman (1997) *NAR* 25:4907–14; Vignali (2000) *J Immunol Methods* 243:243–55.

In another approach, a microfluidics chip is used for RNA sample preparation and analysis. This approach increases efficiency because sample preparation and analysis are streamlined. Briefly, microfluidics may be used to sort specific leukocyte sub-populations prior to RNA preparation and analysis. Microfluidics chips are also useful for, e.g., RNA preparation, and reactions involving RNA (reverse transcription, RT-PCR). Briefly, a small volume of whole, anti-coagulated blood is loaded onto a microfluidics chip, for example chips available from Caliper (Mountain View, Calif.) or Nanogen (San Diego, Calif.) A microfluidics chip may contain channels and reservoirs in which cells are moved and reactions are performed. Mechanical, electrical, magnetic, gravitational, centrifugal or other forces are used to move the cells and to expose them to reagents. For example, cells of whole blood are moved into a chamber containing hypotonic saline, which results in selective lysis of red blood cells after a 20-minute incubation. Next, the remaining cells (leukocytes) are moved into a wash chamber and finally, moved into a chamber containing a lysis buffer such as guanidine isothyocyanate. The leukocyte cell lysate is further processed for RNA isolation in the chip, or is then removed for further processing, for example, RNA extraction by standard methods. Alternatively, the microfluidics chip is a circular disk containing ficoll or another density reagent. The blood sample is injected into the center of the disc, the disc is rotated at a speed that generates a centrifugal force appropriate for density gradient separation of mononuclear cells, and the separated mononuclear cells are then harvested for further analysis or processing.

It is understood that the methods of expression evaluation, above, although discussed in the context of discovery of diagnostic nucleotide sots, are also applicable for expression evaluation when using diagnostic nucleotide sets for, e.g. diagnosis of diseases, as further discussed below.

Evaluation of Expression Patterns

Expression patterns can be evaluated by qualitative and/or quantitative measures. Certain of the above described techniques for evaluating gene expression (as RNA or protein products) yield data that are predominantly qualitative in nature. That is, the methods detect differences in expression that classify expression into distinct modes without providing significant information regarding quantitative aspects of expression. For example, a technique can be described as a qualitative technique if it detects the presence or absence of expression of a candidate nucleotide sequence, i.e., an on/off pattern of expression. Alternatively, a qualitative technique measures the presence (and/or absence) of different alleles, or variants, of a gene product.

In contrast, some methods provide data that characterize expression in a quantitative manner. That is, the methods relate expression on a numerical scale, e.g., a scale of 0–5, a scale of 1–10, a scale of +–+++, from grade 1 to grade 5, a grade from a to z, or the like. It will be understood that the numerical, and symbolic examples provided are arbitrary, and that any graduated scale (or any symbolic representation of a graduated scale) can be employed in the context of the present invention to describe quantitative differences in nucleotide sequence expression. Typically, such methods yield information corresponding to a relative increase or decrease in expression.

Any method that yields either quantitative or qualitative expression data is suitable for evaluating expression of candidate nucleotide sequence in a subject sample of leukocytes. In some cases, e.g., when multiple methods are employed to determine expression patterns for a plurality of candidate nucleotide sequences, the recovered data, e.g., the expression profile, for the nucleotide sequences is a combination of quantitative and qualitative data.

In some applications, expression of the plurality of candidate nucleotide sequences is evaluated sequentially. This is typically the case for methods that can be characterized as low- to moderate-throughput. In contrast, as the throughput of the elected assay increases, expression for the plurality of candidate nucleotide sequences in a sample or multiple samples of leukocytes, is assayed simultaneously. Again, the methods (and throughput) are largely determined by the individual practitioner, although, typically, it is preferable to employ methods that permit rapid, e.g. automated or partially automated, preparation and detection, on a scale that is time-efficient and cost-effective.

It is understood that the preceding discussion, while directed at the assessment of expression of the members of candidate libraries, is also applies to the assessment of the expression of members of diagnostic nucleotide sets, as further discussed below.

Genotyping

In addition to, or in conjunction with the correlation of expression profiles and clinical data, it is often desirable to correlate expression patterns with the subject's genotype at one or more genetic loci or to correlate both expression profiles and genetic loci data with clinical data The selected loci can be, for example, chromosomal loci corresponding to one or more member of the candidate library, polymorphic alleles for marker loci, or alternative disease related loci (not contributing to the candidate library) known to be, or putatively associated with, a disease (or disease criterion). Indeed, it will be appreciated, that where a (polymorphic) allele at a locus is linked to a disease (or to a predisposition to a disease), the presence of the allele can itself be a disease criterion.

Numerous well known methods exist for evaluating the genotype of an individual, including southern analysis, restriction fragment length polymorphism (RFLP) analysis, polymerase chain reaction (PCR), amplification length polymorphism (AFLP) analysis, single stranded conformation polymorphism (SSCP) analysis, single nucleotide polymorphism (SNP) analysis (e.g., via PCR, Taqman or molecular beacons), among many other useful methods. Many such procedures are readily adaptable to high throughput and/or automated (or semi-automated) sample preparation and analysis methods. Most, can be performed on nucleic acid samples recovered via simple procedures from the same sample of leukocytes as yielded the material for expression profiling. Exemplary techniques are described in, e.g., Sambrook, and Ausubel, supra.

Identification of the Diagnostic Oligonucleotides and Oligonucleotide Sets of the Invention Identification of diagnostic nucleotides and nucleotide sets and disease specific target nucleotide sequence proceeds by correlating the leukocyte expression profiles with data regarding the subject's health status to produce a data set designated a "molecular signature." Examples of data regarding a patient's health status, also termed "disease criteria(ion)", is described below and in the Section titled "selected diseases," below. Methods useful for correlation analysis are further described elsewhere in the specification.

Generally, relevant data regarding the subject's health status includes retrospective or prospective health data, e.g., in the form of the subject's medical history, as provided by the subject, physician or third party, such as, medical diagnoses, laboratory test results, diagnostic test results, clinical events, or medication lists, as further described below. Such data may include information regarding a patient's response to treatment and/or a particular medication and data regarding the presence of previously characterized "risk factors." For example, cigarette smoking and obesity are previously identified risk factors for heart disease. Further examples of health status information, including diseases and disease criteria, is described in the section titled Selected diseases, below.

Typically, the data describes prior events and evaluations (i.e., retrospective data). However, it is envisioned that data collected subsequent to the sampling (i.e., prospective data) can also be correlated with the expression profile. The tissue sampled, e.g., peripheral blood, bronchial lavage, etc., can be obtained at one or more multiple time points and subject data is considered retrospective or prospective with respect to the time of sample procurement.

Data collected at multiple time points, called "longitudinal data", is often useful, and thus, the invention encompasses the analysis of patient data collected from the same patient at different time points. Analysis of paired samples, such as samples from a patient at different times, allows identification of differences that are specifically related to the disease state since the genetic variability specific to the patient is controlled for by the comparison; Additionally, other variables that exist between patients may be controlled for in this way, for example, the presence or absence of inflammatory diseases (e.g., rheumatoid arthritis) the use of medications that may effect leukocyte gene expression, the presence or absence of co-morbid conditions, etc. Methods for analysis of paired samples are further described below. Moreover, the analysis of a pattern of expression profiles (generated by collecting multiple expression profiles) provides information relating to changes in expression level over time, and may permit the determination of a rate of change, a trajectory, or an expression curve. Two longitudinal samples may provide information on the change in expression of a gene over time, while three longitudinal samples may be necessary to determine the "trajectory" of expression of a gene. Such information may be relevant to the diagnosis of a disease. For example, the expression of a gene may vary from individual to individual, but a clinical event, for example, a heart attack, may cause the level of expression to double in each patient. In this example, clinically interesting information is gleaned from the change in expression level, as opposed to the absolute level of expression in each individual.

When a single patient sample is obtained, it may still be desirable to compare the expression profile of that sample to some reference expression profile. In this case, one can determine the change of expression between the patient's sample and a reference expression profile that is appropriate for that patient and the medical condition in question. For example, a reference expression profile can be determined for all patients without the disease criterion in question who have similar characteristics, such as age, sex, race, diagnoses etc.

Generally, small sample sizes of 1040 samples from 10–20 individuals are used to identify a diagnostic nucleotide set. Larger sample sizes are generally necessary to validate the diagnostic nucleotide set for use in large and varied patient populations, as further described below. For example, extension of gene expression correlations to varied ethnic groups, demographic groups, nations, peoples or races may require expression correlation experiments on the population of interest.

Expression Reference Standards

Expression profiles derived from a patient (i.e., subjects diagnosed with, or exhibiting symptoms of, or exhibiting a disease criterion, or under a doctor's care for a disease) sample are compared to a control or standard expression RNA to facilitate comparison of expression profiles (e.g. of a set of candidate nucleotide sequences) from a group of patients relative to each other (i.e., from one patient in the group to other patients in the group, or to patients in another group).

The reference RNA used should have desirable features of low cost and simplicity of production on a large scale. Additionally, the reference RNA should contain measurable amounts of as many of the genes of the candidate library as possible.

For example, in one approach to identifying diagnostic nucleotide sets, expression profiles derived from patient samples are compared to a expression reference "standard."

Standard expression reference can be, for example, RNA derived from resting cultured leukocytes or commercially available reference RNA, such as Universal reference RNA from Stratagene. See Nature, V406, 8–17-00, p. 747–752. Use of an expression reference standard is particularly useful when the expression of large numbers of nucleotide sequences is assayed, e.g. in an array, and in certain other applications, e.g. qualitative PCR, RT-PCR, etc., where it is desirable to compare a sample profile to a standard profile, and/or when large numbers of expression profiles, e.g. a patient population, are to be compared. Generally, an expression reference standard should be available in large quantities, should be a good substrate for amplification and labeling reactions, and should be capable of detecting a large percentage of candidate nucleic acids using suitable expression profiling technology.

Alternatively, or in addition, the expression profile derived from a patient sample is compared with the expression of an internal reference control gene, for example, β-actin or CD4. The relative expression of the profiled genes and the internal reference control gene (from the same individual) is obtained. An internal reference control may also be used with a reference RNA. For example, an expression profile for "gene 1" and the gene encoding CD4 can be determined in a patient sample and in a reference RNA. The expression of each gene can be expressed as the "relative" ratio of expression the gene in the patient sample compared with expression of the gene in the reference RNA. The expression ratio (sample/reference) for gene 1 may be divided by the expression ration for CD4 (sample/reference) and thus the relative expression of gene 1 to CD4 is obtained.

The invention also provides a buffy coat control RNA useful for expression profiling, and a method of using control RNA produced from a population of buffy coat cells, the white blood cell layer derived from the centrifugation of whole blood. Buffy coat contains all white blood cells, including granulocytes, mononuclear cells and platelets. The invention also provides a method of preparing control RNA from buffy coat cells for use in expression profile analysis of leukocytes. Buffy coat fractions are obtained, e.g. from a blood bank or directly from individuals, preferably from a large number of individuals such that bias from individual samples is avoided and so that the RNA sample represents an average expression of a healthy population. Buffy coat fractions from about 50 or about 100, or more individuals are preferred: 10 ml buffy coat from each individual is used. Buffy coat samples are treated with an erthythrocyte lysis buffer, so that erthythrocytes are selectively removed. The leukocytes of the buffy coat layer are collected by centrifugation. Alternatively, the buffy cell sample can be further enriched for a particular leukocyte sub-populations, e.g. mononuclear cells, T-lymphocytes, etc. To enrich for mononuclear cells, the buffy cell pellet, above, is diluted in PBS (phosphate buffered saline) and loaded onto a non-polystyrene tube containing a polysucrose and sodium diatrizoate solution adjusted to a density of 1.077+/−0.001 g/ml. To enrich for T-lymphocytes, 45 ml of whole blood is treated with RosetteSep (Stem Cell Technologies), and incubated at room temperature for 20 minutes. The mixture is diluted with an equal volume of PBS plus 2% FBS and mixed by inversion. 30 ml of diluted mixture is layered on top of 15 ml DML medium (Stem Cell Technologies). The tube is centrifuged at 1200×g, and the enriched cell layer at the plasma:medium interface is removed, washed with PBS+2% FBS, and cells collected by centrifugation at 1200×g. The cell pellet is treated with 5 ml of erythrocyte lysis buffer (EL buffer, Qiagen) for 10 minutes on ice, and enriched T-lymphocytes are collected by centrifugation.

In addition or alternatively, the buffy cells (whole buffy coat or sub-population, e.g. mononuclear fraction) can be cultured in vitro and subjected to stimulation with cytokines or activating chemicals such as phorbol esters or ionomycin. Such stimuli may increase expression of nucleotide sequences that are expressed in activated immune cells and might be of interest for leukocyte expression profiling experiments.

Following sub-population selection and/or further treatment, e.g. stimulation as described above, RNA is prepared using standard methods. For example, cells are pelleted and lysed with a phenol/guanidinium thiocyanate and RNA is prepared. RNA can also be isolated using a silica gel-based purification column or the column method can be used on RNA isolated by the phenol/guanidinium thiocyanate method. RNA from individual buffy coat samples can be pooled during this process, so that the resulting reference RNA represents the RNA of many individuals and individual bias is minimized or eliminated. In addition, a new batch of buffy coat reference RNA can be directly compared to the last batch to ensure similar expression pattern from one batch to another, using methods of collecting and comparing expression profiles described above/below. One or more expression reference controls are used in an experiment. For example, RNA derived from one or more of the following sources can be used as controls for an experiment: stimulated or unstimulated whole buffy coat, stimulated or unstimulated peripheral mononuclear cells, or stimulated or unstimulated T-lymphocytes.

Alternatively, the expression reference standard can be derived from any subject or class of subjects including healthy subjects or subjects diagnosed with the same or a different disease or disease criterion. Expression profiles from subjects in two or more distinct classes are compared to determine which subset of nucleotide sequences in the candidate library can best distinguish between the subject classes, as further discussed below. It will be appreciated that in the present context, the term "distinct classes" is relevant to at least one distinguishable criterion relevant to a disease of interest, a "disease criterion." The classes can, of course, demonstrate significant overlap (or identity) with respect to other disease criteria, or with respect to disease diagnoses, prognoses, or the like. The mode of discovery involves, e.g., comparing the molecular signature of different subject classes to each other (such as patient to control, patients with a first diagnosis to patients with a second diagnosis, etc.) or by comparing the molecular signatures of a single individual taken at different time points. The invention can be applied to a broad range of diseases, disease criteria, conditions and other clinical and/or epidemiological questions, as further discussed above/below.

It is appreciated that while the present discussion pertains to the use of expression reference controls while identifying diagnostic nucleotide sets, expression reference controls are also useful during use of diagnostic nucleotide sets, e.g. use of a diagnostic nucleotide set for diagnosis of a disease, as further described below.

Analysis of Expression Profiles

In order to facilitate ready access, e.g., for comparison, review, recovery, and/or modification, the molecular signatures/expression profiles are typically recorded in a database. Most typically, the database is a relational database accessible by a computational device, although other formats, e.g., manually accessible indexed files of expression profiles as photographs, analogue or digital imaging readouts, spreadsheets, etc. can be used. Further details regarding preferred embodiments are provided below. Regardless of whether the expression patterns initially recorded are analog or digital in nature and/or whether they represent quantitative or qualitative differences in expression, the expression patterns, expression profiles (collective expression patterns), and molecular signatures (correlated expression patterns) are stored digitally and accessed via a database. Typically, the database is compiled and maintained at a central facility, with access being available locally and/or remotely.

As additional samples are obtained, and their expression profiles determined and correlated with relevant subject data, the ensuing molecular signatures are likewise recorded in the database. However, rather than each subsequent addition being added in an essentially passive manner in which the data from one sample has little relation to data from a second (prior or subsequent) sample, the algorithms optionally additionally query additional samples against the existing database to further refine the association between a molecular signature and disease criterion. Furthermore, the data set comprising the one (or more) molecular signatures is optionally queried against an expanding set of additional or other disease criteria. The use of the database in integrated systems and web embodiments is further described below.

Analysis of Expression Profile Data from Arrays

Expression data is analyzed using methods well known in the art, including the software packages Imagene (Biodiscovery, Marina del Rey, Calif.), Feature Extraction Software (Agilent, Palo Alto, Calif.), and Scanalyze (Stanford University). In the discussion that follows, a "feature" refers to an individual spot of DNA on an array. Each gene may be represented by more than one feature. For example, hybridized microarrays are scanned and analyzed on an Axon Instruments scanner using GenePix 3.0 software (Axon Instruments, Union City, Calif.). The data extracted by GenePix is used for all downstream quality control and expression evaluation. The data is derived as follows. The data for all features flagged as "not found" by the software is removed from the dataset for individual hybridizations. The "not found" flag by GenePix indicates that the software was unable to discriminate the feature from the background. Each feature is examined to determine the value of its signal. The median pixel intensity of the background ($B_n$) is subtracted from the median pixel intensity of the feature ($F_n$) to produce the background-subtracted signal (hereinafter, "BGSS"). The BGSS is divided by the standard deviation of the background pixels to provide the signal-to-noise ratio (hereinafter, "S/N"). Features with a SIN of three or greater in both the Cy3 channel (corresponding to the sample RNA) and Cy5 channel (corresponding to the reference RNA) are used for further analysis (hereinafter denoted "useable features"). Alternatively, different SINs are used for selecting expression data for an analysis. For example, only expression data with signal to noise ratios >3 might be used in an analysis. Alternatively, features with S/N values <3 may be flagged as such and included in the analysis. Such flagged data sets include more values and may allow one to discover expression markers that would be missed otherwise. However, such data sets may have a higher variablilty than filtered data, which may decrease significance of findings or performance of correlation statistics.

For each usable feature (i), the expression level (e) is expressed as the logarithm of the ratio (R) of the Background Subtracted Signal (hereinafter "BGSS") for the Cy3 (sample RNA) channel divided by the BGSS for the Cy5 channel (reference RNA). This "log ratio" value is used for comparison to other experiments.

$$R_i = \frac{BGSS_{sample}}{BGSS_{reference}} \quad (0.1)$$

$$e_i = \log r_i \quad (0.2)$$

Variation in signal across hybridizations may be caused by a number of factors affecting hybridization, DNA spotting, wash conditions, and labeling efficiency.

A single reference RNA may be used with all of the experimental RNAs, permitting multiple comparisons in addition to individual comparisons. By comparing sample RNAs to the same reference, the gene expression levels from each sample are compared across arrays, permitting the use of a consistent denominator for our experimental ratios.

Scaling

The data may be scaled (normalized) to control for labeling and hybridization variability within the experiment, using methods known in the art. Scaling is desirable because it facilitates the comparison of data between different experiments, patients, etc. Generally the BGSS are scaled to a factor such as the median, the mean, the trimmed mean, and percentile. Additional methods of scaling include: to scale between 0 and 1, to subtract the mean, or to subtract the median.

Scaling is also performed by comparison to expression patterns obtained using a common reference RNA, as described in greater detail above. As with other scaling methods, the reference RNA facilitates multiple comparisons of the expression data, e.g., between patients, between samples, etc. Use of a reference RNA provides a consistent denominator for experimental ratios.

In addition to the use of a reference RNA, individual expression levels may be adjusted to correct for differences in labeling efficiency between different hybridization experiments, allowing direct comparison between experiments with different overall signal intensities, for example. A scaling factor ($\alpha$) may be used to adjust individual expression levels as follows. The median of the scaling factor ($\alpha$), for example, BGSS, is determined for the set of all features with a S/N greater than three. Next, the $BGSS_i$ (the BGSS for each feature "i") is divided by the median for all features ($\alpha$), generating a scaled ratio. The scaled ration is used to determine the expression value for the feature ($e_i$), or the log ratio.

$$S_i = \frac{BGSS_i}{a} \quad (0.3)$$

$$e_i = \log\left(\frac{Cy3S_i}{C_y5S_i}\right) \quad (0.4)$$

In addition, or alternatively, control features are used to normalize the data for labeling and hybridization variability within the experiment. Control feature may be cDNA for genes from the plant, *Arabidopsis thaliana*, that are included when spotting the mini-array. Equal amounts of RNA complementary to control cDNAs are added to each of the samples before they were labeled. Using the signal from these control genes, a normalization constant (L) is determined according to the following formula:

$$L_j = \frac{\frac{\sum_{i=1}^{N} BGSS_{j,i}}{N}}{\frac{\sum_{j=1}^{K} \frac{\sum_{i=1}^{N} BGSS_{j,i}}{N}}{K}}$$

where $BGSS_i$ is the signal for a specific feature, N is the number of *A. thaliana* control features, K is the number of hybridizations, and $L_j$ is the normalization constant for each individual hybridization.

Using the formula above, the mean for all control features of a particular hybridization and dye (e.g., Cy3) is calculated. The control feature means for all Cy3 hybridizations are averaged, and the control feature mean in one hybridization divided by the average of all hybridizations to generate a normalization constant for that particular Cy3 hybridization ($L_j$), which is used as a in equation (0.3). The same normalization steps may be performed for Cy3 and Cy5 values.

Many additional methods for normalization exist and can be applied to the data. In one method, the average ratio of Cy3 BGSS/Cy5 BGSS is determined for all features on an array. This ratio is then scaled to some arbitrary number, such as 1 or some other number. The ratio for each probe is then multiplied by the scaling factor required to bring the average ratio to the chosen level. This is performed for each array in an analysis. Alternatively, the ratios are normalized to the average ratio across all arrays in an analysis.

If multiple features are used per gene sequence or oligonucleotide, these repeats can be used to derive an average expression value for each gene. If some of the replicate features are of poor qualitay and don't meet requirements for analysis, the remaining features can be used to represent the gene or gene sequence.

Correlation Analysis

Correlation analysis is performed to determine which array probes have expression behavior that best distinguishes or serves as markers for relevant groups of samples representing a particular clinical condition. Correlation analysis, or comparison among samples representing different disease criteria (e.g., clinical conditions), is performed using standard statistical methods. Numerous algorithms are useful for correlation analysis of expression data, and the selection of algorithms depends in part on the data analysis to be performed. For example, algorithms can be used to identify the single most informative gene with expression behavior that reliably classifies samples, or to identify all the genes useful to classify samples. Alternatively, algorithms can be applied that determine which set of 2 or more genes have collective expression behavior that accurately classifies samples. The use of multiple expression markers for diagnostics may overcome the variability in expression of a gene between individuals, or overcome the variability intrinsic to the assay. Multiple expression markers may include redundant markers (surrogates), in that two or more genes or probes may provide the same information with respect to diagnosis. This may occur, for example, when two or more genes or gene probes are coordinately expressed. For diagnostic application, it may be appropriate to utilize a gene and one or more of its surrogates in the assay. This redundancy may overcome failures (technical or biological) of a single marker to distinguish samples. Alternatively, one or more surrogates may have properties that make them more suitable for assay development, such as a higher baseline level of expression, better cell specificity, a higher fold change between sample groups or more specific sequence for the design of PCR primers or complimentary probes. It will be appreciated that while the discussion above pertains to the analysis of RNA expression profiles the discussion is equally applicable to the analysis of profiles of proteins or other molecular markers.

Prior to analysis, expression profile data may be formatted or prepared for analysis using methods known in the art. For example, often the log ratio of scaled expression data for every array probe is calculated using the following formula:

log (Cy3 BGSS/Cy5 BGSS), where Cy3 signal corresponds to the expression of the gene in the clinical sample, and Cy5 signal corresponds to expression of the gene in the reference RNA.

Data may be further filtered depending on the specific analysis to be done as noted below. For example, filtering may be aimed at selecting only samples with expression above a certain level, or probes with variability above a certain level between sample sets.

The following non-limiting discussion consider several statistical methods known in the art. Briefly, the t-test and ANOVA are used to identify single genes with expression differences between or among populations, respectively. Multivariate methods are used to identify a set of two or more genes for which expression discriminates between two disease states more specifically than expression of any single gene.

t-test

The simplest measure of a difference between two groups is the Student's t test. See, e.g., Welsh et al. (2001) *Proc Natl Acad Sci USA* 98:1176–81 (demonstrating the use of an unpaired Student's t-test for the discovery of differential gene expression in ovarian cancer samples and control tissue samples). The t-test assumes equal variance and normally distributed data. This test identifies the probability that there is a difference in expression of a single gene between two groups of samples. The number of samples within each group that is required to achieve statistical significance is dependent upon the variation among the samples within each group. The standard formula for a t-test is:

$$t(e_i) = \frac{\overline{e}_{i,c} - \overline{e}_{i,t}}{\sqrt{(s_{i,c}^2/n_c) + (s_{i,t}^2/n_t)}}, \quad (0.5)$$

where $\overline{e}_i$ is the difference between the mean expression level of gene i in groups c and t, $s_{i,c}$ is the variance of gene x in group c and $s_{i,t}$ is the variance of gene x in group t. $n_c$ and $n_t$ are the numbers of samples in groups c and t.

The combination of the t statistic and the degrees of freedom [min($n_t$, $n_c$)−1] provides a p value, the probability of rejecting the null hypothesis. A p-value of ≦0.01, signifying a 99 percent probability the mean expression levels are different between the two groups (a 1% chance that the mean expression levels are in fact not different and that the observed difference occurred by statistical chance), is often considered acceptable.

When performing tests on a large scale, for example, on a large dataset of about 8000 genes, a correction factor must be included to adjust for the number of individual tests being performed. The most common and simplest correction is the Bonferroni correction for multiple tests, which divides the p-value by the number of tests run. Using this test on an 8000 member dataset indicates that a p value of ≦0.00000125 is required to identify genes that are likely to be truly different between the two test conditions.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are a set of genes which are called significant, and the FDR gives a confidence level for this claim. If a gene is called differentially expressed between 2 classes by SAM, with a FDR of 5%, there is a 95% chance that the gene is actually differentially expressed between the classes. SAM takes intoaccount the variability and large number of variables of microarrays. SAM will identiy genes that are most globally differentially expressed between the classes. Thus, important genes for identifying and classifying outlier samples or patients may not be identified by SAM.

Wilcoxon's Signed Ranks Test

This method is non-parametric and is utilized for paired comparisons. See e.g., Sokal and Rohlf (1987) *Introduction to Biostatistics* $2^{nd}$ edition, WH Freeman, New York. At least 6 pairs are necessary to apply this statistic. This test is useful for analysis of paired expression data (for example, a set of patients who have had samples taken before and after administration of a pharmacologic agent).

ANOVA

Differences in gene expression across multiple related groups may be assessed using an Analysis of Variance (ANOVA), a method well known in the art (Michelson and Schofield, 1996).

Multivariate Analysis

Many algorithms suitable for multivariate analysis are known in the art (Katz 1999). Generally, a set of two or more genes for which expression discriminates between two disease states more specifically than expression of any single gene is identified by searching through the possible combinations of genes using a criterion for discrimination, for example the expression of gene X must increase from normal 300 percent, while the expression of genes Y and Z must decrease from normal by 75 percent. Ordinarily, the search starts with a single gene, then adds the next best fit at each step of the search. Alternatively, the search starts with all of the genes and genes that do not aid in the discrimination are eliminated step-wise.

Paired Samples

Paired samples, or samples collected at different time-points from the same patient, are often useful, as described above. For example, use of paired samples permits the reduction of variation due to genetic variation among individuals. In addition, the use of paired samples has a statistical significance in that data derived from paired samples can be calculated in a different manner that recognizes the reduced variability. For example, the formula for a t-test for paired samples is:

$$t(e_x) = \frac{\overline{D}_{e_x}}{\sqrt{\frac{\sum D^2 - (\sum D)^2/b}{b-1}}} \quad (0.5)$$

where D is the difference between each set of paired samples and b is the number of sample pairs. $\overline{D}$ is the mean of the differences between the members of the pairs. In this test, only the differences between the paired samples are considered, then grouped together (as opposed to taking all possible differences between groups, as would be the case with an ordinary t-test). Additional statistical tests useful with paired data, e.g., ANOVA and Wilcoxon's signed rank test, are discussed above.

Diagnostic Classification

Once a discriminating set of genes is identified, the diagnostic classifier (a mathematical function that assigns samples to diagnostic categories based on expression data) is applied to unknown sample expression levels.

Methods that can be used for this analysis include the following non-limiting list:

CLEAVER is an algorithm used for classification of useful expression profile data See Raychaudhuri et al. (2001) *Trends Biotechnol* 19:189–193. CLEAVER uses positive training samples (e.g., expression profiles from samples known to be derived from a particular patient or sample diagnostic category, disease or disease criteria), negative training samples (e.g., expression profiles from samples known not to be derived from a particular patient or sample diagnostic category, disease or disease criteria) and test samples (e.g., expression profiles obtained from a patient), and determines whether the test sample correlates with the particular disease or disease criteria, or does not correlate with a particular disease or disease criteria. CLEAVER also generates a list of the 20 most predictive genes for classification.

Artificial neural networks (hereinafter, "ANN") can be used to recognize patterns in complex data sets and can discover expression criteria that classify samples into more than 2 groups. The use of artificial neural networks for discovery of gene expression diagnostics for cancers using expression data generated by oligonucleotide expression microarrays is demonstrated by Khan et al. (2001) *Nature Med.* 7:673–9. Khan found that 96 genes provided 0% error rate in classification of the tumors. The most important of these genes for classification was then determined by measuring the sensitivity of the classification to a change in expression of each gene. Hierarchical clustering using the 96 genes results in correct grouping of the cancers into diagnostic categories.

Golub uses cDNA microarrays and a distinction calculation to identify genes with expression behavior that distinguishes myeloid and lymphoid leukemias. See Golub et al. (1999) *Science* 286:531–7. Self organizing maps were used for new class discovery. Cross validation was done with a "leave one out" analysis. 50 genes were identified as useful markers. This was reduced to as few as 10 genes with equivalent diagnostic accuracy.

Hierarchical and non-hierarchical clustering methods are also useful for identifying groups of genes that correlate with a subset of clinical samples such as those with and without Lupus. Alizadeh used hierarchical clustering as the primary tool to distinguish different types of diffuse B-cell lymphomas based on gene expression profile data. See Alizadeh et al. (2000) *Nature* 403:503–11. Alizadeh used hierarchical clustering as the primary tool to distinguish different types of diffuse B-cell lymphomas based on gene expression profile data. A cDNA array carrying 17856 probes was used for these experiments, 96 samples were assessed on 128 arrays, and a set of 380 genes was identified as being useful for sample classification.

Perou demonstrates the use of hierarchical clustering for the molecular classification of breast tumor samples based on expression profile data. See Perou et al. (2000) *Nature* 406:747–52. In this work, a cDNA array carrying 8102 gene probes was used. 1753 of these genes were found to have high variation between breast tumors and were used for the analysis.

Hastie describes the use of gene shaving for discovery of expression markers. Hastie et al. (2000) *Genome Biol.* 1(2):RESEARCH 0003.1–0003.21. The gene shaving algorithm identifies sets of genes with similar or coherent expression patterns, but large variation across conditions (RNA samples, sample classes, patient classes). In this manner, genes with a tight expression pattern within a diagnostic group, but also with high variability across the diagnoses are grouped together. The algorithm takes advantage of both characteristics in one grouping step. For example, gene shaving can identify useful marker genes with co-regulated expression. Sets of useful marker genes can be reduced to a smaller set, with each gene providing some non-redundant value in classification. This algorithm was used on the data set described in Alizadeh et al., supra, and the set of 380 informative gene markers was reduced to 234.

Supervised harvesting of expression trees (Hastie 2001) identifies genes or clusters that best distinguish one class from all the others on the data set. The method is used to identify the genes/clusters that can best separate one class versus all the others for datasets that include two or more classes or all classes from each other. This algorithm can be used for discovery or testing of a diagnostic gene set.

CART is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. See examples 10 and 16 for further description of its use in classification analysis and examples of its usefulness in discovering and implementing a diagnostic gene set. CART identifies surrogates for each splitter (genes that are the next best substitute for a useful gene inclassification.

Once a set of genes and expression criteria for those genes have been established for classification, cross validation is done. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples.

Clinical data are gathered for every patient sample used for expression analysis. Clinical variables can be quantitative or non-quantitative. A clinical variable that is quantitiative can be used as a variable for significance or classification analysis. Non-quantitative clinical variables, such as the sex of the patient, can also be used in a significance analysis or classification analysis with some statistical tool. It is appreciated that the most useful diagnostic gene set for a condition may be optimal when considered along with one or more predictive clinical variables. Clinical data can also be used as supervising vectors for a correlation analysis. That is to say that the clinical data associated with each sample can be used to divide the samples into meaningful diagnostic categories for analysis. For example, samples can be divided into 2 or more groups based on the presence or absence of some diagnostic criterion (a). In addition, clinical data can be utilized to select patients for a correlation analysis or to exclude them based on some undesirable characteristic, such as an ongoing infection, a medicine or some other issue. Clincial data can also be used to assess the pre-test probability of an outcome. For example, patients who a re female a re much more likely to be diagnosed as having systemic lupus erythematosis than patients who are male.

Once a set of genes are identified that classify samples with acceptable accuracy. These genes are validated as a set using new samples that were not used to discover the ge ne set. These samples can be taken from frozen archieves from the discovery clinical study or can be taken from new patients prospectively. Validation using a "test set" of samples can be done using expression profiling of the gene set with microarrays or using real-time PCR for each gene on the test set samples. Alternatively, a different expression profiling technology can be used.

Validation and Accuracy of Diagnostic Nucleoside Sets

Prior to widespread application of the diagnostic probe sets of the invention the predictive value of the probe set is validated. When the diagnostic probe set is discovered by microarray based expression analysis, the differential expression of the member genes may be validated by a less variable and more quantitive and accurate technology such as real time PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measure ment ($C_T=C_p$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3'exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/ quencher dye Taqman chemistry, for example scorpions.

Real-time PCR validation can be done as described in Example 15.

Typically, the oligonucleotide sequence of each probe is confirmed, e.g. by DNA sequencing using an oligonucleotide-specific primer. Partial sequence obtained is generally sufficient to confirm the identity of the oligonucleotide probe. Alternatively, a complementary polynucleotide is fluorescently labeled and hybridized to the array, or to a different array containing a resynthesized version of the oligo nucleotide probe, and detection of the correct probe is confirmed.

Typically, validation is performed by statistically evaluating the accuracy of the correspondence between the molecular signature for a diagnostic probe set and a selected indicator. For example, the expression differential for a nucleotide sequence between two subject classes can be expressed as a simple ratio of relative expression. The expression of the nucleotide sequence in subjects with selected indicator can be compared to the expression of that nucleotide sequence in subjects without the indicator, as described in the following equations.

$$\Sigma E_x ai/N = E_x A$$

the average expression of nucleotide sequence x in the members of group A;

$$\Sigma E_x bi/M = E_x B$$

the average expression of nucleotide sequence x in the members of group B;

$$E_x A/E x B = \Delta E_x AB$$

the average differential expression of nucleotide sequence x between groups A and B:
where Σ indicates a sum; Ex is the expression of nucleotide sequence x relative to a standard; ai are the individual members of group A, group A has N members; bi are the individual members of group B, group B has M members.

Individual components of a diagnostic probe set each have a defined sensitivity and specificity for distinguishing between subject groups. Such individual nucleotide sequences can be employed in concert as a diagnostic probe set to increase the sensitivity and specificity of the evaluation. The database of molecular signatures is queried by algorithms to identify the set of nucleotide sequences (i.e., corresponding to members of the probe set) with the highest average differential expression between subject groups. Typically, as the number of nucleotide sequences in the diagnostic probe set increases, so does the predictive value, that is, the sensitivity and specificity of the probe set. When the probe sets are defined they may be used for diagnosis and patient monitoring as discussed below. The diagnostic sensitivity and specificity of the probe sets for the defined use can be determined for a given probe set with specified expression levels as demonstrated above. By altering the expression threshold required for the use of each nucleotide sequence as a diagnostic, the sensitivity and specificity of the probe set can be altered by the practitioner. For example, by lowering the magnitude of the expression differential threshold for each nucleotide sequence in the set, the sensitivity of the test will increase, but the specificity will decrease. As is apparent from the foregoing discussion, sensitivity and specificity are inversely related and the predictive accuracy of the probe set is continuous and dependent on the expression threshold set for each nucleotide sequence. Although sensitivity and specificity tend to have an inverse relationship when expression thresholds are altered, both parameters calf be increased as nucleotide sequences with predictive value are added to the diagnostic nucleotide set. In addition a single or a few markers may not be reliable expression markers across a population of patients. This is because of the variability in expression and measurement of expression that exists between measurements, individuals and individuals over time. Inclusion of a large number of candidate nucleotide sequences or large numbers of nucleotide sequences in a diagnostic nucleotide set allows for this variability as not all nucleotide sequences need to meet a threshold for diagnosis. Generally, more markers are better than a single marker. If many markers are used to make a diagnosis, the likelihood that all expression markers will not meet some thresholds based upon random variability is low and thus the test will give fewer false negatives. Surrogate markers are useful for these purposes. These are markers or genes that are coordinately expressed. Surrogate markers essential provide redundant infomation, but this redundancy can improve accuracy by decreasing errors due to assay variability.

It is appreciated that the desired diagnostic sensitivity and specificity of the diagnostic nucleotide set may vary depending on the intended use of the set. For example, in certain uses, high specificity and high sensitivity are desired. For example, a diagnostic nucleotide set for predicting which patient population may experience side effects may require high sensitivity so as to avoid treating such patients. In other settings, high sensitivity is desired, while reduced specificity may be tolerated. For example, in the case of a beneficial treatment with few side effects, it may be important to identify as many patients as possible (high sensitivity) who will respond to the drug, and treatment of some patients who will not respond is tolerated. In other settings, high specificity is desired and reduced sensitivity may be tolerated. For example, when identifying patients for an early-phase clinical trial, it is important to identify patients who may respond to the particular treatment. Lower sensitivity is tolerated in this setting as it merely results in reduced patients who enroll in the study or requires that more patients are screened for enrollment.

To discover and validate a gene set that can be applied to accurately diagnose or classify patients across the country or around the world, it is necessary to ensure that the gene set was developed and validated using samples that represent the types of patients that will be encountered in the clinical setting. For example, diverse ethnicity, drug usage and clinical practice patterns must all be represented in the discovery and validation to ensure that the test works on this variety of patients.

Selected Diseases

In principle, individual oligonucleotides and diagnostic oligonucleotide sets of the invention may be developed and applied to essentially any disease, or disease criterion, as long as at least one subset of oligonucleotide sequences is differentially expressed in samples derived from one or more individuals with a disease criteria or disease and one or more individuals without the disease criteria or disease, wherein the individual may be the same individual sampled at different points in time, or the individuals may be different individuals (or populations of individuals). For example, the subset of oligonucleotide sequences may be differentially expressed in the sampled tissues of subjects with the disease or disease criterion (e.g., a patient with a disease or disease criteria) as compared to subjects without the disease or disease criterion (e.g., patients without a disease (control patients)). Alternatively, or in addition, the subset of oligonucleotide sequence(s) may be differentially expressed in different samples taken from the same patient, e.g at different points in time, at different disease stages, before and after a treatment, in the presence or absence of a risk factor, etc.

Expression profiles corresponding to oligonucleotides and sets of oligonucleotide sequences that correlate not with a diagnosis, but rather with a particular aspect of a disease can also be used to identify the diagnostic oligonucleotide sets and disease specific target oligonucleotide sequences of the invention. For example, such an aspect, or disease criterion, can relate to a subject's medical or family history, e.g., occurance of an autoimmune disease, childhood illness, cause of death of a parent or other relative, prior surgery or other intervention, medications, laboratory values and results of diagnostic testing (radiology, pathology, etc.), symptoms (including onset and/or duration of symptoms), etc. Alternatively, the disease criterion can relate to a diagnosis, e.g., chronic inflammatory disease such as lupus, rheumatoid arthritis, osteoarthritis, or prognosis (e.g., prediction of future diagnoses, events or complications), e.g., renal failure from lupus, joint replacement surgery for rheumatoid arthritis, rheumatoid arthritis or systemic lupus erythematosis disease activity or the like. In other cases, the disease criterion corresponds to a therapeutic outcome, e.g., response to a medication, response to a surgery or physical therapy for a joint. Alternatively, the disease criteria correspond with previously identified or classic risk factors and may correspond to prognosis or future disease diagnosis. As indicated above, a disease criterion can also correspond to genotype for one or more loci. Disease criteria (including patient data) may be collected (and compared) from the same patient at different points in time, from different patients, between patients with a disease (criterion) and patients respresenting a control population, etc. Longitudinal data, i.e., data collected at different time points from an individual (or group of individuals) may be used for comparisons of samples obtained from an individual (group of individuals) at different points in time, to permit identification of differences specifically related to the disease state, and to obtain information relating to the change in expression over time, including a rate of change or trajectory of expression over time. The usefulness of longitudinal data is further discussed in the section titled "Identification of diagnostic nucleotide sets of the invention".

It is further understood that diagnostic oligonucleotides and oligonucleotide sets may be developed for use in diagnosing conditions for which there is no present means of diagnosis. For example, in rheumatoid arthritis, joint destruction is often well under way before a patient experience symptoms of the condition. A diagnostic nucleotide or nucleotide set may be developed that diagnoses rheumatic joint destruction at an earlier stage than would be possible using present means of diagnosis, which rely in part on the presentation of symptoms by a patient. Diagnostic nucleotide sets may also be developed to replace or augment current diagnostic procedures. For example, the use of a diagnostic nucleotide or nucleotide set to diagnose lupus may replace or supplement the current diagnostic tests and strategies.

It is understood that the following discussion of diseases is exemplary and non-limiting, and further that the general criteria discussed above, e.g. use of family medical history, are generally applicable to the specific diseases discussed below.

In addition to leukocytes, as described throughout, the general method is applicable to oligonucleotide sequences that are differentially expressed in any subject tissue or cell type, by the collection and assessment of samples of that tissue or cell type. However, in many cases, collection of such samples presents significant technical or medical problems given the current state of the art.

Systemic Lupus Erythematosis (SLE)

SLE is a chronic, systemic inflammatory disease characterized by dysregulation of the immune system, which affects up to 2 million patients in the US. Symptoms of SLE include rashes, joint pain, abnormal blood counts, renal dysfunction and damage, infections, CNS disorders, arthralgias and autoimmunity. Patients may also have early onset atherosclerosis. The diagnosis of SLE is difficult to make with certainty using current diagnostic tests and algorithms. Antibody tests can be specific for the disease, but often lack sensitivity. Clinical diagnosis may lack both high sensitivity and specificity. SLE is a disease that clearly involves differential gene expression in leukocytes compared to patients without the disease.

Diagnostic oligonucleotides and oligonucleotide sets are identified and validated for use in diagnosis and monitoring of SLE activity and progression. Disease criteria correspond to clinical data, e.g. symptom rash, joint pain, malaise, rashes, blood counts (white and red), tests of renal function e.g. creatinine, blood urea nitrogen (hereinafter, "bun") creative clearance, data obtained from laboratory tests, including complete blood counts with differentials, CRP, ESR, ANA, Serum IL6, Soluble CD40 ligand, LDL, HDL, Anti-DNA antibodies, rheumatoid factor, C3, C4, serum creatinine and any medication levels, the need for pain medications, cumulative doses or immunosuppressive therapy, symptoms or any manifestation of carotid atherosclerosis (e.g. ultrasound diagnosis or any other manifestations of the disease), data from surgical procedures such as gross operative findings and pathological evaluation of resected tissues and biopsies (e.g., renal, CNS), information on pharmacological therapy and treatment changes, clinical diagnoses of disease "flare", hospitalizations, death, response to medications, quantitative joint exams, results from health assessment questionnaires (HAQs), and other clinical measures of patient symptoms and disability. In addition, disease criteria correspond to the clinical score known as SLEDAI (Bombadier C, Gladman D D, Urowitz M B, Caron D, Chang C H and the Committee on Prognosis Studies in SLE: Derivation of the SLEDAI for Lupus Patients. Arthritis Rheum 35:630–640, 1992.). Diagnostic nucleotide sets may be useful for diagnosis of SLE, monitoring disease progression including progressive renal dysfunction, carotid atherosclerosis and CNS dysfunction, and predicting occurrence of side-effects, for example.

Rheumatoid Arthritis

Rheumatoid arthritis (RA) effects about two million patients in the US and is a chronic and debilitating inflammatory arthritis, particularly involving pain and destruction of the joints. RA often goes undiagnosed because patients may have no pain, but the disease is actively destroying the joint. Other patients are known to have RA, and are treated to alleviate symptoms, but the rate of progression of joint destruction can't easily be monitored. Drug therapy is available, but the most effective medicines are toxic (e.g., steroids, methotrexate) and thus need to be used with caution. A new class of medications (TNF blockers) is very effective, but the drugs are expensive, have side effects, and not all patients respond. Side-effects are common and include immune suppression, toxicity to organ systems, allergy and metabolic disturbances.

Diagnostic oligonucleotides and oligonucleotide sets of the invention are developed and validated for use in diagnosis and treatment of RA. Disease criteria correspond to disease symptoms (e.g., joint pain, joint swelling and joint stiffness and any of the American College for Rheumatology criteria for the diagnosis of RA, see Arnett et al (1988) *Arthr. Rheum.* 31:315–24), progression of joint destruction (e.g. as measured by serial hand radiographs, assessment of joint function and mobility), surgery, need for medication, additional diagnoses of inflammatory and non-inflammatory conditions, and clinical laboratory measurements including complete blood counts with differentials, CRP, ESR, ANA, Serum IL6, Soluble CD40 ligand, LDL, HDL, Anti-DNA antibodies, rheumatoid factor, C3, C4, serum creatinine, death, hospitalization and disability due to joint destruction. In addition, or alternatively, disease criteria correspond to response to drug therapy and presence or absence of side-effects or measures of improvement exemplified by the American College of Rheumatology "20%" and "50%" response/improvement rates. See Felson et al (1995) *Arthr Rheum* 38:531–37. Diagnostic nucleotide sets are identified that monitor and predict disease progression including flaring (acute worsening of disease accompanied by joint pain or other symptoms), response to drug treatment and likelihood of side-effects.

In addition to peripheral leukocytes, surgical specimens of rheumatoid joints can be used for leukocyte expression profiling experiments. Members of diagnostic nucleotide sets are candidates for leukocyte target nucleotide sequences, e.g. as a candidate drug target for rheumatoid arthritis. Synovial specimens can be used for expression profiling or cells derived and sorted from that tissue (such as subsets of leukocytes) can be used. Cells can be separated by fluorescence activated cell sorting or magnetic affinity reagent techniques or some other technique. Synovial specimens and blood can be obtained from the same patient and gene expression can be compared between these 2 sample types.

Osteoarthritis

20–40 million patients in the US have osteoarthritis. Patient groups are heterogeneous, with a subset of patients having earlier onset, more aggressive joint damage, involving more inflammation (leukocyte infiltration). Leukocyte diagnostics can be used to distinguish osteoarthritis from rheumatoid arthritis and other differntial diagnoses, define likelihood and degree of response to NSAID therapy (non-steroidal anti-inflammatory drugs) or other anti-inflammatory therapies. Rate of progression of joint damage can also be assessed. Diagnostic nucleotide sets may be developed for use in selection and titration of treatment therapies. Disease criteria correspond to response to therapy, and disease progression using certain therapies, response to medications, need for joint surgery, joint pain and disability.

In addition to peripheral leukocytes, surgical specimens of osteoarthritic joints can be used for leukocyte expression profiling experiments. Diagnostic oligonucleotides and diagnostic oligonucleotide sets are candidates for leukocyte target nucleotide sequences, e.g. as a candidate drug target for osteoarthritis. Synovial specimens can be used for expression profiling or cells derived and sorted from that tissue (such as subsets of leukocytes) can be used. Cells can be separated by fluorescence activated cell sorting or magnetic affinity reagent techniques or some other technique. Synovial specimens and blood can be obtained from the same patient and gene expression can be compared between these 2 sample types.

In another example, diagnostic nucleotide sets ate developed and validated for use in diagnosis and therapy of peri-prosthetic osteolysis. In this disease, a prosthetic joint such as a knee or hip is found to loosen over time and requires repeat surgery. Loosening may occur in some patients due to an inflammatory response incited by the foreign material of the prosthesis. Disease criteria include joint loosening, radiographic evidence of peri-prosthetic osteolysis, need for repeat surgery, response to pharmacological therapy, and/or histological (from biopsy or surgery) or biochemical (markers of bone metabolism such as alkaline phosphatase) evidence of osteolysis. Tissues used for expression profiling can include peripheral leukocytes or leukocyte subsets, periprosthetic tissue, or synovial fluid. In addition, gene sets can be discovered using an in vitromodel of the disease in which immune cells are exposed to prosthesis materials such as cement or titanium.

Pharmacogenomics

Pharmacogenomics is the study of the individual propensity to respond to a particular drug therapy (combination of therapies). In this context, response can mean whether a particular drug will work on a particular patient, e.g. some patients respond to one drug but not to another drug. Response can also refer to the likelihood of successful treatment or the assessment of progress in treatment. Titration of drug therapy to a particular patient is also included in this description, e.g. different patients can respond to different doses of a given medication. This aspect may be important when drugs with side-effects or interactions with other drug therapies are contemplated.

Diagnostic oligonucleotides and oligonucleotide sets are developed and validated for use in assessing whether a patient will respond to a particular therapy and/or monitoring response of a patient to drug therapy(therapies). Disease criteria correspond to presence or absence of clinical symptoms or clinical endpoints, presence of side-effects or interaction with other drug(s). The diagnostic nucleotide set may further comprise nucleotide sequences that are targets of drug treatment or markers of active disease.

Diagnostic oligonucleotides and oligonucleotide sets are developed and validated for use in assessing whether a patient has a particular drug toxicity or toxicity due to an environmental, work-related or other agent. Such exposures of the patient may also be related to biological or biochemical agents used in warfare. Diagnostic oligonucleotides and oligonucleotide sets may allow early diagnosis of a toxicity or exposure or may monitor the severity and course of toxic responses.

Methods of Using Diagnostic Oligonucleotides and Oligonucleotide Sets.

The invention also provide methods of using the diagnostic oligonucleotides and oligonucleotide sets to: diagnose or monitor disease; assess severity of disease; predict future occurrence of disease; predict future complications of disease; determine disease prognosis; evaluate the patient's risk, or "stratify" a group of patients; assess response to current drug therapy; assess response to current non-pharmacological therapy; determine the most appropriate medication or treatment for the patient; predict whether a patient is likely to respond to a particular drug; and determine most appropriate additional diagnostic testing for the patient, among other clinically and epidemiologically relevant applications.

The oligonucleotides and oligonucleotide sets of the invention can be utilized for a variety of purposes by physicians, healthcare workers, hospitals, laboratories, patients, companies and other institutions. As indicated previously, essentially any disease, condition, or status for which at least one nucleotide sequence is differentially expressed in leukocyte populations (or sub-populations) can be evaluated, e.g., diagnosed, monitored, etc. using the diagnostic nucleotide sets and methods of the invention. In addition to assessing health status at an individual level, the diagnostic nucleotide sets of the present invention are suitable for evaluating subjects at a "population level," e.g., for epidemiological studies, or for population screening for a condition or disease.

Collection and Preparation of Sample

RNA, protein and/or DNA are prepared using methods well-known in the art, as further described herein. It is appreciated that subject samples collected for use in the methods of the invention are generally collected in a clinical setting, where delays may be introduced before RNA samples are prepared from the subject samples of whole blood, e.g. the blood sample may not be promptly delivered to the clinical lab for further processing. Further delay may be introduced in the clinical lab setting where multiple samples are generally being processed at any given time. For this reason, methods that feature lengthy incubations of intact leukocytes at room temperature are not preferred, because the expression profile of the leukocytes may change during this extended time period. For example, RNA can be isolated from whole blood using a phenol/guanidine isothiocyanate reagent or another direct whole-blood lysis method, as described in, e.g., U.S. Pat. Nos. 5,346,994 and 4,843,155. This method may be less preferred under certain circumstances because the large majority of the RNA recovered from whole blood RNA extraction comes from erythrocytes since these cells outnumber leukocytes 1000:1. Care must be taken to ensure that the presence of erythrocyte RNA and protein does not introduce bias in the RNA expression profile data or lead to inadequate sensitivity or specificity of probes.

Alternatively, intact leukocytes may be collected from whole blood using a lysis buffer that selectively lyses erythrocytes, but not leukocytes, as described, e.g., in (U.S. Pat. Nos. 5,973,137, and 6,020,186). Intact leukocytes are then collected by centrifugation, and leukocyte RNA is isolated using standard protocols, as described herein. However, this method does not allow isolation of sub-populations of leukocytes, e.g. mononuclear cells, which may be desired. In addition, the expression profile may change during the lengthy incubation in lysis buffer, especially in a busy clinical lab where large numbers of samples are being prepared at any given time.

Alternatively, specific leukocyte cell types can be separated using density gradient reagents (Boyum, A, 1968.). For example, mononuclear cells may be separated from whole blood using density gradient centrifugation, as described, e.g., in U.S. Pat. Nos. 4,190,535, 4,350,593, 4751001, 4818418, and 5053134. Blood is drawn directly into a tube containing an anticoagulant and a density reagent (such as Ficoll or Percoll). Centrifugation of this tube results in separation of blood into an erythrocyte and granulocyte layer, a mononuclear cell suspension, and a plasma layer. The mononuclear cell layer is easily removed and the cells can be collected by centrifugation, lysed, and frozen. Frozen samples are stable until RNA can be isolated. Density centrifugation, however, must be conducted at room temperature, and if processing is unduly lengthy, such as in a busy clinical lab, the expression profile may change.

The quality and quantity of each clinical RNA sample is desirably checked before amplification and labeling for array hybridization, using methods known in the art. For example, one microliter of each sample may be analyzed on a Bioanalyzer (Agilent 2100 Palo Alto, Calif. USA) using an RNA 6000 nano LabChip (Caliper, Mountain View, Calif. USA). Degraded RNA is identified by the reduction of the 28S to 18S ribosomal RNA ratio and/or the presence of large quantities of RNA in the 25–100 nucleotide range.

It is appreciated that the RNA sample for use with a diagnostic oligonucleotide or oligonucleotide set may be produced from the same or a different cell population, sub-population and/or cell type as used to identify the diagnostic nucleotide set. For example, a diagnostic oligonucleotide or oligonucleotide set identified using RNA extracted from mononuclear cells may be suitable for analysis of RNA extracted from whole blood or mononuclear cells, depending on the particular characteristics of the members of the diagnostic nucleotide set. Generally, diagnostic oligonucleotides or oligonucleotide sets must be tested and validated when used with RNA derived from a different cell population, sub-population or cell type than that used when obtaining the diagnostic gene set. Factors such as the cell-specific gene expression of diagnostic nucleotide set members, redundancy of the information provided by members of the diagnostic nucleotide set, expression level of the member of the diagnostic nucleotide set, and cell-specific alteration of expression of a member of the diagnostic nucleotide set will contribute to the usefullness of a different RNA source than that used when identifying the members of the diagnostic nucleotide set. It is appreciated that it may be desirable to assay RNA derived from whole blood, obviating the need to isolate particular cell types from the blood.

Assessing Expression for Diagnostics

Expression profiles for the oligonucleotides or the set of diagnostic oligonucleotide sequences in a subject sample can be evaluated by any technique that determines the expression of each component oligonucleotide sequence. Methods suitable for expression analysis are known in the art, and numerous examples are discussed in the Sections titled "Methods of obtaining expression data" and "high throughput expression Assays", above.

In many cases, evaluation of expression profiles is most efficiently, and cost effectively, performed by analyzing RNA expression. Alternatively, the proteins encoded by each component of the diagnostic nucleotide set are detected for diagnostic purposes by any technique capable of determining protein expression, e.g., as described above. Expression profiles can be assessed in subject leukocyte sample using the same or different techniques as those used to identify and validate the diagnostic oligonucleotide or oligonucleotide set. For example, a diagnostic nucleotide set identified as a subset of sequences on a cDNA microarray can be utilized for diagnostic (or prognostic, or monitoring, etc.) purposes on the same array from which they were identified. Alternatively, the diagnostic nucleotide sets for a given disease or condition can be organized onto a dedicated sub-array for the indicated purpose. It is important to note that if diagnostic nucleotide sets are discovered using one technology, e.g. RNA expression profiling, but applied as a diagnostic using another technology, e.g. protein expression profiling, the nucleotide (or gene, or protein) sets must generally be validated for diagnostic purposes with the new technology. In addition, it is appreciated that diagnostic nucleotide sets that are developed for one use, e.g. to diagnose a particular disease, may later be found to be useful for a different application, e.g. to predict the likelihood that the particular disease will occur. Generally, the diagnostic nucleotide set will need to be validated for use in the second circumstance. As discussed herein, the sequence of diagnostic nucleotide set members may be amplified from RNA or cDNA using methods known in the art providing specific amplification of the nucleotide sequences.

Identification of Novel Nucleotide Sequences that are Differentially Expressed in Leukocytes Novel nucleotide sequences that are differentially expressed in leukocytes are also part of the invention. Previously unidentified open reading frames maybe identified in a library of differentially expressed candidate nucleotide sequences, as described above, and the DNA and predicted protein sequence may be identified and characterized as noted above. We identified unnamed (not previously described as corresponding to a gene, or an expressed gene) nucleotide sequences in our candidate nucleotide library, depicted in Table 3A, 3B AND 3C and the sequence listing. Accordingly, further embodiments of the invention are the isolated nucleic acids described in Tables 3A and 3B AND 3C and in the sequence listing. The novel differentially expressed nucleotide sequences of the invention are useful in the diagnostic nucleotide set of the invention described above, and are further useful as members of a diagnostic nucleotide set immobilized on an array. The novel partial nucleotide sequences may be further characterized using sequence tools and publically or privately accessible sequence databases, as is well known in the art: Novel differentially expressed nucleotide sequences may be identified as disease target nucleotide sequences, described below. Novel nucleotide sequences may also be used as imaging reagent, as further described below.

As used herein, "novel nucleotide sequence" refers to (a) a nucleotide sequence containing at least one of the DNA sequences disclosed herein (as shown in FIGS. Table 3A, 3B a nd the sequence listing); (b) a any DNA sequence that encodes the amino acid sequence encoded by the DNA sequences disclosed herein; (c) any DNA sequence that hybridizes to the complement of the coding sequences disclosed herein, contained within the coding region of the nucleotide sequence to which the DNA sequences disclosed herein (as shown in Table 3A, 3B AND 3C and the sequence listing) belong, under highly stringent conditions, e.g., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C. (Ausubel F. M. et al., eds., 1989, Current Protocols in Molecular Biology, Vol. I, Green Publishing Associates, Inc., and John Wiley & sons, Inc., New York, at p. 2.10.3), (d) any DNA sequence that hybridizes to the complement of the coding sequences disclosed herein, (as shown in Table 3A, 3B AND 3C and the sequence listing) contained within the coding region of the nucleotide sequence to which DNA sequences disclosed herein (as shown in TABLES 3A, 3B and the sequence listing) belong, under less stringent conditions, such as moderately stringent conditions, e.g., washing in 0.2×SSC/ 0.1% SDS at 42° C. (Ausubel et al., 1989, supra), yet which still encodes a functionally equivalent gene product; and/or (e) any DNA sequence that is at least 90% identical, at least 80% identical or at least 70% identical to the coding sequences disclosed herein (as shown in TABLES 3A, 3B AND 3C and the sequence listing), wherein % identity is determined using standard algorithms known in the art.

The invention also includes nucleic acid molecules, preferably DNA molecules, that hybridize to, and are therefore the complements of, the DNA sequences (a) through (c), in the preceding paragraph. Such hybridization conditions may be highly stringent or less highly stringent, as described above. In instances wherein the nucleic acid molecules are deoxyoligonucleotides ("oligos"), highly stringent conditions may refer, e.g., to washing in 6×SSC/0.05% sodium pyrophosphate at 37° C. (for 14-base oligos), 48° C. (for 17-base oligos), 55° C. (for 20-base oligos), and 60° C. (for 23-base oligos). These nucleic acid molecules may act as target nucleotide sequence antisense molecules, useful, for example, in target nucleotide sequence regulation and/or as antisense primers in amplification reactions of target nucleotide sequence nucleic acid sequences. Further, such sequences may be used as part of ribozyme and/or triple helix sequences, also useful for target nucleotide sequence regulation. Still further, such molecules may be used as components of diagnostic methods whereby the presence of a disease-causing allele, may be detected.

The Invention Also Encompasses Nucleic Acid Molecules Contained in Full-Length Gene Sequences That Are Related to Or Derived From Sequences In Tables 2, 3, 8–10 and the Sequence Listing. One Sequence May Map to More Than One Full-Length Gene.

The invention also encompasses (a) DNA vectors that contain any of the foregoing coding sequences and/or their complements (i.e., antisense); (b) DNA expression vectors that contain any of the foregoing coding sequences operatively associated with a regulatory element that directs the expression of the coding sequences; and (c) genetically engineered host cells that contain any of the foregoing coding sequences operatively associated with a regulatory element that directs the expression of the coding sequences in the host cell. As used herein, regulatory elements include but are not limited to inducible and non-inducible promoters, enhancers, operators and other elements known to those skilled in the art that drive and regulate expression. The invention includes fragments of any of the DNA sequences disclosed herein. Fragments of the DNA sequences may be at least 5, at least 10, at least 15, at least 19 nucleotides, at least 25 nucleotides, at least 50 nucleotides, at least 100 nucleotides, at least 200, at least 500, or larger.

In addition to the oligonucleotide sequences described above, homologues and orthologs of such sequences, as may, for example be present in other species, may be identified and may be readily isolated, without undue experimentation, by molecular biological techniques well known in the art, as well as use of gene analysis tools described above, and e.g., in Example 4. Further, there may exist nucleotide sequences at other genetic loci within the genome that encode proteins, which have extensive homology to one or more domains of such gene products. These nucleotide sequences may also be identified via similar techniques.

For example, the isolated differentially expressed nucleotide sequence may be labeled and used to screen a cDNA library constructed from mRNA obtained from the organism of interest. Hybridization conditions will be of a lower stringency when the cDNA library was derived from an organism different from the type of organism from which the labeled sequence was derived. Alternatively, the labeled fragment may be used to screen a genomic library derived from the organism of interest, again, using appropriately stringent conditions. Such low stringency conditions will be well known to those of skill in the art, and will vary predictably depending on the specific organisms from which the library and the labeled sequences are derived. For guidance regarding such conditions see, for example, Sambrook et al., 1989, Molecular Cloning, A Laboratory Manual, Cold Springs Harbor Press, N.Y.; and Ausubel et al., 1989, Current Protocols in Molecular Biology, Green Publishing Associates and Wiley Interscience, N.Y.

Protein Products

Novel nucleotide products include those proteins encoded by the novel nucleotide sequences described, above. Specifically, novel gene products may include polypeptides encoded by the novel nucleotide sequences contained in the coding regions of the nucleotide sequences to which DNA sequences disclosed herein (in TABLES 3A, 3B and the sequence listing).

In addition, novel protein products of novel nucleotide sequences may include proteins that represent functionally equivalent gene products. Such an equivalent novel gene product may contain deletions, additions or substitutions of amino acid residues within the amino acid sequence encoded by the novel nucleotide sequences described, above, but which result in a silent change, thus producing a functionally equivalent novel nucleotide sequence product. Amino acid substitutions may be made on the basis of similarity in polarity, charge, solubility, hydrophobicity, hydrophilicity, and/or the amphipathic nature of the residues involved.

For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Functionally equivalent", as utilized herein, refers to a protein capable of exhibiting a substantially similar in vivo activity as the endogenous novel gene products encoded by the novel nucleotide described, above.

The novel gene products (protein products of the novel nucleotide sequences) may be produced by recombinant DNA technology using techniques well known in the art. Methods which are well known to those skilled in the art can be used to construct expression vectors containing novel nucleotide sequence protein coding sequences and appropriate transcriptional/translational control signals. These methods include, for example, in vitro recombinant DNA techniques, synthetic techniques and in vivo recombination/genetic recombination. See, for example, the techniques described in Sambrook et al., 1989, supra, and Ausubel et al., 1989, supra. Alternatively, RNA capable of encoding novel nucleotide sequence protein sequences may be chemically synthesized using, for example, synthesizers. See, for example, the techniques described in "Oligonucleotide Synthesis", 1984, Gait, M. J. ed., IRL Press, Oxford, which is incorporated by reference herein in its entirety. A variety of host-expression vector systems may be utilized to express the novel nucleotide sequence coding sequences of the invention. (Ruther et al., 1983, EMBO J. 2:1791; Inouyc & Inouye, 1985, Nucleic Acids Res. 13:3101–3109; Van Heeke & Schuster, 1989, J. Biol. Chem. 264:5503; Smith et al., 1983, *J. Virol.* 46: 584; Smith, U.S. Pat. No. 4,215,051; Logan & Shenk, 1984, Proc. Natl. Acad. Sci. USA 81:3655–3659; Bittner et al., 1987, Methods in Enzymol. 153:516–544; Wigler, et al., 1977, Cell 11:223; Szybalska & Szybalski, 1962, Proc. Natl. Acad. Sci. USA 48:2026; Lowy, et al., 1980, *Cell* 22:817; Wigler, et al., 1980, Natl. Acad. Sci. USA 77:3567; O'Hare, et al., 1981, Proc. Natl. Acad. Sci. USA 78:1527; Mulligan & Berg, 1981, Proc. Natl. Acad. Sci. USA 78:2072; Colberre-Garapin, et al., 1981, J. Mol. Biol. 150:1; Santerre, et al., 1984, Gene 30:147; Janknecht, et al., 1991, Proc. Natl. Acad. Sci. USA 88: 8972–8976

Where recombinant DNA technology is used to produce the protein encoded by the novel nucleotide sequence for such assay systems, it may be advantageous to engineer fusion proteins that can facilitate labeling, immobilization and/or detection.

Indirect labeling involves the use of a protein, such as a labeled antibody, which specifically binds to the protein encoded by the novel nucleotide sequence. Such antibodies include but are not limited to polyclonal, monoclonal, chimeric, single chain, Fab fragments and fragments produced by an Fab expression library.

Antibodies

The invention also provides for antibodies to the protein encoded by the novel nucleotide sequences. Described herein are methods for the production of antibodies capable of specifically recognizing one or more novel nucleotide sequence epitopes. Such antibodies may include, but are not limited to polyclonal antibodies, monoclonal antibodies (mAbs), humanized or chimeric antibodies, single chain antibodies, Fab fragments, F(ab')2 fragments, fragments produced by a Fab expression library, anti-idiotypic (anti-Id) antibodies, and epitope-binding fragments of any of the above. Such antibodies may be used, for example, in the detection of a novel nucleotide sequence in a biological sample, or, alternatively, as a method for the inhibition of abnormal gene activity, for example, the inhibition of a disease target nucleotide sequence, as further described below. Thus, such antibodies may be utilized as part of cardiovascular or other disease treatment method, and/or may be used as part of diagnostic techniques whereby patients may be tested for abnormal levels of novel nucleotide sequence encoded proteins, or for the presence of abnormal forms of the such proteins.

For the production of antibodies to a novel nucleotide sequence, various host animals may be immunized by injection with a novel protein encoded by the novel nucleotide sequence, or a portion thereof. Such host animals may include but are not limited to rabbits, mice, and rats, to name but a few. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacille Calmette-Guerin) and *Corynebacterium parvum.*

Polyclonal antibodies are heterogeneous populations of antibody molecules derived from the sera of animals immunized with an antigen, such as novel gene product, or an antigenic functional derivative thereof. For the production of polyclonal antibodies, host animals such as those described above, may be immunized by injection with novel gene product supplemented with adjuvants as also described above.

Monoclonal antibodies, which are homogeneous populations of antibodies to a particular antigen, may be obtained by any technique which provides for the production of antibody molecules by continuous cell lines in culture. These include, but are not limited to the hybridoma technique of Kohler and Milstein, (1975, Nature 256:495–497; and U.S. Pat. No. 4,376,110), the human B-cell hybridoma technique (Kosbor et al., 1983, Immunology Today 4:72; Cole et al., 1983, Proc. Natl. Acad. Sci. USA 80:2026–2030), and the EBV-hybridoma technique (Cole et al., 1985, Monoclonal Antibodies And Cancer Therapy, Alan R. Liss, Inc., pp. 77–96). Such antibodies may be of any immunoglobulin class including IgG, IgM, IgE, IgA, IgD and any subclass thereof. The hybridoma producing the mAb of this invention may be cultivated in vitro or in vivo.

In addition, techniques developed for the production of "chimeric antibodies" (Morrison et al., 1984, Proc. Natl. Acad. Sci., 81:6851–6855; Neuberger et al., 1984, Nature, 312:604–608; Takeda et al., 1985, Nature, 314:452–454) by splicing the genes from a mouse antibody molecule of appropriate antigen specificity together with genes from a human antibody molecule of appropriate biological activity can be used. A chimeric antibody is a molecule in which different portions are derived from different animal species, such as those having a variable region derived from a murine mAb and a human immunoglobulin constant region.

Alternatively, techniques described for the production of single chain antibodies (U.S. Pat. No. 4,946,778; Bird, 1988, Science 242:423–426; Huston et al., 1988, Proc. Natl. Acad. Sci. USA 85:5879–5883; and Ward et al., 1989, Nature 334:544–546) can be adapted to produce novel nucleotide sequence-single chain antibodies. Single chain antibodies are formed by linking the heavy and light chain fragments of the Fv region via an amino acid bridge, resulting in a single chain polypeptide.

Antibody fragments which recognize specific epitopes may be generated by known techniques For example, such fragments include but are not limited to: the F(ab')2 fragments which can be produced by pepsin digestion of the antibody molecule and the Fab fragments which can be generated by reducing the disulfide bridges of the F(ab')2 fragments. Alternatively, Fab expression libraries may be constructed (Huse et al., 1989, Science, 246:1275–1281) to allow rapid and easy identification of monoclonal Fab fragments with the desired specificity.

Disease Specific Target Oligonucleotide Sequences

The invention also provides disease specific target oligonucleotide sequences, and sets of disease specific target oligonucleotide sequences. The diagnostic oligonucleotide sets, subsets thereof, novel oligonucleotide sequences, and individual members of the diagnostic oligonucleotide sets identified as described above are also disease specific target oligonucleotide sequences. In particular, individual oligonucleotide sequences that are differentially regulated or have predictive value that is strongly correlated with a disease or disease criterion are especially favorable as disease specific target oligonucleotide sequences. Sets of genes that are co-regulated may also be identified as disease specific target oligonucleotide sets. Such oligonucleotide sequences and/or oligonucleotide sequence products are targets for modulation by a variety of agents and techniques. For example, disease specific target oligonucleotide sequences (or the products of such oligonucleotide sequences, or sets of disease specific target oligonucleotide sequences) can be inhibited or activated by, e.g., target specific monoclonal antibodies or small molecule inhibitors, or delivery of the oligonucleotide sequence or gene product of the oligonucleotide sequence to patients. Also, sets of genes can be inhibited or activated by a variety of agents and techniques. The specific usefulness of the target oligonucleotide sequence(s) depends on the subject groups from which they were discovered, and the disease or disease criterion with which they correlate.

Kits

The present invention is optionally provided to a user as a kit. Typically, a kit contains one or more diagnostic nucleotide sets of the invention. Alternatively, the kit contains the candidate nucleotide library of the invention. Most often, the kit contains a diagnostic nucleotide probe set, or other subset of a candidate library, (e.g., as a cDNA, oligonucleotide or antibody microarray or reagents for performing an assay on a diagnostic gene set using any expression profiling technology), packaged in a suitable container. The kit may further comprise, one or more additional reagents, e.g., substrates, labels, primers, for labeling expression products, tubes and/or other accessories, reagents for collecting blood samples, buffers, e.g., erythrocyte lysis buffer, leukocyte lysis buffer, hybridization chambers, cover slips, etc., as well as a software package, e.g., including the statistical methods of the invention, e.g., as described above, and a password and/or account number for accessing the compiled database. The kit optionally further comprises an instruction set or user manual detailing preferred methods of using the diagnostic nucleotide sets in the methods of the invention.

This invention will be better understood by reference to the following non-limiting Examples:
Examples
Example 1: Generation of subtracted leukocyte candidate nucleotide library
Example 2: Identification of nucleotide sequences for candidate library using data mining techniques
Example 3: DNA Sequencing and Processing of raw sequence data
Example 4: Further sequence analysis of novel nucleotide sequences identified by subtractive hybridization screening
Example 5: Further sequence analysis of novel Clone 596H6
Example 6: Further sequence analysis of novel Clone 486E11
Example 7: Preparation of RNA from mononuclear cells for expression profiling
Example 8: Preparation of Universal Control RNA for use in leukocyte expression profiling
Example 9: Identification of diagnostic oligonucleotide sets for use in diagnosis of rheumatoid arthritis
Example 10: Identification of diagnostic oligonucleotide sets for diagnosis of Systemic Lupus Erythematosis
Example 11: Probe selection for a 24,000 feature Array.
Example 12: Design of oligonucleotide probes
Example 13: Production of an array of 8,000 spotted 50 mer oligonucleotides.
Example 14: Amplification, labeling and hybridization of total RNA to an oligonucleotide microarray
Example 15: Real-time PCR validation of array expression results
Example 16: Correlation and classification analysis

EXAMPLES

Example 1

Generation of Subtracted Leukocyte Candidate Nucleotide Library

To produce a candidate nucleotide library with representatives from the spectrum of nucleotide sequences that are differentially expressed in leukocytes, subtracted hybridization libraries were produced from the following cell types and conditions:

1. Buffy Coat leukocyte fractions—stimulated with ionomycin and PMA
2. Buffy Coat leukocyte fractions—un-stimulated
3. Peripheral blood mononuclear cells stimulated with ionomycin and PMA
4. Peripheral blood mononuclear cells—un-stimulated
5. T lymphocytes—stimulated with PMA and ionomycin
6. T lymphocytes—resting Cells were obtained from multiple individuals to avoid introduction of bias by using only one person as a cell source.

Buffy coats (platelets and leukocytes that are isolated from whole blood) were purchased from Stanford Medical School Blood Center. Four buffy coats were used, each of which was derived from about 350 ml of whole blood from one donor individual 10 ml of buffy coat sample was drawn from the sample bag using a needle and syringe. 40 ml of Buffer EL (Qiagen) was added per 10 ml of buffy coat to lyse red blood cells. The sample was placed on ice for 15 minutes, and cells were collected by centrifugation at 2000 rpm for 10 minutes. The supernatant was decanted and the cell pellet was re-suspended in leukocyte growth media supplemented with DNase (LGM-3 from Clonetics supplemented with Dnase at a final concentration of 30 U/ml). Cell density was determined using a hemocytometer. Cells were plated in media at a density of $1 \times 10^6$ cells/ml in a total volume of 30 ml in a T-75 flask (Corning). Half of the cells were stimulated with ionomycin and phorbol myristate acetate (PMA) at a final concentration of 1 $\mu$g/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm for 10 minutes and the supernatant was removed. Cells were lysed in 6 ml of phenol/guanidine isothyocyanate (Trizol reagent, GibcoBRL), homogenized using a rotary homogenizer, and frozen at 80°. Total RNA and mRNA were isolated as described below.

Two frozen vials of $5 \times 10^6$ pooled human peripheral blood mononuclear cells (PBMCs) were purchased from Clonetics (catalog number cc-2702). The cells were rapidly thawed in a 37° C. water bath and transferred to a 15 ml tube containing 10 ml of leukocyte growth media supplemented with DNase (prepared as described above). Cells were centrifuged at 200 $\mu$g for 10 minutes. The supernatant was removed and the cell pellet was resuspended in LGM-3 media supplemented with DNase. Cell density was determined using a hemocytometer. Cells were plated at a density of $1 \times 10^6$ cells/ml in a total volume of 30 ml in a T-75 flask (Corning). Half of the cells were stimulated with ionomycin and PMA at a final concentration of 1 $\mu$g/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm and the supernatant was removed. Cells were lysed in 6 ml of phenol/guanidine isothyocyanate solution (TRIZOL reagent, GibcoBRL)), homogenized using a rotary homogenizer, and frozen at 80°. Total RNA and mRNA were isolated from these samples using the protocol described below.

45 ml of whole blood was drawn from a peripheral vein of four healthy human subjects into tubes containing anticoagulant. 50 $\mu$l RosetteSep (Stem Cell Technologies) T-cell isolation cocktail per ml of blood was added, mixed well, and incubated for 20 minutes at room temperature. The mixture was diluted with an equal volume of PBS+2% fetal bovine serum (FBS) and mixed by inversion. 30 ml of diluted mixture sample was layered on top of 15 ml DML medium (Stem Cell Technologies). The sample tube was centrifuged for 20 minutes at 1200×g at room temperature. The enriched T-lymphocyte cell layer at the plasma: medium interface was removed. Enriched cells were washed with PBS+2% FBS and centrifuged at 1200×g. The cell pellet was treated with 5 ml of erythrocyte lysis buffer (EL buffer, Qiagen) for 10 minutes on ice. The sample was centrifuged for 5 min at 1200 g. Cells were plated at a density of $1 \times 10^6$ cells/ml in a total volume of 30 ml in a T-75 flask (Corning). Half of the cells were stimulated with ionomycin and PMA at a final concentration of 1 $\mu$g/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm and the supernatant was removed. Cells were lysed in 6 ml of phenol/guanidine isothyocyanate solution (TRIZOL reagent, GibcoBRL), homogenized using a rotary homogenizer, and frozen at 80°. Total RNA and mRNA were isolated as described below.

Total RNA and mRNA were isolated using the following procedure: the homogenized samples were thawed and mixed by vortexing. Samples were lysed in a 1:0.2 mixture of Trizol and chloroform, respectively. For some samples, 6 ml of Trizol-chloroform was added. Variable amounts of Trizol-chloroform was added to other samples. Following lysis, samples were centrifuged at 3000 g for 15 min at 4° C. The aqueous layer was removed into a clean tube and 4 volumes of Buffer RLT Qiagen) was added for every volume of aqueous layer. The samples were mixed thoroughly and total RNA was prepared from the sample by following the Qiagen Rneasy midi protocol for RNA cleanup (October 1999 protocol, Qiagen). For the final step, the RNA was eluted from the column twice with 250 $\mu$l Rnase-free water. Total RNA was quantified using a spectrophotometer. Isolation of mRNA from total RNA sample was done using The Oligotex mRNA isolation protocol (Qiagen) was used to isolate mRNA from total RNA, according to the manufacturer's instructions (Qiagen, 7/99 version). mRNA was quantified by spectrophotometry.

Subtracted cDNA libraries were prepared using Clontech's PCR-Select cDNA Subtraction Kit (protocol number PT-1117-1) as described in the manufacturer's protocol. The protocol calls for two sources of RNA per library, designated "Driver" and "Tester." The following 6 libraries were made:

| Library | Driver RNA | Tester RNA |
|---|---|---|
| Buffy Coat Stimulated | Un-stimulated Buffy Coat | Stimulated Buffy Coat |
| Buffy Coat Resting | Stimulated Buffy Coat | Un-stimulated Buffy Coat |
| PBMC Stimulated | Un-stimulated PBMCs | Stimulated PBMCs |
| PBMC Resting | Stimulated PBMCs | Un-stimulated PBMCs |
| T-cell Stimulated | Un-stimulated T-cells | Stimulated T-cells |
| T-cell Resting | Stimulated T-cells | Un-stimulated T-cells |

The Clontech protocol results in the PCR amplification of cDNA products. The PCR products of the subtraction protocol were ligated to the pGEM T-easy bacterial vector as described by the vector manufacturer (Promega 6/99 version). Ligated vector was transformed into competent bacteria using well-known techniques, plated, and individual clones are picked, grown and stored as a glycerol stock at -80C. Plasmid DNA was isolated from these bacteria by standard techniques and used for sequence analysis of the insert. Unique cDNA sequences were searched in the Unigene database (build 133), and Unigene cluster numbers were identified that corresponded to the DNA sequence of the cDNA. Unigene cluster numbers were recorded in an Excel spreadsheet.

Example 2

Identification of Nucleotide Sequences for Candidate Library Using Data Mining Techniques Existing and publicly available gene sequence databases were used to identify candidate nucleotide sequences for leukocyte expression profiling. Genes and nucleotide sequences with specific expression in leukocytes, for example, lineage specific markers, or known differential expression in resting or activated leukocytes were identified. Such nucleotide sequences are used in a leukocyte candidate nucleotide library, alone or in combination with nucleotide sequences isolated through cDNA library construction, as described above.

Leukocyte candidate nucleotide sequences were identified using three primary methods. First, the publically accessible publication database PubMed was searched to identify nucleotide sequences with known specific or differential expression in leukocytes. Nucleotide sequences were identified that have been demonstrated to have differential expression in peripheral blood leukocytes between subjects with and without particular disease(s) selected from Table 1. Additionally, genes and gene sequences that were known to be specific or selective for leukocytes or sub-populations of leukocytes were identified in this way.

Next, two publicly available databases of DNA sequences, Unigene located on the website at ncbi.nlm.nih.gov/UniGene and BodyMap located on the website at bodymap.ims.u-tokyo.ac.jp, were searched for sequenced DNA clones that showed specificity to leukocyte lineages, or subsets of leukocytes, or resting or activated leukocytes.

The human Unigene database (build 133) was used to identify leukocyte candidate nucleotide sequences that were likely to be highly or exclusively expressed in leukocytes. We used the Library Differential Display utility of Unigene located on the website at ncbi.nlm.nih.gov/UniGene/info/ddd.html, which uses statistical methods (The Fisher Exact Test) to identify nucleotide sequences that have relative specificity for a chosen library or group of libraries relative to each other. We compared the following human libraries from Unigene release 133:

546 NCI_CGAP_HSCI (399)
848 Human_mRNA_from_cd34+_stem_cells (122)
105 CD34+DIRECTIONAL (150)
3587 KRIBB_Human_CD4_intrathymic_T-cell-cDNA_library (134)
3586 KRIBB_Human_DP_intrathymic_T-cell_cDNA_library (179)
3585 KRIBB_Human_TN_intrathymic-T-cell_cDNA_library (127) 3586 323 Activated_T-cells_I (740)
376 Activated_T-cells_XX (1727)
327 Monocytes,_stimulated_II (110)
Proliferating_Erythroid_Cells_(LCB:ad_library) (665)
825 429 Macrophage_II (105)
387 Macrophage_I (137)
669 NCI_CGAP_CLL1 (11626)
129 Human_White_blood_cells (922)
1400 NIH_MGC_2 (422)
55 Human_promyelocyte (1220)
1010 NCI_CGAP_CML1 (2541)
2217 NCI_CGAP_Sub7 (218)
1395 NCI_CGAP_Sub6 (2764)
4874 NIH_MGC_48 (2524)

Sequences from these libraries were compared to sequences from non-leukocyte derived libraries in the Unigene database to identify genes that had some specificity for the leukocyte-derived libraries.

BodyMap, like Unigene, contains cell-specific libraries that contain potentially useful information about genes that may serve as lineage-specific or leukocyte specific markers (Okubo et al. 1992). We compared three leukocyte specific libraries, Granulocyte, CD4 T cell, and CD8 T cell, with the other libraries. Nucleotide sequences that were found in one or more of the leukocyte-specific libraries, but absent in the others, were identified. Clones that were found exclusively in one of the three leukocyte libraries were also included in a list of nucleotide sequences that could serve as lineage-specific markers.

Next, the sequence of the nucleotide sequences identified in PubMed or BodyMap were searched in Unigene (version 133), and a human Unigene cluster number was identified for each nucleotide sequence. The cluster number was recorded in a Microsoft Excel™ spreadsheet, and a non-redundant list of these clones was made by sorting the clones by UniGene number, and removing all redundant clones using Microsoft Excel™ tools. The non-redundant list of UniGene cluster numbers was then compared to the UniGene cluster numbers of the cDNAs identified using subtractive cDNA hybridization, as described above in Example 1 (listed in Table 3 and the sequence listing). Only UniGene clusters that were not contained in the cDNA libraries were retained. Unigene clusters corresponding to 1911 candidate nucleotide sequences for leukocyte expression profiling were identified in this way and are listed in Table 3 and the sequence listing.

DNA clones corresponding to each UniGene cluster number are obtained in a variety of ways. First, a cDNA clone with identical sequence to part of, or all of the identified UniGene cluster is bought from a commercial vendor or obtained from the IMAGE consortium located on the web at image.llnl.gov/, the Integrated Molecular Analysis of Genomes and their Expression. Alternatively, PCR primers are designed to amplify and clone any portion of the nucleotide sequence from cDNA or genomic DNA using well-known techniques. Alternatively, the sequences of the identified UniGene clusters are used to design and synthesize oligonucleotide probes for use in oligonucleotide microarray based expression profiling.

Example 3

DNA Sequencing and Processing of Raw Sequence Data

Clones of differentially expressed cDNAs (identified by subtractive hybridization, described above) were sequenced on an MJ Research BaseStation™ slab gel based fluorescent detection system, using BigDye™ (Applied Biosystems, Foster City, Calif.) terminator chemistry was used (Heiner et al., Genome Res 1998 May;8(5):557–61).

The fluorescent profiles were analyzed using the Phred sequence analysis program (Ewing et al, (1998), Genome Research 8: 175–185). Analysis of each clone results in a one pass nucleotide sequence and a quality file containing a number for each base pair with a score based on the probability that the determined base is correct. Each of the sequence files and its respective quality files were initially combined into single fasta format (Pearson, W R. Methods Mol. Biol. 2000;132:185–219), multi-sequence file with the appropriate labels for each clone in the headers for subsequent automated analysis.

Initially, known sequences were analyzed by pair wise similarity searching using the blastn option of the blastall program obtained from the National Center for Biological Information, National Library of Medicine, National Institutes of Health (NCBI) to determine the quality score that produced accurate matching (Altschul SF,et al. J. Mol. Biol. 1990 Oct. 5;215(3):403–10.). Empirically, it was determined that a raw score of 8 was the minimum that contained useful information. Using a sliding window average for 16 base pairs, an average score was determined. The sequence was removed (trimmed) when the average score fell below 8. Maximum reads were 950 nucleotides long.

Next, the sequences were compared by similarity matching against a database file containing the flanking vector sequences used to clone the cDNA, using the blastall program with the blastn option. All regions of vector similarity were removed, or "trimmed" from the sequences of the clones using scripts in the GAWK programming language, a variation of AWK (Aho AV et al, The Awk Programming Language (Addison-Wesley, Reading Mass., 1988); Robbins, AD, "Effective AWK Programming" (Free Software Foundation, Boston Mass., 1997). It was found that the first 45 base pairs of all the sequences were related to vector; these sequences were also trimmed and thus removed from consideration. The remaining sequences were then compared against the NCBI vector database (Kitts, P. A. et al. National Center for Biological Information, National Library of Medicine, National Institutes of Health, Manuscript in preparation (2001) using blastall with the blastn option. Any vector sequences that were found were removed from the sequences.

Messenger RNA contains repetitive elements that are found in genomic DNA. These repetitive elements lead to false positive results in similarity searches of query mRNA sequences versus known mRNA and EST databases. Additionally, regions of low information content (long runs of the same nucleotide, for example) also result in false positive results. These regions were masked using the program RepeatMasker2 found on the website at repeatmasker.genome.washington.edu (Smit, AFA & Green, P "Repeat-Masker" at the website at genome.washington.edu/RM/RepeatMasker.html. The trimmed and masked files were then subjected to further sequence analysis.

Example 4

Further Sequence Analysis of Novel Nucleotide Sequences Identified by Subtractive Hybridization Screening cDNA sequences were further characterized using BLAST analysis. The BLASTN program was used to compare the sequence of the fragment to the UniGene, dbEST, and nr databases at NCBI (GenBank release 123.0; see Table 5). In the BLAST algorithm, the expect value for an alignment is used as the measure of its significance. First, the cDNA sequences were compared to sequences in Unigene on the web at ncbi.nlm.nih.gov/UniGene. If no alignments were found with an expect value less than $10^{-25}$, the sequence was compared to the sequences in the dbEST database using BLASTN. If no alignments were found with an expect value less than $10^{-25}$, the sequence was compared to sequences in the nr database.

The BLAST analysis produced the following categories of results: a) a significant match to a known or predicted human gene, b) a significant match to a nonhuman DNA sequence, such as vector DNA or *E. coli* DNA, c) a significant match to an unidentified GenBank entry (a sequence not previously identified or predicted to be an expressed sequence or a gene), such as a cDNA clone, mRNA, or cosmid, or d) no significant alignments. If a match to a known or predicted human gene was found, analysis of the known or predicted protein product was performed as described below. If a match to an unidentified GenBank entry was found, or if no significant alignments were found, the sequence was searched against all known sequences in the human genome database located on the web at ncbi.nlmm.nih.gov/genome/seq/page.cgi?F=HsBlast.html&&ORG=Hs, see Table 5.

If many unknown sequences were to be analyzed with BLASTN, the clustering algorithm CAP2 (Contig Assembly Program, version 2) was used to cluster them into longer, contiguous sequences before performing a BLAST search of the human genome. Sequences that can be grouped into contigs are likely to be cDNA from expressed genes rather than vector DNA, *E. coli* DNA or human chromosomal DNA from a noncoding region, any of which could have been incorporated into the library. Clustered sequences provide a longer query sequence for database comparisons with BLASTN, increasing the probability of finding a significant match to a known gene. When a significant alignment was found, further analysis of the putative gene was performed, as described below. Otherwise, the sequence of the original cDNA fragment or the CAP2 contig is used to design a probe for expression analysis and further approaches are taken to identify the gene or predicted gene that corresponds to the cDNA sequence, including similarity searches of other databases, molecular cloning, and Rapid Amplification of cDNA Ends (RACE).

In some cases, the process of analyzing many unknown sequences with BLASTN was automated by using the BLAST network-client program blastcl3, which was downloaded from ftp://ncbi.nlm.nih.gov/blast/network/netblast.

When a cDNA sequence aligned to the sequence of one or more chromosomes, a large piece of the genomic region around the loci was used to predict the gene containing the cDNA. To do this, the contig corresponding to the mapped locus, as assembled by the RefSeq project at NCBI, was downloaded and cropped to include the region of alignment plus 100,000 bases preceding it and 100,000 bases following it on the chromosome. The result was a segment 200 kb in length, plus the length of the alignment. This segment, designated a putative gene, was analyzed using an exon prediction algorithm to determine whether the alignment area of the unknown sequence was contained within a region predicted to be transcribed (see Table 6).

This putative gene was characterized as follows: all of the exons comprising the putative gene and the introns between them were taken as a unit by noting the residue numbers on the 200 kb+ segment that correspond to the first base of the first exon and the last base of the last exon, as given in the data returned by the exon prediction algorithm. The truncated sequence was compared to the UniGene, dbEST, and nr databases to search for alignments missed by searching with the initial fragment.

The predicted amino acid sequence of the gene was also analyzed. The peptide sequence of the gene predicted from the exons was used in conjunction with numerous software tools for protein analysis (see Table 7). These were used to classify or identify the peptide based on similarities to known proteins, as well as to predict physical, chemical, and biological properties of the peptides, including secondary and tertiary structure, flexibility, hydrophobicity, antigenicity (hydrophilicity), common domains and motifs, and localization within the cell or tissues. The peptide sequence was compared to protein databases, including SWISS-PROT, TrEMBL, GenPept, PDB, PIR, PROSITE, ProDom, PROSITE, Blocks, PRINTS, and Pfam, using BLASTP and other algorithms to detemine similarities to known proteins or protein subunits.

Example 5

Further Sequence Analysis of Novel Clone 596H6

The sequence of clone 596H6 is provided below

```
ACTATATTTA GGCACCACTG CCATAAACTA CCAAAAAAAA AATGTAATTC    50  (SEQ ID NO:8767)
CTAGAAGCTG TGAAGAATAG TAGTGTAGCT AAGCACGGTG TGTGGACAGT   100
GGGACATCTG CCACCTGCAG TAGGTCTCTG CACTCCCAAA AGCAAATTAC   150
```

```
                                -continued
ATTGGCTTGA ACTTCAGTAT GCCCGGTTCC ACCCTCCAGA AACTTTTGTG    200

TTCTTTGTAT AGAATTTAGG AACTTCTGAG GGCCACAAAT ACACACATTA    250

AAAAAGGTAG AATTTTTGAA GATAAGATTC TTCTAAAAAA GCTTCCCAAT    300

GCTTGAGTAG AAAGTATCAG TAGAGGTATC AAGGGAGGAG AGACTAGGTG    350

ACCACTAAAC TCCTTCAGAC TCTTAAAATT ACGATTCTTT TCTCAAAGGG    400

GAAGAACGTC AGTGCAGCGA TCCCTTCACC TTTAGCTAAA GAATTGGACT    450

GTGCTGCTCA AAATAAAGAT CAGTTGGAGG TANGATGTCC AAGACTGAAG    500

GTAAAGGACT AGTGCAAACT GAAAGTGATG GGGAAACAGA CCTACGTATG    550

GAAGCCATGT AGTGTTCTTC ACAGGCTGCT GTTGACTGAA ATTCCTATCC    600

TCAAATTACT CTAGACTGAA GCTGCTTCCC TTCAGTGAGC AGCCTCTCCT    650

TCCAAGATTC TGGAAAGCAC ACCTGACTCC AAACAAAGAC TTAGAGCCCT    700

GTGTCAGTGC TGCTGCTGCT TTTACCAGAT TCTCTAACCT TCCGGGTAGA    750

AGAG
```

This sequence was used as input for a series of BLASTN searches. First, it was used to search the UniGene database, build 132 located on the web at ncbi.nlm.nih.gov/BLAST. No alignments were found with an expect value less than the threshold value of $10^{-25}$. A BLASTN search of the database dbEST, release 041001, was then performed on the sequence and 21 alignments were found (http://www.ncbi.nlm.nih.gov/BLAST/). Ten of these had expect values less than $10^{-25}$, but all were matches to unidentified cDNA clones. Next, the sequence was used to run a BLASTN search of the nr database, release 123.0. No significant alignment to any sequence in nr was found. Finally, a BLASTN search of the human genome was performed on the sequence located on the web at ncbi.nlm.nih.gov/genome/seq/page.cgi?F=HsBlast.html&&ORG=Hs.

A single alignment to the genome was found on contig NT_004698.3 (e=0.0). The region of alignment on the contig was from base 1,821,298 to base 1,822,054, and this region was found to be mapped to chromosome 1, from base 105,552,694 to base 105,553,450. The sequence containing the aligned region, plus 100 kilobases on each side of the aligned region, was downloaded. Specifically, the sequence of chromosome 1 from base 105,452,694 to 105,653,450 was downloaded from the website at ncbi.nlm.nih.gov/cgi-bin/Entrez/seq_reg.cgi?chr=1&from=105452694&to=105653450.

This 200,757 bp segment of the chromosome was used to predict exons and their peptide products as follows. The sequence was used as input for the Genscan algorithm located on the web at genes.mit.edu/GENSCAN.html, using the following Genscan settings:

Organism: vertebrate
Suboptimal exon cutoff: 10.00 (no suboptimal exons)
Print options: Predicted CDS and peptides The region matching the sequence of clone 596H6 was known to span base numbers 100,001 to 100,757 of the input sequence. An exon was predicted by the algorithm, with a probability of 0.695, covering bases 100,601 to 101,094 (designated exon 4.14 of the fourth predicted gene). This exon was part of a predicted cistron that is 24,195 bp in length. The sequence corresponding to the cistron was noted and saved separately from the 200,757 bp segment. BLASTN searches of the Unigene, dbEST, and nr databases were performed on it.

At least 100 significant alignments to various regions of the sequence were found in the dbEST database, although most appeared to be redundant representations of a few exons. All matches were to unnamed cDNAs and mRNAs (unnamed cDNAs and mRNAs are cDNAs and mRNAs not previously identified, or shown to correspond to a known or predicted human gene) from various tissue types. Most aligned to a single region on the sequence and spanned 500 bp or less, but several consisted of five or six regions separated by gaps, suggesting the locations of exons in the gene. Several significant matches to entries in the UniGene database were found, as well, even after masking low-complexity regions and short repeats in the sequence. All matches were to unnamed cDNA clones.

At least 100 significant alignments were found in the nr database, as well. A similarity to hypothetical protein FLJ22457 (UniGene cluster Hs.238707) was found (e=0.0). The cDNA of this predicted protein has been isolated from B lymphocytes located on the web at ncbi.nlm.nih.gov/entrez/viewer.cgi?save=0&cmd=&cfm=on&f=1 &view=gp&txt=0&val=13637988.

Other significant alignments were to unnamed cDNAs and mRNAs.

Using Genscan, the following 730 residue peptide sequence was predicted from the putative gene:

```
MDGLGRRLRA SLRLKRGHGG HWRLNEMPYM KHEFDGGPPQ DNSGEALKEP     50  SEQ ID NO:8768

ERAQEHSLPN FAGGQHFFEY LLVVSLKKKR SEDDYEPIIT YQFPKRENLL    100

RGQQEEEERL LKAIPLFCFP DGNEWASLTE YPSLSCKTPG LLAALVVEKA    150
```

```
QPRTCCHASA PSAAPQARGP DAPSPAAGQA LPAGPGPRLP KVYCIISCIG  200

CFGLFSKILD EVEKRHQISM AVIYPFMQGL REAAFPAPGK TVTLKSFIPD  250

SGTEFISLTR PLDSHLEHVD FSSLLHCLSF EQILQIFASA VLERKIIFLA  300

EGLREEEKDV RDSTEVRGAG ECHGFQRKGN LGKQWGLCVE DSVKMGDNQR  350

GTSCSTLSQC IHAAAALLYP FSWAHTYIPV VPESLLATVC CPTPFMVGVQ  400

MRFQQEVMDS PMEEIQPQAE IKTVNPLGVY EERGPEKASL CLFQVLLVNL  450

CEGTFLMSVG DEKDILPPKL QDDILDSLGQ GINELKTAEQ INEHVSGPFV  500

QFFVKIVGHY ASYIKREANG QGHFQERSFC KALTSKTNRR FVKKFVKTQL  550

FSLFIQEAEK SKNPPAEVTQ VGNSSTCVVD TWLEAAATAL SHHYNIFNTE  600

HTLWSKGSAS LHEVCGHVRT RVKRKILFLY VSLAFTMGKS IFLVENKAMN  650

MTIKWTTSGR PGHGDMFGVI ESWGAAALLL LTGRVRDTGK SSSSTGHRAS  700

KSLVWSQVCF PESWEERLLT EGKQLQSRVI
```

Multiple analyses were performed using this prediction. First, a pairwise comparison of the sequence above and the sequence of FLJ22457, the hypothetical protein mentioned above, using BLASTP version 2.1.2 located on the web at ncbi.nlm.nih.gov/BLAST, resulted in a match with an expect value of 0.0. The peptide sequence predicted from clone 596H6 was longer and 19% of the region of alignment between the two resulted from gaps in hypothetical protein FLJ22457. The cause of the discrepancy might be alternative mRNA splicing, alternative post-translational processing, or differences in the peptide-predicting algorithms used to create the two sequences, but the homology between the two is significant.

BLASTP and TBLASTN were also used to search for sequence similarities in the SWISS-PROT, TrEMBL, GenBank Translated, and PDB databases. Matches to several proteins were found, among them a tumor cell suppression protein, HTS1. No matches aligned to the full length of the peptide sequence, however, suggesting that similarity is limited to a few regions of the peptide.

TBLASTN produced matches to several proteins—both identified and theoretical—but again, no matches aligned to the full length of the peptide sequence. The best alignment was to the same hypothetical protein found in GenBank before (FLJ22457).

To discover similarities to protein families, comparisons of the domains (described above) were carried out using the Pfam and Blocks databases. A search of the Pfam database identified two regions of the peptide domains as belonging the DENN protein family (e=2.1×10$^{-33}$). The human DENN protein possesses an RGD cellular adhesion motif and a leucine-zipper-like motif associated with protein dimerization, and shows partial homology to the receptor binding domain of tumor necrosis factor alpha DENN is virtually identical to MADD, a human MAP kinase-activating death domain protein that interacts with type I tumor necrosis factor receptor located on the web at srs.ebi.ac.uk/srs6bin/cgi-bin/wgetz?-id+fS5n1GQsHf+-e+ [INTERPRO:'IPR001194']. The search of the Blocks database also revealed similarities between regions of the peptide sequence and known protein groups, but none with a satisfactory degree of confidence. In the Blocks scoring system, scores over 1,100 are likely to be relevant. The highest score of any match to the predicted peptide was 1,058.

The Prosite, ProDom, PRINTS databases (all publicly available) were used to conduct further domain and motif analysis. The Prosite search generated many recognized protein domains. A BLASTP search was performed to identify areas of similarity between the protein query sequence and PRINTS, a protein database of protein fingerprints, groups of motifs that together form a characteristic signature of a protein family. In this case, no groups were found to align closely to any section of the submitted sequence. The same was true when the ProDom database was searched with BLASTP.

A prediction of protein structure was done by performing a BLAST search of the sequence against PDB, a database in which every member has tertiary structure information. No significant alignments were found by this method. Secondary and super-secondary structure was examined using the Garnier algorithm. Although it is only considered to be 60–65% accurate, the algorithm provided information on the locations and lengths of alpha-helices, beta-sheets, turns and coils.

The antigenicity of the predicted peptide was modeled by graphing hydrophilicity vs. amino acid number. This produced a visual representation of trends in hydrophilicity along the sequence. Many locations in the sequence showed antigenicity and five sites had antigenicity greater than 2. This information can be used in the design of affinity reagents to the protein.

Membrane-spanning regions were predicted by graphing hydrophobicity vs. amino acid number. Thirteen regions were found to be somewhat hydrophobic. The algorithm TMpred predicted a model with 6 strong transmembrane helices located on the web at ch.embnet.orglsoftware/TMPRED_form.html.

NNPSL is a neural network algorithm developed by the Sanger Center. It uses amino acid composition and sequence to predict cellular location. For the peptide sequence submitted, its first choice was mitochondrial (51.1% expected accuracy). Its second choice was cytoplasmic (91.4% expected accuracy).

Example 6

Further Sequence Analysis of Novel Clone 486E11

The sequence of clone 486E11 is provided below

```
TAAAAGCAGG CTGTGCACTA GGGACCTAGT GACCTTACTA GAAAAAACTC   50  SEQ ID NO:8769
AAATTCTCTG AGCCACAAGT CCTCATGGGC AAAATGTAGA TACCACCACC  100
TAACCCTGCC AATTTCCTAT CATTGTGACT ATCAAATTAA ACCACAGGCA  150
GGAAGTTGCC TTGAAAACTT TTTATAGTGT ATATTACTGT TCACATAGAT  200
NAGCAATTAA CTTTACATAT ACCCGTTTTT AAAAGATCAG TCCTGTGATT  250
AAAAGTCTGG CTGCCCTAAT TCACTTCGAT TATACATTAG GTTAAAGCCA  300
TATAAAAGAG GCACTACGTC TTCGGAGAGA TGAATGGATA TTACAAGCAG  350
TAATGTTGGC TTTGGAATAT ACACATAATG TCCACTTGAC CTCATCTATT  400
TGACACAAAA TGTAAACTAA ATTATGAGCA TCATTAGATA CCTTGGCCTT  450
TTCAAATCAC ACAGGGTCCT AGATCTNNNN NNNNNNNNNN NNNNNNNNNN  500
NNNNNNNNNN NNNNNNNNNN NNNNNNNNNN NNNNNNNNAC TTTGGGATTC  550
CTATATCTTT GTCAGCTGTC AACTTCAGTG TTTTCAGGTT AAATTCTATC  600
CATAGTCATC CCAATATACC TGCTTTAGAT GATACAACCT TCAAAAGATC  650
CGCTCTTCCT CGTAAAAAGT GGAG
```

The BLASTN program was used to compare the sequence to the UniGene and dbEST databases. No significant alignments were found in either. It was then searched against the nr database and only alignments to unnamed genomic DNA clones were found.

CAP2 was used to cluster a group of unknowns, including clone 486E11. The sequence for 486E11 was found to overlap others. These formed a contig of 1,010 residues, which is shown below:

```
CGGACAGGTA CCTAAAAGCA GGCTGTGCAC TAGGGACCTA GTGACCTTAC   50  SEQ ID NO:8832
TAGAAAAAAC TCAAATTCTC TGAGCCACAA GTCCTCATGG GCAAAATGTA  100
GATACCACCA CCTAACCCTG CCAATTTCCT ATCATTGTGA CTATCAAATT  150
AAACCACAGG CAGGAAGTTG CCTTGAAAAC TTTTTATAGT GTATATTACT  200
GTTCACATAG ATNAGCAATT AACTTTACAT ATACCCGTTT TAAAAGATC   250
AGTCCTGTGA TTAAAAGTCT GGCTGCCCTA ATTCACTTCG ATTATACATT  300
AGGTTAAAGC CATATAAAAG AGGCACTACG TCTTCGGAGA GATGAATGGA  350
TATTACAAGC AGTAATTTTG GCTTTGGAAT ATACACATAA TGTCCACTTG  400
ACCTCATCTA TTTGACACAA AATGTAAACT AAATTATGAG CATCATTAGA  450
TACCTTGGGC CTTTTCAAAT CACACAGGGT CCTAGATCTG NNNNNNNNNN  500
NNNNNNNNNN NNNNNNNNNN NNNNNNNNNN NNNNNNNNNN NNNNNNNNNN  550
NACTTTGGAT TCTTATATCT TTGTCAGCTG TCAACTTCAG TGTTTTCAGG  600
NTAAATTCTA TCCATAGTCA TCCCAATATA CCTGCTTTAG ATGATACAAA  650
CTTCAAAAGA TCCGGCTCTC CCTCGTAAAA CGTGGAGGAC AGACATCAAG  700
GGGGTTTTCT GAGTAAAGAA AGGCAACCGC TCGGCAAAAA CTCACCCTGG  750
CACAACAGGA NCGAATATAT ACAGACGCTG ATTGAGCGTT TTGCTCCATC  800
TTCACTTCTG TTAAATGAAG ACATTGATAT CTAAAATGCT ATGAGTCTAA  850
CTTTGTAAAA TTAAAATAGA TTTGTAGTTA TTTTTCAAAA TGAAATCGAA  900
```

-continued

```
AAGATACAAG TTTTGAAGGC AGTCTCTTTT TCCACCCTGC CCCTCTAGTG    950

TGTTTTACAC ACTTCTCTGG CCACTCCAAC AGGGAAGCTG GTCCAGGGCC   1000

ATTATACAGG
```

The sequence of the CAP2 contig was used in a BLAST search of the human genome. 934 out of 1,010 residues aligned to a region of chromosome 21. A gap of 61 residues divided the aligned region into two smaller fragments. The sequence of this region, plus 100 kilobases on each side of it, was downloaded and analyzed using the Genscan site at MIT located on the web at genes.mit.edu/GENSCAN.html, with the following settings:

Organism: vertebrate
Suboptimal exon cutoff: 1.00 (no suboptimal exons)
Print options; Predicted CDS and peptides The fragment was found to fall within one of several predicted genes in the chromosome region. The bases corresponding to the predicted gene, including its predicted introns, were saved as a separate file and used to search GenBank again with BLASTN to find any ESTs or UniGene clusters identified by portions of the sequence not included in the original unknown fragment. The nr database contained no significant matches. At least 100 significant matches to various parts of the predicted gene were found in the dbEST database, but all of them were to unnamed cDNA clones. Comparison to UniGene produced fewer significant matches, but all matches were to unnamed cDNAs.

The peptide sequence predicted by Genscan was also saved. Multiple types of analyses were performed on it using the resources mentioned in Table 3. BLASTP and TBLASTN were used to search the TrEMBL protein database located on the web at expasy.ch/sprot/) and the GenBank nr database located on the web at ncbi.nlm.hih.gov/BLAST, which includes data from the SwissProt, PIR, PRF, and PDB databases. No significant matches were found in any of these, so no gene identity or tertiary structure was discovered.

The peptide sequence was also searched for similarity to known domains and motifs using BLASTP with the Prositc, Blocks, Pfam, and ProDom databases. The searches produced no significant alignments to known domains. BLASTP comparison to the PRINTS database produced an alignment to the P450 protein family, but with a low probability of accuracy (e=6.9).

Two methods were used to predict secondary structure—the Garnier/Osguthorpe/Robson model and the Chou-Fasman model. The two methods differed somewhat in their results, but both produced representations of the peptide sequence with helical and sheet regions and locations of turns.

Antigenicity was plotted as a graph with amino acid number in the sequence on the x-axis and hydrophilicity on the y-axis. Several areas of antigenicity were observed, but only one with antigenicity greater than 2. Hydrophobicity was plotted in the same way. Only one region, from approximately residue 135 to residue 150, had notable hydrophobicity. TMpreα, accessed through ExPASy, was used to predict transmembrane helices. No regions of the peptide sequence were predicted with reasonable confidence to be membrane-spanning helices.

NNPSL predicted that the putative protein would be found either in the nucleus (expected prediction accuracy=51.1%) or secreted from the cell (expected prediction accuracy=91.4%).

Example 7

Preparation of RNA from Mononuclear Cells for Expression Profiling

Blood was isolated from the subject for leukocyte expression profiling using the following methods:

Two tubes were drawn per patient. Blood was drawn from either a standard peripheral venous blood draw or directly from a large-bore intra-arterial or intravenous catheter inserted in the femoral artery, femoral vein, subclavian vein or internal jugular vein. Care was taken to avoid sample contamination with heparin from the intravascular catheters, as heparin can interfere with subsequent RNA reactions.

For each tube, 8 ml of whole blood was drawn into a tube (CPT, Becton-Dickinson order #362753) containing the anticoagulant Citrate, 25° C. density gradient solution (e.g. Ficoll, Percoll) and a polyester gel barrier that upon centrifugation was permeable to RBCs and granulocytes but not to mononuclear cells. The tube was inverted several times to mix the blood with the anticoagulant. The tubes were centrifuged at 1750×g in a swing-out rotor at room temperature for 20 minutes. The tubes were removed from the centrifuge and inverted 5–10 times to mix the plasma with the mononuclear cells, while trapping the RBCs and the granulocytes beneath the gel barrier. The plasma/mononuclear cell mix was decanted into a 15 ml tube and 5 ml of phosphate-buffered saline (PBS) is added. The 15 ml tubes were spun for 5 minutes at 1750×g to pellet the cells. The supernatant was discarded and 1.8 ml of RLT lysis buffer is added to the mononuclear cell pellet. The buffer and cells were pipetted up and down to ensure complete lysis of the pellet. The cell lysate was frozen and stored until it is convenient to proceed with isolation of total RNA.

Total RNA was purified from the lysed mononuclear cells using the Qiagen Rneasy Miniprep kit, as directed by the manufacturer (10/99 version) for total RNA isolation, including homogenization (Qiashredder columns) and on-column DNase treatment. The purified RNA was eluted in 5Oul of water.

Some samples were prepared by a different protocol, as follows:

Two 8 ml blood samples were drawn from a peripheral vein into a tube (CPT, Becton-Dickinson order #362753) containing anticoagulant (Citrate), 25° C. density gradient solution (Ficoll) and a polyester gel barrier that upon centrifugation is permeable to RBCs and granulocytes but not to mononuclear cells. The mononuclear cells and plasma remained above the barrier while the RBCs and granulocytes were trapped below. The tube was inverted several times to mix the blood with the anticoagulant, and the tubes were subjected to centrifugation at 1750×g in a swing-out rotor at room temperature for 20 min. The tubes were removed from the centrifuge, and the clear plasma layer above the cloudy mononuclear cell layer was aspirated and discarded. The cloudy mononuclear cell layer was aspirated, with care taken to rinse all of the mononuclear cells from the surface of the gel barrier with PBS (phosphate buffered saline). Approximately 2 mls of mononuclear cell suspension was transferred to a 2 ml microcentrifuge tube, and centrifuged for 3 min. at 16,000 rpm in a microcentrifuge to pellet the cells. The supernatant was discarded and 1.8 ml of RLT lysis buffer (Qiagen) were added to the mononuclear cell pellet, which lysed the cells and inactivated Rnases. The cells and lysis buffer were pipetted up and down to ensure complete lysis of the pellet. Cell lysate was frozen and stored until it was convenient to proceed with isolation of total RNA.

RNA samples were isolated from 8 mL of whole blood. Yields ranged from 2 ug to 20ug total RNA for 8 mL blood. A260/A280 spectrophotometric ratios were between 1.6 and 2.0, indicating purity of sample. 2 ul of each sample were run on an agarose gel in the presence of ethidium bromide. No degradation of the RNA sample and no DNA contamination were visible.

In some cases, specific subsets of mononuclear cells were isolated from peripheral blood of human subjects. When this was done, the StemSep cell separation kits (manual version 6.0.0) were used from StemCell Technologies (Vancouver, Canada). This same protocol can be applied to the isolation of T cells, CD4 T cells, CD8 T cells, B cells, monocytes, NK cells and other cells. Isolation of cell types using negative selection with antibodies may be desirable to avoid activation of target cells by antibodies.

Example 8

Preparation of Universal Control RNA for Use in Leukocyte Expression Profiling

Control RNA was prepared using total RNA from Buffy coats and/or total RNA from enriched mononuclear cells isolated from Buffy coats, both with and without stimulation with ionomycin and PMA. The following control RNAs were prepared:
Control 1: Buffy Coat Total RNA
Control 2: Mononuclear cell Total RNA
Control 3: Stimulated buffy coat Total RNA
Control 4: Stimulated mononuclear Total RNA
Control 5: 50% Buffy coat Total RNA/50% Stimulated buffy coat Total RNA
Control 6: 50% Mononuclear cell Total RNA/50% Stimulated Mononuclear Total RNA.

Some samples were prepared using the following protocol: Buffy coats from 38 individuals were obtained from Stanford Blood Center. Each buffy coat is derived from ~350 mL whole blood from one individual. 10 ml buffy coat was removed from the bag, and placed into a 50 ml tube. 40 ml of Buffer EL (Qiagen) was added, the tube was mixed and placed on ice for 15 minutes, then cells were pelleted by centrifugation at 2000×g for 10 minutes at 4° C. The supernatant was decanted and the cell pellet was re-suspended in 10 ml of Qiagen Buffer EL. The tube was then centrifuged at 2000×g for 10 minutes at 4° C. The cell pellet was then re-suspended in 20 ml TRIZOL (GibcoBRL) per Buffy coat sample, the mixture was shredded using a rotary homogenizer, and the lysate was then frozen at −80° C. prior to proceeding to RNA isolation.

Other control RNAs were prepared from enriched mononuclear cells prepared from Buffy coats. Buffy coats from Stanford Blood Center were obtained, as described above. 10 ml buffy coat was added to a 50 ml polypropylene tube, and 10 ml of phosphate buffer saline (PBS) was added to each tube. A polysucrose (5.7 g/dL) and sodium diatrizoate (9.0 g/dL) solution at a 1.077+/−0.0001 g/ml density solution of equal volume to diluted sample was prepared (Histopaque 1077, Sigma cat. no 1077-1). This and all subsequent steps were performed at room temperature. 15 ml of diluted buffy coat/PBS was layered on top of 15 ml of the histopaque solution in a 50 ml tube. The tube was centrifuged at 400×g for 30 minutes at room temperature. After centrifugation, the upper layer of the solution to within 0.5 cm of the opaque interface containing the mononuclear cells was discarded. The opaque interface was transferred into a clean centrifuge tube. An equal volume of PBS was added to each tube and centrifiged at 350×g for 10 minutes at room temperature. The supernatant was discarded. 5 ml of Buffer EL (Qiagen) was used to resuspend the remaining cell pellet and the tube was centrifuged at 2000×g for 10 minutes at room temperature. The supernatant was discarded. The pellet was resuspended in 20 ml of TRIZOL (GibcoBRL) for each individual buffy coat that was processed. The sample was homogenized using a rotary homogenizer and frozen at −80C until RNA was isolated.

RNA was isolated from frozen lysed Buffy coat samples as follows: frozen samples were thawed, and 4 ml of chloroform was added to each buffy coat sample. The sample was mixed by vortexing and centrifuged at 2000×g for 5 minutes. The aqueous layer was moved to new tube and then repurified by using the RNeasy Maxi RNA clean up kit, according to the manufacturer's instruction (Qiagen, PN 75162). The yield, purity and integrity were assessed by spectrophotometer and gel electrophoresis.

Some samples were prepared by a different protocol, as follows. The further use of RNA prepared using this protocol is described in Example 14.

50 whole blood samples were randomly selected from consented blood donors at the Stanford Medical School Blood Center. Each buffy coat sample was produced from ~350 mL of an individual's donated blood. The whole blood sample was centrifuged at ~4,400×g for 8 minutes at room temperature, resulting in three distinct layers: a top layer of plasma, a second layer of buffy coat, and a third layer of red blood cells. 25 ml of the buffy coat fraction was obtained and diluted with an equal volume of PBS (phosphate buffered saline). 30 ml of diluted buffy coat was layered onto 15 ml of sodium diatrizoate solution adjusted to a density of 1.077+/−0.001 g/ml (Histopaque 1077, Sigma) in a 50 mL plastic tube. The tube was spun at 800 g for 10 minutes at room temperature. The plasma layer was removed to the 30 ml mark on the tube, and the mononuclear cell layer removed into a new tube and washed with an equal volume of PBS, and collected by centrifugation at 2000 g for 10 minutes at room temperature. The cell pellet was resuspended in 10 ml of Buffer EL (Qiagen) by vortexing and incubated on ice for 10 minutes to remove any remaining erthythrocytes. The mononuclear cells were spun at 2000 g for 10 minutes at 4 degrees Celsius. The cell pellet was lysed in 25 ml of a phenol/guanidinium thiocyanate solution (TRIZOL Reagent, Invitrogen). The sample was homogenized using a PowerGene 5 rotary homogenizer (Fisher Scientific) and Omini disposable generator probes (Fisher Scientific). The Trizol lysate was frozen at −80 degrees C. until the next step.

The samples were thawed out and incubated at room temperature for 5 minutes. 5 ml chloroform was added to each sample, mixed by vortexing, and incubated at room temperature for 3 minutes. The aqueous layers were transferred to new 50 ml tubes. The aqueous layer containing total RNA was further purified using the Qiagen RNeasy Maxi kit (PN 75162), per the manufacturer's protocol (October 1999). The columns were eluted twice with 1 ml Rnase-free water, with a minute incubation before each spin. Quantity and quality of RNA was assessed using standard methods. Generally, RNA was isolated from batches of 10 buffy coats at a time, with an average yield per buffy coat of 870 μg, and an estimated total yield of 43.5 mg total RNA with a 260/280 ratio of 1.56 and a 28S/18S ratio of 1.78.

Quality of the RNA was tested using the Agilent 2100 Bioanalyzer using RNA 6000 microfluidics chips. Analysis of the electrophorgrams from the Bioanalyzer for five different batches demonstrated the reproducibility in quality between the batches.

Total RNA from all five batches were combined and mixed in a 50 ml tube, then aliquoted as follows: 2×10 ml aliquots in 15 ml tubes, and the rest in 100 μl aliquots in 1.5 ml microcentrifuge tubes. The aliquots gave highly reproducible results with respect to RNA purity, size and integrity. The RNA was stored at −80° C.

Test Hybridization of Reference RNA.

Figure 3:
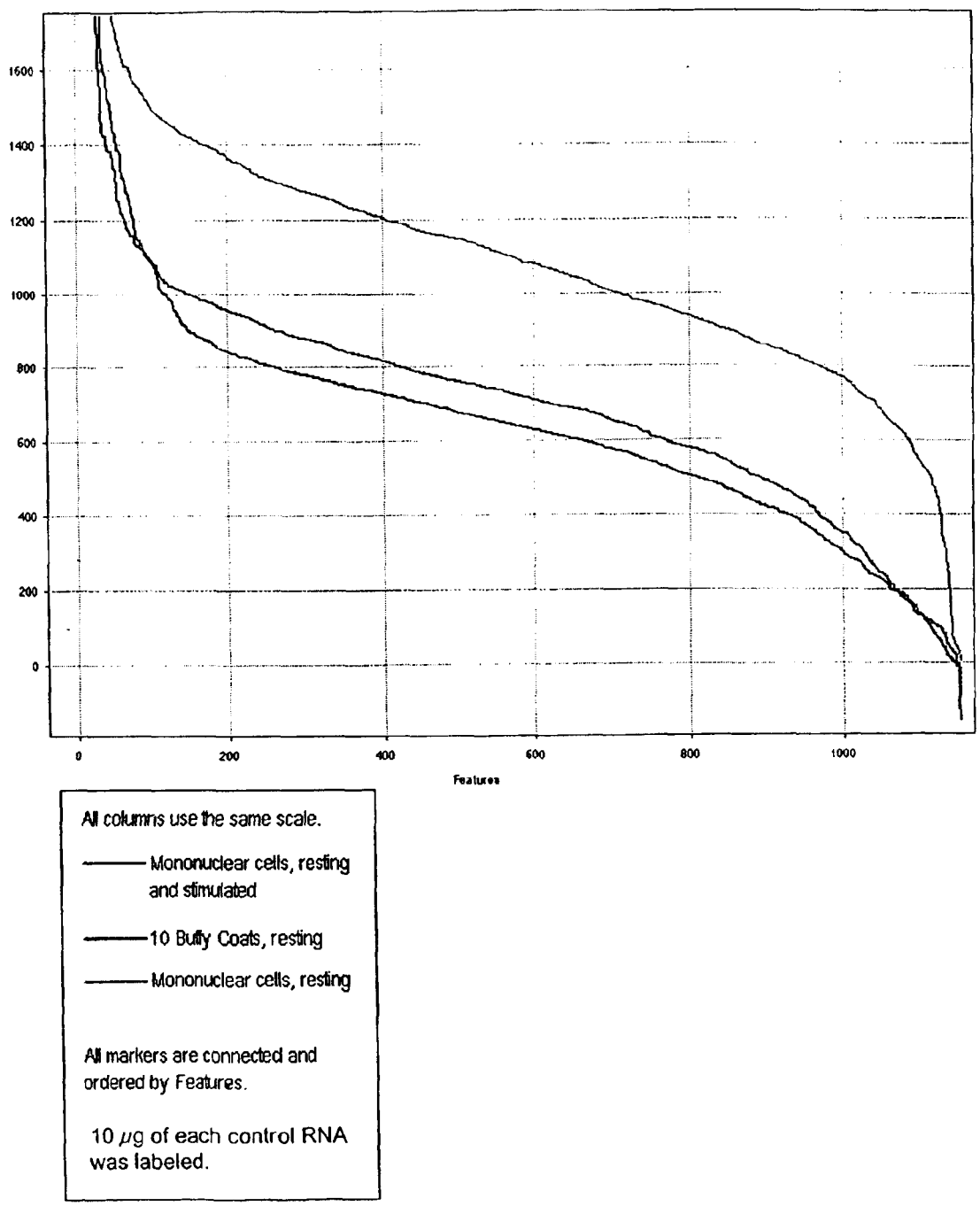
FIG. 3.

When compared with BC38 and Stimulated mononuclear reference samples, the R50 performed as well, if not better than the other reference samples as shown in FIG. 3.

In an analysis of hybridizations, where the R50 targets were fluorescently labeled with Cy-5 using methods described herein and the amplified and labeled aRNA was hybridized (as in example 14) to the olignoucleotide array described in example 13. The R50 detected 97.3% of probes with a Signal to Noise ratio (S/N) of greater than three and 99.9% of probes with S/N greater one.

Example 9

Identification of Diagnostic Oligonucleotides and Oligonucleotide Sets for Use in Monitoring Treatment and/or Progression of Rheumatoid Arthritis Rheumatoid arthritis (hereinafter, "RA") is a chronic and debilitating inflammatory arthritis. The diagnosis of RA is made by clinical criteria and radiographs. A new class of medication, TNF blockers, are effective, but the drugs are expensive, have side effects and not all patients respond to treatment. In addition, relief of disease symptoms does not always correlate with inhibition of joint destruction. For these reasons, an alternative mechanism for the titration of therapy is needed.

An observational study was conducted in which a cohort of patients meeting American College of Rheumatology (hereinafter "ARC") criteria for the diagnosis of RA was identified. Arnett et al. (1988) *Arthritis Rheum* 31:315–24. Patients gave informed consent and a peripheral blood mononuclear cell RNA sample was obtained by the methods as described herein. When available, RNA samples were also obtained from surgical specimens of bone or synovium from effected joints, and synovial fluid. Also, T-cells were isolated from the peripheral blood for some patients for expression analysis. This was done using the protocol given in Example 7.

From each patient, the following clinical information was obtained if available: Demographic information; information relating to the ACR criteria for RA; presence or absence of additional diagnoses of inflammatory and non-inflammatory conditions; data from laboratory test, including complete blood counts with differentials, CRP, ESR, ANA, Serum IL6, Soluble CD40 ligand, LDL, HDL, Anti-DNA antibodies, rheumatoid factor, C3, C4, serum creatinine and any medication levels; data from surgical procedures such as gross operative findings and pathological evaluation of resected tissues and biopsies; information on pharmacological therapy and treatment changes; clinical diagnoses of disease "flare"; hospitalizations; quantitative joint exams; results from health assessment questionnaires (HAQs); other clinical measures of patient symptoms and disability; physical examination results and radiographic data assessing joint involvement, synovial thickening, bone loss and erosion and joint space narrowing and deformity. In some cases, data includes pathological evaluation of synovial memebranes and joint tissues from RA and control patients. Pathology scoring systems were used to determine disease category, inflammation, type of inflammatory infiltrate, cellular and makeup of the synovial inflammation.

For some specimens of synovium, mononuclear cells or subsets of mononuclear cells (such as T cells) can be isolated for expression profiling. The relative number of lyphocyte subsets for some specimens can be determined by fluorescence activated cell sorting. Examples are determination of the CD4/CD8 T-cell ratio for a specimen. This information can be used as a variable to correlate to other outcomes or as an outcome for correlation analysis.

From these data, measures of improvement in RA are derived as exemplified by the ACR 20% and 50% response/improvement rates (Felson et al. 1996). Measures of disease activity over some period of time is derived from these data as are measures of disease progression. Serial radiography of effected joints is used for objective determination of progression (e.g., joint space narrowing, peri-articular osteoporosis, synovial thickening). Disease activity is determined from the clinical scores, medical history, physical exam, lab studies, surgical and pathological findings.

The collected clinical data (disease criteria) is used to define patient or sample groups for correlation of expression data. Patient groups are identified for comparison, for example, a patient group that possesses a useful or interesting clinical distinction, verses a patient group that does not possess the distinction. Examples of useful and interesting patient distinctions that can be made on the basis of collected clinical data are listed here:

Samples from patients during a clinically diagnosed RA flare versus samples from these same or different patients while they are asymptomatic.

Samples from patients who subsequently have high measures of disease activity versus samples from those same or different patients who have low subsequent disease activity.

Samples from patients who subsequently have high measures of disease progression versus samples from those same or different patients who have low subsequent disease progression.

Samples from patients who subsequently respond to a given medication or treatment regimen versus samples from those same or different patients who subsequently do not respond to a given medication or treatment regimen (for example, TNF pathway blocking medications).

Samples from patients with a diagnosis of osteoarthritis versus patients with rheumatoid arthritis.

Samples from patients with tissue biopsy results showing a high degree of inflammation versus samples from patients with lesser degrees of histological evidence of inflammation on biopsy.

Expression profiles correlating with progression of RA are identified. Subsets of the candidate library (or a previously identified diagnostic nucleotide set) are identified, according to the above procedures, that have predictive value for the progression of RA.

Diagnostic nucleotide set(s) are identified which predict respond to TNF blockade. Patients are profiled before and during treatment with these medications. Patients are followed for relief of symptoms, side effects and progression of joint destruction, e.g., as measured by hand radiographs. Expression profiles correlating with response to TNF blockade are identified. Subsets of the candidate library (or a previously identified diagnostic nucleotide set) are identified, according to the above procedures that have predictive value for response to TNF blockade.

Example 10

Identification of Diagnostic Oligonucleotide and Oligonucleotide Sets for Diagnosis of Systemic Lupus Erythematosis SLE is a chronic, systemic inflammatory disease characterized by dysregulation of the immune system. Clinical manifestations affect every organ system and include skin rash, renal dysfunction, CNS disorders, arthralgias and hematologic abnormalities. SLE clinical manifestations tend to both recur intermittently (or "flare") and progress over time, leading to permanent end-organ damage.

An observational study was conducted in which a cohort of patients meeting American College of Rheumatology (hereinafter "ACR") criteria for the diagnosis of SLE were identified. See Tan et al. (1982) *Arthritis Rheum* 25:1271–7. Patients gave informed consent and a peripheral blood mononuclear cell RNA sample or a peripheral T cell sample was obtained by the methods as described in example 7.

From each patient, the following clinical information was obtained if available: Demographic information, ACR criteria for SLE, additional diagnoses of inflammatory and non-inflammatory conditions, data from laboratory testing including complete blood counts with differentials, CRP, ESR, ANA, Serum IL6, Soluble CD40 ligand, LDL, HDL, Anti-DNA antibodies, rheumatoid factor, C3, C4, serum creatinine (and other measures of renal dysfunction), medication levels, data from surgical procedures such as gross operative findings and pathological evaluation of resected tissues and biopsies (e.g., renal, CNS), information on pharmacological therapy and treatment changes, clinical diagnoses of disease "flare", hospitalizations, quantitative joint exams, results from health assessment questionnaires (HAQs), SLEDAIs (a clinical score for SLE activity that assess many clinical variables; Bombadier C, Gladman DD, Urowitz MB, Caron D, Chang CH and the Committee on Prognosis Studies in SLE: Derivation of the SLEDAI for Lupus Patients. *Arthritis Rheum* 35:630–640, 1992), other clinical measures of patient symptoms and disability, physical examination results and carotid ultrasonography.

The collected clinical data (disease criteria) is used to define patient or sample groups for correlation of expression data. Patient groups are identified for comparison, for example, a patient group that possesses a useful or interesting clinical distinction, verses a patient group that does not possess the distinction. Measures of disease activity in SLE are derived from the clinical data described above to divide patients (and patient samples) into groups with higher and lower disease activity over some period of time or at any one point in time. Such data are SLEDAI scores and other clinical scores, levels of inflammatory markers or complement, number of hospitalizations, medication use and changes, biopsy results and data measuring progression of end-organ damage or end-organ damage, including progressive renal failure, carotid atherosclerosis, and CNS dysfunction.

Expression profiles correlating with progression of SLE are identified, including expression profiles corresponding to end-organ damage and progression of end-organ damage. Expression profiles are identified predicting disease progression or disease "flare", response to treatment or likelihood of response to treatment, predict likelihood of "low" or "high" disease measures-(optionally described using the SLEDAI score), and presence or likelihood of developing premature carotid atherosclerosis. Subsets of the candidate library (or a previously identified diagnostic nucleotide set) are identified, according to the above procedures that have predictive value for the progression of SLE.

Further examples of useful and interesting patient distinctions that can be made on the basis of collected clinical data are listed here. Samples can be grouped and groups are compared to discover diagnostic gene sets:

1. Samples from patients during a clinically diagnosed SLE flare versus samples from these same or different patients while they are asymptomatic or while they have a documented infection.
2. Samples from patients who subsequently have high measures of disease activity versus samples from those same or different patients who have low subsequent disease activity.
3. Samples from patients who subsequently have high measures of disease progression versus samples from those same or different patients who have low subsequent disease progression.
4. Samples from patients who subsequently respond to a given medication or treatment regimen versus samples from those same or different patients who subsequently do not respond to a given medication or treatment regimen.
5. Samples from patients with premature carotid atherosclerosis on ultrasonography versus patients with SLE without premature atherosclerosis.

Identification of a Diagnostic Oligonucleotide or Oligonucleotide Set for Diagnosis of Lupus Mononuclear RNA samples were collected from patients with SLE and patients with Rheumatoid or Osteoarthritis (RA and OA) or controls using the protocol described in example 7. The patient diagnoses were determined using standard diagnostic algorithms such as those that are employed by the American College of Rheumatology (see example See Tan et al. (1982) *Arthritis Rheum* 25:1271–7; Arnett et al. (1988) *Arthritis Rheum* 31:315–24).

32 samples were included in the anaysis. 15 samples were derived from patients with a clinical diagnosis of SLE and the remainder were derived from patients with RA (9), OA (4) and subjects without known disease (4) who served as controls. Samples from patients with SLE or RA were classified as "Active" or "Controlled" (with respect to disease activity) by the patient's physician based on objective and subjective criteria, such as patient history, physical exam and lab studies. An attempt was made to match SLE patients and controls with respect to important variables such as medication use, sex, age and secondary diagnoses.

After preparation of RNA (example 7), amplification, labeling, hybridization, scanning, feature extraction and data processing were done as described in Example 14 using the oligonucleotide microarrays described in Example 13. The resulting log ratio of expression of Cy3 (patient sample)/Cy5 (R50 reference RNA) was used for analysis.

Initially, significance analysis for microarrays (SAM, Tusher 2001, Example 16) was used to discover that were differentially expressed between 7 of the Lupus samples and 17 control samples. 1 gene was identified that was expressed at a higher level in the lupus patients than in all controls. This gene had a 0.5% false detection rate using SAM. This means that there is statistically, a 99.5% chance that the gene is truly differentially expressed between the Lupus and control samples. This gene was oligonucleotide and SEQ ID #4637. The oligonucleotide: GCCTCTTGCTTGGCGT-GATAACCCTGTCATCTTCCCAAAGCTCATTTATG detects a specific human gene: sialyltransferase (SIAT4A), Unigene:Hs.301698 Locus: NM_003033, GI: 4506950. Expression ratios for the gene are given for each sample in FIGS. 4A–B. The average fold change in expression between SLE and controls was 1.48.

When a larger data set was used, 15 SLE samples were compared to 17 controls. Using SAM, genes were identified as significantly differentially expressed between Lupus and controls. These genes and their FDRs are given in Table 10A. Supervised harvesting classification (X-Mine, Brisbane, Calif.) and CARTF (Salford Systems, San Diego Calif.) were also used on the same data to determine which set of genes best distinguish SLE from control samples (Example 16).

CART was used to build a decision tree for classification of samples as lupus or not lupus using the gene expression data from the arrays. The analysis identitifies sets of genes that can be used together to accurately identify samples derived from lupus patients. The set of genes and the identified threshold expression levels for the decision tree are referred to as "models". Multiple models for diagnosis of Lupus were derived by using different settings and parameters for the CART algorithm and using different sets of genes in the analysis. When using CART, it may be desirable to limit the number of independent variables. In the case of the genes on the arrays, a subset of ~8000 can be selected for analysis in CART based on significant differential expression discovered by using SAM or some other algorithm.

Model I was based on a data set consisting of thirty-two samples (fifteen SLE and seventeen non-SLE). These samples were used to derive the model and are referred to a the "training set". Model I used the expression values for twenty-nine genes, which were found to be most significant in differentiating SLE and non-SLE samples in the analysis using SAM described above. SLE samples were designated as Class 1 and non-SLE samples were designated as Class 2. For this analysis, the following settings were used in the MODEL SETUP (CART, Salford Systems, San Diego, Calif.). In the Model settings, the tree type selected for the analysis was classification. In the Categorical settings, the default values were used. In the Testing settings, V-fold cross-validation was selected with a value of 10. In the Select Cases settings, the default values were used. In the Best Tree settings, the default values were used. In the Combine settings, the default values were used. In the Method settings, Symmetric Gini was selected as the type of classification tree and Linear combinations for splitting was also selected. The default values were used for the linear combinations. In the Advance Settings, the default values were used. In the Costs settings, the default values were used. In the Priors settings, Equal was selected as the priors for Class. In the penalty settings, the default values were used.

From this analysis, CART built two models, a two-gene model and a three-gene model (FIGS. 4C–E). The sensitivity and specificity for the identification of lupus in the training set samples of the two genes model were 100% and 94%, respectively. The sensitivity and specificity for the 10-fold cross validation set of the two-gene model were 100% and 88%, respectively, with a relative cost of 0.118. The sensitivity and specificity for the training set of the three genes model were 100% and 100%, respectively. The sensitivity and specificity for the 10-fold cross validation set of the three genes model were 93% and 94%, respectively, with a relative cost of 0.125.

Model II was based on a data set consisted of thirty-two samples, fifteen SLE and seventeen non-SLE (training set) and six thousand forty-four genes with expression values for at least 80% of the samples. The MODEL SETUP for the analysis of this data set was the same as for the analysis above, except for the following correction. In the Method settings, Linear combination for splitting was unchecked after the analysis yielded no classification tree. The change in the linear combination setting resulted in the following.

The sensitivity and specificity for the training set of the one gene model were 87% and 82%, respectively. The sensitivity and specificity for the 10-fold cross validation set of the one gene model were 80% and 59%, respectively, with a relative cost of 0.612. The sensitivity and specificity for the training set of the three genes model were 100% and 88%, respectively. The sensitivity and specificity for the 10-fold cross validation set of the three genes model were 67% and 65%, respectively, with a relative cost of 0.686. The sensitivity and specificity for the training set of the five genes model were 100% and 94%, respectively. The sensitivity and specificity for the 10-fold cross validation set of the five genes model were 67% and 59%, respectively, with a relative cost of 0.745. Results and models are summarized in FIGS. 4C and F.

Those genes that were found to be useful for classification are noted in Table 10A.

These genes can be used alone or in association with other genes or variables to build a diagnostic gene set or a classification algorithm. These genes can be used in association with known gene markers for lupus (such as those identified in the prior art) to provide a diagnostic algorithm.

Primers for real-time PCR validation were designed for each of the genes as described in Example 15 and are listed in Table 10B.

Surrogates for some of the most useful genes were identified and are listed in Table 10C. Surrogates can be used in addition to or in place of a diagnostic gene in a method of detecting lupus or in diagnostic gene set. For genes that were splitters in CART, surrogates were identified and reported by the software. In these cases, the best available surrogates are listed. For other genes, hierarchical clustering of the data was performed with default settings (x-miner, X-mine, Brisbane, Calif.) and members of gene expression clusters were noted. A cluster was selected that included the gene of interest and the members of that cluster were recorded in Table 10C.

Example 11

Probe Selection for a 24,000 Feature Array

This Example describes the compilation of almost 8,000 unique genes and ESTs using sequences identified from the sources described below. The sequences of these genes and ESTs were used to design probes, as described in the following Example.

Tables 3A, 3B and 3C list the sequences identified in the subtracted leukocyte expression libraries. All sequences that were identified as corresponding to a known RNA transcript were represented at least once, and all unidentified sequences were represented twice—once by the sequence on file and again by the complementary sequence—to ensure that the sense (or coding) strand of the gene sequence was included.

Table 3A. Table 3A contained all those sequences in the subtracted libraries of example 1 that matched sequences in GenBank's nr, EST_Human, and UniGene databases with an acceptable level of confidence. All the entries in the table representing the sense strand of their genes were grouped together and all those representing the antisense strand were grouped. A third group contained those entries whose strand could not be determined. Two complementary probes were designed for each member of this third group.

Table 3B and 3C. Table 3B and 3C contained all those sequences in the leukocyte expression subtracted libraries of example 1 that did not match sequences in GenBank's nr, EST_Human, and UniGene databases with an acceptable level of confidence, but which had a high probability of representing real mRNA sequences. Sequences in Table 3B did not match anything in the databases above but matched regions of the human genome draft and were spatially clustered along it, suggesting that they were exons, rather than genomic DNA included in the library by chance. Sequences in Table 3C also aligned well to regions of the human genome draft, but the aligned regions were interrupted by genomic DNA, meaning they were likely to be spliced transcripts of multiple exon genes.

Table 3B lists 510 clones and Table 3C lists 48 clones that originally had no similarity with any sequence in the public databases. Blastn searches conducted after the initial filing have identified sequences in the public database with high similarity (E values less than 1e-40) to the sequences determined for these clones. Table 3B contained 272 clones and Table 3C contained 25 clones that were found to have high similarity to sequences in dbEST. The sequences of the similar dbEST-clones were used to design probes. Sequences from clones that contained no similar regions to any sequence in the database were used to design a pair of complementary probes.

Probes were designed from database sequences that had the highest similarity to each of the sequenced clones in Tables 3A, 3B, and 3C. Based on BLASTn searches the most similar database sequence was identified by locus number and the locus number was submitted to GenBank using batch Entrez (located at the website ncbi.nlm.nih.gov/entrez/batchentrez.cgi?db=Nucleotide) to obtain the sequence for that locus. The GenBank entry sequence was used because in most cases it was more complete or was derived from multi-pass sequencing and thus would likely have fewer errors than the single pass cDNA library sequences. When only UniGene cluster IDs were available for genes of interest, the respective scquences were extracted from the UniGene_unique database, build 137, downloaded from NCBI (ftp://ncbi.nlm.nih.gov/repository/UniGene/). This database contains one representative sequence for each cluster in UniGene.

Summary of library clones used in array probe design

| Table | Sense Strand | Antisnese Strand | Strand Undetermined |
|---|---|---|---|
| 3A | 3621 | 763 | 124 |
| 3B | 142 | 130 | 238 |
| 3C | 19 | 6 | 23 |
| Totals | 3782 | 899 | 385 |

Literature Searches

Example 2 describes searches of literature databases. We also searched for research articles discussing genes expressed only in leukocytes or involved in inflammation and particular disease conditions, including genes that were specifically expressed or down-regulated in a disease state. Searches included, but were not limited to, the following terms and various combinations of theses terms: inflammation, atherosclerosis, rheumatoid arthritis, osteoarthritis, lupus, SLE, allograft, transplant, rejection, leukocyte, monocyte, lymphocyte, mononuclear, macrophage, neutrophil, eosinophil, basophil, platelet, congestive heart failure, expression, profiling, microarray, inflammatory bowel disease, asthma, RNA expression, gene expression, granulocyte.

A UniGene cluster ID or GenBank accession number was found for each gene in the list. The strand of the corresponding sequence was determined, if possible, and the genes were divided into the three groups: sense (coding) strand, anti-sense strand, or strand unknown. The rest of the probe design process was carried out as described above for the sequences from the leukocyte subtracted expression library.

Database Mining

Database mining was performed as described in Example 2. In addition, the Library Browser at the NCBI UniGene web site (located on the web at ncbi.nlmn.nih.gov/UniGene/lbrowse.cgi?ORG=Hs&DISPLAY=ALL) was used to identify genes that are specifically expressed in leukocyte cell populations. All expression libraries available at the time were examined and those derived from leukocytes were viewed individually. Each library viewed through the Library Browser at the UniGene web site contains a section titled "Shown below are UniGene clusters of special interest only" that lists genes that are either highly represented or found only in that library. Only the genes in this section were downloaded from each library. Alternatively, every sequence in each library is downloaded and then redundancy between libraries is reduced by discarding all UniGene cluster IDs that are represented more than once. A total of 439 libraries were downloaded, containing 35,819 genes, although many were found in more than one library. The most important libraries from the remaining set were separated and 3,914 genes remained. After eliminating all redundancy between these libraries and comparing the remaining genes to those listed in Tables 3A, 3B and 3C, the set was reduced to 2,573 genes in 35 libraries as shown in Table 4. From these, all genes in first 30 libraries were used to design probes. A random subset of genes was used from Library Lib.376, "Activated_T_cells_XX". From the last four libraries, a random subset of sequences listed as "ESTs, found only in this library" was used.

Angiozenesis Markers 215 sequences derived from an angiogenic endothelial cell subtracted cDNA library obtained from Stanford University were used for probe design. Briefly, using well known subtractive hybridization procedures, (as described in, e.g., U.S. Pat. Nos. 5,958,738; 5,589,339; 5,827,658; 5,712,127; 5,643,761; 5,565,340) modified to normalize expression by suppressing over-representation of abundant RNA species while increasing representation of rare RNA species, a library was produced that is enriched for RNA species (messages) that are differentially expressed between test (stimulated) and control (resting) HUVEC populations. The subtraction/suppression protocol was performed as described by the kit manufacturer (Clontech, PCR-select cDNA Subtraction Kit).

Pooled primary HUVECs (Clonetics) were cultured in 15% FCS, M199 (GibcoBRL) with standard concentrations of Heparin, Penicillin, Streptomycin, Glutamine and Endothelial Cell Growth Supplement. The cells were cultured on 1% gelatin coated 10 cm dishes. Confluent HUVECs were photographed under phase contrast microscopy. The cells formed a monolayer of flat cells without gaps. Passage 2–5 cells were used for all experiments. Confluent HUVECs were treated with trypsin/EDTA and seeded onto collagen gels. Collagen gels were made according to the protocol of the Collagen manufacturer (Becton Dickinson Labware). Collagen gels were prepared with the following ingredients: Rat tail collagen type I (Collaborative Biomedical) 1.5 mg/mL, mouse laminin (Collaborative Biomedical) 0.5 mg/mL, 10% 10X media 199 (Gibco BRL). 1N NaOH, 10 X PBS and sterile water were added in amounts recommended in the protocol. Cell density was measured by microscopy. $1.2 \times 10^6$ cells were seeded onto gels in 6-well, 35 mm dishes, in 5% FCS M199 media. The cells were incubated for 2 hrs at 37 C with 5% $CO_2$. The media was then changed to the same media with the addition of VEGF (Sigma) at 30 ng/mL media. Cells were cultured for 36 hrs. At 12, 24 and 36 hrs, the cells were observed with phase contrast microscopy. At 36 hours, the cells were observed elongating, adhering to each other and forming lumen structures. At 12 and 24 hrs media was aspirated and refreshed. At 36 hrs, the media was aspirated, the cells were rinsed with PBS and then treated with Collagenase (Sigma) 2.5 mg/mL PBS for 5 min with active agitation until the collagen gels were liquefied. The cells were then centrifuged at 4C, 2000 g for 10 min. The supernatant was removed and the cells were lysed with 1 mL Trizol Reagent (Gibco) per $5 \times 10^6$ cells. Total RNA was prepared as specified in the Trizol instructions for use. mRNA was then isolated as described in the micro-fast track mRNA isolation protocol from Invitrogen. This RNA was used as the tester RNA for the subtraction procedure.

Ten plates of resting, confluent, p4 HUVECs, were cultured with 15% FCS in the M199 media described above. The media was aspirated and the cells were lysed with 1 mL Trizol and total RNA was prepared according to the Trizol protocol. mRNA was then isolated according to the micro-fast track mRNA isolation protocol from Invitrogen. This RNA served as the control RNA for the subtraction procedure.

The entire subtraction cloning procedure was carried out as per the user manual for the Clontech PCR Select Subtraction Kit. The cDNAs prepared from the test population of HUVECs were divided into "tester" pools, while cDNAs prepared from the control population of HUVECs were designated the "driver" pool. cDNA was synthesized from the tester and control RNA samples described above. Resulting cDNAs were digested with the restriction enzyme RsaI. Unique double-stranded adapters were ligated to the tester cDNA. An initial hybridization was performed consisting of the tester pools of cDNA (with its corresponding adapter) and an excess of the driver cDNA. The initial hybridization results in a partial normalization of the cDNAs such that high and low abundance messages become more equally represented following hybridization due to a failure of driver/tester hybrids to amplify.

A second hybridization involved pooling unhybridized sequences from the first hybridization together with the addition of supplemental driver cDNA. In this step, the expressed sequences enriched in the two tester pools following the initial hybridization can hybridize. Hybrids resulting from the hybridization between members of each of the two tester pools are then recovered by amplification in a polymerase chain reaction (PCR) using primers specific for the unique adapters. Again, sequences originating in a tester pool that form hybrids with components of the driver pool are not amplified. Hybrids resulting between members of the same tester pool are eliminated by the formation of "panhandles" between their common 5' and 3' ends. The subtraction was done in both directions, producing two libraries, one with clones that are upregulated in tube-formation and one with clones that are down-regulated in the process.

The resulting PCR products representing partial cDNAs of differentially expressed genes were then cloned (i.e., ligated) into an appropriate vector according to the manufacturer's protocol (pGEM-Teasy from Promega) and transformed into competent bacteria for selection and screening. Colonies (2180) were picked and cultured in LB broth with 50 ug/mL ampicillin at 37C overnight. Stocks of saturated LB+50 ug/mL ampicillin and 15% glycerol in 96-well plates were stored at −80C. Plasmid was prepared from 1.4 mL saturated LB broth containing 50 ug/mL ampicillin. This was done in a 96 well format using commercially available kits according to the manufacturer's recommendations (Qiagen 96-turbo prep).

2 probes to represent 22 of these sequences required, therefore, a total of 237 probes were derived from this library.

Viral Genes

Several viruses may play a role in a host of disease including inflammatory disorders, atherosclerosis, and transplant rejection. Table 12 lists the viral genes represented by oligonucleotide probes on the microarray. Low-complexity regions in the sequences were masked using RepeatMasker before using them to design probes.

Strand Selection

It was necessary to design sense oligonucleotide probes because the labeling and hybridization protocol to be used with the microarray results in fluorescently-labeled anti-sense cRNA. All of the sequences we selected to design probes could be divided into three categories:

(1) Sequences known to represent the sense strand
(2) Sequences known to represent the antisense strand
(3) Sequences whose strand could not be easily determined from their descriptions It was not known whether the sequences from the leukocyte subtracted expression library were from the sense or antisense strand. GenBank sequences are reported with sequence given 5' to 3', and the majority of the sequences we used to design probes came from accession numbers with descriptions that made it clear whether they represented sense or antisense sequence. For example, all sequences containing "mRNA" in their descriptions were understood to be the sequences of the sense mRNA, unless otherwise noted in the description, and all IMAGE Consortium clones are directionally cloned and so the direction (or sense) of the reported sequence can be determined from the annotation in the GenBank record.

For accession numbers representing the sense strand, the sequence was downloaded and masked and a probe was designed directly from the sequence. These probes were selected as close to the 3' end as possible. For accession numbers representing the antisense strand, the sequence was downloaded and masked, and a probe was designed complementary to this sequence. These probes were designed as close to the 5' end as possible (i.e., complementary to the 3' end of the sense strand).

Minimizing Probe Redundancy.

Multiple copies of certain genes or segments of genes were included in the sequences from each category described above, either by accident or by design. Reducing redundancy within each of the gene sets was necessary to maximize the number of unique genes and ESTs that could be represented on the microarray.

Three methods were used to reduce redundancy of genes, depending on what information was available. First, in gene sets with multiple occurrences of one or more UniGene numbers, only one occurrence of each UniGene number was kept. Next, each gene set was searched by GenBank accession numbers and only one occurrence of each accession number was conserved. Finally, the gene name, description, or gene symbol were searched for redundant genes with no UniGene number or different accession numbers. In reducing the redundancy of the gene sets, every effort was made to conserve the most information about each gene.

We note, however, that the UniGene system for clustering submissions to GenBank is frequently updated and UniGene cluster IDs can change. Two or more clusters may be combined under a new cluster ID or a cluster may be split into several new clusters and the original cluster ID retired. Since the lists of genes in each of the gene sets discussed were assembled at different times, the same sequence may appear in several different sets with a different UniGene ID in each.

Sequences from Table 3A were treated differently. In some cases, two or more of the leukocyte subtracted expression library sequences aligned to different regions of the same GenBank entry, indicating that these sequences were likely to be from different exons in the same gene transcript. In these cases, one representative library sequence corresponding to each presumptive exon was individually listed in Table 3A.

Compilation.

After redundancy within a gene set was sufficiently reduced, a table of approximately 8,000 unique genes and ESTs was compiled in the following manner. All of the entries in Table 3A were transferred to the new table. The list of genes produced by literature and database searches was added, eliminating any genes already contained in Table 3A. Next, each of the remaining sets of genes was compared to the table and any genes already contained in the table were deleted from the gene sets before appending them to the table.

| | Probes |
|---|---|
| Subtracted Leukocyte Expression Library | |
| Table 3A | 4,872 |
| Table 3B | 796 |
| Table 3C | 85 |
| Literature Search Results | 494 |
| Database Mining | 1,607 |
| Viral genes | |
| a. CMV | 14 |
| b. EBV | 6 |
| c. HHV 6 | 14 |
| d. Adenovirus | 8 |

-continued

| | Probes |
|---|---|
| Angiogenesis markers: 215, 22 of which needed two probes | 237 |
| *Arabidopsis thaliana* genes | 10 |
| Total sequences used to design probes | 8,143 |

Example 12

Design of Oligonucleotide Probes

By way of example, this section describes the design of four oligonucleotide probes using Array Designer Ver 1.1 (Premier Biosoft International, Palo Alto, Calif.). The major steps in the process are given first.

1) Obtain best possible sequence of mRNA from GenBank. If a full-length sequence reference sequence is not available, a partial sequence is used, with preference for the 3' end over the 5' end. When the sequence is known to represent the antisense strand, the reverse complement of the sequence is used for probe design. For sequences represented in the subtracted leukocyte expression library that have no significant match in GenBank at the time of probe design, our sequence is used.

2) Mask low complexity regions and repetitive elements in the sequence using an algorithm such as RepeatMasker.

3) Use probe design software, such as Array Designer, version 1.1, to select a sequence of 50 residues with specified physical and chemical properties. The 50 residues nearest the 3' end constitute a search frame. The residues it contains are tested for suitability. If they don't meet the specified criteria, the search frame is moved one residue closer to the 5' end, and the 50 residues it now contains are tested. The process is repeated until a suitable 50-mer is found.

4) If no such 50-mer occurs in the sequence, the physical and chemical criteria are adjusted until a suitable 50-mer is found.

5) Compare the probe to dbEST, the UniGene cluster set, and the assembled human genome using the BLASTn search tool at NCBI to obtain the pertinent identifying information and to verify that the probe does not have significant similarity to more than one known gene.

Clone 40H12

Clone 40H12 was sequenced and compared to the nr, dbEST, and UniGene databases at NCBI using the BLAST search tool. The sequence matched accession number NM_002310, a 'curated RefSeq project' sequence, see Pruitt et al. (2000) *Trends Genet.* 16:44–47, encoding leukemia inhibitory factor receptor (LIFR) mRNA with a reported E value of zero. An E value of zero indicates there is, for all practical purposes, no chance that the similarity was random based on the length of the sequence and the composition and size of the database. This sequence, cataloged by accession number NM_002310, is much longer than the sequence of clone 40H 12 and has a poly-A tail. This indicated that the sequence cataloged by accession number NM_002310 is the sense strand and a more complete representation of the mRNA than the sequence of clone 40H 12, especially at the 3' end. Accession number "NM_002310" was included in a text file of accession numbers representing sense strand mRNAs, and sequences for the sense strand mRNAs were obtained by uploading a text file containing desired accession numbers as an Entrez search query using the Batch Entrez web interface and saving the results locally as a FASTA file. The following sequence was obtained, and the region of alignment of clone 40H12 is outlined:

```
CTCTCTCCCAGAACGTGTCTCTGCTGCAAGGCACCGGGCCCTTTCGCTCTGCAGAACTGC    (SEQ ID NO: 8827)
ACTTGCAAGACCATTATCAACTCCTAATCCCAGCTCAGAAAGGGAGCCTCTGCGACTCAT
TCATCGCCCTCCAGGACTGACTGCATTGCACAGATGATGGATATTTACGTATGTTTGAAA
CGACCATCCTGGATGGTGGACAATAAAAGAATGAGGACTGCTTCAAATTTCCAGTGGCTG
TTATCAACATTTATTCTTCTATATCTAATGAATCAAGTAAATAGCCAGAAAAAGGGGGCT
CCTCATGATTTGAAGTGTGTAACTAACAATTTGCAAGTGTGGAACTGTTCTTGGAAAGCA
CCCTCTGGAACAGGCCGTGGTACTGATTATGAAGTTTGCATTGAAAACAGGTCCCGTTCT
TGTTATCAGTTGGAGAAAACCAGTATTAAAATTCCAGCTCTTTCACATGGTGATTATGAA
ATAACAATAAATTCTCTACATGATTTTGGAAGTTCTACAAGTAAATTCACACTAAATGAA
CAAAACGTTTCCTTAATTCCAGATACTCCAGAGATCTTGAATTTGTCTGCTGATTTCTCA
ACCTCTACATTATACCTAAAGTGGAACGACAGGGGTTCAGTTTTTCCACACCGCTCAAAT
GTTATCTGGGAAATTAAAGTTCTACGTAAAGAGAGTATGGAGCTCGTAAAATTAGTGACC
CACAACACAACTCTGAATGGCAAAGATACACTTCATCACTGGAGTTGGGCCTCAGATATG
CCCTTGGAATGTGCCATTCATTTGTGGAAATTAGATGCTACATTGACAATCTTCATTTT
TCTGGTCTCGAAGAGTGGAGTGACTGGAGCCCTGTGAAGAACATTTCTTGGATACCTGAT
TCTCAGACTAAGGTTTTTCCTCAAGATAAAGTGATACTTGTAGGCTCAGACATAACATTT
TGTTGTGTGAGTCAAGAAAAAGTGTTATCAGCACTGATTGGCCATACAAACTGCCCCTTG
ATCCATCTTGATGGGAAAATGTTGCAATCAAGATTCGTAATATTTCTGTTTCTGCAAGT
AGTGGAACAAATGTAGTTTTTACAACCGAAGATAACATATTTGGAACCGTTATTTTTGCT
GGATATCCACCAGATACTCCTCAACAACTGAATTGTGAGACACATGATTTAAAAGAAATT
ATATGTAGTTGGAATCCAGGAAGGGTGACAGCGTTGGTGGGCCCACGTGCTACAAGCTAC
ACTTTAGTTGAAAGTTTTTCAGGAAAATATGTTAGACTTAAAAGAGCTGAAGCACCTACA
AACGAAAGCTATCAATTATTATTTCAAATGCTTCCAAATCAAGAAATATATAATTTTACT
TTGAATGCTCACAATCCGCTGGGTCGATCACAATCAACAATTTTAGTTAATATAACTGAA
AAAGTTTATCCCCATACTCCTACTTCATTCAAAGTGAAGGATATTAATTCAACAGCTGTT
AAACTTTCTTGGCATTTACCAGGCAACTTTGCAAAGATTAATTTTTTATGTGAAATTGAA
ATTAAGAAATCTAATTCAGTACAAGAGCAGCGGAATGTCACAATCAAAGGAGTAGAAAAT
TCAAGTTATCTTGTTGCTCTGGACAAGTTAAATCCATACACTCTATATACTTTTCGGATT
CGTTGTTCTACTGAAACTTTCTGGAAATGGAGCAAATGGAGCAATAAAAAACAACATTTA
ACAACAGAAGCCAGTCCTTCAAAGGGGCCTGATACTTGGAGAGAGTGGAGTTCTGATGGA
AAAAATTTAATAATCTATTGGAAGCCTTTACCCATTAATGAAGCTAATGGAAAAATACTT
TCCTACAATGTATCGTGTTCATCAGATGAGGAAACACAGTCCCTTTCTGAAATCCCTGAT
CCTCAGCACAAAGCAGAGATACGACTTGATAAGAATGACTACATCATCAGCGTAGTGGCT
AAAAATTCTGTGGGCTCATCACCACCTTCCAAAATAGCGAGTATGGAAATTCCAAATGAT
GATCTCAAAATAGAACAAGTTGTTGGGATGGGAAAGGGGATTCTCCTCACCTGGCATTAC
GACCCCAACATGACTTGCGACTACGTCATTAAGTGGTGTAACTCGTCTCGGTCGGAACCA
TGCCTTATGGACTGGAGAAAAGTTCCCTCAAACAGCACTGAAACTGTAATAGAATCTGAT
GAGTTTCGACCAGGTATAAGATATAATTTTTTCCTGTATGGATGCAGAAATCAAGGATAT
CAATTATTACGCTCCATGATTGGATATATAGAAGAATTGGCTCCCATTGTTGCACCAAAT
TTTACTGTTGAGGATACTTCTGCAGATTCGATATTAGTAAAATGGGAAGACATTCCTGTG
GAAGAACTTAGAGGCTTTTTAAGAGGATATTTGTTTTACTTTGGAAAAGGAGAAAGAGAC
ACATCTAAGATGAGGGTTTTAGAATCAGGTCGTTCTGACATAAAAGTTAAGAATATTACT
GACATATCCCAGAAGACACTGAGAATTGCTGATCTTCAAGGTAAAACAAGTTACCACCTG
GTCTTGCGAGCCTATACAGATGGTGGAGTGGGCCCGGAGAAGAGTATGTATGTGGTGACA
AAGGAAAATTCTGTGGGATTAATTATTGCCATTCTCATCCCAGTGGCAGTGGCTGTCATT
GTTGGAGTGGTGACAAGTATCCTTTGCTATCGGAAACGAGAATGGATTAAAGAAACCTTC
TACCCTGATATTCCAAATCCAGAAAACTGTAAAGCATTACAGTTTCAAAAGAGTGTCTGT
GAGGGAAGCAGTGCTCTTAAAACATTGGAAATGAATCCTTGTACCCCAAATAATGTTGAG
GTTCTGGAAACTCGATCAGCATTTCCTAAAATAGAAGATACAGAAATAATTTCCCCAGTA
GCTGAGCGTCCTGAAGATCGCTCTGATGCAGAGCCTGAAAACCATGTGGTTGTGTCCTAT
TGTCCACCCATCATTGAGGAAGAAATACCAAACCCAGCCGCAGATGAAGCTGGAGGGACT
GCACAGGTTATTTACATTGATGTTCAGTCGATGTATCAGCCTCAAGCAAAACCAGAAGAA
GAACAAGAAAATGACCCTGTAGGAGGGGCAGGCTATAAGCCACACAGATGCACCTCCCCATT
AATTCTACTGTGGAAGATATAGCTGCAGAAGAGGACTTAGATAAAACTGCGGGTTACAGA
CCTCAGGCCAATGTAAATACATGGAATTTAGTGTCTCCAGACTCTCCTAGATCCATAGAC
AGCAACAGTGAGATTGTCTCATTTGGAAGTCCATGCTCCATTAATTCCCGACAATTTTTG
```

-continued

```
ATTCCTCCTAAAGATGAAGACTCTCCTAAATCTAATGGAGGAGGGTGGTCCTTTACAAAC
TTTTTTCAGAACAAACCAAACGATTAACAGTGTCACCGTGTCACTTCAGTCAGCCATCTC
AATAAGCTCTTACTGCTAGTGTTGCTACATCAGCACTGGGCATTCTTGGAGGGATCCTGT
GAAGTATTGTTAGGAGGTGAACTTCACTACATGTTAAGTTACACTGAAAGTTCATGTGCT
TTTAATGTAGTCTAAAAGCCAAAGTATAGTGACTCAGAATCCTCAATCCACAAAACTCAA
GATTGGGAGCTCTTTGTGATCAAGCCAAAGAATTCTCATGTACTCTACCTTCAAGAAGCA
TTTCAAGGCTAATACCTACTTGTACGTACATGTAAAACAAATCCCGCCGCAACTGTTTTC
TGTTCTGTTGTTTGTGGTTTTCTCATATGTATACTTGGTGGAATTGTAAGTGGATTTGCA
GGCCAGGGAGAAAATGTCCAAGTAACAGGTGAAGTTTATTTGCCTGACGTTTACTCCTTT
CTAGATGAAAACCAAGCACAGATTTTAAAACTTCTAAGATTATTCTCCTCTATCCACAGC
ATTCACAAAAATTAATATAATTTTTAATGTAGTGACAGCGATTTAGTGTTTTGTTTGATA
AAGTATGCTTATTTCTGTGCCTACTGTATAATGGTTATCAAACAGTTGTCTCAGGGGTAC
AAACTTTGAAAACAAGTGTGACACTGACCAGCCCAAAT CATAATCATGTTTTCTTGCTGT
GATAGGTTTTGCTTGCCTTTTCATTATTTTTTAGCTTTTATGCTTGCTTCCATTATTTCA
GTTGGTTGCCCTAATATTTAAAATTTACACTTCTAAGACTAGAGACCCACATTTTTTAAA
AATCATTTTATTTTGTGATACAGTGACAGCTTTATATGAGCAAATTCAATATTATTCATA
AGCATGTAATTCCAGTGACTTACTATGTGAGATGACTACTAAGCAATATCTAGCAGCGTT
AGTTCCATATAGTTCTGATTGGATTTCGTTCCTCCTGAGGAGACCATGCCGTTGAGCTTG
GCTACCCAGGCAGTGGTGATCTTTGACACCTTCTGGTGGATGTTCCTCCCACTCATGAGT
CTTTTCATCATGCCACATTATCTGATCCAGTCCTCACATTTTTAAATATAAAACTAAAGA
GAGAATGCTTCTTACAGGAACAGTTACCCAAGGGCTGTTTCTTAGTAACTGTCATAAACT
GATCTGGATCCATGGGCATACCTGTGTTCGAGGTGCAGCAATTGCTTGGTGAGCTGTGCA
GAATTGATTGCCTTCAGCACAGCATCCTCTGCCCACCCTTGTTTCTCATAAGCGATGTCT
GGAGTGATTGTGGTTCTTGGAAAAGCAGAAGGAAAAACTAAAAAGTGTATCTTGTATTTT
CCCTGCC CTCAGGTTGCCTATGTATTTTACCTTTTCATATTTAAGGCAAAAGTACTTGAA
AATTTTAAGTGTCCGAATAAGATATGTCTTTTTTGTTTGTTTTTTTGGTTGGTTGTTTG
TTTTTTATCATCTGAGATTCTGTAATGTATTTGCAAATAATGGATCAATTAATTTTTTTT
GAAGCTCATATTGTATCTTTTTAAAAACCATGTTGTGGAAAAAAGCCAGAGTGACAAGTG
ACAAAATCTATTTAGGAACTCTGTGTATGAATCCTGATTTTAACTGCTAGGATTCAGCTA
AATTTCTGAGCTTTATGATCTGTGGAAATTTGGAATGAAATCGAATTCATTTTGTACATA
CATAGTATATTAAAACTATATAATAGTTCATAGAAATGTTCAGTAATGAAAAAATATATC
CAATCAGAGCCATCCCGAAAAAAAAAAAAAA
```

The FASTA file, including the sequence of NM_002310, was masked using the RepeatMasker web interface (Smit, AFA & Green, P RepeatMasker at genome.washington.edu/RM/RepeatMasker.html, Smit and Green). Specifically, during masking, the following types of sequences were replaced with "N's": SINE/MIR & LINE/L2, LINE/L1, LTR/MaLR, LTR/Retroviral, Alu, and other low informational content sequences such as simple repeats. Below is the sequence following masking:

```
CTCTCTCCCAGAACGTGTCTCTGCTGCAAGGCACCGGGCCCTTTCGCTCTGCAGAACTG    (SEQ ID NO: 8828)
CACTTGCAAGACCATTATCAACTCCTAATCCCAGCTCAGAAAGGGAGCCTCTGCGACTC
AATCATCGCCCTCCAGGACTGACTGCATTGCACAGATGATGGATATTTACGTATGTTTG
AAACGACCATCCTGGATGGTGGACAATAAAAGAATGAGGACTGCTTCAAATTTCCAGTG
GCTGTTATCAACATTTATTCTTCTATATCTAATGAATCAAGTAAATAGCCAGAAAAAGG
GGGCTCCTCATGATTTGAAGTGTGTAACTAACAATTTGCAAGTGTGGAACTGTTCTTGG
AAAGCACCCTCTGGAACAGGCCGTGGTACTGATTATGAAGTTTGCATTGAAAACAGGTC
CCGTTCTTGTTATCAGTTGGAGAAAACCAGTATTAAAATTCCAGCTCTTTCACATGGTG
ATTATGAAATAACAATAAATTCTCTACATGATTTTGGAACTTCTACAAGTAAATTCACA
CTAAATGAACAAAACGTTTCCTTAATTCCAGATACTCCAGAGATCTTGAATTTGTCTGC
TGATTTCTCAACCTCTACATTATACCTAAAGTGGAACGACAGGGGTTCAGTTTTTCCAC
ACCGCTCAAATGTTATCTGGGAAATTAAAGTTCTACGTAAAGAGAGTATGGAGCTCGTA
AAATTAGTGACCCACAACACAACTCTGAATGGCAAAGATACACTTCATCACTGGAGTTG
GGCCTCAGATATGCCCTTGGAATGTGCCATTCATTTTGTGGAAATTAGATGCTACATTG
ACAATCTTCATTTTTCTGGTCTCGAAGAGTGGAGTGACTGGAGCCCTGTGAAGAACATT
TCTTGGATACCTGATTCTCAGACTAAGGTTTTTCCTCAAGATAAAGTGATACTTGTAGG
```

```
CTCAGACATAACATTTTGTTGTGTGAGTCAAGAAAAAGTGTTATCAGCACTGATTGGCC
ATACAAACTGCCCCTTGATCCATCTTGATGGGGAAAATGTTGCAATCAAGATTCGTAAT
ATTTCTGTTTCTGCAAGTAGTGGAACAAATGTAGTTTTTACAACCGAAGATAACATATT
TGGAACCGTTATTTTTGCTGGATATCCACCAGATACTCCTCAACAACTGAATTGTGAGA
CACATGATTTAAAAGAAATTATATGTAGTTGGAATCCAGGAAGGGTGACAGCGTTGGTG
GGCCCACGTGCTACAAGCTACACTTTAGTTGAAAGTTTTTCAGGAAAATATGTTAGACT
TAAAAGAGCTGAAGCACCTACAAACGAAAGCTATCAATTATTATTTCAAATGCTTCCAA
ATCAAGAAATATATAATTTTACTTTGAATGCTCACAATCCGCTGGGTCGATCACAATCA
ACAATTTTAGTTAATATAACTGAAAAAGTTTATCCCCATACTCCTACTTCATTCAAAGT
GAAGGATATTAATTCAACAGCTGTTAAACTTTCTTGGCATTTACCAGGCAACTTTGCAA
AGATTAATTTTTTATGTGAAATTGAAATTAAGAAATCTAATTCAGTACAAGAGCAGCGG
AATGTCACAATCAAAGGAGTAGAAAATTCAAGTTATCTTGTTGCTCTGGACAAGTTAAA
TCCATACACTCTATATACTTTTCGGATTCGTTGTTCTACTGAAACTTTCTGGAAATGGA
GCAAATGGAGCAATAAAAAACAACATTTAACAACAGAAGCCAGTCCTTCAAAGGGGCCT
GATACTTGGAGAGAGTGGAGTTCTGATGAAAAAATTTAATAATCTATTGGAAGCCTTT
ACCCATTAATGAAGCTAATGGAAAAATACTTTCCTACAATGTATCGTGTTCATCAGATG
AGGAAACACAGTCCCTTTCTGAAATCCCTGATCCTCAGCACAAAGCAGAGATACGACTT
GATAAGAATGACTACATCATCAGCGTAGTGGCTAAAAATTCTGTGGGCTCATCACCACC
TTCCAAAATAGCGAGTATGGAAATTCCAAATGATGATCTCAAAATAGAACAAGTTGTTG
GGATGGGAAAGGGGATTCTCCTCACCTGGCATTACGACCCCAACATGACTTGCGACTAC
GTCATTAAGTGGTGTAACTCGTCTCGGTCGGAACCATGCCTTATGGACTGGAGAAAAGT
TCCCTCAAACAGCACTGAAACTGTAATAGAATCTGATGAGTTTCGACCAGGTATAAGAT
ATAATTTTTTCCTGTATGGATGCAGAAATCAAGGATATCAATTATTACGCTCCATGATT
GGATATATAGAAGAATTGGCTCCCATTGTTGCACCAAATTTTACTGTTGAGGATACTTC
TGCAGATTCGATATTAGTAAAATGGGAAGACATTCCTGTGGAAGAACTTAGAGGCTTTT
TAAGAGGATATTTGTTTTACTTTGGAAAAGGAGAAAGAGACACATCTAAGATGAGGGTT
TTAGAATCAGGTCGTTCTGACATAAAAGTTAAGAATATTACTGACATATCCCAGAAGAC
ACTGAGAATTGCTGATCTTCAAGGTAAAACAAGTTACCACCTGGTCTTGCGAGCCTATA
CAGATGGTGGAGTGGGCCCGGAGAAGAGTATGTATGTGGTGACAAAGGAAAATTCTGTG
GGATTAATTATTGCCATTCTCATCCCAGTGGCAGTGGCTGTCATTGTTGGAGTGGTGAC
AAGTATCCTTTGCTATCGGAAACGAGAATGGATTAAAGAAACCTTCTACCCTGATATTC
CAAATCCAGAAAACTGTAAAGCATTACAGTTTCAAAAGAGTGTCTGTGAGGGAAGCAGT
GCTCTTAAAACATTGGAAATGAATCCTTGTACCCCAAATAATGTTGAGGTTCTGGAAAC
TCGATCAGCATTTCCTAAAATAGAAGATACAGAAATAATTTCCCCAGTAGCTGAGCGTC
CTGAAGATCGCTCTGATGCAGAGCCTGAAAACCATGTGGTTGTGTCCTATTGTCCACCC
ATCATTGAGGAAGAAATACCAAACCCAGCCGCAGATGAAGCTGGAGGGACTGCACAGGT
TATTTACATTGATGTTCAGTCGATGTATCAGCCTCAAGCAAAACCAGAAGAAGAACAAG
AAAATGACCCTGTAGGAGGGGCAGGCTATAAGCCACAGATGCACCTCCCCATTAATTCT
ACTGTGGAAGATATAGCTGCAGAAGAGGACTTAGATAAAACTGCGGGTTACAGACCTCA
GGCCAATGTAAATACATGGAATTTAGTGTCTCCAGACTCTCCTAGATCCATAGACAGCA
ACAGTGAGATTGTCTCATTTGGAAGTCCATGCTCCATTAATTCCCGACAATTTTTGATT
CCTCCTAAAGATGAAGACTCTCCTAAATCTAATGGAGGAGGGTGGTCCTTTACAAACTT
TTTTCAGAACAAACCAAACGATTAACAGTGTCACCGTGTCACTTCAGTCAGCCATCTCA
ATAAGCTCTTACTGCTAGTGTTGCTACATCAGCACTGGGCATTCTTGGAGGGATCCTGT
GAAGTATTGTTAGGAGGTGAACTTCACTACATGTTAAGTTACACTGAAAGTTCATGTGC
TTTTAATGTAGTCTAAAAGCCAAAGTATAGTGACTCAGAATCCTCAATCCACAAAACTC
AAGATTGGGAGCTCTTTGTGATCAAGCCAAAGAATTCTCATGTACTCTACCTTCAAGAA
GCATTTCAAGGCTAATACCTACTTGTACGTACATGTAAAACAAATCCCGCCGCAACTGT
TTTCTGTTCTGTTGTTTGTGGTTTTCTCATATGTATACTTGGTGGAATTGTAAGTGGAT
TTGCAGGCCAGGGAGAAAATGTCCAAGTAACAGGTGAAGTTTATTTGCCTGACGTTTAC
TCCTTTCTAGATGAAAACCAAGCACAGATTTTAAAACTTCTAAGATTATTCTCCTCTAT
CCACAGCATTCACNNNNNNNNNNNNNNNNNNNNNNGTAGTGACAGCGATTTAGTGTTTT
GTTTGATAAAGTATGCTTATTTCTGTGCCTACTGTATAATGGTTATCAAACAGTTGTCT
CAGGGGTACAAACTTTGAAAACAAGTGTGACACTGACCAGCCCAAATCATAATCATGTT
TTCTTGCTGTGATAGGTTTTGCTTGCCTTTTCATTATTTTTTAGCTTTTATGCTTGCTT
```

```
CCATTATTTCAGTTGGTTGCCCTAATATTTAAAATTTACACTTCTAAGACTAGAGACCC
ACATTTTTTAAAAATCATTTTATTTTGTGATACAGTGACAGCTTTATATGAGCAAATTC
AATATTATTCATAAGCATGTAATTCCAGTGACTTACTATGTGAGATGACTACTAAGCAA
TATCTAGCAGCGTTAGTTCCATATAGTTCTGATTGGATTTCGTTCCTCCTGAGGAGACC
ATGCCGTTGAGCTTGGCTACCCAGGCAGTGGTGATCTTTGACACCTTCTGGTGGATGTT
CCTCCCACTCATGAGTCTTTTCATCATGCCACATTATCTGATCCAGTCCTCACATTTTT
AAATATAAAACTAAAGAGAGAATGCTTCTTACAGGAACAGTTACCCAAGGGCTGTTTCT
TAGTAACTGTCATAAACTGATCTGGATCCATGGGCATACCTGTGTTCGAGGTGCAGCAA
TTGCTTGGTGAGCTGTGCAGAATTGATTGCCTTCAGCACAGCATCCTCTGCCCACCCTT
GTTTCTCATAAGCGATGTCTGGAGTGATTGTGGTTCTTGGAAAAGCAGAAGGAAAAACT
AAAAAGTGTATCTTGTATTTTCCCTGCC
```
CTCAGGTTGCCTATGTATTTTACCTTTTCAT
ATTTAAGGCAAAAGTACTTGAAAATTTTAAGTGTCCGAATAAGATATGTCTTTTTTGTT
TGTTTTTTTTGGTTGGTTGTTTGTTTTTTATCATCTGAGATTCTGTAATGTATTTGCAA
ATAATGGATCAATTAATTTTTTTTGAAGCTCATATTGTATCTTTTTAAAAACCATGTTG
TGGAAAAAAGCCAGAGTGACAAGTGACAAAATCTATTTAGGAACTCTGTGTATGAATCC
TGATTTTAACTGCTAGGATTCAGCTAAATTTCTGAGCTTTATGATCTGTGGAAATTTGG
AATGAAATCGAATTCATTTTGTACATACATAGTATATTAAAACTATATAATAGTTCATA
GAAATGTTCAGTAATGAAAAAATATATCCAATCAGAGCCATCCCGAAAAAAAAAAAAAA
A

The length of this sequence was determined using batch, automated computational methods and the sequence, as sense strand, its length, and the desired location of the probe sequence near the 3' end of the mRNA was submitted to Array Designer Ver 1.1 (Premier Biosoft International, Palo Alto, Calif.). Search quality was set at 100%, number of best probes set at 1, length range set at 50 base pairs, Target Tm set at 75 C. degrees plus or minus 5 degrees, Hairpin max deltaG at 6.0-kcal/mol., Self dimmer max deltaG at 6.0-kcal/mol, Run/repeat (dinucleotide) max length set at 5, and Probe site minimum overlap set at 1. When none of the 49 possible probes met the criteria, the probe site would be moved 50 base pairs closer to the 5' end of the sequence and resubmitted to Array Designer for analysis. When no possible probes met the criteria, the variation on melting temperature was raised to plus and minus 8 degrees and the number of identical basepairs in a run increased to 6 so that a probe sequence was produced.

In the sequence above, using the criteria noted above, Array Designer Ver 1.1 designed a probe corresponding to oligonucleotide number 2280 in Table 8 and is indicated by underlining in the sequence above. It has a melting temperature of 68.4 degrees Celsius and a max run of 6 nucleotides and represents one of the cases where the criteria for probe design in Array Designer Ver 1.1 were relaxed in order to obtain an oligonucleotide near the 3' end of the mRNA (Low melting temperature was allowed).

Clone 463D12

Clone 463D12 was sequenced and compared to the nr, dbEST, and UniGene databases at NCBI using the BLAST search tool. The sequence matched accession number A 184553, an EST sequence with the definition line "qd60a05.x1 Soares_testis_NHT *Homo sapiens* cDNA clone IMAGE:1733840 3' similar to gb:M29550 PROTEIN PHOSPHATASE 2B CATALYTIC SUBUNIT 1 (HUMAN); mRNA sequence." The E value of the alignment was $1.00 \times 10^{-118}$. The GenBank sequence begins with a poly-T region, suggesting that it is the antisense strand, read 5' to 3'. The beginning of this sequence is complementary to the 3' end of the mRNA sense strand. The accession number for this sequence was included in a text file of accession numbers representing antisense sequences. Sequences for antisense strand mRNAs were obtained by uploading a text file containing desired accession numbers as an Entrez search query using the Batch Entrez web interface and saving the results locally as a FASTA file. The following sequence was obtained, and the region of alignment of clone 463D12 is outlined:

```
TTTTTTTTTTTTTTCTTAAATAGCATTTATTTTCTCTCAAAAAGCCTATTATGTACTAA     (SEQ ID NO: 8829)
CAAGTGTTCCTCTAAATTAGAAAGGCATCACTACTAAAATTTTATACATATTTTTATA
TAAGAGAAGGAATATTGGGTTACAATCTGAATTTCTCTTTATGATTTCTCTTAAAGTAT
AGAACAGCTATTAAAATGACTAATATTGCTAAAATGAAGGCTACTAAATTTCCCCAAGA
ATTTCGGTGGAATGCCCAAAAATGGTGTTAAGATATGCAGAAGGGCCCATTTCAAGCAA
AGCAATCTCTCCACCCCTTCATAAAAGATTTAAGCTAAAAAAAAAAAAAAAAGAAGAAA
ATCCAACAGCTGAAGACATTGGGCTATTTATAAATCTTCTCCCAGTCCCCCAGACAGCC
TCACATGGGGGCTGTAAACAGCTAACTAAAATATCTTTGAGACTCTTATGTCCACACCC
```

-continued

```
ACTGACACAAGGAGAGCTGTAACCACAGTGAAACTAGACTTTGCTTTCCTTTAGCAAGT
ATGTGCCTATGATAGTAAACTGGAGTAAATGTAACAGTAATAAAACAAATTTTTTTTAA
AAATAAAAATTATACCTTTTTCTCCAACAAACGGTAAAGACCACGTGAAGACATCCATA
AAATTAGGCAACCAGTAAAGATGTGGAGAACCAGTAAACTGTCGAAATTCATCACATTA
TTTTCATACTTTAATACAGCAGCTTTAATTATTGGAGAACATCAAAGTAATTAGGTGCC
GAAAAACATTGTTATTAATGAAGGGAACCCCTGACGTTTGACCTTTTCTGTACCATCTA
TAGCCCTGGACTTGA
```

The FASTA file, including the sequence of AA184553, was then masked using the RepeatMasker web interface, as shown below. The region of alignment of clone 463D12 is outlined.

```
TTTTTTTTTTTTTCTTAAATAGCATTTATTTTCTCTCAAAAAGCCTATTATGTACTAA      (SEQ ID NO: 8830)
CAAGTGTTCCTCTAAATTAGAAAGGCATCACTACNNNNNNNNNNNNNNNNNNNNNNNNN
NNNGAGAAGGAATATTGGGTTACAATCTGAATTTCTCTTTATGATTTCTCTTAAAGTAT
AGAACAGCTATTAAAATGACTAATATTGCTAAAATGAAGGCTACTAAATTTCCCCAAGA
ATTTCCGTGGAATGCCCAAAAATGGTGTTAAGATATGCAGAAGGGCCCATTTCAAGCAA
AGCAATCTCTCCACCCCTTCATAAAAGATTTAAGCTAAAAAAAAAAAAAAAAGAAGAAA
ATCCAACAGCTGAAGACATTGGGCTATTTATAAATCTTCTCCCAGTCCCCCAGACAGCC
TCACATGGGGCTGTAAACAGCTAACTAAAATATCTTTGAGACTCTTATGTCCACACCC
ACTGACACAAGGAGAGCTGTAACCACAGTGAAACTAGACTTTGCTTTCCTTTAGCAAGT
ATGTGCCTATGATAGTAAACTGGAGTAAATGTAACAGNNNNNNNNNNNNNNNNNNNNNN
NNNNNNNNNNNNNNCCTTTTTCTCCAACAAACGGTAAAGACCACGTGAAGACATCCATA
AAATTAGGCAACCAGTAAAGATGTGGAGAACCAGTAAACTGTCGAAATTCATCACATTA
TTTTCATACTTTAATACAGCAGCTTTAATTATTGGAGAACATCAAAGTAATTAGGTGCC
GAAAAACATTGTTATTAATGAAGGGAACCCCTGACGTTTGACCTTTTCTGTACCATCTA
TAGCCCTGGACTTGA  Masked version of 463D12 sequence.
```

The sequence was submitted to Array Designer as described above, however, the desired location of the probe was indicated at base pair 50 and if no probe met the criteria, moved in the 3' direction. The complementary sequence from Array Designer was used, because the original sequence was antisense. The oligonucleotide designed by Array Designer corresponds to oligonucleotide number 4342 in Table 8 and is complementary to the underlined sequence above. The probe has a melting temperature of 72.7 degrees centigrade and a max run of 4 nucleotides.

Clone 72D4

Clone 72D4 was sequenced and compared to the nr, dbEST, and UniGene databases at NCBI using the BLAST search tool. No significant matches were found in any of these databases. When compared to the human genome draft, significant alignments were found to three consecutive regions of the reference sequence NT_008060, as depicted below, suggesting that the insert contains three spliced exons of an unidentified gene.

Residue Numbers on Matching Residue

| clone 72D4 sequence numbers on NT_008060 | |
| --- | --- |
| 1–198 | 478646–478843 |
| 197–489 | 479876–480168 |
| 491–585 | 489271–489365 |

Because the reference sequence contains introns and may represent either the coding or noncoding strand for this gene, BioCardia's own sequence file was used to design the oligonucleotide. Two complementary probes were designed to ensure that the sense strand was represented. The sequence of the insert in clone 72D4 is shown below, with the three putative exons outlined.

```
CAGGTCACACAGCACATCAGTGGCTACATGTGAGCTCAGACCTGGGTCTGCTGCTGTCT          (SEQ ID NO: 8545)
GTCTTCCCAATATCCATGACCTTGACTGATGCAGGTGTCTAGGGATACGTCCATCCCCG
TCCTGCTGGAGCCCAGAGCACGGAAGCCTGGCCCTCCGAGGAGACAGAAGGGAGTGTC
GGACACCATGACGAGAGCTT GGCAGAATAAATAACTTCTTTAAACAATTTTACGGCAT
GAAGAAATCTGGACCAGTTTATTAAATGGGATTTCTGCCACAAACCTTGGAAGAATCA
CATCATCTTANNCCCAAGTGAAAACTGTGTTGCGTAACAAAGAACATGACTGCGCTCC
ACACATACATCATTGCCCGGCGAGGCGGGACACAAGTCAACGACGGAACACTTGAGAC
AGGCCTACAACTGTGCACGGGTCAGAAGCAAGTTTAAGCCATACTTGCTGCAGTGAGA
CTACATTTCTGTCTATAGAAGAT A CCTGACTTGATCTGTTTTTCAGCTCCAGTTCCCAG
ATGTGCGTGTTGTGGTCCCCAAGTATCACCTTCCAATTTCTGGGAGCAGTGCTCTGGCC
G GATCCTTGCCGCGCGGATAAAAACT
```

The sequence was submitted to RepeatMasker, but no repetitive sequences were found. The sequence shown above was used to design the two 50-mer probes using Array Designer as described above. The probes are shown in bold typeface in the sequence depicted below. The probe in the sequence is oligonucleotide number 6415 (SEQ ID NO: 6415) in Table 8 and the complementary probe is oligonucleotide number 6805 (SEQ ID NO:6805).

```
CAGGTCACACAGCACATCAGTGGCTACATGTGAGCTCAGACCTGGGTCTGCTGCTGTCTGTCTTCCC

AATATCCATGACCTTGACTGATGCAGGTGTCTAGGGATACGTCCATCCCCGTCCTGCTGGAGCCCAG

AGCACGGAAGCCTGGCCCTCCGAGGAGACAGAAGGGAGTGTCGGACACCATGACGAGAGCTTGGCAG

AATAAATAACTTCTTTAAACAATTTTACGGCATGAAGAAATCTGGACCAGTTTATTAAATGGGATTT

CTGCCACAAACCTTGGAAGAATCACATCATCTTANNCCCAAGTGAAAACTGTGTTGCGTAACAAAGA

ACATGACTGCGCTCCACACATACATCATTGCCCGGCGAGGCGGGACACAAGTCAACGACGGAACACT

TGAGACAGGCCTACAACTGTGCACGGGTCAGAAGCAAGTTTAAGCCATACTTGCTGCAGTGAGACTA

CATTTCTGTCTATAGAAGATACCTGACTTGATCTGTTTTTCAGCTCCAGTTCCCAGATGTGC--->

<----3'-GTCAAGGGTCTACAC

GTGTTGTGGTCCCCAAGTATCACCTTCCAATTTCTGGGAG--->

CACAACACCAGGGGTTCATAGTGGAAGGTTAAAG-5'(SEQ ID NO:6805))

CAGTGCTCTGGCCGGATCCTTGCCGCGCGGATAAAAACT---->(end of SEQ ID:8545)
```

Confirmation of Probe Sequence

Following probe design, each probe sequence was confirmed by comparing the sequence against dbEST, the UniGene cluster set, and the assembled human genome using BLASTn at NCBI. Alignments, accession numbers, gi numbers, UniGene cluster numbers and names were examined and the most common sequence used for the probe. The final probe set was compiled into Table 8. In this table, the sequence ID is given which corresponds to the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. The name of the gene associated with the accession number is noted. The strand is noted as −1 or 1, meaning that the probe was designed from the complement of the sequence (−1) or directly from the sequence (1). Finally, the nucleotide sequence of each probe is also given.

Example 13

Production of an Array of 8000 Spotted 50mer Oligonucleotides

We produced an array of 8000 spotted 50mer oligonucleotides. Examples 11 and 12 exemplify the design and selection of probes for this array.

Sigma-Genosys (The Woodlands, Tex.) synthesized un-modified 50-mer oligonucleotides using standard phosphoramidite chemistry, with a starting scale of synthesis of 0.05 μmole (see, e.g., R. Meyers, ed. (1995) *Molecular Biology and Biotechnology: A Comprehensive Desk Reference*). Briefly, to begin synthesis, a 3' hydroxyl nucleoside with a dimethoxytrityl (DMT) group at the 5' end was attached to a solid support. The DMT group was removed with trichloroacetic acid (TCA) in order to free the 5'-hydroxyl for the coupling reaction. Next, tetrazole and a phosphoramidite derivative of the next nucleotide were added. The tetrazole protonates the nitrogen of the phosphoramidite, making it susceptible to nucleophilic attack. The DMT group at the 5'-end of the hydroxyl group blocks further addition of nucleotides in excess. Next, the inter-nucleotide linkage was converted to a phosphotriester bond in an oxidation step using an oxidizing agent and water as the oxygen donor. Excess nucleotides were filtered out and the cycle for the next nucleotide was started by the removal of the DMT protecting group. Following the synthesis, the oligo was cleaved from the solid support. The oligonucleotides were desalted, resuspended in water at a concentration of 100 or 200 µM, and placed in 96-deep well format. The oligonucleotides were re-arrayed into Whatman Uniplate 384-well polyproylene V bottom plates. The oligonucleotides were diluted to a final concentration 30 µM in 1X Micro Spotting Solution Plus (Telechem/arrayit.com, Sunnyvale, Calif.) in a total volume of 15)µl. In total, 8,031 oligonucleotides were arrayed into twenty-one 384-well plates.

Arrays were produced on Telechem/arrayit.com Super amine glass substrates (Telechem/arrayit.com), which were manufactured in 0.1 mm filtered clean room with exact dimensions of 25×76×0.96 mm. The arrays were printed using the Virtek Chipwriter with a Telechem 48 pin Micro Spotting Printhead. The Printhead was loaded with 48 Stealth SMP3B TeleChem Micro Spotting Pins, which were used to print oligonucleotides onto the slide with the spot size being 110–115 microns in diameter.

Example 14

Amplification, Labeling, and Hybridization of Total RNA to an Oligonucleotide Microarray Amplification, Labeling, Hybridization and Scanning Samples consisting of at least 2 µg of intact total RNA were further processed for array hybridization. Amplification and labeling of total RNA samples was performed in three successive enzymatic reactions. First, a single-stranded DNA copy of the RNA was made (hereinafter, "ss-cDNA"). Second, the ss-cDNA was used as a template for the complementary DNA strand, producing double-stranded cDNA (hereinafter, "ds-cDNA, or cDNA"). Third, linear amplification was performed by in vitro transcription from a bacterial $T_7$ promoter. During this step, fluorescent-conjugated nucleotides were incorporated into the amplified RNA (hereinafter, "aRNA").

The first strand cDNA was produced using the Invitrogen kit (Superscript II). The first strand cDNA was produced in a reaction composed of 50 mM Tris-HCl (pH 8.3), 75 mM KCl, and 3 mM $MgCl_2$ (1×First Strand Buffer, Invitrogen), 0.5 mM dGTP, 0.5 mM DATP, 0.5 mM dTTP, 0.5 mM dCTP, 10 mM DTT, 10 U reverse transcriptase (Superscript II, Invitrogen, #18064014), 15 U RNase inhibitor (RNAGuard, Amersham Pharmacia, #27-0815-01), 5 µM T7T24 primer (5'-GGCCAGTGAATIGTAATACGACTCAC-TATAGGGAGGCCGGTTTTTTTTTTT TTTTTTTTTTTT-3'), (SEQ ID NO:8831) and 2 µg of selected sample total RNA. Several purified, recombinant control mRNAs from the plant Arabidopsis thaliana were added to the reaction mixture: 2–20 pg of the following genes CAB, RCA, LTP4, NAC1, RCP1,XCP2, RBCL, LTP6, TIM, and PRKase (Stratagene, #252201, #252202, #252204, #252208, #252207, #252206, #252203, #252205, #252209, #252210 respectively). The control RNAs allow the estimate of copy numbers for individual mRNAs in the clinical sample because corresponding sense oligonucleotide probes for each of these plant genes are present on the microarray. The final reaction volume of 20 µl was incubated at 42° C. for 60 min.

For synthesis of the second cDNA strand, DNA polymerase and RNase were added to the previous reaction, bringing the final volume to 150 µl. The previous contents were diluted and new substrates were added to a final concentration of 20 mM Tris-HCl (pH 7.0) (Fisher Scientific, Pittsburgh, Pa. #BP1756-100), 90 mMKCl (Teknova, Half Moon Bay, Calif., #0313-500), 4.6 mM $MgCl_2$ (Tcknova, Half Moon Bay, Calif., #0304-500), 10 mM$(NH_4)_2SO_4$ (Fisher Scientific #A702-500)(1×Second Strand buffer, Invitrogen), 0.266 mM dGTP, 0.266 mM dATP, 0.266 mM dTTP, 0.266 mM dCTP, 40 U E. coli DNA polymerase (Invitrogen, #18010-025), and 2 U RNaseH (Invitrogen, #18021-014). The second strand synthesis took place at 16° C. for 120 minutes.

Following second-strand synthesis, the ds-cDNA was purified from the enzymes, dNTPs, and buffers before proceeding to amplification, using phenol-chloroform extraction followed by ethanol precipitation of the cDNA in the presence of glycogen.

Alternatively, a silica-gel column is used to purify the cDNA (e.g. Qiaquick PCR cleanup from Qiagen, #28104). The cDNA was collected by centrifugation at >10,000×g for 30 minutes, the supernatant is aspirated, and 150 µl of 70% ethanol, 30% water was added to wash the DNA pellet. Following centrifugation, the supernatant was removed, and residual ethanol was evaporated at room temperature.

Linear amplification of the cDNA was performed by in vitro transcription of the cDNA. The cDNA pellet from the step described above was resuspended in 7.4 µl of water, and in vitro transcription reaction buffer was added to a final volume of 20 µl containing 7.5 mM GTP, 7.5 mM ATP, 7.5 mM TTP, 2.25 mM CTP, 1.025 mM Cy3-conjugated CTP (Perkin Elmer; Boston, Mass., #NEL-580), 1x reaction buffer (Ambion, Megascript Kit, Austin, Tex. and #1334) and 1% $T_7$ polymerase enzyme mix (Ambion, Megascript Kit, Ausfin, Tex. and #1334). This reaction was incubated at 37° C. overnight. Following in vitro transcription, the RNA was purified from the enzyme, buffers, and excess NTPs using the RNeasy kit from Qiagen (Valencia, Calif.; # 74106) as described in the vendor's protocol. A second elution step was performed and the two eluates were combined for a final-volume of 60 µl. RNA is quantified using an Agilent 2100 bioanalyzer with the RNA 6000 nano LabChip.

Reference RNA was prepared as described above, except Cy5-CTP was incorporated instead of Cy3CTP. Reference RNA from five reactions, each reaction started with 2 ug total RNA, was pooled together and quantitated as described above.

Hybridization to an Array

RNA was prepared for hybridization as follows: for an 18 mm×55 mm array, 20 µg of amplified RNA (aRNA) was combined with 20 µg of reference aRNA. The combined sample and reference aRNA was concentrated by evaporating the water to 10 µl in a vacuum evaporator. The sample was fragmented by heating the sample at 95° C. for 30 minutes to fragment the RNA into 50–200 bp pieces. Alternatively, the combined sample and reference aRNA was concentrated by evaporating the water to 5 µl in a vacuum evaporator. Five µl of 20 mM zinc acetate was added to the aRNA and the mix incubated at 60° C. for 10 minutes. Following fragmentation, 40 µl of hybridization buffer was added to achieve final concentrations of 5×SSC and 0.20% SDS with 0.1 µg/µl of Cot-1 DNA (Invitrogen) as a competitor DNA. The final hybridization mix was heated to 98° C., and then reduced to 50° C. at 0.1° C. per second.

Alternatively, formamide is included in the hybridization mixture to lower the hybridization temperature.

The hybridization mixture was applied to a pre-heated 65° C. microarray, surface, covered with a glass coverslip (Corning, #2935-246), and placed on a pre-heated 65° C. hybridization chamber (Telechem, AHC-10). 15 ul of 5×SSC was placed in each of the reservoir in the hybridization chamber and the chamber was sealed and placed in a water bath at 62° C. for overnight (16–20 hrs). Following incubation, the slides were washed in 2×SSC, 0.1% SDS for five minutes at 30° C., then in 2×SSC for five minutes at 30° C., then in 2×SSC for another five minutes at 30° C., then in 0.2×SSC for two minutes at room temperature. The arrays were spun at 1000×g for 2 minutes to dry them. The dry microarrays are then scanned by methods described above.

The microarrays were imaged on the Agilent (Palo Alto, Calif.) scanner G2565AA. The scan settings using the Agilent software were as follows: for the PMT Sensitivity (100% Red and 100% Green); Scan Resolution (10 microns); red and green dye channels; used the default scan region for all slides in the carousel; using the largest scan region; scan date for Instrument ID; and barcode for Slide ID. The full image produced by the Agilent scanner was flipped, rotated, and split into two images (one for each signal channel) using TIFFSplitter (Agilent, Palo Alto, Calif.). The two channels are the output at 532 nm (Cy3-labeled sample) and 633 nm (Cy5-labeled R50). The individual images were loaded into GenePix 3.0 (Axon Instruments, Union City, Calif.) for feature extraction, each image was assigned an excitation wavelength corresponding the file opened; Red equals 633 nm and Green equals 532 mm. The setting file (gal) was opened and the grid was laid onto the image so that each spot in the grid overlaped with >50% of the feature. Then the GenePix software was used to find the features without setting minimum threshold value for a feature. For features with low signal intensity, GenePix reports "not found". For all features, the diameter setting was adjusted to include only the feature if necessary.

The GenePix software determined the median pixel intensity for each feature ($F_i$) and the median pixel intensity of the local background for each feature ($B_i$) in both channels. The standard deviation ($SDF_{i\ and}$ and $SDB_i$) for each is also determined. Features for which GenePix could not discriminate the feature from the background were "flagged" as described below.

Following feature extraction into a .gpr file, the header information of the .gpr file was changed to carry accurate information into the database. An Excel macro was written to change the headers. The steps in that macro were:

1. Open .gpr file.
2. Check the value in the first row, first column. If it is "ATF", then the header has likely already been reformatted. The file is skipped and the user is alerted. Otherwise, proceed through the following steps.
3. Store the following values in variables.
    a. Name of .tif image file: parsed from row 11.
    b. SlideD: parsed from name of .tif image file.
    c. Version of the feature extraction software: parsed from row 25
    d. GenePix Array List file: parsed from row 6
    e. GenePix Settings file: parsed from row 5
4. Delete rows 1–8, 10–12, 20, 22, and 25.
5. Arrange remaining values in rows 15–29.
6. Fill in rows 1–14 with the following:
    Row 1: ScanID (date image file was last modified, formatted as yyyy.mm.dd-hh.mm.ss)
    Row 2: SlideID, from stored value
    Row 3: Name of person who scanned the slide, from user input
    Row 4: Image file name, from stored value
    Row 5: Green PMT setting, from user input
    Row 6: Red PMT setting, from user input
    Row 7: ExtractID (date .gpr file was created, formatted as yyyy.mm.dd-hh.mm.ss)
    Row 8: Name of person who performed the feature extraction, from user input
    Row 9: Feature extraction software used, from stored value
    Row 10: Results file name (same as the .gpr file name)
    Row 11: GenePix Array List file, from stored value
    Row 12: GenePix Settings file, from stored value
    Row 13: StorageCD, currently left blank
    Row 14: Extraction comments, from user input (anything about the scanning or feature extraction of the image the user feels might be relevant when selecting which hybridizations to include in an analysis)

Pre-Processing with Excel Templates

Following analysis of the image and extraction of the data, the data from each hybridization was pre-processed to extract data that was entered into the database and subsequently used for analysis. The complete GPR file produced by the feature extraction in GenePix was imported into an excel file pre-processing template. The same excel template was used to process each GPR file. The template performs a series of calculations on the data to differentiate poor features from others and to combine triplicate feature data into a single data point for each probe.

Each GPR file contained 31 rows of header information, followed by rows of data for 24093 features. The last of these rows was retained with the data. Rows 31 through the end of the file were imported into the excel template. Each row contained 43 columns of data. The only columns used in the pre-processing were: Oligo ID, F633 Median (median value from all the pixels in the feature for the Cy5 dye), B633 Median (the median value of all the pixels in the local background of the selected feature for Cy5), B633 SD (the standard deviation of the values for the pixels in the local background of the selected feature for Cy5), F532 Median (median value from all the pixels in the feature for the Cy3 dye), B532 Median (the median value of all the pixels in the local background of the selected feature for Cy3), B532 SD (the standard deviation of the values for the pixels in the local background of the selected feature for Cy3), and Flags. The GenePix Flags column contains the flags set during feature extraction. "–75" indicates there were no features printed on the array in that position, "–50" indicates that GenePix could not differentiate the feature signal from the local background, and "–100" indicates that the user marked the feature as bad.

Once imported, the rows with –75 flags were deleted. Then the median of B633 SD and B532 SD were calculated over all features with a flag value of "0". The minimum values of B633 Median and B532 Median were identified, considering only those values associated with a flag value of "0". For each feature, the signal to noise ratio (S/N) was calculated for both dyes by taking the fluorescence signal minus the local background (BGSS) and dividing it by the standard deviation of the local background:

$$S/N = \frac{F_i - B_i}{SDB_i}$$

If the S/N was less than 3, then an adjusted background-subtracted signal was calculated as the fluorescence minus the minimum local background on the slide. An adjusted SIN was then calculated as the adjusted background subtracted signal divided by the median noise over all features for that channel. If the adjusted S/N was greater than three and the original S/N were less than three, a flag of 25 was set for the Cy5 channel, a flag of 23 was set for the Cy3 channel, and if both met these criteria, then a flag of 20 was set. If both the adjusted S/N and the original S/N were less than three, then a flag of 65 was set for Cy5, 63 set for Cy3, and 60 set if both dye channels had an adjusted S/N less than three. All signal to noise calculations, adjusted background-subtracted signal, and adjusted S/N were calculated for each dye channel. If the BGSS value was greater than or equal to 64000, a flag was set to indicate saturation; 55 for Cy5, 53 for Cy3, 50 for both.

The BGSS used for further calculations was the original BGSS if the original S/N was greater than or equal to three. If the original S/N ratio was less than three and the adjusted S/N ratio was greater than or equal to three, then the adjusted BGSS was used. If the adjusted S/N ratio was less than three, then the adjusted BGSS was used, but with knowledge of the flag status.

To facilitate comparison among arrays, the Cy3 and Cy5 data were scaled to have a median of 1. For each dye channel, the median value of all features with flags=0,20,23, or 25 was calculated. The BGSS for each dye in each feature was then divided by this median value. The Cy3/Cy5 ratio was calculated for each feature using the scaled $$R_n = \frac{Cy3S_i}{Cy5S_i}$$

The flag setting for each feature was used to determine the expression ratio for each probe, a combination of three features. If all three features had flag settings in the same category (categories=negatives, 0 to 25, 50–55, and 60–65), then the average and CV of the three feature ratios was calculated. If the CV of all three features was less than 15, the average was used. If the CV was greater than 15, then the CV of each combination of two of the features was calculated and the two features with the lowest CV were averaged. If none of the combinations of two features had a CV less than 15, then the median ratio of the three features was used as the probe feature.

If the three features do not have flags in the same category, then the features with the best quality flags were used (0>25>23>20>55>53>50>65>63>60). Features with negative flags were never used. When the best flags were two features in the same category, the average was used. If a single feature had a better flag category than the other two then that feature was used.

Once the probe expression ratio was calculated from the three features, the log of the ratio was taken as described below and stored for use in analyzing the data. Whichever features were used to calculate the probe value, the worst of the flags from those features was carried forward and stored as the flag value for that probe. 2 different data sets can be used for analysis. Flagged data uses all values, including those with flags. Filtered data sets are created by removing flagged data from the set before analysis.

Example 15

Real-Time PCR Validation of Array Expression Results

In example 10, leukocyte gene expression was used to discover expression markers and diagnostic gene sets for clinical outcomes. It is desirable to validate the gene expression results for each gene using a more sensitive and quantitative technology such as real-time PCR. Further, it is possible for the diagnostic nucleotide sets to be implemented as a diagnostic test as a real-time PCR panel. Alternatively, the quantitative information provided by real-time PCR validation can be used to design a diagnostic test using any alternative quantitative or semi-quantitative gene expression technology.

To validate the results of the microarray experiments we used real-time, or kinetic, PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measurement ($C_T=C_P$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3' exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/quencher dye Taqman chemistry, for example scorpions.

Initially, samples are chosen for validation, which have already been used for microarray based expression analysis. They are also chosen to represent important disease classes or disease criteria. For the first steps of this example (primer design, primer endpoint testing, and primer efficiency testing) we examined β-actin and β-GUS. These genes are considered "housekeeping" genes because they are required for maintenance in all cells. They are commonly used as a reference that is expected to not change with experimental treatment. We chose these two particular genes as references because they varied the least in expression across 5 mRNA samples examined by real-time PCR.

The inputs for real time PCR reaction are gene-specific primers, cDNA from specific patient samples, and the standard reagents. The cDNA was produced from mononuclear RNA (prepared as in example 7) by reverse transcription using OligodT primers (Invitrogen, 18418-012) and random hexamers (Invitrogen, 48190-011) at a final concentration of 0.5 ng/lp and 3 ng/µl respectively. For the first strand reaction mix, 1.45 μg/μl of total RNA (R50, universal leukocyte reference RNA as described in Example 8) and 1 μl of the Oligo dT/Random Hexamer Mix, were added to water to a final volume of 11.5 s. The sample mix was then placed at 70° C. for 10 minutes. Following the 70° C. incubation, the samples were chilled on ice, spun down, and 88.5 μl of first strand buffer mix dispensed into the reaction tube. The final first strand buffer mix produced final concentrations of 1X first strand buffer (Invitrogen, Y00146, Carlsbad, Calif.), 0.01 mM DTT (Invitrogen, Y00147), 0.1 mM dATP (NEB, N0440S, Beverly, Mass.), 0.1 mM dGTP (NEB, N0442S), 0.1 mM dATP (NEB, N0443S), 0.1 mM dCTP (NEB, N0441S), 2U of reverse transcriptase (Superscript II, Invitrogen, 18064-014), and 0.18U of RNase inhibitor (RNAGaurd Amersham Pharmacia, 27-0815-01, Piscataway, N.J.). The reaction was incubated at 42° C. for 1 hour. After incubation the enzyme was heat inactivated at 70° C. for 15 minutes, 1 μl of RNAse H added to the reaction tube, and incubated at 37° C. for 20 minutes.

Primer Design

Two methods were used to design primers. The first was to use the software, Primer Express™ and recommendations for primer design that are provided with the GeneAmp® 7700 Sequence Detection System supplied by Applied Bio-Systems (Foster City, Calif.). The second method used to design primers was the PRIMER3 ver 0.9 program that is available from the Whitehead Research Institute, Cambridge, Mass. The program can also be accessed on the World Wide Web at: genome.wi.mit.edu/cgi-bin/primer/primer3_www.cgi. Primers and Taqman/hybridization probes were designed as described below using both programs.

The Primer Express literature explains that primers should be designed with a melting temperature between 58 and 60 degrees C. while the Taqman probes should have a melting temperature of 68 to 70 under the salt conditions of the supplied reagents. The salt concentration is fixed in the software. Primers should be between 15 and 30 basepairs long. The primers should produce and ampricon in size between 50 and 150 base pairs, have a C-G content between 20% and 80%, have no more than 4 identical base pairs next to one another, and no more than 2 C's and G's in the last 5 bases of the 3' end. The probe cannot have a G on the 5' end and the strand with the fewest G's should be used for the probe.

Primer3 has a large number of parameters. The defaults were used for all except for melting temperature and the optimal size of the amplicon was set at 100 bases. One of the most critical is salt concentration as it affects the melting temperature of the probes and primers. In order to produce primers and probes with melting temperatures equivalent to Primer Express, a number of primers and probes designed by Primer Express were examined using PRIMER3. Using a salt concentration of 50 mM these primers had an average melting temperature of 3.7 degrees higher than predicted by Primer Express. In order to design primers and probes with equivalent melting temperatures as Primer Express using PRIMER3, a melting temperature of 62.7 plus/minus 1.0 degree was used in PRIMER3 for primers and 72.7 plus/minus 1.0 degrees for probes with a salt concentration of 50 mM.

The C source code for Primer3 was downloaded and complied on a Sun Enterprise 250 server using the GCC complier. The program was then used from the command line using a input file that contained the sequence for which we wanted to design primers and probes along with the input parameters as described by help files that accompany the software. Using scripting it was possible to input a number of sequences and automatically generate a number of possible probes and primers.

Primers for β-Actin (Beta Actin, Genbank Locus: NM_0010) and β-GUS: glucuronidase, beta, (GUSB, Genbank Locus: NM_000181), two reference genes, were designed using both methods and are shown here as examples.

The first step was to mask out repetitive sequences found in the mRNA sequences using RepeatMasker program that can be accessed at the web site located at repeatmasker.genome.washington.edu/cgi-bin/RepeatMasker (Smit, AFA & Green, P "RepeatMasker" at the web site located at ftp.genome.washington.edu/RM/RepeatMasker.html).

The last 500 basepairs on the last 3' end of masked sequence was then submitted to PRIMER3 using the following exemplary input file:

```
PRIMER_SEQUENCE_ID=>ACTB Beta Actin
PRIMER_EXPLAIN_FLAG=1
PRIMER_MISPRIMING_LIBRARY=
SEQUENCE=TTGGCTTGACTCAGGATTTAAAAACTGGAACGGTGAAGGTGACAGCAGTCGGTTGGACGAGC
ATCCCCCAAAGTTCACAATGTGGCCGAGGACTTTGATTGCACATTGTTGTTTTTTAATAGTCATTCCAAAT
ATGAGATGCATTGTTACAGGAAGTCCCTTGCCATCCTAAAAGCACCCCACTTCTCTCTAAGGAGAATGGCC
CAGTCCTCTCCCAAGTCCACACAGGGGAGGGATAGCATTGCTTTCGTGTAAATTATGTAATGCAAAATTTT
TTTAATCTTCGCCTTAATCTTTTTTATTTTGTTTTATTTTGAATGATGAGCCTTCGTGCCCCCCCTTCCCC
CTTTTTTCCCCCAACTTGAGATGTATGAAGGCTTTTGGTCTCCCTGGGAGTGGGTGGAGGCAGCCGGGCTT
ACCTGTACACTGACTTGAGACCAGTTGAATAAAAGTGCACACCTTA (SEQ ID NO: 8833)
PRIMER_PRODUCT_OPT_SIZE=100
PRIMER_NUM_RETURN=100
PRIMER_MAX_END_STABILITY=9.0
PRIMER_MAX_MISPRIMING=12.00
PRIMER_PAIR_MAX_MISPRIMING=24.00
PRIMER_MIN_SIZE=18
PRIMER_OPT_SIZE=20
PRIMER_MAX_SIZE=32
PRIMER_MIN_TM=61.7
PRIMER_OPT_TM=62.7
PRIMER_MAX_TM=63.7
PRIMER_MAX_DIFF_TM=100.0
PRIMER_MIN_GC=20.0
PRIMER_MAX_GC=80.0
PRIMER_SELF_ANY=8.00
PRIMER_SELF_END=3.00
PRIMER_NUM_NS_ACCEPTED=0
PRIMER_MAX_POLY_X=4
```

-continued

```
PRIMER_OUTSIDE_PENALTY=0
PRIMER_GC_CLAMP=0
PRIMER_SALT_CONC=50.0
PRIMER_DNA_CONC=50.0
PRIMER_LIBERAL_BASE=1
PRIMER_MIN_QUALITY=0
PRIMER_MIN_END_QUALITY=0
PRIMER_QUALITY_RANGE_MIN=0
PRIMER_QUALITY_RANGE_MAX=100
PRIMER_WT_TM_LT=1.0
PRIMER_WT_TM_GT=1.0
PRIMER_WT_SIZE_LT=1.0
PRIMER_WT_SIZE_GT=1.0
PRIMER_WT_GC_PERCENT_LT=0.0
PRIMER_WT_GC_PERCENT_GT=0.0
PRIMER_WT_COMPL_ANY=0.0
PRIMER_WT_COMPL_END=0.0
PRIMER_WT_NUM_NS=0.0
PRIMER_WT_REP_SIM=0.0
PRIMER_WT_SEQ_QUAL=0.0
PRIMER_WT_END_QUAL=0.0
PRIMER_WT_POS_PENALTY=0.0
PRIMER_WT_END_STABILITY=0.0
PRIMER_PAIR_WT_PRODUCT_SIZE_LT=0.05
PRIMER_PAIR_WT_PRODUCT_SIZE_GT=0.05
PRIMER_PAIR_WT_PRODUCT_TM_LT=0.0
PRIMER_PAIR_WT_PRODUCT_TM_GT=0.0
PRIMER_PAIR_WT_DIFF_TM=0.0
PRIMER_PAIR_WT_COMPL_ANY=0.0
PRIMER_PAIR_WT_COMPL_END=0.0
PRIMER_PAIR_WT_REP_SIM=0.0
PRIMER_PAIR_WT_PR_PENALTY=1.0
PRIMER_PAIR_WT_IO_PENALTY=0.0
PRIMER_INTERNAL_OLIGO_MIN_SIZE=18
PRIMER_INTERNAL_OLIGO_OPT_SIZE=20
PRIMER_INTERNAL_OLIGO_MAX_SIZE=35
PRIMER_INTERNAL_OLIGO_MIN_TM=71.7
PRIMER_INTERNAL_OLIGO_OPT_TM=72.7
PRIMER_INTERNAL_OLIGO_MAX_TM=73.7
PRIMER_INTERNAL_OLIGO_MIN_GC=20.0
PRIMER_INTERNAL_OLIGO_MAX_GC=80.0
PRIMER_INTERNAL_OLIGO_SELF_ANY=12.00
PRIMER_INTERNAL_OLIGO_SELF_END=12.00
PRIMER_INTERNAL_OLIGO_NUM_NS=0
PRIMER_INTERNAL_OLIGO_MAX_POLY_X=5
PRIMER_INTERNAL_OLIGO_MISHYB_LIBRARY=
PRIMER_INTERNAL_OLIGO_MAX_MISHYB=12.00
PRIMER_INTERNAL_OLIGO_MIN_QUALITY=0
PRIMER_INTERNAL_OLIGO_SALT_CONC=50.0
PRIMER_INTERNAL_OLIGO_DNA_CONC=50.0
PRIMER_IO_WT_TM_LT=1.0
PRIMER_IO_WT_TM_GT=1.0
PRIMER_IO_WT_SIZE_LT=1.0
PRIMER_IO_WT_SIZE_GT=1.0
PRIMER_IO_WT_GC_PERCENT_LT=0.0
PRIMER_IO_WT_GC_PERCENT_GT=0.0
PRIMER_IO_WT_COMPL_ANY=0.0
PRIMER_IO_WT_NUM_NS=0.0
PRIMER_IO_WT_REP_SIM=0.0
PRIMER_IO_WT_SEQ_QUAL=0.0
PRIMER_TASK=pick_pcr_primers_and_hyb_probe
PRIMER_PRODUCT_SIZE_RANGE=50-150
PRIMER_FIRST_BASE_INDEX=1
PRIMER_PICK_ANYWAY=1
=
PRIMER_SEQUENCE_ID=>GUSB
PRIMER_EXPLAIN_FLAG=1
PRIMER_MISPRIMING_LIBRARY=
SEQUENCE=GAAGAGTACCAGAAAAGTCTGCTAGAGCAGTACCATCTGGGTCTGGATCAAAAACGCAGAAA
ATATGTGGTTGGAGAGCTCATTTGGAATTTTGCCGATTTCATGACTGAACAGTCACCGACGAGAGTGCTGG
GGAATAAAAAGGGGATCTTCACTCGGCAGAGACAACCAAAAAGTGCAGCGTTCCTTTTGCGAGAGAGATAC
TGGAAGATTGCCAATGAAACCAGGTATCCCCACTCAGTAGCCAAGTCACAATGTTTGGAAAACAGCCCGTT
TACTTGAGCAAGACTGATACCACCTGCGTGTCCCTTCCTCCCCGAGTCAGGGCGACTTCCACAGCAGCAGA
ACAAGTGCCTCCTGGACTGTTCACGGCAGACCAGAACGTTTCTGGCCTGGGTTTTGTGGTCATCTATTCTA
GCAGGGAACACTAAAGGTGGAAATAAAAGATTTTCTATTATGGAAATAAAGAGTTGGCATGAAAGTCGCTA
CTG (SEQ ID NO: 8834)
PRIMER_PRODUCT_OPT_SIZE=100
PRIMER_NUM_RETURN=100
PRIMER_MAX_END_STABILITY=9.0
PRIMER_MAX_MISPRIMING=12.00
```

```
-continued
PRIMER_PAIR_MAX_MISPRIMING=24.00
PRIMER_MIN_SIZE=18
PRIMER_OPT_SIZE=20
PRIMER_MAX_SIZE=32
PRIMER_MIN_TM=61.7
PRIMER_OPT_TM=62.7
PRIMER_MAX_TM=63.7
PRIMER_MAX_DIFF_TM=100.0
PRIMER_MIN_GC=20.0
PRIMER_MAX_GC=80.0
PRIMER_SELF_ANY=8.00
PRIMER_SELF_END=3.00
PRIMER_NUM_NS_ACCEPTED=0
PRIMER_MAX_POLY_X=4
PRIMER_OUTSIDE_PENALTY=0
PRIMER_GC_CLAMP=0
PRIMER_SALT_CONC=50.0
PRIMER_DNA_CONC=50.0
PRIMER_LIBERAL_BASE=1
PRIMER_MIN_QUALITY=0
PRIMER_MIN_END_QUALITY=0
PRIMER_QUALITY_RANGE_MIN=0
PRIMER_QUALITY_RANGE_MAX=100
PRIMER_WT_TM_LT=1.0
PRIMER_WT_TM_GT=1.0
PRIMER_WT_SIZE_LT=1.0
PRIMER_WT_SIZE_GT=1.0
PRIMER_WT_GC_PERCENT_LT=0.0
PRIMER_WT_GC_PERCENT_GT=0.0
PRIMER_WT_COMPL_ANY=0.0
PRIMER_WT_COMPL_END=0.0
PRIMER_WT_NUM_NS=0.0
PRIMER_WT_REP_SIM=0.0
PRIMER_WT_SEQ_QUAL=0.0
PRIMER_WT_END_QUAL=0.0
PRIMER_WT_POS_PENALTY=0.0
PRIMER_WT_END_STABILITY=0.0
PRIMER_PAIR_WT_PRODUCT_SIZE_LT=0.05
PRIMER_PAIR_WT_PRODUCT_SIZE_GT=0.05
PRIMER_PAIR_WT_PRODUCT_TM_LT=0.0
PRIMER_PAIR_WT_PRODUCT_TM_GT=0.0
PRIMER_PAIR_WT_DIFF_TM=0.0
PRIMER_PAIR_WT_COMPL_ANY=0.0
PRIMER_PAIR_WT_COMPL_END=0.0
PRIMER_PAIR_WT_REP_SIM=0.0
PRIMER_PAIR_WT_PR_PENALTY=1.0
PRIMER_PAIR_WT_IO_PENALTY=0.0
PRIMER_INTERNAL_OLIGO_MIN_SIZE=18
PRIMER_INTERNAL_OLIGO_OPT_SIZE=20
PRIMER_INTERNAL_OLIGO_MAX_SIZE=35
PRIMER_INTERNAL_OLIGO_MIN_TM=71.7
PRIMER_INTERNAL_OLIGO_OPT_TM=72.7
PRIMER_INTERNAL_OLIGO_MAX_TM=73.7
PRIMER_INTERNAL_OLIGO_MIN_GC=20.0
PRIMER_INTERNAL_OLIGO_MAX_GC=80.0
PRIMER_INTERNAL_OLIGO_SELF_ANY=12.00
PRIMER_INTERNAL_OLIGO_SELF_END=12.00
PRIMER_INTERNAL_OLIGO_NUM_NS=0
PRIMER_INTERNAL_OLIGO_MAX_POLY_X=5
PRIMER_INTERNAL_OLIGO_MISHYB_LIBRARY=
PRIMER_INTERNAL_OLIGO_MAX_MISHYB=12.00
PRIMER_INTERNAL_OLIGO_MIN_QUALITY=0
PRIMER_INTERNAL_OLIGO_SALT_CONC=50.0
PRIMER_INTERNAL_OLIGO_DNA_CONC=50.0
PRIMER_IO_WT_TM_LT=1.0
PRIMER_IO_WT_TM_GT=1.0
PRIMER_IO_WT_SIZE_LT=1.0
PRIMER_IO_WT_SIZE_GT=1.0
PRIMER_IO_WT_GC_PERCENT_LT=0.0
PRIMER_IO_WT_GC_PERCENT_GT=0.0
PRIMER_IO_WT_COMPL_ANY=0.0
PRIMER_IO_WT_NUM_NS=0.0
PRIMER_IO_WT_REP_SIM=0.0
PRIMER_IO_WT_SEQ_QUAL=0.0
PRIMER_TASK=pick_pcr_primers_and_hyb_probe
PRIMER_PRODUCT_SIZE_RANGE=50-150
PRIMER_FIRST_BASE_INDEX=1
PRIMER_PICK_ANYWAY=1
=
```

After running PRIMER3, 100 sets of primers and probes were generated for ACTB and GUSB. From this set, nested primers were chosen based on whether both left primers could be paired with both right primers and a single Taqman probe could be used on an insert of the correct size. With more experience we have decided not use the mix and match approach to primer selection and just use several of the top pairs of predicted primers.

For ACTB this turned out to be:

Forward   75 CACAATGTGGCCGAGGACTT, (SEQ ID NO: 8835)

Forward   80 TGTGGCCGAGGACTTTGATT, (SEQ ID NO: 8836)

Reverse  178 TGGCTTTTAGGATGGCAAGG, (SEQ ID NO: 8837) and

Reverse  168 GGGGGCTTAGTTTGCTTCCT. (SEQ ID NO: 8838)

Upon testing, the F75 and R178 pair worked best.
For GUSB the following primers were chosen:

Forward   59 AAGTGCAGCGTTCCTTTTGC, (SEQ ID NO: 8839)

Forward   65 AGCGTTCCTTTTGCGAGAGA, (SEQ ID NO: 8840)

Reverse  158 CGGGCTGTTTTCCAAACATT (SEQ ID NO: 8841) and

Reverse  197 GAAGGGACACGCAGGTGGTA. (SEQ ID NO: 8842)

No combination of these GUSB pairs worked well.

In addition to the primer pairs above, Primer Express predicted the following primers for GUSB: Forward 178 TACCACCTGCGTGTCCCTTC (SEQ ID NO: 8843) and Reverse 242 GAGGCACTTGTTCTGCTGCTG (SEQ ID NO: 8844). This pair of primers worked to amplify the GUSB mRNA.

The parameters used to predict these primers in Primer Express were:

Primer Tm: min 58, Max=60, opt 59, max difference=2 degrees

Primer GC: min=20% Max=80% no 3' G/C clamp

Primer: Length: min=9 max=40 opt=20

Amplicon: min $T_m$=0 max $T_m$=85 min=50 bp max=150 bp

Probe: Tm 10 degrees>primers, do not begin with a G on 5' end

Other: max base pair repeat=3 max number of ambiguous residues=0 secondary structure: max consec bp=4, max total bp=8

Uniqueness: max consec match=9 max % match=75 max 3' consecutive match=7

Using this approach, multiple primers were designed for genes that were shown to have expression patterns that correlated with clinical data in example 10. These primer pairs are shown in Table 10B and are added to the sequence listing. Primers can be designed from any region of a target gene using this approach.

Granzyme B is an important marker of CMV infection and transplant rejection. For Granzyme B the following sequence (NM_004131) was used as input for Primer3:

(SEQ ID No: 9086)
GGGGACTCTGGAGGCCCTCTTGTGTGTAACAAGGTGGCCCAGGGCATTGT

CTCCTATGGACGAAACAATGGCATGCCTCCACGAGCCTGCACCAAAGTCT

-continued

CAAGCTTTGTACACTGGATAAAGAAAACCATGAAACGCTACTAACTACAG

GAAGCAAACTAAGCCCCCGCTGTAATGAAACACCTTCTCTGGAGCCAAGT

CCAGATTTACACTGGGAGAGGTGCCAGCAACTGAATAAATACCTCTCCCA

GTGTAAATCTGGAGCCAAGTCCAGATTTACACTGGGAGAGGTGCCAGCAA

CTGAATAAATACCTCTTAGCTGAGTGG

For Granzyme B the following primers were chosen for testing:

Forward   81 ACGAGCCTGCACCAAAGTCT  (SEQ ID No: 9087)

Forward   63 AAACAATGGCATGCCTCCAC  (SEQ ID No: 9088)

Reverse  178 TCATTACAGCGGGGGCTTAG  (SEQ ID No: 9089)

Reverse  168 GGGGGCTTAGTTTGCTTCCT  (SEQ ID No: 9090)

Testing demonstrated that F81 and R178 worked well in amplifying a product.

Primer Endpoint Testing

Primers were first tested to examine whether they would produce the correct size product without non-specific amplification. The standard real-time PCR protocol was used with out the Rox and Sybr green dyes. Each primer pair was tested on cDNA made from universal mononuclear leukocyte reference R NA that was produced from 50 individuals as described in Example 8 (R50).

The PCR reaction consisted of 1X RealTime PCR Buffer (Ambion, Austin, Tex.), 3 mM MgC12 (Applied BioSystems, B02953), 0.2 mM dATP (NEB), 0.2 mM dTTP (NEB), 0.2 mM dCTP (NEB), 0.2 mM dGTP (NEB), 1.25U AmpliTaq Gold (Applied BioSystems, Foster City, Calif.), 0.3 µM of each primer to be used (Sigma Genosys, The Woodlands, Tex.), 5 µl of the R50 reverse-transcription reaction and water to a final volume of 19 µl.

Following 40 cycles of PCR, one microliter of the product was examined by agarose gel electrophoresis and on an Agilent Bioanalyzer, DNA1000 chip (Palo Alto, Calif.). Results for 2 genes are shown in FIG. 5. From the primer design and the sequence of the target gene, one can calculate the expected size of the amplified DNA product. Only primer pairs with amplification of the desired product and minimal amplification of contaminants were used for real-time PCR. Primers that produced multiple products of different sizes are likely not specific for the gene of interest and may amplify multiple genes or chromosomal loci.

Primer Op Tjm!Za Tion/Efficiency

Once primers passed the end-point PCR, the primers were tested to determine the efficiency of the re action in a real-time PCR reaction. cDNA was synthesized from starting total RNA as described above. A set of 5 serial dilutions of the R50 reverse-transcribed cDNA (as described above) were made in water: 1:10, 1:20, 1:40, 1:80, and 1:160.

The Sybr Green real-time PCR reaction was performed using the Taqman PCR Reagent kit (Applied BioSystcms, Foster City, Calif., N808-0228). A master mix was made that consisted of all reagents except the primes and template. The final concentration of all ingredients in the reaction was 1xTaqman Buffer A (Applied BioSystems), 2 mM MgCl2 (Applied BioSystems), 200 µM dATP (Applied BioSystems), 200 µM dCTP (Applied BioSystems), 200 µM dGTP (Applied BioSystems), 400 µM dUTP (Applied BioSystems), 1:400,000 diluted Sybr Green dye (Molecular Probes), 1.25U AmpliTaq Gold (Applied BioSystems). The master mix for 92 reactions was made to a final volume of 2112 µl. 1012 µl of PCR master mix was dispensed into two, light-tight tubes. Each β-Actin primer F75 and R178 (Genosys), was added to one tube of PCR master mix and Each β-GUS primer F178 and R242 (Genosys), was added to the other tube of PCR master mix to a final primer concentration of 300 nM, and a final volume of 1035 µl per reaction tube. 45 µl of the β-Actin master mix was dispensed into 23 wells, in a 96well plate (Applied BioSystems). 45 µl of the β-GUS master mix was dispensed into 23 wells, in a 96well plate (Applied BioSystems). 5 µl of the template dilution series was dispensed into triplicate wells for each primer. The reaction was run on an ABI 7700 Sequence Detector (Applied BioSystems).

The Sequence Detector v1.7 software was used to analyze the fluorescent signal from each well. A threshold value was selected that allowed most of the amplification curves to cross the threshold during the linear phase of amplification. The cycle number at which each amplification curve crossed the threshold (CT) was recorded and the file transferred to MS Excel for further analysis. The $C_T$ values for triplicate wells were averaged. The data were plotted as a function of the $\log_{10}$ of the calculated starting concentration of RNA. The starting RNA concentration for each cDNA dilution was determined based on the original amount of RNA used in the RT reaction, the dilution of the RT reaction, and the amount used (5 µl) in the real-time PCR reaction. For each gene, a linear regression line was plotted through all of the dilutions series points. The slope of the line was used to calculate the efficiency of the reaction for each primer set using the equation:

$$E = 10^{\left(\frac{-1}{slope}\right)}$$

Figure 2:
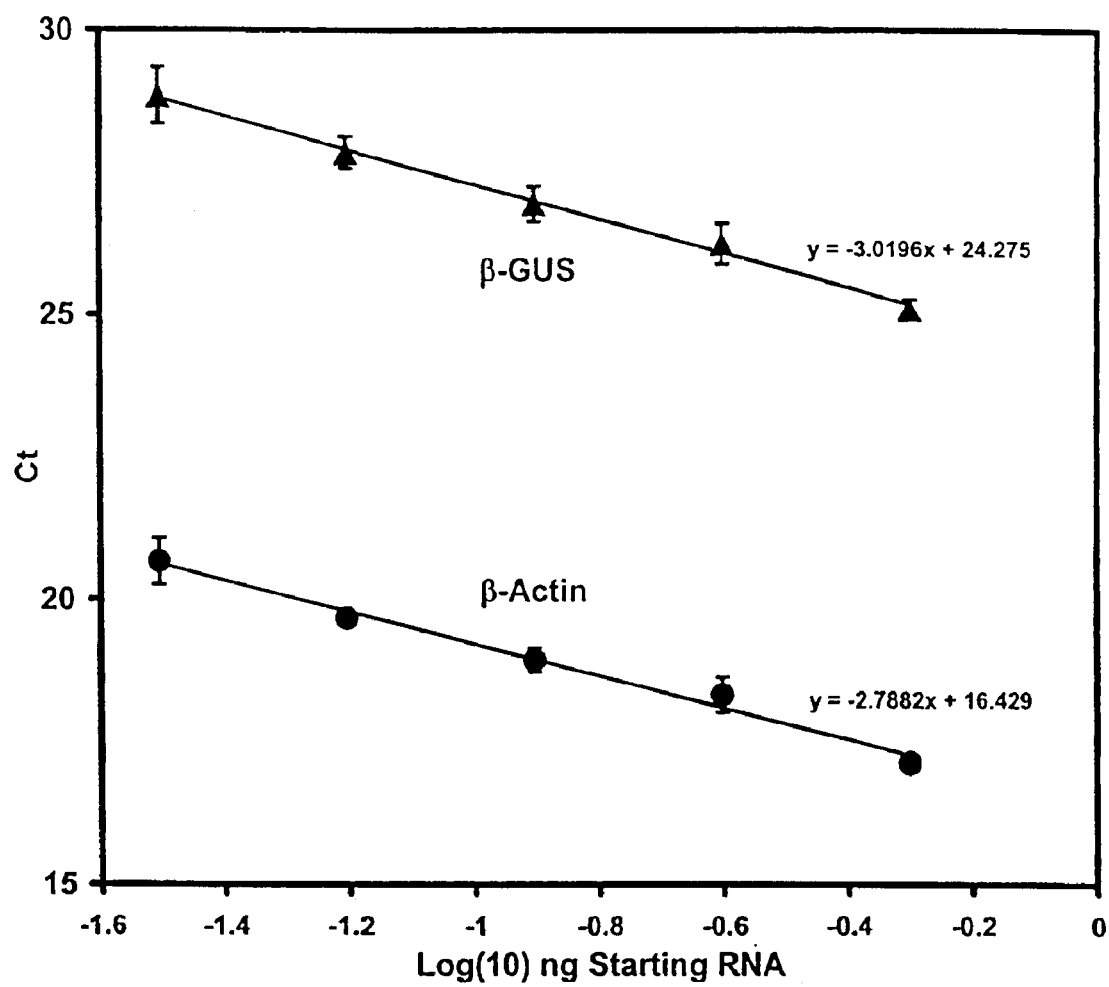
FIG. 2.

Using this equation (Pfaffl 2001), the efficiency for these β-actin primers is 2.28 and the efficiency for these P-GUS primers is 2.14 (FIG. 2). This efficiency was used when comparing the expression levels among multiple genes and multiple samples. This same method was used to calculate reaction efficiency for primer pairs for each gene we studied.

Assay and Results

Once primers were designed and tested and efficiency analysis was completed, primers were used examine expression of a single gene among many clinical samples. The basic design was to examine expression of both the experimental gene and a reference gene in each sample and, at the same time, in a control sample. The control sample we used was the universal mononuclear leukocyte reference RNA described in example 8 (R50).

In this example, three patient samples from patients with known CMV infection were compared to three patient samples from patients with no diagnosis of CMV infection based on standard diagnostic algorithms for active CMV infection (including viral PCR assays, serologies, culture and other tests). cDNA was made from all six RNA samples and the R50 control as described above. The cDNA was diluted 1:10 in water and 5 µl of this dilution was used in the 50 µl PCR reaction. Each 96-well plate consisted of 32 reactions, each done in triplicate. There were 17 templates and 3 primer sets. The three primer sets were β-GUS, β-Actin, and Granzyme B AS described above. Each of the three primer sets was used to measure template levels in 8 templates: the six experimental samples, R50, and water (no-template control). The β-GUS primers were also used to measure template levels a set of 8 templates identical except for the absence of the reverse transcriptase enzyme in the cDNA synthesis reaction (−RT). The real-time PCR reactions were performed as described above in "primer optimization/efficiency".

Figure 6A:
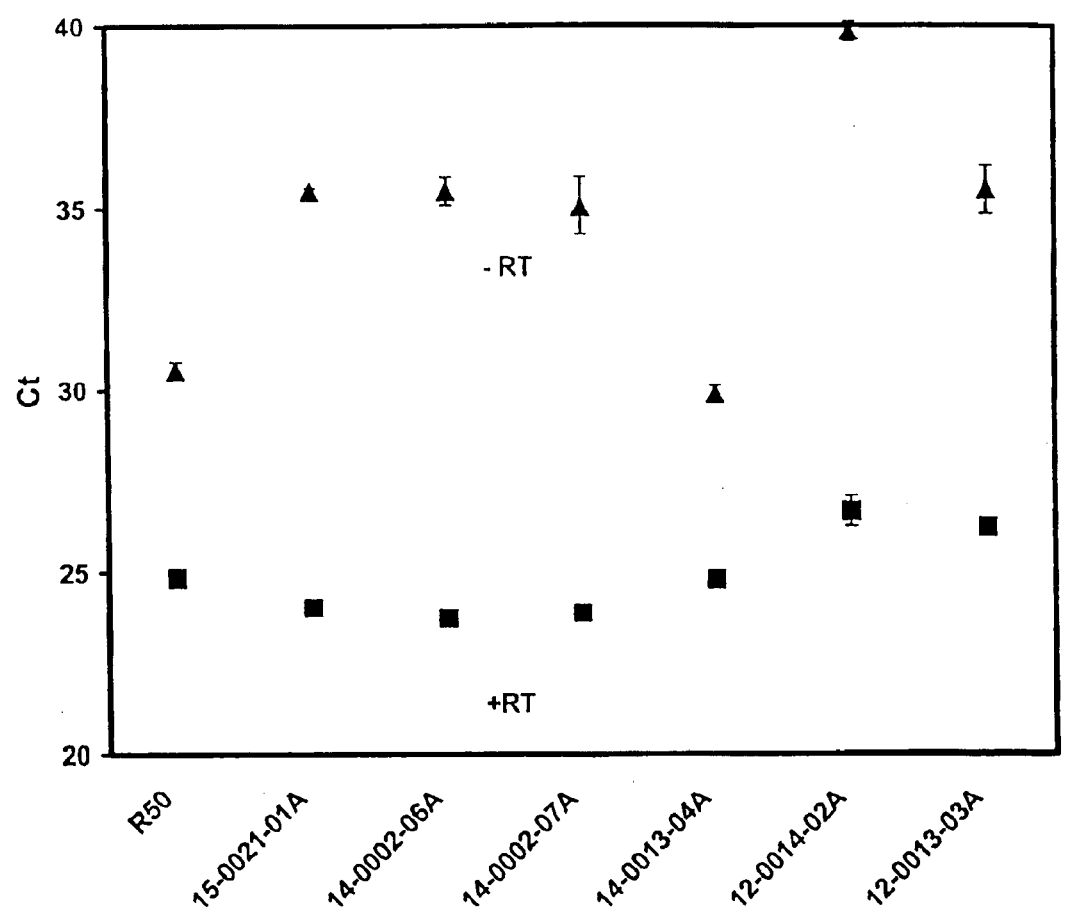
FIG. 6A shows the Ct for each patient sample on multiple assays is shown along with the Ct in the R50 control RNA. Triangles represent −RT (reverse transcriptase) controls.

The β-GUS amplification with +RT and −RT cDNA synthesis reaction templates were compared to measure the amount of genomic DNA contamination of the patient RNA sample (FIG. 6A). The only source of amplifiable material in the −RT cDNA synthesis reaction is contaminating genomic DNA. Separation by at least four $C_T$ between the −RT and +RT for each sample was required to consider the sample useful for analysis of RNA levels. Since a $C_T$ decrease of one is a two-fold increase in template, a difference of four $C_T$ would indicate that genomic DNA contamination level in the +RT samples was 6.25% of the total signal. Since we used these reactions to measure 30% or greater differences, a 6% contamination would not change the result.

For samples with sufficiently low genomic DNA contamination the data were used to identify differences in gene expression by measuring RNA levels. $C_T$ values from the triplicate wells for each reaction were averaged and the coefficient of variation (CV) determined. Samples with high CV (>2%) were examined and outlier reaction wells were discarded from further analysis. The average of the wells for each sample was taken as the $C_T$ value for each sample. For each gene, the $\Delta C_T$ was the R50 control $C_T$ minus the sample $C_T$. The equation below was then used to identify an expression ratio compared to a reference gene (β-Actin) and control sample (R50) for Granzyme B expression in each experimental sample (Pfaffl, M. W. 2001). E is the amplification efficiency determined above.

$$ratio = \frac{(E_{target})^{\Delta C_T target(control-sample)}}{(E_{ref})^{\Delta C_T ref(control-sample)}}$$

Figure 6B:
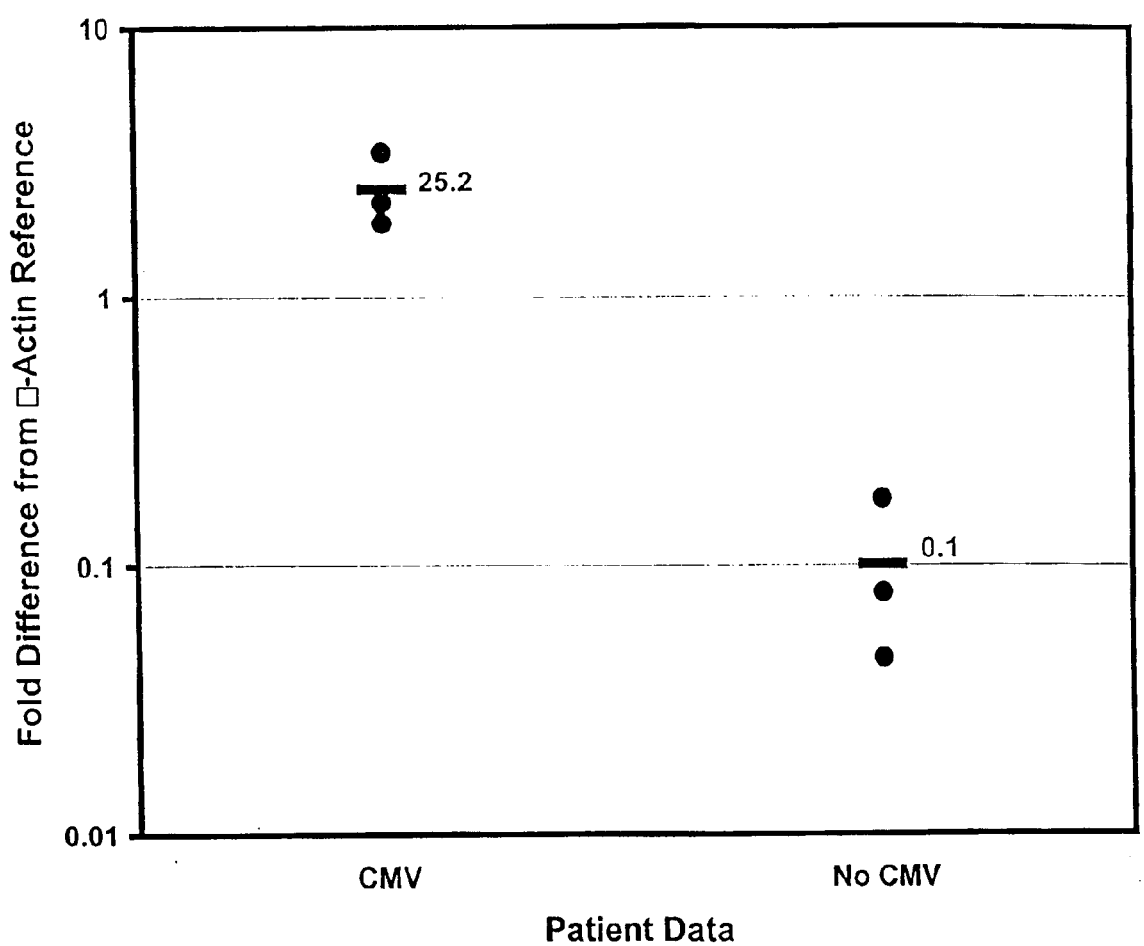
FIG. 6B shows the fold difference between the expression of Granzyme B and an Actin reference is shown for 3 samples from patients with and without CMV disease.

The complete experiment was performed in duplicate and the average of the two ratios taken for each gene. When β-Actin was used as the reference gene, the data show that Granzyme B is expressed at 25-fold higher levels in mononuclear cell RNA from patients with CMV than from patients without CMV (FIG. 6B). In this graph, each circle represents a patient sample and the black bars are the average of the three samples in each category.

Example 16

Correlation and Classification Analysis

After generation and processing of expression data sets from microarrays as described in Example 14, a log ratio value is used for most subsequent analysis. This is the logarithm of the expression ratio for each gene between sample and universal reference. The processing algorithm assigns a number of flags to data that are of low signal to noise or are in some other way of uncertain quality. Correlation analysis can proceed with all the data (including the flagged data) or can be done on filtered data sets where the flagged data is removed from the set. Filtered data should have less variability and may result in more significant results. Flagged data contains all information available and may allow discovery of genes that are missed with the filtered data set.

In addition to expression data, clinical data are included in the analysis. Continuous variables, such as the ejection fraction of the heart measured by echocardiography or the white blood cell count can be used for correlation analysis. In some cases, it may be desirable to take the logarithm of the values before analysis. These variables can be included in an analysis along with gene expression values, in which case they are treated as another "gene". Sets of markers can be discovered that work to diagnose a patient condition and these can include both genes and clinical parameters. Categorical variables such as male or female can also be used as variables for correlation analysis. For example, the sex of a patient may be an important splitter for a classification tree.

Clinical data are used as supervising vectors for the significance or classification analysis. In this case, clinical data associated with the samples are used to divide samples in to clinically meaningful diagnostic categories for correlation or classification analsysis. For example, pathologic specimens from kidney biopsies can be used to divide lupus patients into groups with and without kidney disease. A third or more categories can also be included (for example "unknown" or "not reported"). After generation of expression data and definition of using supervising vectors, correlation, significance and classification analysis is used to determine which set of genes are most appropriate for diagnosis and classification of patients and patient samples.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are a set of genes which are called significant, and the FDR gives a confidence level for this claim. If a gene is called differentially expressed between 2 classes by SAM, with a FDR of 5%, there is a 95% chance that the gene is actually differentially expressed between the classes. SAM takes into account the variability and large number of variables of microarrays. SAM will identify genes that are most globally differentially expressed between the classes. Thus, important genes for identifying and classifying outlier samples or patients may not be identified by SAM.

After generation of data from patient samples and definition of categories using clinical data as supervising vectors, SAM is used to detect genes that are likely to be differentially expressed between the groupings. Those genes with the highest significance can be validated by real-time PCR (Example 15) or can be used to build a classification algorithm as described here.

Classification

Supervised harvesting of expression trees (Hastie 2001) identifies genes or clusters that best distinguish one class from all the others on the data set. The method is used to identify the genes/clusters that can best separate one class versus all the others for datasets that include two or more classes from each other. This algorithm can be used to identify genes that are used to create a diagnostic algorithm. Genes that are identified can be used to build a classification tree with algorithms such as CART.

CART is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. Genes from expression data sets can be selected for classification building using CART by significant differential expression in SAM analysis or other significance test), identification by supervised tree-harvesting analysis, high fold change between sample groups, or known relevance to classification of the target diseases. In addition, clinical data can also be used as variables for CART that are of know importance to the clinical question or are found to be significant predictors by multivariate analysis or some other technique. CART identifies surrogates for each splitter (genes that are the next best substitute for a useful gene in classification). Analysis is performed in CART by weighting misclassification costs to optimize desired performance of the assay. For example, it may be most important the sensitivity of a test for a given diagnosis be near 100% while specificity is less important.

Once a set of genes and expression criteria for those genes have been established for classification, cross validation is done. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples. When a gene set is established for a diagnosis with a low cross validation error, this set of genes is tested using samples that were not included in the initial analysis (test samples). These samples may be taken from archives generated during the clinical study. Alternatively, a new prospective clinical study can be initiated, where samples are obtained and the gene set is used to predict patient diagnoses.

TABLE 1

| Disease Classification | Disease/Patient Group |
|---|---|
| Cardiovascular Disease | Atherosclerosis |
| | Unstable angina |
| | Myocardial Infarction |
| | Restenosis after angioplasty |
| | Congestive Heart Failure |
| | Myocarditis |
| | Endocarditis |
| | Endothelial Dysfunction |
| | Cardiomyopathy |
| | Cardiovascular drug use |
| Endocrine Disease | Diabetes Mellitus I and II |
| | Thyroiditis |
| | Addisson's Disease |
| Infectious Disease | Hepatitis A, B, C, D, E, G |
| | Malaria |
| | Tuberculosis |
| | HIV |
| | Pneumocystis Carinii |
| | Giardia |
| | Toxoplasmosis |
| | Lyme Disease |
| | Rocky Mountain Spotted Fever |
| | Cytomegalovirus |
| | Epstein Barr Virus |
| | Herpes Simplex Virus |
| | Clostridium Dificile Colitis |
| | Meningitis (all organisms) |
| | Pneumonia (all organisms) |
| | Urinary Tract Infection (all organisms) |
| | Infectious Diarrhea (all organisms) |
| | Anti-infectious drug use |
| Anglogenesis | Pathologic angiogenesis |
| | Physiologic angiogenesis |
| | Treatment induced angiogenesis |
| | Pro or anti-angiogenic drug use |
| Inflammatory/Rheumatic | Rheumatoid Arthritis |
| | Systemic Lupus Erythematosis |
| | Sjogrens Disease |

TABLE 1-continued

| Disease Classification | Disease/Patient Group |
|---|---|
| | CREST syndrome |
| | Scleroderma |
| | Ankylosing Spondylitis |
| | Crohn's |
| | Ulcerative Colitis |
| | Primary Sclerosing Cholangitis |
| | Appendicitis |
| | Diverticulitis |
| | Primary Biliary Sclerosis |
| | Wegener's Granulomatosis |
| | Polyarteritis nodosa |
| | Whipple's Disease |
| | Psoriasis |
| | Microscopic Polyanngiitis |
| | Takayasu's Disease |
| | Kawasaki's Disease |
| | Autoimmune hepatitis |
| | Asthma |
| | Churg-Strauss Disease |
| | Beurger's Disease |
| | Raynaud's Disease |
| | Cholecystitis |
| | Sarcoidosis |
| | Asbestosis |
| | Pneumoconioses |
| | Antinflammatory drug use |
| Transplant Rejection | Heart |
| | Lung |
| | Liver |
| | Pancreas |
| | Bowel |
| | Bone Marrow |
| | Stem Cell |
| | Graft versus host disease |
| | Transplant vasculopathy |
| | Skin |
| | Cornea |
| | Immunosupressive drug use |
| Malignant Disorders | Leukemia |
| | Lymphoma |
| | Carcinoma |
| | Sarcoma |
| Neurological Disease | Alzheimer's Dementia |
| | Pick's Disease |
| | Multiple Sclerosis |
| | Guillain Barre Syndrome |
| | Peripheral Neuropathy |

TABLE 2

Candidate genes, Database mining
Unigene clusters are listed.
Cluster numbers are defined as in Unigene build #133 uploaded on: Fri Apr 20 2001

| | | | |
|---|---|---|---|
| CD50 | Hs.99995 | Homo sapiens cAMP responsive element binding protein 1 (CREB1) mRNA. | Hs.79194 |
| CD70 = CD27L | Hs.99899 | Nucleolin (NCL) | Hs.79110 |
| MDC | Hs.97203 | MAPK14 | Hs.79107 |
| CD3z | Hs.97087 | CD100 | Hs.79089 |
| CD19 | Hs.96023 | OX-2 | Hs.79015 |
| | Hs.95388 | PCNA | Hs.78996 |
| CD3d | Hs.95327 | | Hs.78909 |
| | Hs.9456 | GRO-a | Hs.789 |
| interleukin 6 | Hs.93913 | CDw32A | Hs.78864 |
| phospholipaseA2 | Hs.93304 | H. sapiens mRNA for herpesvirus associated ubiquitin-specific protease (HAUSP). | Hs.78683 |
| Human mRNA for KIAA0128 gene, partial cds. | Hs.90998 | CD41b = LIBS1 | Hs.785 |
| CD48 | Hs.901 | ANXA1 (LPC1) | Hs.78225 |
| heat shock 70 kD protein 1A | Hs.8997 | CD31 | Hs.78146 |
| TxA2 receptor | Hs.89887 | Homo sapiens TERF1 (TRF1)-interacting nuclear factor 2 (TINF2), mRNA. | Hs.7797 |
| fragile X mental retardation protein (FMR-1) | Hs.89764 | major histocompatibility complex, class I, B | Hs.77961 |
| CD20 | Hs.89751 | LOX1 | Hs.77729 |
| ENA-78 | Hs.89714 | major histocompatibility complex, class II, DM alpha | Hs.77522 |
| IL-2 | Hs.89679 | CD64 | Hs.77424 |
| CD79b | Hs.89575 | CD71 | Hs.77356 |
| CD2 | Hs.89476 | | Hs.77054 |
| SDF-1 = CXCR4 | Hs.89414 | HLA-DRA | Hs.76807 |
| CD61 | Hs.87149 | CD105 | Hs.76753 |
| IFN-g | Hs.856 | | Hs.76691 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| CD34 | Hs.85289 | TNF-alpha | Hs.76507 |
| CD104 | Hs.85266 | LCP1 | Hs.76506 |
| CD8 | Hs.85258 | TMSB4X | Hs.75968 |
| IGF-1 | Hs.85112 | PAI2 | Hs.75716 |
| CD103 | Hs.851 | MIP-1b | Hs.75703 |
| IL-13 | Hs.845 | CD58 | Hs.75626 |
| RPA1 | Hs.84318 | CD36 | Hs.75613 |
| CD74 | Hs.84298 | hnRNP A2/hnRNP B1 | Hs.75598 |
| CD132 | Hs.84 | CD124 | Hs.75545 |
| CD18 | Hs.83968 | MIP-3a | Hs.75498 |
| Cathepsin K | Hs.83942 | beta-2-microglobulin | Hs.75415 |
| CD80 | Hs.838 | FPR1 | Hs.753 |
| CD46 | Hs.83532 | Topo2B | Hs.75248 |
| NFKB1 | Hs.83428 | interleukin enhancer binding factor 2, 45 kD | Hs.75117 |
| IL-18 | Hs.83077 | chloride intracellular channel 1 | Hs.74276 |
| interleukin 14 | Hs.83004 | EGR3 | Hs.74088 |
| L-selectin = CD62L | Hs.82848 | MIP-1a | Hs.73817 |
| CD107b | Hs.8262 | CD62P = p-selectin | Hs.73800 |
| CD69 | Hs.82401 | CD21 | Hs.73792 |
| CD95 | Hs.82359 | APE | Hs.73722 |
| CD53 | Hs.82212 | IL12Rb2 | Hs.73165 |
| Human lymphocyte specific interferon regulatory factor/interferon regulatory factor 4 (LSIRF/IRF4) mRNA, complete cds. | Hs.82132 | NFKB2 | Hs.73090 |
| IL-16 | Hs.82127 | I-309 | Hs.72918 |
| DUT | Hs.82113 | immunoglobulin superfamily, member 4 | Hs.70337 |
| CDw121a | Hs.82112 | IL-3 | Hs.694 |
| PAI-1 | Hs.82085 | | Hs.6895 |
| TGF-bR2 | Hs.82028 | NTH1 | Hs.66196 |
| CD117 | Hs.81665 | CD40L | Hs.652 |
| HLA-DPB1 | Hs.814 | IL-11R | Hs.64310 |
| NFKBIA | Hs.81328 | Homo sapiens toll-like receptor 2 (TLR2) mRNA. | Hs.63668 |
| CD6 | Hs.81226 | ferritin H chain | Hs.62954 |
| IL-1 RA | Hs.81134 | IL8 | Hs.624 |
| UBE2B (RAD6B) | Hs.811 | Tissue Factor | Hs.62192 |
| Lyn | Hs.80887 | F-box only protein 7 | Hs.5912 |
| STAT4 | Hs.80642 | CD5 | Hs.58685 |
| UBE2A (RAD6A) | Hs.80612 | guanine nucleotide binding protein (G protein), beta polypeptide 2-like 1 | Hs.5662 |
| Fractalkine | Hs.80420 | SCYA11 | Hs.54460 |
| IK cytokine, down-regulator of HLA II | Hs.8024 | IK1 | Hs.54452 |
| | Hs.79933 | CCR1 | Hs.516 |
| CD79a | Hs.79630 | Homo sapiens TRAIL receptor 2 mRNA, complete cds. | Hs.51233 |
| | Hs.7942 | CD11c | Hs.51077 |
| nuclear factor, interleukin 3 regulated | Hs.79334 | CD66a | Hs.50964 |
| CD83 | Hs.79197 | JAK1 | Hs.50651 |
| DC-CK1 | Hs.16530 | Homo sapiens programmed cell death 4 (PDCD4), mRNA. | Hs.100407 |
| CCR7 | Hs.1652 | SCYB13 (CXCL13) | Hs.100431 |
| TLR4 | Hs.159239 | SMAD7 | Hs.100602 |
| EST | Hs.158975 | RAD51L1 (RAD51B) | Hs.100669 |
| EST | Hs.158966 | PPARG | Hs.100724 |
| EST | Hs.158965 | transcription factor 3 (E2A immunoglobulin enhancer binding factors E12/E47) | Hs.101047 |
| EST | Hs.158943 | major histocompatibility complex, class I-like sequence | Hs.101840 |
| EST | Hs.158894 | immunoglobulin superfamily containing leucine-rich repeat | Hs.102171 |
| EST | Hs.158877 | CD166 | Hs.10247 |
| EST | Hs.157815 | fibroblast tropomyosin TM30 (pl) | Hs.102824 |
| EST | Hs.157813 | interleukin 1 receptor-like 2 | Hs.102865 |
| ESTs | Hs.157569 | GTF2H4 | Hs.102910 |
| immunoglobulin kappa constant | Hs.156110 | | Hs.10326 |
| INPP5D | Hs.155939 | Human ITAC (IBICK) | Hs.103982 |
| C3AR1 | Hs.155935 | novel protein with MAM domain | Hs.104311 |
| PRKDC | Hs.155637 | ESTs, Weakly similar to interleukin enhancer binding factor 2 [H. sapiens] | Hs.105125 |
| MHC class II HLA-DRw53-associated glycoprotein | Hs.155122 | Homo sapiens clone 24686 mRNA sequence. | Hs.105509 |
| CD73 | Hs.153952 | | Hs.105532 |
| CD37 | Hs.153053 | Homo sapiens granulysin (GNLY), transcript variant 519, mRNA. | Hs.105806 |
| IFNAR1 | Hs.1513 | CD77 | Hs.105956 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| *Homo sapiens* solute carrier family 21 (organic anion transporter), member 11 (SLC21A11), mRNA. | Hs.14805 | RD RNA-binding protein | Hs.106061 |
| EST | Hs.146627 | | Hs.106673 |
| SET translocation (myeloid leukemia-associated) | Hs.145279 | | Hs.10669 |
| EST | Hs.144119 | *Homo sapiens* clone 24818 mRNA sequence. | Hs.106823 |
| ESTs | Hs.143534 | | Hs.106826 |
| STAT3 | Hs.142258 | | Hs.10712 |
| CD96 | Hs.142023 | | Hs.107149 |
| CD23 | Hs.1416 | hypothetical protein | Hs.10729 |
| EGR2 | Hs.1395 | Tachykinin Receptor 1 | Hs.1080 |
| CDw84 | Hs.137548 | glycophorin A | Hs.108694 |
| CD55 | Hs.1369 | Histone H1x | Hs.109804 |
| EST | Hs.135339 | CD66d | Hs.11 |
| GM-CSF | Hs.1349 | interleukin 17 | Hs.110040 |
| EST | Hs.133175 | | Hs.110131 |
| CD1a | Hs.1309 | major histocompatibility complex, class I, F | Hs.110309 |
| CD10 | Hs.1298 | REV1 | Hs.110347 |
| HVEM | Hs.129708 | HCR | Hs.110746 |
| C9 | Hs.1290 | VWF | Hs.110802 |
| C6 | Hs.1282 | high affinity immunoglobulin epsilon receptor beta subunit | Hs.11090 |
| C1R | Hs.1279 | interleukin 22 receptor | Hs.110915 |
| IL-1b | Hs.126256 | | Hs.110978 |
| CD9 | Hs.1244 | *Homo sapiens* ubiquitin specific protease 6 (Tre-2 oncogene) (USP6), mRNA. | Hs.111065 |
| | Hs.12305 | | Hs.111128 |
| *Homo sapiens* Vanin 2 (VNN2) mRNA. | Hs.121102 | MMP2 | Hs.111301 |
| Hsp10 | Hs.1197 | major histocompatibility complex, class II, DN alpha | Hs.11135 |
| CD59 | Hs.119663 | LTBR | Hs.1116 |
| CD51 | Hs.118512 | ESTs, Weakly similar to A41285 interleukin enhancer-binding factor ILE-1 [*H. sapiens*] | Hs.111941 |
| CD49a | Hs.116774 | *Homo sapiens* STRIN protein (STRIN), mRNA. | Hs.112144 |
| CD72 | Hs.116481 | MSH5 | Hs.112193 |
| HLA-DMB | Hs.1162 | TCRg | Hs.112259 |
| MCP-4 | Hs.11383 | | Hs.11307 |
| | Hs.111554 | CMKRL2 | Hs.113207 |
| ferritin L chain | Hs.111334 | CCR8 | Hs.113222 |
| TGF-b | Hs.1103 | LILRA3 | Hs.113277 |
| *Homo sapiens* ras homolog gene family, member H (ARHH), mRNA. | Hs.109918 | Human CXCR-5 (BLR-1) | Hs.113916 |
| lysosomal alpha-mannosidase (MANB) | Hs.108969 | RAD51C | Hs.11393 |
| | Hs.108327 | myosin, heavy polypeptide 8, skeletal muscle, perinatal | Hs.113973 |
| granzyme B | Hs.1051 | CD42a | Hs.1144 |
| HCC-4 | Hs.10458 | TNFRSF11A | Hs.114676 |
| | Hs.10362 | | Hs.114931 |
| | Hs.102630 | MSH4 | Hs.115246 |
| | Hs.101382 | *Homo sapiens* dendritic cell immunoreceptor (DCIR), mRNA. | Hs.115515 |
| C4BPA | Hs.1012 | REV3L (POLZ) | Hs.115521 |
| CD125 | Hs.100001 | JAK2 | Hs.115541 |
| TERF2 | Hs.100030 | OPG ligand | Hs.115770 |
| LIG3 | Hs.100299 | PCDH12 | Hs.115897 |
| | Hs.157489 | | Hs.166235 |
| EST | Hs.157560 | POLE1 | Hs.166846 |
| EST | Hs.157808 | regulatory factor X, 5 (influences HLA class II expression) | Hs.166891 |
| EST | Hs.157811 | PIG-F (phosphatidyl-inositol-glycan class F) | Hs.166982 |
| | Hs.158127 | ESTs, Moderately similar to ILF1_HUMAN INTERLEUKIN ENHANCER-BINDING FACTOR 1 [*H. sapiens*] | Hs.167154 |
| interleukin 18 receptor accessory protein | Hs.158315 | HLA-DRB6 | Hs.167385 |
| CCR3 | Hs.158324 | ret finger protein-like 3 | Hs.167751 |
| Human DNA sequence from clone CTA-390C10 on chromosome 22q11.21–12.1 Contains an Immunoglobulin-like gene and a pseudogene similar to Beta Crystallin, | Hs.158352 | CD56 | Hs.167988 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| ESTs, STSs, GSSs and taga and tat repeat polymorphisms | | | |
| ESTs | Hs.158576 | RBT1 | Hs.169138 |
| | Hs.158874 | APOE | Hs.169401 |
| EST | Hs.158875 | | Hs.16944 |
| EST | Hs.158876 | | Hs.169470 |
| EST | Hs.158878 | MMP12 | Hs.1695 |
| EST | Hs.158956 | CD161 | Hs.169824 |
| EST | Hs.158967 | tenascin XB | Hs.169886 |
| EST | Hs.158969 | | Hs.170027 |
| EST | Hs.158971 | | Hs.170150 |
| EST | Hs.158988 | C4A | Hs.170250 |
| CD120a = TNFR-1 | Hs.159 | TP53BP1 | Hs.170263 |
| EST | Hs.159000 | ESTs | Hs.170274 |
| | Hs.159013 | ESTs, Weakly similar to ALU1__HUMAN ALU SUBFAMILY J SEQUENCE CONTAMINATION WARNING ENTRY☐ [*H. sapiens*] | Hs.170338 |
| EST | Hs.159025 | ESTs | Hs.170578 |
| EST | Hs.159059 | EST | Hs.170579 |
| IL18R1 | Hs.159301 | ESTs | Hs.170580 |
| ftp-3 | Hs.159494 | EST | Hs.170581 |
| CASP8 | Hs.159651 | ESTs | Hs.170583 |
| EST | Hs.159655 | EST | Hs.170586 |
| EST | Hs.159660 | EST | Hs.170588 |
| EST | Hs.159678 | EST | Hs.170589 |
| kallikrein 12 (KLK12) | Hs.159679 | | Hs.170772 |
| EST | Hs.159682 | ESTs | Hs.170786 |
| EST | Hs.159683 | EST | Hs.170909 |
| EST | Hs.159693 | EST | Hs.170912 |
| EST | Hs.159706 | EST | Hs.170933 |
| EST | Hs.159718 | ESTs | Hs.171004 |
| SPO11 | Hs.159737 | EST | Hs.171095 |
| EST | Hs.159754 | EST | Hs.171098 |
| EST | Hs.160401 | ESTs | Hs.171101 |
| EST | Hs.160405 | EST | Hs.171108 |
| EST | Hs.160408 | ESTs | Hs.171110 |
| EST | Hs.160410 | ESTs | Hs.171113 |
| EST | Hs.160423 | ESTs | Hs.171117 |
| RPA3 | Hs.1608 | EST | Hs.171119 |
| ESTs | Hs.160946 | ESTs | Hs.171120 |
| EST | Hs.160956 | EST | Hs.171122 |
| ESTs | Hs.160978 | EST | Hs.171123 |
| EST | Hs.160980 | EST | Hs.171124 |
| EST | Hs.160981 | EST | Hs.171140 |
| EST | Hs.160982 | EST | Hs.171216 |
| EST | Hs.160983 | EST | Hs.171260 |
| Tachykinin Receptor 2 | Hs.161305 | ESTs | Hs.171264 |
| RAD17 (RAD24) | Hs.16184 | RIP | Hs.171545 |
| Human phosphatidylinositol 3-kinase catalytic subunit p110delta mRNA, complete cds. | Hs.162808 | ESTs, Weakly similar to immunoglobulin superfamily member [*D. melanogaster*] | Hs.171697 |
| Human alpha-1 Ig germline C-region membrane-coding region, 3' end | Hs.163271 | CD22 | Hs.171763 |
| GCP-2 | Hs.164021 | | Hs.171776 |
| | Hs.164284 | sema domain, immunoglobulin domain (Ig), short basic domain, secreted, (semaphorin) 3C | Hs.171921 |
| EST | Hs.164331 | interleukin 11 | Hs.1721 |
| | Hs.164427 | CD11b | Hs.172631 |
| | Hs.165568 | EST, Highly similar to APS [*H. sapiens*] | Hs.172656 |
| ER | Hs.1657 | ALK1 | Hs.172670 |
| EST, Highly similar to JM26 [*H. sapiens*] | Hs.165701 | | Hs.172674 |
| EST | Hs.165702 | CD123 | Hs.172689 |
| EST | Hs.165704 | ESTs | Hs.172822 |
| EST | Hs.165732 | ColIaI | Hs.172928 |
| regulatory factor X, 3 (influences HLA class II expression) | Hs.166019 | | Hs.172998 |
| LIG4 | Hs.166091 | | Hs.173081 |
| TNFSF18 | Hs.248197 | myosin, heavy polypeptide 3, skeletal muscle, embryonic | Hs.173084 |
| EST | Hs.248228 | | Hs.173201 |
| *H. sapiens* rearranged gene for kappa immunoglobulin subgroup V kappa IV | Hs.248756 | Mediterranean fever (MEFV) | Hs.173730 |
| caspase 1, apoptosis-related cysteine | Hs.2490 | | Hs.173749 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| protease (interleukin 1, beta, convertase) | | | |
| EST | Hs.249031 | interleukin 1 receptor accessory protein | Hs.173880 |
| TNFRSF10A | Hs.249190 | EST, Weakly similar to RL13_HUMAN 60S RIBOSOMAL PROTEIN L13 [*H. sapiens*] | Hs.174231 |
| immunoglobulin lambda variable 3–10 | Hs.249208 | EST | Hs.174242 |
| *Homo sapiens* mRNA for single-chain antibody, complete cds | Hs.249245 | EST | Hs.174300 |
| EST | Hs.250473 | EST | Hs.174634 |
| ESTs | Hs.250591 | EST | Hs.174635 |
| ESTs | Hs.250605 | EST | Hs.174650 |
| | Hs.25063 | EST | Hs.174673 |
| Human DNA sequence from clone RP1-149A16 on chromosome 22 Contains an IGLC (Immunoglobulin Lambda Chain C) pseudogene, the RFPL3 gene for Ret finger protein-like 3, the RFPL3S gene for Ret finger protein-like 3 antisense, the gene for a novel Immunoglobulin Lambda Chain V family protein, the gene for a novel protein similar to mouse RGDS (RALGDS, RALGEF, Guanine Nucleotide Dissociation Stimulator A) and rabbit oncogene RSC, the gene for a novel protein (ortholog of worm F16A11.2 and bacterial and archea-bacterial predicted proteins), the gene for a novel protein similar to BPI (Bacterial Permeability-Increasing Protein) and rabbit LBP (Liposaccharide-Binding Protein) and the 5' part of a novel gene. Contains ESTs, STSs, GSSs and three putative CpG islands | Hs.250675 | EST | Hs.174716 |
| ACE | Hs.250711 | EST | Hs.174740 |
| TREX2 | Hs.251398 | EST | Hs.174778 |
| Human DNA sequence from clone 1170K4 on chromosome 22q12.2–13.1. Contains three novel genes, one of which codes for a Trypsin family protein with class A LDL receptor domains, and the IL2RB gene for Interleukin 2 Receptor, Beta (IL-2 Receptor, CD122 antigen). Contains a putative CpG island, ESTs, and GSSs | Hs.251417 | EST | Hs.174779 |
| EST | Hs.251539 | EST, Weakly similar to RL13_HUMAN 60S RIBOSOMAL PROTEIN L13 [*H. sapiens*] | Hs.174780 |
| EST | Hs.251540 | (KIAA0033) for ORF, partial cds. | Hs.174905 |
| C3 | Hs.251972 | | Hs.175270 |
| EST | Hs.252273 | EST | Hs.175281 |
| EST | Hs.252359 | EST | Hs.175300 |
| ESTs, Moderately similar to T2DT_HUMAN TRANSCRIPTION INITIATION FACTOR TFIID 105 KDA SUBUNIT [*H. sapiens*] | Hs.252867 | EST | Hs.175336 |
| EST, Moderately similar to RS2_HUMAN 40S RIBOSOMAL PROTEIN S2 [*H. sapiens*] | Hs.253150 | EST | Hs.175388 |
| EST | Hs.253151 | | Hs.175437 |
| EST | Hs.253154 | EST, Weakly similar to salivary proline-rich protein precursor [*H. sapiens*] | Hs.175777 |
| EST | Hs.253165 | EST | Hs.175803 |
| EST | Hs.253166 | ESTs | Hs.176337 |
| EST | Hs.253167 | EST | Hs.176374 |
| EST | Hs.253168 | EST | Hs.176380 |
| EST | Hs.253169 | EST | Hs.176404 |
| interleukin 1 receptor, type II | Hs.25333 | EST | Hs.176406 |
| | Hs.25361 | LCK | Hs.1765 |
| EST | Hs.253742 | LIG1 | Hs.1770 |
| EST | Hs.253743 | EST | Hs.177012 |
| EST, Weakly similar to AF161429_1 HSPC311 [*H. sapiens*] | Hs.253744 | PERB11 family member in MHC class I region | Hs.17704 |
| EST | Hs.253747 | EST | Hs.177146 |
| EST | Hs.253748 | EST | Hs.177209 |
| EST | Hs.253753 | | Hs.177376 |
| EST, Moderately similar to ALU5_HUMAN ALU SUBFAMILY SC SEQUENCE CONTAMINATION | Hs.254108 | | Hs.177461 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| WARNING ENTRY☐ [*H. sapiens*] | | | |
| ESTs | Hs.254948 | CD99 | Hs.177543 |
| ESTs | Hs.255011 | PMS2 | Hs.177548 |
| EST | Hs.255118 | human calmodulin | Hs.177656 |
| EST | Hs.255119 | | Hs.177712 |
| EST | Hs.255123 | *Homo sapiens* immunoglobulin lambda gene locus DNA, clone:288A10 | Hs.178665 |
| EST | Hs.255129 | | Hs.178743 |
| EST | Hs.255134 | EST | Hs.179008 |
| EST | Hs.255135 | EST | Hs.179070 |
| EST | Hs.255139 | EST | Hs.179130 |
| EST | Hs.255140 | EST | Hs.179132 |
| ESTs | Hs.255142 | | Hs.179149 |
| EST | Hs.255150 | EST | Hs.179490 |
| EST | Hs.255152 | EST | Hs.179492 |
| ESTs | Hs.255153 | promyelocytic leukemia cell mRNA, clones pHH58 and pHH81. | Hs.179735 |
| ESTs | Hs.255157 | | Hs.179817 |
| ESTs | Hs.255171 | major histocompatibility complex, class II, DO beta | Hs.1802 |
| EST | Hs.255172 | HLA-DRB1 | Hs.180255 |
| EST, Moderately similar to PGTA_HUMAN RAB GERANYLGERANYLTRANSFERASE ALPHA SUBUNIT [*H. sapiens*] | Hs.255174 | TNFRSF12 | Hs.180338 |
| EST | Hs.255177 | RAD23A (HR23A) | Hs.180455 |
| EST | Hs.255178 | MKK3 | Hs.180533 |
| EST | Hs.255245 | EST | Hs.180637 |
| EST | Hs.255246 | CD27 | Hs.180841 |
| EST | Hs.255249 | STAT6 | Hs.181015 |
| EST | Hs.255251 | TNFSF4 | Hs.181097 |
| EST | Hs.255253 | immunoglobulin lambda locus | Hs.181125 |
| EST | Hs.255254 | | Hs.181368 |
| EST | Hs.255255 | CD3 | Hs.181392 |
| ESTs | Hs.255256 | EST | Hs.255745 |
| EST | Hs.255330 | EST | Hs.255746 |
| EST, Weakly similar to putative G protein-coupled Receptor [*H. sapiens*] | Hs.255333 | EST | Hs.255747 |
| EST | Hs.255336 | EST | Hs.255749 |
| EST | Hs.255337 | EST | Hs.255754 |
| EST | Hs.255339 | ESTs, Moderately similar to KIAA1271 protein [*H. sapiens*] | Hs.255759 |
| EST | Hs.255340 | EST | Hs.255762 |
| EST | Hs.255341 | EST | Hs.255763 |
| ESTs | Hs.255343 | EST | Hs.255764 |
| EST | Hs.255347 | EST | Hs.255766 |
| EST | Hs.255349 | EST | Hs.255767 |
| EST | Hs.255350 | EST | Hs.255768 |
| EST | Hs.255354 | EST | Hs.255769 |
| ESTs | Hs.255359 | EST | Hs.255770 |
| ESTs | Hs.255387 | EST | Hs.255772 |
| EST | Hs.255388 | EST | Hs.255777 |
| EST | Hs.255389 | EST | Hs.255778 |
| ESTs | Hs.255390 | EST | Hs.255779 |
| EST | Hs.255392 | EST | Hs.255782 |
| EST | Hs.255444 | EST | Hs.255783 |
| EST | Hs.255446 | EST | Hs.255784 |
| EST | Hs.255448 | EST | Hs.255785 |
| ESTs | Hs.255449 | EST, Weakly similar to Con1 [*H. sapiens*] | Hs.255788 |
| EST | Hs.255454 | EST | Hs.255791 |
| EST | Hs.255455 | EST | Hs.255794 |
| EST | Hs.255457 | EST | Hs.255796 |
| EST | Hs.255459 | EST | Hs.255797 |
| EST | Hs.255462 | EST | Hs.255799 |
| EST | Hs.255464 | ESTs | Hs.255877 |
| EST | Hs.255492 | EST | Hs.255880 |
| EST | Hs.255494 | EST | Hs.255920 |
| EST | Hs.255495 | EST | Hs.255927 |
| EST | Hs.255497 | CD40 | Hs.25648 |
| EST | Hs.255498 | interleukin enhancer binding factor 3, 90 kD | Hs.256583 |
| EST | Hs.255499 | ESTs | Hs.256810 |
| EST | Hs.255501 | EST | Hs.256956 |
| EST | Hs.255502 | EST | Hs.256957 |
| EST | Hs.255505 | EST | Hs.256959 |
| EST | Hs.255541 | EST | Hs.256961 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| EST | Hs.255543 | EST | Hs.256970 |
| ESTs | Hs.255544 | EST | Hs.256971 |
| EST | Hs.255546 | ESTs | Hs.256979 |
| EST | Hs.255549 | ESTs | Hs.257572 |
| EST | Hs.255552 | EST | Hs.257579 |
| EST | Hs.255554 | EST | Hs.257581 |
| EST | Hs.255556 | EST | Hs.257582 |
| EST | Hs.255558 | EST | Hs.257630 |
| EST | Hs.255559 | EST | Hs.257632 |
| EST | Hs.255560 | EST | Hs.257633 |
| EST | Hs.255561 | EST | Hs.257636 |
| EST | Hs.255569 | EST | Hs.257640 |
| EST | Hs.255572 | ESTs | Hs.257641 |
| EST | Hs.255573 | EST | Hs.257644 |
| EST | Hs.255575 | EST | Hs.257645 |
| EST | Hs.255577 | EST | Hs.257646 |
| EST | Hs.255578 | EST | Hs.257647 |
| EST | Hs.255579 | EST | Hs.257667 |
| EST | Hs.255580 | EST | Hs.257668 |
| EST | Hs.255590 | EST | Hs.257677 |
| EST | Hs.255591 | EST | Hs.257679 |
| EST | Hs.255598 | EST | Hs.257680 |
| TNFRSF17 | Hs.2556 | ESTs | Hs.257682 |
| EST | Hs.255600 | ESTs | Hs.257684 |
| EST | Hs.255601 | EST | Hs.257687 |
| ESTs, Highly similar to KIAA1039 protein [*H. sapiens*] | Hs.255603 | EST | Hs.257688 |
| EST | Hs.255614 | EST | Hs.257690 |
| EST | Hs.255615 | EST | Hs.257695 |
| ESTs | Hs.255617 | EST | Hs.257697 |
| EST | Hs.255618 | EST | Hs.257705 |
| EST | Hs.255621 | EST | Hs.257706 |
| EST | Hs.255622 | EST | Hs.257709 |
| ESTs | Hs.255625 | ESTs, Moderately similar to ALU8_HUMAN ALU SUBFAMILY SX SEQUENCE CONTAMINATION WARNING ENTRY□ [*H. sapiens*] | Hs.257711 |
| EST | Hs.255626 | EST | Hs.257713 |
| ESTs | Hs.255627 | EST | Hs.257716 |
| ESTs | Hs.255630 | EST | Hs.257719 |
| EST | Hs.255632 | EST | Hs.257720 |
| EST | Hs.255633 | EST | Hs.257727 |
| EST | Hs.255634 | EST | Hs.257730 |
| EST | Hs.255635 | EST | Hs.257738 |
| EST | Hs.255637 | EST | Hs.257743 |
| ESTs | Hs.255639 | ESTs | Hs.258513 |
| EST | Hs.255641 | EST | Hs.258820 |
| EST | Hs.255644 | EST | Hs.258864 |
| EST | Hs.255645 | sema domain, immunoglobulin domain (Ig), transmembrane domain (TM) and short cytoplasmic domain, (semaphorin) 4F | Hs.25887 |
| EST | Hs.255646 | EST | Hs.258898 |
| EST | Hs.255647 | EST | Hs.258933 |
| EST | Hs.255648 | interleukin 13 receptor, alpha 2 | Hs.25954 |
| EST | Hs.255649 | *Homo sapiens* HSPC101 mRNA, partial cds | Hs.259683 |
| EST | Hs.255650 | EST | Hs.263695 |
| EST | Hs.255653 | ESTs | Hs.263784 |
| EST | Hs.255657 | TNFSF12 | Hs.26401 |
| EST | Hs.255661 | EST | Hs.264154 |
| ESTs | Hs.255664 | EST | Hs.264654 |
| EST | Hs.255665 | CDw116b | Hs.265262 |
| EST | Hs.255666 | MHC binding factor, beta | Hs.2654 |
| EST | Hs.255668 | EST | Hs.265634 |
| EST | Hs.255671 | EST | Hs.266387 |
| EST | Hs.255672 | ESTs | Hs.268027 |
| EST | Hs.255673 | ATHS (LDLR?) | Hs.268571 |
| EST | Hs.255674 | ESTs, Highly similar to AAD18086 BAT2 [*H. sapiens*] | Hs.270193 |
| EST | Hs.255675 | ESTs | Hs.270198 |
| EST | Hs.255677 | ESTs | Hs.270294 |
| EST | Hs.255679 | ESTs, Weakly similar to alternatively spliced product using exon 13A [*H. sapiens*] | Hs.270542 |
| EST | Hs.255681 | ESTs, Moderately similar to ALU2_HUMAN ALU SUBFAMILY SB SEQUENCE CONTAMINATION | Hs.270561 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| EST | Hs.255682 | WARNING ENTRY☐ [*H. sapiens*] ESTs, Weakly similar to pro alpha 1(I) collagen [*H. sapiens*] | Hs.270564 |
| EST | Hs.255686 | ESTs, Weakly similar to ALU1_HUMAN ALU SUBFAMILY J SEQUENCE CONTAMINATION WARNING ENTRY☐ [*H. sapiens*] | Hs.270578 |
| ESTs | Hs.255687 | ESTs, Moderately similar to brain-derived immunoglobulin superfamily molecule [*M. musculus*] | Hs.270588 |
| EST | Hs.255688 | TALL1 | Hs.270737 |
| ESTs | Hs.255689 | ESTs | Hs.271206 |
| EST | Hs.255691 | MYH | Hs.271353 |
| EST | Hs.255692 | POLI (RAD30B) | Hs.271699 |
| ESTs | Hs.255693 | ADPRTL3 | Hs.271742 |
| EST | Hs.255695 | ESTs, Moderately similar to ALU8_HUMAN ALU SUBFAMILY SX SEQUENCE CONTAMINATION WARNING ENTRY☐ [*H. sapiens*] | Hs.272075 |
| EST, Highly similar to transmembrane chloride conductor protein [*H. sapiens*] | Hs.255697 | Human DNA sequence from clone RP5-1170K4 on chromosome 22q12.2–13.1 Contains three novel genes, one of which codes for a Trypsin family protein with class A LDL receptor domains, and the IL2RB gene for Interleukin 2 Receptor, Beta (IL-2 Receptor, CD122 antigen), a putative CpG island, ESTs, and GSSs | Hs.272271 |
| EST | Hs.255698 | interleukin 1 receptor accessory protein-like 2 | Hs.272354 |
| EST | Hs.255699 | *Homo sapiens* partial IGVH3 V3-20 gene for immunoglobulin heavy chain V region, case 1, clone 2 | Hs.272355 |
| EST | Hs.255705 | *Homo sapiens* partial IGVH3 gene for immunoglobulin heavy chain V region, case 1, clone 16 | Hs.272356 |
| EST | Hs.255706 | *Homo sapiens* partial IGVH3 gene for immunoglobulin heavy chain V region, case 1, clone 19 | Hs.272357 |
| EST | Hs.255708 | *Homo sapiens* partial IGVH3 gene for immunoglobulin heavy chain V region, case 1, cell Mo IV 72 | Hs.272358 |
| EST | Hs.255710 | *Homo sapiens* partial IGVH1 gene for immunoglobulin heavy chain V region, case 1, cell Mo V 94 | Hs.272359 |
| EST | Hs.255713 | *Homo sapiens* partial IGVL2 gene for immunoglobulin lambda light chain V region, case 1, cell Mo V 94 | Hs.272360 |
| EST | Hs.255717 | *Homo sapiens* partial IGVH3 gene for immunoglobulin heavy chain V region, case 1, cell Mo VI 7 | Hs.272361 |
| EST | Hs.255718 | *Homo sapiens* partial IGVL1 gene for immunoglobulin lambda light chain V region, case 1, cell Mo VI 65 | Hs.272362 |
| EST | Hs.255721 | *Homo sapiens* partial IGVH3 gene for immunoglobulin heavy chain V region, case 1, cell Mo VI 162 | Hs.272363 |
| ESTs | Hs.255723 | *Homo sapiens* partial IGVH3 DP29 gene for immunoglobulin heavy chain V region, case 1, cell Mo VII 116 | Hs.272364 |
| EST | Hs.255725 | *Homo sapiens* partial IGVH4 gene for immunoglobulin heavy chain V region, case 2, cell D 56 | Hs.272365 |
| EST | Hs.255726 | *Homo sapiens* partial IGVH3 gene for immunoglobulin heavy chain V region, case 2, cell E 172 | Hs.272366 |
| EST | Hs.255727 | interleukin 20 | Hs.272373 |
| EST | Hs.255736 | Human DNA sequence from clone RP1-149A16 on chromosome 22 Contains an IGLC (Immunoglobulin Lambda Chain C) pseudogene, the RFPL3 gene for Ret finger protein-like 3, the RFPL3S gene for Ret finger protein-like 3 antisense, the gene for a novel Immunoglobulin Lambda Chain V family protein, the gene for a novel protein similar to mouse RGDS (RALGDS, RALGEF, Guanine Nucleotide Dissociation | Hs.272521 |

TABLE 2-continued

Candidate genes, Database mining
Unigene clusters are listed.
Cluster numbers are defined as in Unigene build #133 uploaded on: Fri Apr 20 2001

| | | Stimulator A) and rabbit oncogene RSC, the gene for a novel protein (ortholog of worm F16A11.2 and bacterial and archea-bacterial predicted proteins), the gene for a novel protein similar to BPI (Bacterial Permeability-Increasing Protein) and rabbit LBP (Liposaccharide-Binding Protein) and the 5' part of a novel gene. Contains ESTs, STSs, GSSs and three putative CpG islands | |
|---|---|---|---|
| EST | Hs.255740 | TdT | Hs.272537 |
| EST | Hs.255742 | ret finger protein-like 3 antisense | Hs.274285 |
| EST | Hs.255743 | PRKR | Hs.274382 |
| EST | Hs.7569 | H. sapiens immunoglobulin epsilon chain | Hs.274600 |
| SMAD4 | Hs.75862 | EST, Weakly similar to HLA-DQ alpha chain [H. sapiens] | Hs.275720 |
| Homo sapiens splicing factor, arginine/serine-rich 4 (SFRS4) mRNA. | Hs.76122 | EST, Weakly similar to RL13__HUMAN 60S RIBOSOMAL PROTEIN L13 [H. sapiens] | Hs.276279 |
| thymosin beta-10 | Hs.76293 | EST | Hs.276341 |
| CD63 | Hs.76294 | EST | Hs.276342 |
| AIF1 | Hs.76364 | EST, Weakly similar to RL13__HUMAN 60S RIBOSOMAL PROTEIN L13 [H. sapiens] | Hs.276353 |
| phospholipase A2, group IIA (platelets, synovial fluid), | Hs.76422 | EST | Hs.276774 |
| CES1 | Hs.76688 | EST | Hs.276819 |
| ubiquitin conjugating enzyme | Hs.76932 | EST | Hs.276871 |
| Homo sapiens KIAA0963 protein (KIAA0963), mRNA. | Hs.7724 | EST, Weakly similar to FBRL__HUMAN FIBRILLARIN [H. sapiens] | Hs.276872 |
| Homo sapiens fragile histidine triad gene (FHIT) mRNA. | Hs.77252 | EST | Hs.276887 |
| PAF-AH | Hs.77318 | EST | Hs.276902 |
| Mig | Hs.77367 | EST | Hs.276917 |
| DDB2 | Hs.77602 | EST | Hs.276918 |
| ATR | Hs.77613 | EST, Weakly similar to RL13__HUMAN 60S RIBOSOMAL PROTEIN L13 [H. sapiens] | Hs.276938 |
| XPB (ERCC3) | Hs.77929 | EST | Hs.277051 |
| PNKP | Hs.78016 | EST | Hs.277052 |
| C7 | Hs.78065 | EST, Moderately similar to RL13__HUMAN 60S RIBOSOMAL PROTEIN L13 [H. sapiens] | Hs.277236 |
| Homo sapiens small nuclear RNA activating complex, polypeptide 2, 45 kD (SNAPC2) mRNA. | Hs.78403 | EST, Moderately similar to DEAD Box Protein 5 [H. sapiens] | Hs.277237 |
| | Hs.78465 | EST | Hs.277238 |
| sphingolipid activator protein/cerebroside sulfate activator protein | Hs.78575 | EST | Hs.277286 |
| Homo sapiens aminolevulinate, delta-, synthase 1 (ALAS1), nuclear gene encoding mitochondrial protein, mRNA. | Hs.78712 | major histocompatibility complex, class I, C | Hs.277477 |
| tyrosine kinase with immunoglobulin and epidermal growth factor homology domains | Hs.78824 | EST, Weakly similar to AF150959 1 immunoglobulin G1 Fc fragment [H. sapiens] | Hs.277591 |
| Hsp72 | Hs.78846 | EST | Hs.277714 |
| UNG | Hs.78853 | EST | Hs.277715 |
| CX3CR1 | Hs.78913 | EST | Hs.277716 |
| MSH2 | Hs.78934 | EST | Hs.277717 |
| CRHR1 | Hs.79117 | EST | Hs.277718 |
| BCL2 | Hs.79241 | EST, Weakly similar to BAT3__HUMAN LARGE PROLINE-RICH PROTEIN BAT3 [H. sapiens] | Hs.277774 |
| P-selectin | Hs.79283 | EST | Hs.277975 |
| UBE2VE (MMS2) | Hs.79300 | EST | Hs.278060 |
| retinoid X receptor, beta | Hs.79372 | cytochrome P450, subfamily XXIA (steroid 21-hydroxylase, congenital adrenal hyperplasia), polypeptide 2 | Hs.278430 |
| MPG | Hs.79396 | KIAA0015 gene product | Hs.278441 |
| RPA2 | Hs.79411 | CD32B | Hs.278443 |
| heat shock 70 kD protein-like 1 | Hs.80288 | KIR2DL1 | Hs.278453 |
| FANCG (XRCC9) | Hs.8047 | CD158a | Hs.278455 |
| CD43 | Hs.80738 | CD24 | Hs.278667 |
| POLG | Hs.80961 | HLA class II region expressed gene KE4 | Hs.278721 |
| Human CB-4 transcript of unrearranged immunoglobulin V(H)5 gene | Hs.81220 | IL-17C | Hs.278911 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| Human L2-9 transcript of unrearranged immunoglobulin V(H)5 pseudogene | Hs.81221 | HSPC048 protein (HSPC048) | Hs.278944 |
| immunoglobulin superfamily, member 3 | Hs.81234 | HSPC054 protein (HSPC054) | Hs.278946 |
| UBL1 | Hs.81424 | HSPC073 protein (HSPC073) | Hs.278948 |
| PF4 | Hs.81564 | ESTs | Hs.279066 |
| palmitoyl-protein thioesterase 2 | Hs.81737 | ESTs | Hs.279067 |
| natural killer cell receptor, immunoglobulin superfamily member | Hs.81743 | ESTs | Hs.279068 |
| TNFRSF11B | Hs.81791 | ESTs | Hs.279069 |
| interleukin 6 signal transducer (gp130, oncostatin M receptor) | Hs.82065 | ESTs | Hs.279070 |
| CD138 | Hs.82109 | ESTs | Hs.279071 |
| Human monocytic leukaemia zinc finger protein (MOZ) mRNA, complete cds. | Hs.82210 | ESTs | Hs.279072 |
| sema domain, immunoglobulin domain (Ig), short basic domain, secreted, (semaphorin) 3B | Hs.82222 | ESTs, Weakly similar to KIAA0052 protein [*H. sapiens*] | Hs.279073 |
| HPRT | Hs.82314 | ESTs | Hs.279074 |
| Human RNA binding protein Etr-3 mRNA, complete cds. | Hs.82321 | ESTs | Hs.279075 |
| MNAT1 | Hs.82380 | ESTs | Hs.279076 |
| SMAD2 | Hs.82483 | ESTs | Hs.279077 |
| CD47 | Hs.82685 | EST | Hs.279078 |
| CETN2 | Hs.82794 | EST | Hs.279079 |
| protein phosphatase 1, regulatory (inhibitor) subunit 11 | Hs.82887 | ESTs | Hs.279080 |
| MMP1 | Hs.83169 | EST | Hs.279081 |
| D3-type cyclin (CCND3) | Hs.83173 | ESTs | Hs.279082 |
| MMP3 | Hs.83326 | ESTs | Hs.279083 |
| TNFSF10 | Hs.83429 | ESTs | Hs.279084 |
| CD33 | Hs.83731 | ESTs | Hs.279085 |
| CD102 | Hs.83733 | ESTs | Hs.279086 |
| | Hs.84153 | ESTs, Weakly similar to AF201422_1 splicing coactivator subunit SRm300 [*H. sapiens*] | Hs.279087 |
| interleukin 8 receptor, beta | Hs.846 | ESTs | Hs.279088 |
| titin immunoglobulin domain protein (myotilin) | Hs.84665 | ESTs | Hs.279089 |
| KU80 (XRCC5) | Hs.84981 | | Hs.86437 |
| Raf-1 | Hs.85181 | | Hs.86761 |
| major histocompatibility complex, class I, J (pseudogene) | Hs.85242 | CD118 = IFNAR-2 | Hs.86958 |
| RELB | Hs.858 | | Hs.87113 |
| | Hs.85923 | PGHS-1 | Hs.88474 |
| ERK1 | Hs.861 | | Hs.8882 |
| FADD | Hs.86131 | LT-b | Hs.890 |
| MHC class I polypeptide-related sequence A | Hs.90598 | EST | Hs.92440 |
| TNF receptor-associated factor 6 | Hs.90957 | | Hs.92460 |
| Topo3A | Hs.91175 | myosin-binding protein H | Hs.927 |
| PARG | Hs.91390 | IFN-b | Hs.93177 |
| HLA-DPA1 | Hs.914 | C8A | Hs.93210 |
| SEEK1 | Hs.91600 | pre-B-cell leukemia transcription factor 2 | Hs.93728 |
| POLD1 | Hs.99890 | Tachykinin Receptor 3 | Hs.942 |
| ALK4 | Hs.99954 | *Homo sapiens* cDNA FLJ12242 fis, clone MAMMA1001292 | Hs.94810 |
| XPD (ERCC2) | Hs.99987 | CD29 | Hs.287797 |
| SCYA25 (CCL25) | Hs.50404 | LIF | Hs.2250 |
| SCYA19 (CCL19) | Hs.50002 | Human IP-10 | Hs.2248 |
| TCIRG1 | Hs.46465 | IL-5 | Hs.2247 |
| PAF-Receptor | Hs.46 | G-CSF | Hs.2233 |
| CD26 | Hs.44926 | TGF-bR | Hs.220 |
| | Hs.44865 | G-CSFR | Hs.2175 |
| REL | Hs.44313 | CD15 | Hs.2173 |
| IL-17 | Hs.41724 | STAT1 | Hs.21486 |
| CD49d | Hs.40034 | CD85 | Hs.204040 |
| CCR2 | Hs.395 | HCC-1 | Hs.20144 |
| | Hs.3688 | Fas ligand | Hs.2007 |
| TNF-b | Hs.36 | CD28 | Hs.1987 |
| lactoferrin | Hs.347 | HLA-DQA1 | Hs.198253 |
| MCP-1 | Hs.340 | Ku70 (G22P1) | Hs.197345 |
| CD150 | Hs.32970 | PGHS-2 | Hs.196384 |
| IL-10Ra | Hs.327 | CDw128 | Hs.194778 |
| EGR1 | Hs.326035 | IL-10 | Hs.193717 |
| SCYC1 (XCL1) | Hs.3195 | CD126 | Hs.193400 |
| HLA-DR | Hs.318720 | | Hs.1880 |

TABLE 2-continued

Candidate genes, Database mining
Unigene clusters are listed.
Cluster numbers are defined as in Unigene build #133 uploaded on: Fri Apr 20 2001

| Gene | Cluster | Gene | Cluster |
|---|---|---|---|
| Topo I (TOP1) | Hs.317 | CD98 | Hs.184601 |
| SCYA2 (MCP1) | Hs.303649 | | Hs.184542 |
| HuRNPD | Hs.303627 | MHC class I region ORF | Hs.1845 |
| Human C mu gene for IgM heavy chain exons CH1-4, secretory | Hs.302063 | CDw116a | Hs.182378 |
| P1 | Hs.297681 | HLA-DRB5 | Hs.181366 |
| immunoglobulin lambda joining 3 | Hs.289110 | major histocompatibility complex, class I, A | Hs.181244 |
| major histocompatibility complex, class II, DQ alpha 2 | Hs.289095 | elongation factor 1-alpha (clone CEF4) | Hs.181165 |
| HSPCA | Hs.289088 | CD119 | Hs.180866 |
| interleukin 22 | Hs.287369 | | Hs.180804 |
| ribosomal protein L4 | Hs.286 | | Hs.180532 |
| IgM | Hs.285823 | POLB | Hs.180107 |
| EST | Hs.283267 | CD1d | Hs.1799 |
| TREM1 | Hs.283022 | CD87 | Hs.179657 |
| HLA-DRB3 | Hs.279930 | minichromosome maintenance deficient (*S. cerevisiae*) 3 | Hs.179565 |
| LIFR | Hs.2798 | RAD23B (HR23B) | Hs.178658 |
| C4B | Hs.278625 | | Hs.178391 |
| EST | Hs.276907 | | Hs.177781 |
| CDw52 | Hs.276770 | ADPRT | Hs.177766 |
| CD16b | Hs.274467 | IFNGR2 | Hs.177559 |
| heat shock 70 kD protein 1B | Hs.274402 | CD16a | Hs.176663 |
| Th1 | Hs.273385 | CD4 | Hs.17483 |
| MIP-5/HCC-2 | Hs.272493 | SCYC2 (XCL2) | Hs.174228 |
| TBX21 | Hs.272409 | CD115 | Hs.174142 |
| *Homo sapiens* mRNA; cDNA DKFZp434O2417 (from clone DKFZp434O2417); partial cds | Hs.272307 | CD11a | Hs.174103 |
| Human DNA sequence from clone RP1-108C2 on chromosome 6p12.1–21.1. Contains the MCM3 gene for minichromosome maintenance deficient (*S. cerevisiae*) 3 (DNA replication licensing factor, DNA polymerase alpha holoenzyme-associated protein P1, RLF beta subunit), a CACT (carnitine/acylcarnitine translocase) pseudogene, part of the gene for a PUTATIVE novel protein similar to IL17 (interleukin 17 (cytotoxic T-lymphocyte-associated serine esterase 8)) (cytotoxic T lymphocyte-associated antigen 8, CTLA8), ESTs, STSs, GSSs and a putative CpG island | Hs.272295 | IL-10Rb | Hs.173936 |
| CD49b | Hs.271986 | MSCF | Hs.173894 |
| MCP-2 | Hs.271387 | TDG | Hs.173824 |
| CD49c | Hs.265829 | RAC1 | Hs.173737 |
| NBS1 | Hs.25812 | integrin cytoplasmic domain-associated protein 1 | Hs.173274 |
| CD120b = TNFRSF1B | Hs.256278 | IL2R | Hs.1724 |
| CDw75 | Hs.2554 | IL-1a | Hs.1722 |
| CD82 | Hs.25409 | | Hs.171872 |
| MCP-3 | Hs.251526 | | Hs.171118 |
| xanthine oxidase | Hs.250 | EST | Hs.171009 |
| Human Ig rearranged lambda-chain mRNA, subgroup VL3, V-J region, partial cds | Hs.247947 | EST | Hs.170934 |
| Eotaxin-2/MPIF-2 | Hs.247838 | EST | Hs.170587 |
| CTLA-4 | Hs.247824 | IL-9R | Hs.1702 |
| immunoglobulin kappa variable 1–9 | Hs.247792 | CD45 | Hs.170121 |
| CD68 | Hs.246381 | TGF-a | Hs.170009 |
| OSMR | Hs.238648 | CD44 | Hs.169610 |
| CDw127 | Hs.237868 | | Hs.169370 |
| transcription factor 8 (represses interleukin 2 expression) | Hs.232068 | MPIF-1 | Hs.169191 |
| CD8b | Hs.2299 | ICAM-1 | Hs.168383 |
| EST | Hs.229374 | IL-15 | Hs.168132 |
| TRF4-1 | Hs.225951 | STAT5A | Hs.167503 |
| CD3g | Hs.2259 | ESTs | Hs.167208 |
| C2 | Hs.2253 | ESTs | Hs.165693 |
| | Hs.116834 | | Hs.135750 |
| | Hs.117741 | DINB1 (POLK) | Hs.135756 |
| Human MHC Class I region proline rich protein mRNA, complete cds | Hs.118354 | Human DNA sequence from clone RP1-238O23 on chromosome 6. Contains part of the gene for a novel protein similar to PIGR (polymeric immunoglobulin receptor), part | Hs.136141 |

TABLE 2-continued

Candidate genes, Database mining
Unigene clusters are listed.
Cluster numbers are defined as in Unigene build #133 uploaded on: Fri Apr 20 2001

| | | of the gene for a novel protein similar to rat SAC (soluble adenylyl cyclase), ESTs, STSs and GSS | |
|---|---|---|---|
| ESTs, Weakly similar to FCE2 MOUSE LOW AFFINITY IMMUNOGLOBULIN EPSILON FC RECEPTOR [*M. musculus*] | Hs.118392 | | Hs.136254 |
| MKK6 | Hs.118825 | | Hs.13646 |
| | Hs.118895 | | Hs.136537 |
| *H. sapiens* mRNA for ITBA4 gene. | Hs.119018 | Histone H1 (F3) | Hs.136857 |
| | Hs.119057 | MGMT | Hs.1384 |
| TNFRSF10c | Hs.119684 | | Hs.138563 |
| | Hs.12064 | IgG | Hs.140 |
| | Hs.120907 | | Hs.140478 |
| acid phosphatase 5, tartrate resistant | Hs.1211 | | Hs.14070 |
| | Hs.121297 | | Hs.141153 |
| Human immunoglobulin (mAb59) light chain V region mRNA, partial sequence | Hs.121508 | | Hs.143954 |
| IL12Rb1 | Hs.121544 | ESTs, Moderately similar to I1BC_HUMAN INTERLEUKIN-1 BETA CONVERTASE PRECURSOR [*H. sapiens*] | Hs.144814 |
| Human MHC class II DO-alpha mRNA, partial cds | Hs.123041 | CHK2 (Rad53) | Hs.146329 |
| Histone H4 (H4F2) | Hs.123053 | EST | Hs.146591 |
| TSHR | Hs.123078 | | Hs.147040 |
| | Hs.123445 | CD42b | Hs.1472 |
| regulatory factor X, 1 (influences HLA class II expression) | Hs.123638 | | Hs.149235 |
| CD13 | Hs.1239 | AICD | Hs.149342 |
| IL-15R | Hs.12503 | *Homo sapiens* putative tumor suppressor protein (101F6) mRNA, complete cds. | Hs.149443 |
| RAD51L3 (RAD51D) | Hs.125244 | CD49e | Hs.149609 |
| CDw90 | Hs.125359 | heparan sulfate proteoglycan (HSPG) core protein | Hs.1501 |
| LYPLA1 | Hs.12540 | CD107a | Hs.150101 |
| ESTs, Weakly similar to AF201951 1 high affinity immunoglobulin epsilon receptor beta subunit [*H. sapiens*] | Hs.126580 | ESTs, Weakly similar to 157587 MHC HLA SX-alpha [*H. sapiens*] | Hs.150175 |
| | Hs.127128 | ALK2 | Hs.150402 |
| | Hs.127444 | WRN | Hs.150477 |
| C5 | Hs.1281 | EST | Hs.150708 |
| C8G | Hs.1285 | XRCC4 | Hs.150930 |
| RAD54B | Hs.128501 | IFN-a | Hs.1510 |
| | Hs.129020 | MAPK | Hs.151051 |
| | Hs.129268 | | Hs.15200 |
| | Hs.129332 | immunoglobulin mu binding protein 2 | Hs.1521 |
| XRCC2 | Hs.129727 | 4-1BBL | Hs.1524 |
| potassium voltage-gated channel, Shaw-related subfamily, member 3 (KCNC3) | Hs.129738 | | Hs.152818 |
| interleukin 17 receptor | Hs.129751 | HUS1 | Hs.152983 |
| CD134 | Hs.129780 | SWAP70 | Hs.153026 |
| TNFRSF10d | Hs.129844 | DOM-3 (*C. elegans*) homolog Z | Hs.153299 |
| POLL | Hs.129903 | | Hs.153551 |
| GADD153 = growth arrest and DNA-damage inducible gene/fus-chop fusion protein | Hs.129913 | | Hs.15370 |
| solute carrier family 5 (neutral amino acid transporters, system A), member 4 | Hs.130101 | SMAD6 | Hs.153863 |
| | Hs.130232 | APEXL2 | Hs.154149 |
| | Hs.13034 | | Hs.154198 |
| CD30L | Hs.1313 | | Hs.154366 |
| SCYA26 (CCL26) | Hs.131342 | BCL6 | Hs.155024 |
| CD30 | Hs.1314 | | Hs.155150 |
| | Hs.131885 | | Hs.155402 |
| | Hs.131887 | RAIDD | Hs.155566 |
| | Hs.13256 | POLH | Hs.155573 |
| ESTs | Hs.132775 | | Hs.15589 |
| *Homo sapiens* (clone 3.8-1) MHC class I mRNA fragment | Hs.132807 | *Homo sapiens* mRNA for KIAA0695 protein complete cds. | Hs.155976 |
| | Hs.13288 | SNM1 (P502) | Hs.1560 |
| | Hs.132943 | Topo2A | Hs.156346 |
| EST | Hs.133261 | ESTs, Highly similar to MHC class II antigen [*H. sapiens*] | Hs.156811 |
| | Hs.133388 | Histamine H1 receptor | Hs.1570 |
| EST | Hs.133393 | | Hs.157118 |
| EST | Hs.133930 | | Hs.157267 |
| ESTs | Hs.133947 | EST | Hs.157279 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| ESTs | Hs.133949 | EST | Hs.157280 |
| EST | Hs.134017 | EST | Hs.157308 |
| EST | Hs.134018 | EST | Hs.157309 |
| EST | Hs.134590 | EST | Hs.157310 |
| | Hs.135135 | EST | Hs.157311 |
| immunoglobulin superfamily, member 6 | Hs.135194 | ESTs | Hs.157344 |
| | Hs.135570 | ret finger protein-like 2 | Hs.157427 |
| *Homo sapiens* arrestin, beta 2 (ARRB2) mRNA. | Hs.18142 | | Hs.214956 |
| myeloperoxidase | Hs.1817 | WASP | Hs.2157 |
| APO-1 | Hs.182359 | CD88 | Hs.2161 |
| TRAP1 | Hs.182366 | | Hs.21618 |
| | Hs.182594 | ring finger protein 5 | Hs.216354 |
| TNFRSF16 | Hs.1827 | class II cytokine receptor ZCYTOR7 | Hs.21814 |
| | Hs.182817 | | Hs.219149 |
| regulatory factor X, 4 (influences HLA class II expression) | Hs.183009 | cyclophilin-related protein | Hs.219153 |
| *Homo sapiens* killer cell lectin-like receptor F1 (KLRF1), mRNA. | Hs.183125 | *Homo sapiens* mannosyl (alpha-1,6-)-glycoprotein beta-1,2-N-acetylglucosaminyltransferase (MGAT2) mRNA. | Hs.219479 |
| | Hs.183171 | perforin | Hs.2200 |
| EST | Hs.183386 | | Hs.220154 |
| | Hs.183656 | ESTs, Weakly similar to FCE2 MOUSE LOW AFFINITY IMMUNOGLOBULIN EPSILON FC RECEPTOR [*M. musculus*] | Hs.220649 |
| | Hs.18368 | | Hs.220868 |
| advanced glycosylation end product-specific receptor | Hs.184 | | Hs.220960 |
| CDK7 | Hs.184298 | immunoglobulin superfamily, member 1 | Hs.22111 |
| | Hs.184376 | | Hs.221539 |
| CCR4 | Hs.184926 | ESTs | Hs.221694 |
| EST, Weakly similar to A27307 proline-rich phosphoprotein [*H. sapiens*] | Hs.185463 | | Hs.222921 |
| EST | Hs.185498 | | Hs.222942 |
| EST, Weakly similar to B39066 proline-rich protein 15 - rat [*R. norvegicus*] | Hs.186243 | EST | Hs.223520 |
| EST, Weakly similar to salivary proline-rich protein [*R. norvegicus*] | Hs.186265 | EST | Hs.223935 |
| EST | Hs.187200 | EST, Moderately similar to SMO_HUMAN SMOOTHENED HOMOLOG PRECURSOR [*H. sapiens*] | Hs.224178 |
| | Hs.188048 | Blk | Hs.2243 |
| EST | Hs.188075 | EST | Hs.224344 |
| EST | Hs.188194 | EST | Hs.224408 |
| EST | Hs.188300 | EST | Hs.224409 |
| | Hs.190251 | CPN1 | Hs.2246 |
| | Hs.19056 | MMP7 | Hs.2256 |
| EST | Hs.190831 | MMP10 | Hs.2258 |
| MAPK8 | Hs.190913 | CCR9 | Hs.225946 |
| EST | Hs.190921 | toll-like receptor 6 (TLR6) | Hs.227105 |
| EST, Weakly similar to S39206 hypothetical protein 1 - rat□ [*R. norvegicus*] | Hs.190924 | XPR1 | Hs.227656 |
| GTF2H2 | Hs.191356 | CD49f | Hs.227730 |
| | Hs.191367 | | Hs.22790 |
| | Hs.191914 | EST | Hs.228337 |
| ESTs, Weakly similar to immunoglobulin superfamily member [*D. melanogaster*] | Hs.192078 | EST, Highly similar to 1409218A elastase [*H. sapiens*] | Hs.228525 |
| XPA | Hs.192803 | EST | Hs.228528 |
| CD89 | Hs.193122 | EST, Moderately similar to R37A_HUMAN 60S RIBOSOMAL PROTEIN L37A□ [*H. sapiens*] | Hs.228874 |
| DFFRY | Hs.193145 | EST | Hs.228891 |
| CD35 | Hs.193716 | EST | Hs.228926 |
| REV7 (MAD2L2) | Hs.19400 | EST | Hs.229071 |
| | Hs.194082 | EST | Hs.229405 |
| | Hs.194110 | EST | Hs.229494 |
| BRCA1 | Hs.194143 | EST, Weakly similar to ALU1_HUMAN ALU SUBFAMILY J SEQUENCE CONTAMINATION WARNING ENTRY□ [*H. sapiens*] | Hs.229560 |
| ESTs, Moderately similar to MHC Class I region proline rich protein [*H. sapiens*] | Hs.194249 | EST, Moderately similar to AAD18086 BAT2 [*H. sapiens*] | Hs.229901 |
| | Hs.194534 | EST | Hs.229902 |
| Topo3B | Hs.194685 | EST, Highly similar to 1409218A elastase | Hs.230053 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| Human DNA sequence from clone 1170K4 on chromosome 22q12.2–13.1. Contains three novel genes, one of which codes for a Trypsin family protein with class A LDL receptor domains, and the IL2RB gene for Interleukin 2 Receptor, Beta (IL-2 Receptor, CD122 antigen). Contains a putative CpG island, ESTs, and GSSs | Hs.194750 | [*H. sapiens*] RAD51 | Hs.23044 |
| major histocompatibility complex, class II, DP alpha 2 (pseudogene) | Hs.194764 | EST, Moderately similar to A54746 adhalin precursor - human☐ [*H. sapiens*] | Hs.230485 |
| Human DNA sequence from clone RP11-367J7 on chromosome 1. Contains (part of) two or more genes for novel Immunoglobulin domains containing proteins, a SON DNA binding protein (SON) pseudogene, a voltage-dependent anion channel 1 (VDAC1) (plasmalemmal porin) pseudogene, ESTs, STSs and GSSs | Hs.194976 | EST | Hs.230691 |
| | Hs.195447 | EST | Hs.230775 |
| PDGF-B | Hs.1976 | EST | Hs.230805 |
| CXCR3 | Hs.198252 | EST | Hs.230848 |
| | Hs.198694 | EST | Hs.230862 |
| | Hs.198738 | EST | Hs.230874 |
| MAR/SAR DNA binding protein (SATB1) | Hs.198822 | EST | Hs.230931 |
| CHUK | Hs.198998 | EST | Hs.231031 |
| hemochromatosis | Hs.20019 | EST | Hs.231261 |
| T-cell receptor active beta-chain | Hs.2003 | EST | Hs.231284 |
| APO-1 | Hs.2007 | EST | Hs.231285 |
| RXRA | Hs.20084 | EST | Hs.231292 |
| EST | Hs.200876 | EST, Weakly similar to putative mitochondrial outer membrane protein import receptor [*H. sapiens*] | Hs.231512 |
| | Hs.201194 | *Homo sapiens* mRNA for KIAA0529 protein, partial cds. | Hs.23168 |
| TCRd | Hs.2014 | EST | Hs.235042 |
| ESTs, Highly similar to TNF-alpha converting enzyme [*H. sapiens*] | Hs.202407 | EST | Hs.235826 |
| | Hs.202608 | TREX1 (Dnase III) | Hs.23595 |
| Integrin b1 = CD29 | Hs.202661 | EST | Hs.237126 |
| thrombomodulin | Hs.2030 | | Hs.23860 |
| | Hs.203064 | RAD9 | Hs.240457 |
| | Hs.203184 | 1-acylglycerol-3-phosphate O-acyltransferase 1 (lysophosphatidic acid acyltransferase, alpha) | Hs.240534 |
| | Hs.203584 | EST | Hs.240635 |
| EST | Hs.204477 | EST, Weakly similar to ALU8_HUMAN ALU SUBFAMILY SX SEQUENCE CONTAMINATION WARNING ENTRY☐ [*H. sapiens*] | Hs.241136 |
| EST | Hs.204480 | TNFSF15 | Hs.241382 |
| EST, Weakly similar to CA13_HUMAN COLLAGEN ALPHA 1(III) CHAIN PRECURSOR☐ [*H. sapiens*] | Hs.204483 | interleukin 1 receptor accessory protein-like 1 | Hs.241385 |
| ESTs | Hs.204588 | RANTES | Hs.241392 |
| EST, Weakly similar to salivary proline-rich protein 1 [*H. sapiens*] | Hs.204598 | sema domain, immunoglobulin domain (Ig), short basic domain, secreted, (semaphorin) 3A | Hs.2414 |
| EST | Hs.204610 | POLQ | Hs.241517 |
| ESTs | Hs.204703 | TNF-a | Hs.241570 |
| ESTs | Hs.204751 | *Homo sapiens* genes encoding RNCC protein, DDAH protein, Ly6-C protein, Ly6-D protein and immunoglobulin receptor | Hs.241586 |
| EST | Hs.204760 | megakaryocyte-enhanced gene transcript 1 protein | Hs.241587 |
| EST | Hs.204771 | EST, Moderately similar to 1409218A elastase [*H. sapiens*] | Hs.241981 |
| ESTs | Hs.204873 | EST | Hs.241982 |
| ESTs | Hs.204932 | EST | Hs.241983 |
| EST | Hs.204954 | EST | Hs.242605 |
| EST | Hs.205158 | ADPRT2 | Hs.24284 |
| ESTs | Hs.205159 | EST | Hs.243284 |
| ESTs | Hs.205327 | EST | Hs.243286 |
| CD39 | Hs.205353 | ESTs | Hs.243288 |
| ESTs | Hs.205435 | SCYB14 | Hs.24395 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| EST | Hs.205438 | EST | Hs.244046 |
| EST, Highly similar to elastic titin [*H. sapiens*] | Hs.205452 | EST | Hs.244048 |
| EST | Hs.205456 | EST | Hs.244049 |
| MRE11A | Hs.20555 | EST | Hs.244050 |
| HLA class II region expressed gene KE2 | Hs.205736 | RFXAP | Hs.24422 |
| EST | Hs.205788 | | Hs.24435 |
| ESTs | Hs.205789 | STAT5B | Hs.244613 |
| EST | Hs.205803 | EST | Hs.244666 |
| EST | Hs.205815 | EST | Hs.245586 |
| ESTs | Hs.206160 | CDw108 | Hs.24640 |
| | Hs.206654 | ESTs | Hs.246796 |
| EST | Hs.207060 | dimethylarginine dimethylaminohydrolase 2 | Hs.247362 |
| EST | Hs.207062 | *Homo sapiens* clone mcg53–54 immunoglobulin lambda light chain variable region 4a mRNA, partial cds | Hs.247721 |
| EST | Hs.207063 | *Homo sapiens* ELK1 pseudogene (ELK2) and immunoglobulin heavy chain gamma pseudogene (IGHGP) | Hs.247775 |
| EST | Hs.207473 | immunoglobulin kappa variable 1/OR2-108 | Hs.247804 |
| ESTs | Hs.207474 | butyrophilin-like 2 (MHC class II associated) | Hs.247808 |
| ESTs | Hs.207971 | *Homo sapiens* genes encoding RNCC protein, DDAH protein, Ly6-C protein, Ly6-D protein and immunoglobulin receptor | Hs.247879 |
| EST | Hs.207993 | Histamine H2 receptor | Hs.247885 |
| EST | Hs.208153 | Human anti-streptococcal/anti-myosin immunoglobulin lambda light chain variable region mRNA, partial cds | Hs.247898 |
| EST, Weakly similar to S10889 proline-rich protein - human□ [*H. sapiens*] | Hs.208667 | *Homo sapiens* isolate donor Z clone Z55K immunoglobulin kappa light chain variable region mRNA, partial cds | Hs.247907 |
| ESTs | Hs.209142 | *Homo sapiens* isolate donor D clone D103L immunoglobulin lambda light chain variable region mRNA, partial cds | Hs.247908 |
| EST | Hs.209261 | *Homo sapiens* isolate 459 immunoglobulin lambda light chain variable region (IGL) gene, partial cds | Hs.247909 |
| ESTs | Hs.209306 | *Homo sapiens* isolate donor N clone N88K immunoglobulin kappa light chain variable region mRNA, partial cds | Hs.247910 |
| | Hs.209362 | *Homo sapiens* isolate donor N clone N8K immunoglobulin kappa light chain variable region mRNA, partial cds | Hs.247911 |
| EST, Weakly similar to FCEB MOUSE HIGH AFFINITY IMMUNOGLOBULIN EPSILON RECEPTOR BETA-SUBUNIT [*M. musculus*] | Hs.209540 | Human Ig rearranged mu-chain V-region gene, subgroup VH-III, exon 1 and 2 | Hs.247923 |
| EST | Hs.209913 | Epsilon, IgE = membrane-bound IgE, epsilon m/s isoform {alternative splicing} [human, mRNA Partial, 216 nt] | Hs.247930 |
| EST | Hs.209989 | *H. sapiens* (T1.1) mRNA for IG lambda light chain | Hs.247949 |
| EST | Hs.210049 | *H. sapiens* mRNA for Ig light chain, variable region (ID:CLL001VL) | Hs.247950 |
| EST, Moderately similar to probable sodium potassium ATPase gamma chain [*H. sapiens*] | Hs.210276 | Human interleukin 2 gene, clone pATtacIL-2C/2TT, complete cds, clone pATtacIL-2C/2TT | Hs.247956 |
| EST, Weakly similar to N-WASP [*H. sapiens*] | Hs.210306 | pre-B lymphocyte gene 1 | Hs.247979 |
| EST | Hs.210307 | Human immunoglobulin heavy chain variable region (V4-31) gene, partial cds | Hs.247987 |
| EST | Hs.210385 | Human immunoglobulin heavy chain variable region (V4-30.2) gene, partial cds | Hs.247989 |
| interleukin 21 receptor | Hs.210546 | Human DNA sequence from phage LAW2 from a contig from the tip of the short arm of chromosome 16, spanning 2Mb of 16p13.3 Contains Interleukin 9 receptor pseudogene | Hs.247991 |
| EST | Hs.210727 | *Homo sapiens* HLA class III region containing NOTCH4 gene, partial sequence, homeobox PBX2 (HPBX) gene, receptor for advanced glycosylation end products (RAGE) gene, complete cds, and 6 unidentified cds | Hs.247993 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| | Hs.211266 | *Homo sapiens* immunoglobulin lambda gene locus DNA, clone: 61D6 | Hs.248010 |
| SMAD3 | Hs.211578 | immunoglobulin lambda variable 9–49 | Hs.248011 |
| MHC class I polypeptide-related sequence B | Hs.211580 | immunoglobulin lambda variable 4–3 | Hs.248012 |
| ESTs, Weakly similar to CA1B_MOUSE COLLAGEN ALPHA 1(XI) CHAIN PRECURSOR□ [*M. musculus*] | Hs.211744 | *H. sapiens* mRNA for IgG lambda light chain V-J-C region (clone Tgl11) | Hs.248030 |
| sema domain, immunoglobulin domain (Ig), short basic domain, secreted, (semaphorin) 3E | Hs.212414 | Human immunoglobulin (mAb56) light chain V region mRNA, partial sequence | Hs.248043 |
| TNFRSF18 | Hs.212680 | *Homo sapiens* lymphocyte-predominant Hodgkin's disease case #4 immunoglobulin heavy chain gene, variable region, partial cds | Hs.248077 |
| *Homo sapiens* general transcription factor 2-I pseudogene 1 (GTF2IP1) mRNA. | Hs.212939 | *Homo sapiens* lymphocyte-predominant Hodgkin's disease case #7 immunoglobulin heavy chain gene, variable region, partial cds | Hs.248078 |
| RAD 18 | Hs.21320 | *Homo sapiens* clone ASMneg1-b3 immunoglobulin lambda chain VJ region, (IGL) mRNA, partial cds | Hs.248083 |
| | Hs.213226 | OSM | Hs.248156 |
| ESTs | Hs.279090 | | Hs.29128 |
| ESTs | Hs.279091 | *Homo sapiens* clone 24659 mRNA sequence. | Hs.29206 |
| ESTs | Hs.279092 | EST | Hs.292235 |
| EST | Hs.279093 | EST | Hs.292450 |
| ESTs | Hs.279094 | EST, Moderately similar to Ewing sarcoma breakpoint region 1, isoform EWS [*H. sapiens*] | Hs.292455 |
| ESTs | Hs.279095 | EST | Hs.292461 |
| ESTs, Weakly similar to AF279265_1 putative anion transporter 1 [*H. sapiens*] | Hs.279096 | ESTs | Hs.292501 |
| ESTs | Hs.279097 | EST | Hs.292516 |
| EST | Hs.279098 | EST | Hs.292517 |
| ESTs | Hs.279099 | EST | Hs.292520 |
| ESTs | Hs.279100 | EST, Moderately similar to RL13_HUMAN 60S RIBOSOMAL PROTEIN L13 [*H. sapiens*] | Hs.292540 |
| ESTs | Hs.279101 | EST | Hs.292545 |
| ESTs | Hs.279102 | EST, Weakly similar to ORFII [*H. sapiens*] | Hs.292704 |
| ESTs | Hs.279103 | EST | Hs.292761 |
| ESTs | Hs.279104 | ESTs | Hs.292803 |
| ESTs | Hs.279105 | ESTs | Hs.293183 |
| ESTs | Hs.279106 | ESTs | Hs.293280 |
| EST | Hs.279107 | ESTs | Hs.293281 |
| ESTs | Hs.279108 | ESTs, Moderately similar to 0501254A protein Tro alpha1 H,myeloma [*H. sapiens*] | Hs.293441 |
| EST | Hs.279109 | MMP13 | Hs.2936 |
| ESTs | Hs.279110 | major histocompatibility complex, class II, DR beta 4 | Hs.293934 |
| ESTs | Hs.279111 | Human MHC class III serum complement factor B, mRNA | Hs.294163 |
| ESTs | Hs.279112 | EST | Hs.294315 |
| EST | Hs.279113 | EST | Hs.294316 |
| ESTs | Hs.279114 | EST, Highly similar to Y196_HUMAN HYPOTHETICAL PROTEIN KIAA0196□ [*H. sapiens*] | Hs.295582 |
| ESTs | Hs.279115 | EST | Hs.295583 |
| ESTs | Hs.279116 | EST, Highly similar to ZN07_HUMAN ZINC FINGER PROTEIN 7 [*H. sapiens*] | Hs.295584 |
| ESTs | Hs.279117 | EST | Hs.295585 |
| ESTs | Hs.279118 | EST | Hs.295586 |
| ESTs | Hs.279119 | EST, Moderately similar to angiotensin converting enzyme [*H. sapiens*] | Hs.295595 |
| ESTs | Hs.279120 | EST | Hs.295621 |
| ESTs | Hs.279121 | EST | Hs.295622 |
| ESTs | Hs.279122 | EST, Moderately similar to RL13_HUMAN 60S RIBOSOMAL PROTEIN L13 [*H. sapiens*] | Hs.295629 |
| ESTs | Hs.279123 | EST | Hs.295724 |
| ESTs | Hs.279124 | EST | Hs.296064 |
| ESTs | Hs.279125 | EST, Moderately similar to IDS_HUMAN IDURONATE 2-SULFATASE PRECURSOR□ [*H. sapiens*] | Hs.296070 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| ESTs | Hs.279126 | EST | Hs.296073 |
| ESTs | Hs.279127 | interleukin enhancer binding factor 1 | Hs.296281 |
| EST | Hs.279128 | similar to rat integral membrane glycoprotein POM121 | Hs.296429 |
| ESTs, Weakly similar to aconitase [*H. sapiens*] | Hs.279129 | Human histocompatibility antigen mrna clone phla-1 | Hs.296476 |
| ESTs | Hs.279130 | immunoglobulin lambda-like polypeptide 3 | Hs.296552 |
| ESTs | Hs.279131 | RFXANK | Hs.296776 |
| ESTs | Hs.279132 | | Hs.29826 |
| ESTs | Hs.279133 | | Hs.29871 |
| ESTs, Weakly similar to PYRG_HUMAN CTP SYNTHASE [*H. sapiens*] | Hs.279134 | MEKK1 | Hs.298727 |
| ESTs, Weakly similar to RIR1_HUMAN RIBONUCLEOSIDE-DIPHOSPHATE REDUCTASE M1 CHAIN [*H. sapiens*] | Hs.279135 | | Hs.30029 |
| ESTs | Hs.279136 | CD3e | Hs.3003 |
| ESTs | Hs.279137 | ESTs, Weakly similar to CA13_HUMAN COLLAGEN ALPHA 1(III) CHAIN PRECURSOR [*H. sapiens*] | Hs.300697 |
| ESTs | Hs.279138 | *Homo sapiens* clone BCSynL38 immunoglobulin lambda light chain variable region mRNA, partial cds | Hs.300865 |
| ESTs | Hs.279139 | FCGR3A | Hs.300983 |
| ESTs | Hs.279140 | *Homo sapiens* DP47 gene for immunoglobulin heavy chain, partial cds | Hs.301365 |
| ESTs | Hs.279141 | PMS2L9 | Hs.301862 |
| EST | Hs.279142 | CCR1 | Hs.301921 |
| ESTs | Hs.279143 | FANCE | Hs.302003 |
| ESTs | Hs.279144 | interleukin 21 | Hs.302014 |
| ESTs | Hs.279145 | interleukin 17E | Hs.302036 |
| ESTs | Hs.279146 | | Hs.30446 |
| EST | Hs.279147 | EST | Hs.30709 |
| ESTs | Hs.279148 | EST | Hs.30731 |
| ESTs | Hs.279149 | MHC class II transactivator | Hs.3076 |
| ESTs | Hs.279150 | EST | Hs.30766 |
| ESTs, Weakly similar to PUR2_HUMAN TRIFUNCTIONAL PURINE BIOSYNTHETIC PROTEIN ADENOSINE 3 [*H. sapiens*] | Hs.279151 | EST | Hs.30793 |
| ESTs | Hs.279152 | | Hs.30818 |
| ESTs | Hs.279153 | CD97 | Hs.3107 |
| ESTs | Hs.279154 | RAR-beta2 | Hs.31408 |
| ESTs | Hs.279155 | RECQL4 | Hs.31442 |
| ESTs | Hs.279156 | XPC | Hs.320 |
| ESTs | Hs.279157 | ERK2 | Hs.324473 |
| ESTs | Hs.279158 | | Hs.32456 |
| ESTs | Hs.279159 | MSH6 | Hs.3248 |
| ESTs | Hs.279160 | ribosomal protein L23-related | Hs.3254 |
| ESTs, Weakly similar to IDHA_HUMAN ISOCITRATE DEHYDROGENASE [*H. sapiens*] | Hs.279161 | PI3CG | Hs.32942 |
| ESTs | Hs.279162 | CSA (CKN1) | Hs.32967 |
| ESTs | Hs.279163 | sema domain, immunoglobulin domain (Ig), short basic domain, secreted, (semaphorin) 3F | Hs.32981 |
| ESTs | Hs.279164 | BRCA2 | Hs.34012 |
| ESTs | Hs.279165 | MEK1 | Hs.3446 |
| ESTs | Hs.279166 | STRL33 (CXCR6) | Hs.34526 |
| ESTs | Hs.279167 | MBD4 | Hs.35947 |
| ESTs | Hs.279168 | immunoglobulin (CD79A) binding protein 1 | Hs.3631 |
| EST | Hs.279169 | CD7 | Hs.36972 |
| ESTs | Hs.279170 | IFNA1 | Hs.37026 |
| ESTs | Hs.279171 | PDGF-A | Hs.37040 |
| EST | Hs.279172 | immunoglobulin kappa variable 1–13 | Hs.37089 |
| ESTs | Hs.279174 | DMC1 | Hs.37181 |
| ESTs | Hs.279175 | | Hs.37892 |
| CD86 | Hs.27954 | *Homo sapiens* suppressor of variegation 3–9 (Drosophila) homolog (SUV39H) mRNA, and translated products. | Hs.37936 |
| CGI-81 protein | Hs.279583 | C8B | Hs.38069 |
| ESTs | Hs.279821 | MTH1 (NUDT1) | Hs.388 |
| ESTs | Hs.279823 | Adrenomedullin | Hs.394 |
| ESTs, Weakly similar to IRE1_HUMAN IRON-RESPONSIVE ELEMENT BINDING PROTEIN 1 [*H. sapiens*] | Hs.279824 | | Hs.39441 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| ESTs | Hs.279825 | CD66b | Hs.41 |
| ESTs | Hs.279826 | RAD50 | Hs.41587 |
| MLH3 | Hs.279843 | CD94 | Hs.41682 |
| TNFRSF14 | Hs.279899 | HLJ1 | Hs.41693 |
| RPA4 | Hs.283018 | ESM1 | Hs.41716 |
| EST | Hs.283165 | MSH3 | Hs.42674 |
| EST | Hs.283166 | cAMP responsive element binding protein-like 1 | Hs.42853 |
| EST | Hs.283167 | IKBKG | Hs.43505 |
| EST | Hs.283168 | *Homo sapiens* suppressor of white apricot homolog 2 (SWAP2), mRNA. | Hs.43543 |
| ESTs | Hs.283169 | LEU2 | Hs.43628 |
| EST | Hs.283245 | *Homo sapiens* immunoglobulin lambda gene locus DNA, clone:288A10 | Hs.43834 |
| EST | Hs.283247 | SIRT2 | Hs.44017 |
| ESTs | Hs.283248 | | Hs.44087 |
| EST | Hs.283249 | TREM2 | Hs.44234 |
| EST | Hs.283250 | serine/threonine kinase 19 | Hs.444 |
| EST | Hs.283251 | | Hs.44512 |
| EST | Hs.283252 | | Hs.44628 |
| EST | Hs.283253 | | Hs.45063 |
| EST | Hs.283254 | LTC4 synthase | Hs.456 |
| EST | Hs.283255 | FUT2 | Hs.46328 |
| EST | Hs.283256 | CCR6 | Hs.46468 |
| EST | Hs.283257 | POLM | Hs.46964 |
| EST | Hs.283258 | EXO1 (HEX1) | Hs.47504 |
| ESTs | Hs.283259 | FEN1 (Dnase IV) | Hs.4756 |
| EST | Hs.283261 | | Hs.4863 |
| EST | Hs.283262 | golgin-165 | Hs.4953 |
| EST | Hs.283263 | | Hs.50102 |
| EST | Hs.283264 | ATP-binding cassette, sub-family B (MDR/TAP), member 3 | Hs.502 |
| EST | Hs.283266 | | Hs.5057 |
| ESTs | Hs.283268 | corneodesmosin | Hs.507 |
| EST | Hs.283269 | Histone H2 (H2AFP) | Hs.51011 |
| EST, Weakly similar to AF189011_1 ribonuclease III [*H. sapiens*] | Hs.283270 | CCNH | Hs.514 |
| EST | Hs.283271 | EST | Hs.5146 |
| EST | Hs.283272 | SMUG1 | Hs.5212 |
| EST | Hs.283274 | ABH (ALKB) | Hs.54418 |
| EST | Hs.283275 | CCR5 | Hs.54443 |
| EST | Hs.283276 | CD81 | Hs.54457 |
| ESTs, Weakly similar to S32605 collagen alpha 3(VI) chain - mouse [*M. musculus*] | Hs.283392 | TNFSF13 | Hs.54673 |
| ESTs | Hs.283433 | PRPS1 | Hs.56 |
| ESTs | Hs.283434 | | Hs.56156 |
| ESTs | Hs.283438 | | Hs.56265 |
| ESTs | Hs.283442 | killer cell immunoglobulin-like receptor, three domains, long cytoplasmic tail, 2 | Hs.56328 |
| ESTs | Hs.283443 | EST | Hs.5656 |
| ESTs | Hs.283456 | | Hs.56845 |
| ESTs | Hs.283457 | MLH1 | Hs.57301 |
| ESTs, Weakly similar to similar to collagen [*C. elegans*] | Hs.283458 | testis specific basic protein | Hs.57692 |
| ESTs | Hs.283459 | ESTs | Hs.57841 |
| ESTs | Hs.283460 | Human 6Ckine | Hs.57907 |
| ESTs | Hs.283462 | EST | Hs.5816 |
| ESTs | Hs.283463 | *Homo sapiens* cell growth regulatory with ring finger domain (CGR19) mRNA. | Hs.59106 |
| ESTs | Hs.283496 | ERCC1 | Hs.59544 |
| ESTs | Hs.283497 | | Hs.61558 |
| ESTs | Hs.283499 | *Homo sapiens* GPI transamidase mRNA, complete cds. | Hs.62187 |
| ESTs | Hs.283500 | | Hs.62699 |
| ESTs, Weakly similar to ORF YDL014w [*S. cerevisiae*] | Hs.283504 | | Hs.63913 |
| ESTs, Weakly similar to S09646 collagen alpha 2(VI) chain precursor, medium splice form - human□ [*H. sapiens*] | Hs.283505 | *Homo sapiens* chloride intracellular channel 3 (CLIC3), mRNA. | Hs.64746 |
| ESTs | Hs.283608 | FANCF | Hs.65328 |
| CD42c | Hs.283743 | | Hs.6544 |
| tenascin XA | Hs.283750 | interleukin 1 receptor-like 1 | Hs.66 |
| immunoglobulin kappa variable 1D-8 | Hs.283770 | CD38 | Hs.66052 |
| protocadherin gamma subfamily A, 2 (PCDHGA2) | Hs.283801 | | Hs.6607 |

TABLE 2-continued

Candidate genes, Database mining
Unigene clusters are listed.
Cluster numbers are defined as in Unigene build #133 uploaded on: Fri Apr 20 2001

| | | | |
|---|---|---|---|
| *Homo sapiens* mRNA; cDNA DKFZp762F0616 (from clone DKFZp762F0616) | Hs.283849 | RAD54L | Hs.66718 |
| *Homo sapiens* clone bsmneg3-t7 immunoglobulin lambda light chain VJ region, (IGL) mRNA, partial cds | Hs.283876 | SCYA17 (CCL17) | Hs.66742 |
| *Homo sapiens* transgenic-JHD mouse #2357 immunoglobulin heavy chain variable region (IgG VH251) mRNA, partial cds | Hs.283878 | IL-12 | Hs.673 |
| *Homo sapiens* clone N97 immunoglobulin heavy chain variable region mRNA, partial cds | Hs.283882 | Human IL-12 p40 | Hs.674 |
| *Homo sapiens* clone case06H1 immunoglobulin heavy chain variable region gene, partial cds | Hs.283924 | LILRB4 | Hs.67846 |
| *Homo sapiens* HSPC077 mRNA, partial cds | Hs.283929 | interleukin 5 receptor, alpha | Hs.68876 |
| *Homo sapiens* HSPC088 mRNA, partial cds | Hs.283931 | | Hs.6891 |
| *Homo sapiens* HSPC097 mRNA, partial cds | Hs.283933 | | Hs.69233 |
| *Homo sapiens* HSPC102 mRNA, partial cds | Hs.283934 | FUT1 | Hs.69747 |
| *Homo sapiens* HSPC107 mRNA, partial cds | Hs.283935 | B-factor, properdin | Hs.69771 |
| CMKRL1 | Hs.28408 | | Hs.70333 |
| FANCA | Hs.284153 | | Hs.71618 |
| *Homo sapiens* immunoglobulin mu chain antibody MO30 (IgM) mRNA, complete cds | Hs.284277 | RAD1 | Hs.7179 |
| gamma-glutamyltransferase 1 | Hs.284380 | interleukin 19 | Hs.71979 |
| putative human HLA class II associated protein I | Hs.285013 | MEK2 | Hs.72241 |
| interleukin 13 receptor, alpha 1 | Hs.285115 | IL-7 | Hs.72927 |
| CDw131 | Hs.285401 | STAT2 | Hs.72988 |
| *Homo sapiens* VH2-D3.10-JH5b gene for immunoglobulin heavy chain variable region | Hs.287403 | CD42d | Hs.73734 |
| *Homo sapiens* cDNA: FLJ22546 fis, clone HSI00290 | Hs.287697 | MIF | Hs.73798 |
| *Homo sapiens* cDNA: FLJ23140 fis, clone LNG09065 | Hs.287728 | ECP | Hs.73839 |
| *H. sapiens* mRNA for HLA-C alpha chain (Cw*1701) | Hs.287811 | CPN2 | Hs.73858 |
| *Homo sapiens* clone ASMneg1-b1 immunoglobulin lambda chain VJ region, (IGL) mRNA, partial cds | Hs.287815 | MMP8 | Hs.73862 |
| *Homo sapiens* clone CPRF1-T2 immunoglobulin lambda chain VJ region, (IGL) mRNA, partial cds | Hs.287816 | HLA-G histocompatibility antigen, class I, G | Hs.73885 |
| EST | Hs.287817 | TNFRSF9 | Hs.73895 |
| myelin protein zero-like 1 | Hs.287832 | IL-4 | Hs.73917 |
| immunoglobulin lambda-like polypeptide 1 | Hs.288168 | HLA-DQB1 | Hs.73931 |
| cathepsinB | Hs.288181 | RAG1 | Hs.73958 |
| G18.2 protein | Hs.288316 | LAG-3 | Hs.74011 |
| ESTs | Hs.288403 | | Hs.7402 |
| EST | Hs.288431 | CD163 | Hs.74076 |
| *Homo sapiens* partial IGVH2 gene for immunoglobulin heavy chain V region, case 2, cell B 45 | Hs.288553 | immunoglobulin superfamily, member 2 | Hs.74115 |
| polymeric immunoglobulin receptor | Hs.288579 | CD158b | Hs.74134 |
| Human immunoglobulin heavy chain variable region (V4-4) gene, partial cds | Hs.288711 | | Hs.7434 |
| Human immunoglobulin heavy chain variable region (V4-4b) gene, partial cds | Hs.289036 | TCRa | Hs.74647 |
| | Hs.28921 | human immunodeficiency virus type I enhancer-binding protein 2 | Hs.75063 |
| EST | Hs.289577 | MLN50 | Hs.75080 |
| EST | Hs.289836 | lysyl hydroxylase (PLOD) | Hs.75093 |
| EST | Hs.289878 | TAK1 | Hs.7510 |
| GSN | Hs.290070 | *Homo sapiens* transcription factor 6-like 1 (mitochondrial transcription factor 1-like) (TCF6L1) mRNA. | Hs.75133 |
| EST, Weakly similar to unnamed protein product [*H. sapiens*] | Hs.290133 | UBE2N (UBC13, BTG1) | HS.75355 |
| EST | Hs.290227 | | Hs.75450 |
| ESTs | Hs.290315 | HSPA2 | Hs.75452 |
| EST | Hs.290339 | CD151 | Hs.75564 |
| EST | Hs.290340 | RELA | Hs.75569 |
| | Hs.29055 | CD122 | Hs.75596 |

TABLE 2-continued

Candidate genes, Database mining
Unigene clusters are listed.
Cluster numbers are defined as in Unigene build #133 uploaded on: Fri Apr 20 2001

| | | | | |
|---|---|---|---|---|
| EST | | Hs.291125 | CD14-UZ | Hs.75627 |
| EST | | Hs.291126 | nuclear factor erythroid 2 isoform f = basic leucine zipper protein {alternatively spliced | Hs.75643 |
| CD91 = LRP | | Hs.89137 | C1QB | Hs.8986 |
| XPF (ERCC4) | | Hs.89296 | superkiller viralicidic activity 2 (*S. cerevisiae* homolog)-like | Hs.89864 |
| Carbonic anhydrase IV | | Hs.89485 | EST | Hs.90165 |
| CETP | | Hs.89538 | EST | Hs.90171 |
| RAD52 | | Hs.89571 | GTF2H3 | Hs.90304 |
| GTF2H1 | | Hs.89578 | protein tyrosine kinase related sequence | Hs.90314 |
| Fc fragment of IgE, high affinity I, receptor for; alpha polypeptide transcript ch138 | | Hs.897 | | Hs.90463 |
| | | Hs.94881 | SGRF protein, Interleukin 23 p19 subunit | Hs.98309 |
| | | Hs.9578 | XRCC1 | Hs.98493 |
| IL-9 | | Hs.960 | *Homo sapiens* mRNA for KIAA0543 protein, partial cds. | Hs.98507 |
| NFATC1 | | Hs.96149 | | Hs.9893 |
| OGG1 | | Hs.96398 | DIR1 protein | Hs.99134 |
| | | Hs.96499 | XRCC3 | Hs.99742 |
| NFKBIB | | Hs.9731 | Elastase(leukocyte) | Hs.99863 |
| XAB2 (HCNP) | | Hs.9822 | JAK3 | Hs.99877 |
| CD40 | | Hs.652 | | |

TABLE 3A

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 56D1 | 1521 | 1685 | D00022 | Hs.25 | 1.00E−84 | 1 | for F1 beta subunit, complete |
| 586E3 | 1227 | 1448 | NM_001686 | Hs.25 | 1.00E−89 | 1 | ATP synthase, H+ transporting, mitochondrial |
| 459F4 | 1484 | 2522 | NM_002832 | Hs.35 | 0 | 3 | protein tyrosine phosphatase, non-receptor t |
| 41A11 | 885 | 1128 | D12614 | Hs.36 | 1.00E−125 | 1 | lymphotoxin (TNF-beta), complete |
| 41G12 | 442 | 1149 | D10202 | Hs.46 | 0 | 1 | for platelet-activating factor receptor, |
| 98E12 | 1928 | 2652 | NM_002835 | Hs.62 | 0 | 1 | protein tyrosine phosphatase, non-receptor t |
| 170E1 | 473 | 1071 | U13044 | Hs.78 | 0 | 1 | nuclear respiratory factor-2 subunit alpha mRNA, com |
| 40C6 | 939 | 1357 | D11086 | Hs.84 | 0 | 1 | interleukin 2 receptor gamma chain |
| 521F9 | 283 | 1176 | NM_000206 | Hs.84 | 0 | 8 | interleukin 2 receptor, gamma (severe combined |
| 60A11 | 989 | 1399 | L08069 | Hs.94 | 0 | 2 | heat shock protein, *E. coli* DnaJ homologue complete cd |
| 520B9 | 545 | 1438 | NM_001539 | Hs.94 | 0 | 3 | heat shock protein, DNAJ-like 2 (HSJ2), mRNA/ |
| 460H9 | 626 | 1104 | NM_021127 | Hs.96 | 0 | 1 | phorbol-12-myristate-13-acetate-induced p |
| 127G12 | 651 | 1223 | NM_004906 | Hs.119 | 0 | 2 | Wilms' tumor 1-associating protein (KIAA0105 |
| 586A7 | 438 | 808 | NM_000971 | Hs.153 | 0 | 3 | ribosomal protein L7 (RPL7), mRNA/cds = (10,756 |
| 99H12 | 2447 | 4044 | NM_002600 | Hs.188 | 0 | 2 | phosphodiesterase 4B, cAMP-specific (dunce ( |
| 464D4 | 2317 | 2910 | NM_002344 | Hs.210 | 0 | 1 | leukocyte tyrosine kinase (LTK), mRNA/cds = (17 |
| 464B3 | 10 | 385 | NM_002515 | Hs.214 | 1.00E−164 | 1 | neuro-oncological ventral antigen 1 (NOVA1), |
| 40A12 | 296 | 1153 | L11695 | Hs.220 | 0 | 1 | activin receptor-like kinase (ALK-5) mRNA, complete |
| 129A2 | 4138 | 4413 | NM_000379 | Hs.250 | 1.00E−155 | 1 | xanthene dehydrogenase (XDH), mRNA |
| 36B10 | 80 | 1475 | AF068836 | Hs.270 | 0 | 3 | cytohesin binding protein HE mRNA, complete cd |
| 45C11 | 58 | 1759 | NM_004288 | Hs.270 | 0 | 2 | pleckstrin homology, Sec7 and coiled/coil dom |
| 128C12 | 2555 | 3215 | NM_000153 | Hs.273 | 0 | 4 | galactosylceramidase (Krabbe disease) (GALC) |
| 67H2 | 259 | 1418 | D23660 | Hs.286 | 0 | 8 | ribosomal protein, complete cds |
| 151E6 | 624 | 1170 | AF052124 | Hs.313 | 0 | 1 | clone 23810 osteopontin mRNA, complete cds/c |
| 45A7 | 4 | 262 | NM_000582 | Hs.313 | 1.00E−136 | 1 | secreted phosphoprotein 1 (osteopontin, bone |
| 44C10 | 2288 | 2737 | J03250 | Hs.317 | 0 | 1 | topoisomerase I mRNA, complete cds/ cds = (211,2508)/ |
| 99H9 | 2867 | 3246 | NM_001558 | Hs.327 | 0 | 2 | interleukin 10 receptor, alpha (IL10RA), mRNA |
| 41B4 | 2867 | 3315 | U00672 | Hs.327 | 0 | 6 | interleukin-10 receptor mRNA, complete |
| 144E1 | 283 | 989 | M26683 | Hs.340 | 0 | 36 | interferon gamma treatment inducible/cds = (14,1 |
| 41A12 | 1854 | 2590 | X53961 | Hs.347 | 0 | 1 | lactoferrin/cds = (294,2429)/gb = X53961/gi = |
| 40F1 | 1377 | 1734 | U95626 | Hs.395 | 0 | 1 | ccr2b (ccr2), ccr2a (ccr2), ccr5 (ccr5) and cc |
| 463H4 | 55 | 434 | NM_001459 | Hs.428 | 0 | 1 | fms-related tyrosine kinase 3 ligand (FLT3LG) |
| 127E1 | 552 | 1048 | NM_005180 | Hs.431 | 0 | 1 | murine leukemia viral (bmi-1) oncogene homolo |
| 73G12 | 189 | 1963 | NM_004024 | Hs.460 | 0 | 17 | activating transcription factor 3 (ATF3), ATF |
| 524A4 | 1361 | 2136 | NM_004168 | Hs.469 | 0 | 2 | succinate dehydrogenase complex, subunit A, |
| 41C7 | 1554 | 2097 | D10925 | Hs.516 | 0 | 1 | HM145/cds = (22,1089)/gb = D10925/gi = 219862 |
| 588A2 | 48 | 163 | NM_001032 | Hs.539 | 1.00E−59 | 1 | ribosomal protein S29 (RPS29), mRNA/cds = (30,2 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 177B4 | 1 | 1674 | AF076465 | Hs.550 | 2.00E−37 | 2 | PhLOP2 mRNA, complete cds/cds = (5,358)/gb = AF |
| 68G5 | 2 | 1454 | M26383 | Hs.624 | 0 | 17 | monocyte-derived neutrophil-activating protein (M |
| 45F10 | 1 | 1454 | NM_000584 | Hs.624 | 0 | 11 | interleukin 8 (IL8), mRNA/cds = (74,373)/gb = N |
| 59F11 | 59 | 1822 | X68550 | Hs.652 | 0 | 14 | TRAP mRNA for ligand of CD40/cds = (56,841)/gb = X6 |
| 471C9 | 3115 | 3776 | NM_000492 | Hs.663 | 0 | 1 | cystic fibrosis transmembrane conductance re |
| 68D1 | 228 | 866 | M20137 | Hs.694 | 0 | 3 | interleukin 3 (IL-3) mRNA, complete cds, clone pcD-SR |
| 49H3 | 42 | 665 | NM_000588 | Hs.694 | 0 | 1 | interleukin 3 (colony-stimulating factor, mu |
| 147H3 | 110 | 340 | BF690338 | Hs.695 | 1.00E−102 | 1 | 602186730T1 cDNA, 3' end/clone = IMAGE: 4299006 |
| 483E4 | 310 | 846 | NM_000942 | Hs.699 | 0 | 1 | peptidylprolyl isomerase B (cyclophilin B) ( |
| 522B12 | 349 | 755 | NM_000788 | Hs.709 | 0 | 2 | deoxycytidine kinase (DCK), mRNA/cds = (159,94 |
| 331E5 | 1293 | 1470 | J03634 | Hs.727 | 9.00E−75 | 1 | erythroid differentiation protein mRNA (EDF), comple |
| 514D12 | 1164 | 1579 | NM_004907 | Hs.737 | 1.00E−169 | 3 | immediate early protein (ETR101), mRNA/cds = ( |
| 73H7 | 1953 | 3017 | AJ243425 | Hs.738 | 0 | 8 | EGR1 gene for early growth response protein 1/ |
| 592A8 | 10 | 454 | NM_003973 | Hs.738 | 0 | 5 | ribosomal protein L14 (RPL14), mRNA |
| 519A1 | 116 | 1527 | NM_000801 | Hs.752 | 1.00E−163 | 2 | FK506-binding protein 1A (12 kD) (FKBP1A), mRN |
| 109H11 | 1 | 1206 | M60626 | Hs.753 | 0 | 10 | N-formylpeptide receptor (fMLP-R98) mRNA, complete |
| 99C5 | 1 | 1175 | NM_002029 | Hs.753 | 0 | 25 | formyl peptide receptor 1 (FPR1), mRNA |
| 103C1 | 2285 | 2890 | NM_002890 | Hs.758 | 0 | 1 | RAS p21 protein activator (GTPase activating p |
| 41H4 | 3142 | 3332 | NM_000419 | Hs.785 | 1.00E−84 | 1 | integrin, alpha 2b (platelet glycoprotein IIb |
| 171D2 | 198 | 748 | X54489 | Hs.789 | 1.00E−132 | 2 | melanoma growth stimulatory activity (MGSA) |
| 458H7 | 2165 | 2818 | NM_001656 | Hs.792 | 0 | 1 | ADP-ribosylation factor domain protein 1, 64 |
| 62B3 | 833 | 1241 | M60278 | Hs.799 | 0 | 2 | heparin-binding EGF-like growth factor mRNA, complet |
| 53G4 | 1299 | 2166 | AK001364 | Hs.808 | 0 | 6 | FLJ10502 fis, clone NT2RP2000414, highly |
| 597F3 | 1136 | 1797 | NM_004966 | Hs.808 | 0 | 2 | heterogeneous nuclear ribonucleoprotein F ( |
| 143F7 | 575 | 985 | M74525 | Hs.811 | 0 | 3 | HHR6B (yeast RAD 6 homologue) mRNA, complete |
| 518H8 | 580 | 974 | NM_003337 | Hs.811 | 0 | 1 | ubiquitin-conjugating enzyme E2B (RAD6 homol |
| 45G8 | 277 | 833 | NM_002121 | Hs.814 | 0 | 1 | major histocompatibility complex, class II, |
| 41H11 | 719 | 1534 | NM_005191 | Hs.838 | 0 | 1 | CD80 antigen (CD28 antigen ligand 1, B7-1 antig |
| 41G1 | 117 | 557 | U31120 | Hs.845 | 0 | 1 | interleukin-13 (IL-13) precursor gene, complete cds |
| 75E1 | 693 | 862 | J05272 | Hs.850 | 2.00E−58 | 4 | IMP dehydrogenase type 1 mRNA complete |
| 129B11 | 3361 | 3883 | L25851 | Hs.851 | 0 | 1 | integrin alpha E precursor, mRNA, complete cds |
| 481E9 | 3361 | 3742 | NM_002208 | Hs.851 | 1.00E−173 | 1 | integrin, alpha E (antigen CD103, human mucosa |
| 71G7 | 1 | 1193 | NM_000619 | Hs.856 | 0 | 111 | interferon, gamma (IFNG), mRNA/cds = (108,608) |
| 75H5 | 1 | 1193 | X13274 | Hs.856 | 0 | 314 | interferon IFN-gamma/cds = (108,608)/gb = X13 |
| 525B12 | 672 | 894 | NM_002341 | Hs.890 | 1.00E−121 | 1 | lymphotoxin beta (TNF superfamily, member 3) |
| 40E8 | 75 | 999 | AL121985 | Hs.901 | 0 | 6 | DNA sequence RP11-404F10 on chromosome 1q2 |
| 48H4 | 680 | 933 | NM_001778 | Hs.901 | 1.00E−130 | 2 | CD48 antigen (B-cell membrane protein) (CD48) |
| 179G8 | 1652 | 2181 | AL163285 | Hs.926 | 0 | 1 | chromosome 21 segment HS21C085 |
| 48G1 | 1049 | 2092 | NM_002463 | Hs.926 | 0 | 3 | myxovirus (influenza) resistance 2, homolog o |
| 110B12 | 209 | 1734 | M32011 | Hs.949 | 0 | 8 | neutrophil oxidase factor (p67-phox) mRNA, complete |
| 99C9 | 207 | 1733 | NM_000433 | Hs.949 | 0 | 11 | neutrophil cytosolic factor 2 (65 kD, chronic g |
| 125D2 | 958 | 1645 | NM_004645 | Hs.966 | 0 | 1 | coilin (COIL), mRNA/cds = (22,1752)/gb = NM_004 |
| 458C1 | 1649 | 2285 | NM_006025 | Hs.997 | 0 | 1 | protease, serine, 22 (P11), mRNA/cds = (154,126 |
| 40H11 | 621 | 864 | L26953 | Hs.1010 | 1.00E−135 | 1 | chromosomal protein mRNA, complete cds/cds = (7 |
| 116D10 | 513 | 858 | NM_002932 | Hs.1010 | 0 | 1 | regulator of mitotic spindle assembly 1 (RMSA |
| 40G11 | 1565 | 2151 | M31452 | Hs.1012 | 0 | 1 | proline-rich protein (PRP) mRNA, complete |
| 192A6 | 321 | 908 | NM_000284 | Hs.1023 | 0 | 1 | pyruvate dehydrogenase (lipoamide) alpha 1 ( |
| 460H11 | 2158 | 2402 | NM_004762 | Hs.1050 | 2.00E−91 | 1 | pleckstrin homology, Sec7 and coiled/coil dom |
| 41F12 | 291 | 565 | M57888 | Hs.1051 | 1.00E−112 | 1 | (clone lambda B34) cytotoxic T-lymphocyte-associate |
| 41A5 | 1311 | 1852 | M55654 | Hs.1100 | 0 | 1 | TATA-binding protein mRNA, complete |
| 461D7 | 999 | 1277 | NM_002698 | Hs.1101 | 1.00E−92 | 1 | POU domain, class 2, transcription factor 2 (P |
| 597H9 | 1083 | 1224 | NM_000660 | Hs.1103 | 3.00E−75 | 1 | transforming growth factor, beta 1 (TGFB1), mR |
| 40B5 | 1433 | 2010 | X02812 | Hs.1103 | 0 | 1 | transforming growth factor-beta (TGF-beta) |
| 106A10 | 1977 | 2294 | M73047 | Hs.1117 | 1.00E−176 | 1 | tripeptidyl peptidase II mRNA, complete cds/c |
| 165E8 | 4273 | 4582 | NM_003291 | Hs.1117 | 1.00E−173 | 1 | tripeptidyl peptidase II (TPP2), mRNA/cds = (23 |
| 63G12 | 1114 | 2339 | D49728 | Hs.1119 | 0 | 7 | NAK1 mRNA for DNA binding protein, complete |
| 45B10 | 1317 | 1857 | NM_002135 | Hs.1119 | 0 | 1 | nuclear receptor subfamily 4, group A, member |
| 37H3 | 568 | 783 | M24069 | Hs.1139 | 1.00E−119 | 1 | DNA-binding protein A (dbpA) gene, 3' end |
| 476F9 | 209 | 608 | NM_000174 | Hs.1144 | 0 | 1 | glycoprotein IX (platelet) (GP9), mRNA/cds = ( |
| 43A10 | 1105 | 1357 | U15085 | Hs.1162 | 3.00E−41 | 1 | HLA-DMB mRNA, complete cds |
| 139D6 | 1345 | 1680 | L11329 | Hs.1183 | 1.00E−102 | 1 | protein tyrosine phosphatase (PAC-1) mRNA, co |
| 134B12 | 1233 | 1675 | NM_004418 | Hs.1183 | 0 | 1 | dual specificity phosphatase 2 (DUSP2), mRNA |
| 58F1 | 17 | 341 | NM_002157 | Hs.1197 | 0 | 1 | heat shock 10 kD protein 1 (chaperonin 10) (HSP |
| 158G5 | 20 | 341 | U07550 | Hs.1197 | 1.00E−180 | 2 | chaperonin 10 mRNA, complete cds |
| 167C8 | 813 | 1453 | NM_000022 | Hs.1217 | 0 | 4 | adenosine deaminase (ADA), mRNA/cds = (95,1186 |
| 179H1 | 730 | 1452 | X02994 | Hs.1217 | 0 | 6 | adenosine deaminase (adenosine aminohydrola |
| 40E10 | 594 | 792 | M38690 | Hs.1244 | 1.00E−109 | 1 | CD9 antigen mRNA, complete cds |
| 41C5 | 1280 | 1438 | AK024951 | Hs.1279 | 2.00E−80 | 1 | FLJ21298 fis, clone COL02040, highly sim |
| 40E3 | 1002 | 1735 | NM_000065 | Hs.1282 | 0 | 1 | complement component 6 (C6) mRNA/cd |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 40A11 | 1638 | 1821 | K02766 | Hs.1290 | 3.00E−98 | 1 | complement component C9 mRNA, complete |
| 40B12 | 4639 | 5215 | NM_007289 | Hs.1298 | 0 | 1 | membrane metallo-endopeptidase (neutral end |
| 41G2 | 1576 | 1870 | M28825 | Hs.1309 | 1.00E−115 | 1 | thymocyte antigen CD1a mRNA, complete cds |
| 41F8 | 1171 | 1551 | AX023365 | Hs.1349 | 0 | 1 | Sequence 36 from Patent WO0006605 |
| 40E1 | 673 | 1147 | M30142 | Hs.1369 | 0 | 1 | decay-accelerating factor mRNA, complete cds |
| 118B12 | 1129 | 1719 | NM_000574 | Hs.1369 | 0 | 1 | decay accelerating factor for complement (CD5 |
| 75F8 | 830 | 2979 | NM_000399 | Hs.1395 | 0 | 48 | early growth response 2 (Krox-20 (Drosophila) |
| 41F11 | 973 | 1428 | M15059 | Hs.1416 | 0 | 1 | Fc-epsilon receptor (IgE receptor) mRNA, complete cd |
| 110G12 | 1931 | 2071 | AL031729 | Hs.1422 | 2.00E−70 | 1 | DNA seq RP1-159A19 on chromosome 1p36 |
| 113D10 | 1718 | 2066 | NM_005248 | Hs.1422 | 6.00E−76 | 2 | Gardner-Rasheed feline sarcoma viral (v-fgr) |
| 477C2 | 3292 | 3842 | NM_000152 | Hs.1437 | 0 | 1 | glucosidase, alpha; acid (Pompe disease, glyc |
| 124D1 | 795 | 1127 | NM_000167 | Hs.1466 | 0 | 1 | glycerol kinase (GK), mRNA/cds = (66,1640)/gb |
| 41B9 | 2231 | 2447 | J03171 | Hs.1513 | 1.00E−108 | 1 | interferon-alpha receptor (HuIFN-alpha-Rec) mRNA, |
| 99F7 | 927 | 1889 | NM_014882 | Hs.1528 | 0 | 2 | KIAA0053 gene product (KIAA0053), mRNA/cds = ( |
| 469G9 | 1220 | 1507 | NM_005082 | Hs.1579 | 1.00E−117 | 1 | zinc finger protein 147 (estrogen-responsive |
| 195B7 | 190 | 1801 | BC002971 | Hs.1600 | 0 | 3 | clone IMAGE: 3543711, mRNA, partial cds/cds = |
| 195F10 | 3676 | 3856 | NM_000110 | Hs.1602 | 1.00E−85 | 1 | dihydropyrimidine dehydrogenase (DPYD), mRN |
| 129E7 | 648 | 1827 | L08176 | Hs.1652 | 0 | 2 | Epstein-Barr virus induced G-protein coupled recepto |
| 478H5 | 1839 | 2050 | NM_002056 | Hs.1674 | 7.00E−79 | 1 | glutamine-fructose-6-phosphate transaminas |
| 39H1 | 436 | 865 | L35249 | Hs.1697 | 0 | 1 | vacuolar H+-ATPase Mr 56,000 subunit (HO57) mR |
| 183H8 | 972 | 1183 | NM_001693 | Hs.1697 | 1.00E−106 | 1 | ATPase, H+ transporting, lysosomal (vacuolar |
| 481A4 | 1594 | 1785 | NM_001420 | Hs.1701 | 2.00E−79 | 1 | ELAV (embryonic lethal, abnormal vision, Dros |
| 40B3 | 3846 | 4009 | L39064 | Hs.1702 | 4.00E−70 | 1 | interleukin 9 receptor precursor (IL9R) gene, |
| 176G8 | 1033 | 1400 | NM_006084 | Hs.1706 | 0 | 1 | interferon-stimulated transcription factor |
| 589C11 | 1 | 1347 | NM_005998 | Hs.1708 | 0 | 2 | chaperonin containing TCP1, subunit 3 (gamma) |
| 70H5 | 1 | 494 | X74801 | Hs.1708 | 0 | 1 | Cctg mRNA for chaperonin/cds = (0,1634)/gb = X7480 |
| 460C12 | 3310 | 3809 | NM_012089 | Hs.1710 | 0 | 1 | ATP-binding cassette, sub-family B (MDR/TAP), |
| 41D5 | 484 | 1862 | M28983 | Hs.1722 | 0 | 3 | interleukin 1 alpha (IL 1) mRNA, complete cds/ |
| 119E8 | 493 | 904 | NM_000575 | Hs.1722 | 1.00E−151 | 2 | interleukin 1, alpha (IL1A), mRNA/cds = (36,851 |
| 479E11 | 5 | 268 | NM_000417 | Hs.1724 | 1.00E−145 | 1 | interleukin 2 receptor, alpha (IL2RA), mRNA/ |
| 62C8 | 85 | 1887 | X01057 | Hs.1724 | 0 | 2 | interleukin-2 receptor/cds = (180,998)/gb = X |
| 466A3 | 2166 | 2675 | NM_000889 | Hs.1741 | 0 | 1 | integrin, beta 7 (ITGB7), mRNA/cds = (151,2547) |
| 107A4 | 4960 | 5610 | L33075 | Hs.1742 | 0 | 1 | ras GTPase-activating-like protein (IQGAP1) |
| 189A5 | 4318 | 7450 | NM_003870 | Hs.1742 | 0 | 3 | IQ motif containing GTPase activating protein |
| 597D1 | 1230 | 1737 | NM_005356 | Hs.1765 | 1.00E−127 | 5 | lymphocyte-specific protein tyrosine kinase |
| 41C10 | 1057 | 1602 | J04142 | Hs.1799 | 0 | 1 | (lambda-gt11ht-5) MHC class I antigen-like gl |
| 104F4 | 1854 | 2023 | L06175 | Hs.1845 | 4.00E−54 | 1 | P5-1 mRNA, complete cds/cds = (304,735)/gb = L06 |
| 98F7 | 34 | 2041 | NM_006674 | Hs.1845 | 4.00E−63 | 5 | MHC class I region ORF (P5-1),/cds = (304,735)/ |
| 104F1 | 1390 | 1756 | NM_002436 | Hs.1861 | 0 | 2 | membrane protein, palmitoylated 1 (55 kD) (MPP |
| 171F7 | 1760 | 2192 | M55284 | Hs.1880 | 0 | 1 | protein kinase C-L (PRKCL) mRNA, complete cds |
| 134B2 | 123 | 1182 | NM_002727 | Hs.1908 | 0 | 10 | proteoglycan 1, secretory granule (PRG1), mRN |
| 61C11 | 126 | 902 | X17042 | Hs.1908 | 0 | 11 | hematopoetic proteoglycan core protein/cds |
| 458G1 | 1 | 475 | NM_001885 | Hs.1940 | 0 | 1 | crystallin, alpha B (CRYAB), mRNA |
| 520E10 | 71 | 343 | NM_001024 | Hs.1948 | 1.00E−142 | 3 | ribosomal protein S21 (RPS21), mRNA |
| 459D6 | 2435 | 3055 | NM_001761 | Hs.1973 | 0 | 1 | cyclin F (CCNF), mRNA/cds = (43,2403) |
| 41H3 | 184 | 1620 | NM_006139 | Hs.1987 | 0 | 2 | CD28 antigen (Tp44) (CD28), mRNA/cds = (222,884 |
| 71C5 | 721 | 1329 | NM_000639 | Hs.2007 | 0 | 2 | tumor necrosis factor (ligand) superfamily, m |
| 73C1 | 721 | 1603 | X89102 | Hs.2007 | 0 | 8 | fasligand/cds = (157,1002) |
| 135G3 | 940 | 1352 | NM_002852 | Hs.2050 | 6.00E−96 | 1 | pentaxin-related gene, rapidly induced by IL |
| 44A10 | 1562 | 1748 | M58028 | Hs.2055 | 7.00E−69 | 1 | ubiquitin-activating enzyme E1 (UBE1) mRNA, complete |
| 155G5 | 973 | 2207 | AL133415 | Hs.2064 | 0 | 7 | DNA sequence from clone RP11-124N14 on chromosome 10. |
| 599H7 | 48 | 3022 | AK025306 | Hs.2083 | 0 | 12 | cDNA: FLJ21653 fis, clone COL08586, |
| 71H1 | 1598 | 2163 | NM_004419 | Hs.2128 | 0 | 5 | dual specificity phosphatase 5 (DUSP5), mRNA |
| 69H7 | 1595 | 2161 | U15932 | Hs.2128 | 0 | 11 | dual-specificity protein phosphatase mRNA, complete |
| 458C4 | 1928 | 2356 | NM_005658 | Hs.2134 | 0 | 1 | TNF receptor-associated factor 1 (TRAF1), mRN |
| 192E11 | 6 | 414 | NM_002704 | Hs.2164 | 0 | 1 | pro-platelet basic protein (includes platele |
| 40D12 | 1935 | 2645 | M58597 | Hs.2173 | 0 | 2 | ELAM-1 ligand fucosyltransferase (ELFT) mRNA, comple |
| 40E5 | 2834 | 3024 | M59820 | Hs.2175 | 1.00E−104 | 1 | granulocyte colony-stimulating factor receptor (CSF |
| 482D8 | 2521 | 2943 | NM_000760 | Hs.2175 | 0 | 2 | colony stimulating factor 3 receptor (granuloc |
| 60H6 | 918 | 1723 | AF119850 | Hs.2186 | 0 | 6 | PRO1608 mRNA, complete cds/cds = (1221,2174)/ |
| 597F11 | 99 | 1267 | NM_001404 | Hs.2186 | 0 | 29 | eukaryotic translation elongation factor 1 g |
| 595G4 | 6 | 570 | L40410 | Hs.2210 | 0 | 1 | thyroid receptor interactor (TRIP3) mRNA, 3' |
| 41H12 | 970 | 1353 | X03656 | Hs.2233 | 0 | 1 | granulocyte colony-stimulating factor (G-C |
| 461A9 | 287 | 730 | Z29067 | Hs.2236 | 0 | 1 | H. sapiens nek3 mRNA for protein kinase |
| 493E11 | 212 | 608 | NM_000879 | Hs.2247 | 1.00E−141 | 2 | interleukin 5 (colony-stimulating factor, eo |
| 150B5 | 363 | 815 | X04688 | Hs.2247 | 0 | 1 | T-cell replacing factor (interleukin-5)/cd |
| 461E12 | 255 | 342 | NM_001565 | Hs.2248 | 8.00E−34 | 1 | small inducible cytokine subfamily B (Cys-X-C |
| 129A8 | 1790 | 1970 | NM_002309 | Hs.2250 | 2.00E−94 | 1 | leukemia inhibitory factor (cholinergic diff |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 40G10 | 2152 | 2560 | X04481 | Hs.2253 | 0 | 1 | complement component C2/cds = (36,2294)/gb = X |
| 479A2 | 95 | 610 | NM_000073 | Hs.2259 | 0 | 2 | CD3G antigen, gamma polypeptide (TiT3 complex |
| 592G6 | 783 | 1163 | NM_002950 | Hs.2280 | 0 | 2 | ribophorin I (RPN1), mRNA/cds = (137,1960)/gb |
| 459G11 | 673 | 1316 | NM_004931 | Hs.2299 | 0 | 1 | CD8 antigen, beta polypeptide 1 (p37) (CD8B1), |
| 129B8 | 1159 | 1316 | X13444 | Hs.2299 | 1.00E−74 | 1 | CD8 beta-chain glycoprotein (CD8 beta. 1)/cd |
| 467F12 | 2928 | 3239 | NM_000346 | Hs.2316 | 3.00E−85 | 1 | SRY (sex determining region Y)-box 9 (campomeli |
| 44A6 | 1506 | 1629 | U23028 | Hs.2437 | 7.00E−62 | 1 | eukaryotic initiation factor 2B-epsilon mRNA, partia |
| 127B8 | 1814 | 2405 | NM_003816 | Hs.2442 | 0 | 1 | a disintegrin and metalloproteinase domain 9 |
| 36G6 | 1361 | 2019 | D13645 | Hs.2471 | 0 | 2 | KIAA0020 gene, complete cds/cds = (418,1944) |
| 458D6 | 396 | 961 | NM_021966 | Hs.2484 | 0 | 1 | T-cell leukemia/lymphoma 1A (TCL1A), mRNA/c |
| 124G1 | 966 | 1473 | NM_005565 | Hs.2488 | 0 | 1 | lymphocyte cytosolic protein 2 (SH2 domain-con |
| 107A6 | 1962 | 2031 | U20158 | Hs.2488 | 2.00E−22 | 1 | 76 kDa tyrosine phosphoprotein SLP-76 mRNA, complete |
| 592E12 | 2175 | 2458 | NM_002741 | Hs.2499 | 1.00E−158 | 1 | protein kinase C-like 1 (PRKCL1), mRNA/cds = (8 |
| 106A11 | 1455 | 2219 | U34252 | Hs.2533 | 0 | 2 | gamma-aminobutyraldehyde dehydrogenase mRNA, compl |
| 40F8 | 2201 | 2694 | NM_003032 | Hs.2554 | 0 | 1 | sialyltransferase 1 (beta-galactoside alpha- |
| 460G6 | 565 | 2052 | NM_002094 | Hs.2707 | 0 | 2 | G1 to S phase transition 1 mRNA |
| 60G5 | 35 | 184 | X92518 | Hs.2726 | 7.00E−27 | 2 | HMGI-C protein/cds = UNKNOWN |
| 461F10 | 1034 | 1520 | NM_002145 | Hs.2733 | 0 | 2 | homeo box B2 (HOXB2), mRNA |
| 69G2 | 408 | 1369 | AK026515 | Hs.2795 | 0 | 4 | FLJ22862 fis, clone KAT01966, highly sim |
| 71D8 | 13 | 541 | NM_005566 | Hs.2795 | 0 | 1 | lactate dehydrogenase A (LDHA), mRNA/cds = (97 |
| 40H12 | 4119 | 4807 | NM_002310 | Hs.2798 | 0 | 1 | leukemia inhibitory factor receptor (LIFR) mR |
| 189C12 | 696 | 1287 | NM_006196 | Hs.2853 | 0 | 2 | poly(rC)-binding protein 1 (PCBP1), mRNA/cds |
| 111E8 | 1298 | 1938 | NM_003566 | Hs.2864 | 0 | 1 | early endosome antigen 1, 162 kD (EEA1), mRNA/ |
| 127F12 | 34 | 248 | NM_001033 | Hs.2934 | 1.00E−109 | 1 | ribonucleotide reductase M1 polypeptide (RRM |
| 74G6 | 11 | 241 | AK023088 | Hs.2953 | 1.00E−128 | 38 | FLJ13026 fis, clone NT2RP3000968, modera |
| 128D8 | 178 | 518 | NM_000117 | Hs.2985 | 1.00E−173 | 1 | emerin (Emery-Dreifuss muscular dystrophy) ( |
| 169G7 | 2406 | 3112 | AL136593 | Hs.3059 | 0 | 1 | DKFZp761K102 (from clone DKFZp761K1 |
| 193A3 | 2405 | 3017 | NM_016451 | Hs.3059 | 0 | 5 | coatomer protein complex, subunit beta (COPB) |
| 53F12 | 486 | 1007 | L11066 | Hs.3069 | 0 | 3 | sequence/cds = UNKNOWN/gb = L11066/gi = 307322/u |
| 71E8 | 1623 | 2131 | NM_004134 | Hs.3069 | 0 | 2 | heat shock 70 kD protein 9B (mortalin-2) (HSPA9 |
| 458A5 | 2236 | 2874 | NM_014877 | Hs.3085 | 0 | 1 | KIAA0054 gene product; Helicase (KIAA0054), m |
| 69E8 | 1752 | 1916 | D31884 | Hs.3094 | 7.00E−68 | 1 | KIAA0063 gene, complete cds/cds = (279,887)/ |
| 66B3 | 251 | 1590 | D32053 | Hs.3100 | 0 | 2 | for Lysyl tRNA Synthetase, complete cds/ |
| 458E1 | 1645 | 1964 | NM_001666 | Hs.3109 | 1.00E−178 | 1 | Rho GTPase activating protein 4 (ARHGAP4), mRN |
| 331D8 | 2882 | 3585 | U26710 | Hs.3144 | 0 | 1 | cbl-b mRNA, complete cds/cds = (322,3270)/ gb = U26710 |
| 73D9 | 1 | 613 | AL031736 | Hs.3195 | 0 | 18 | DNA sequence clone 738P11 on chromosome 1q24.1-2 |
| 58B1 | 1 | 607 | NM_002995 | Hs.3195 | 0 | 17 | small inducible cytokine subfamily C, member |
| 98F11 | 145 | 588 | NM_003172 | Hs.3196 | 0 | 1 | surfeit 1 (SURF1), mRNA/cds = (14,916)/gb = NM_ |
| 124E9 | 1258 | 2414 | NM_007318 | Hs.3260 | 0 | 2 | presenilin 1 (Alzheimer disease 3) (PSEN1), tr |
| 64G7 | 1040 | 1569 | NM_002155 | Hs.3268 | 0 | 1 | heat shock 70 kD protein 6 (HSP70B') (HSPA6), mR |
| 36D4 | 1116 | 1917 | X51757 | Hs.3268 | 0 | 4 | heat-shock protein HSP70B' gene/cds = (0,1931)/ gb = X5 |
| 39H11 | 1 | 507 | BE895166 | Hs.3297 | 1.00E−152 | 4 | 601436095F1 cDNA, 5' end/clone = IMAGE: 3921239 |
| 103G4 | 16 | 540 | NM_002954 | Hs.3297 | 0 | 4 | ribosomal protein S27a (RPS27A), mRNA/cds = (3 |
| 127H7 | 1391 | 1806 | AB037752 | Hs.3355 | 0 | 1 | mRNA for KIAA1331 protein, partial cds/cds = (0 |
| 107D3 | 1932 | 2517 | AK027064 | Hs.3382 | 0 | 1 | FLJ23411 fis, clone HEP20452, highly sim |
| 121B3 | 1270 | 3667 | NM_005134 | Hs.3382 | 0 | 4 | protein phosphatase 4, regulatory subunit 1 ( |
| 58H1 | 104 | 573 | NM_001122 | Hs.3416 | 0 | 6 | adipose differentiation-related protein (AD |
| 75G1 | 104 | 1314 | X97324 | Hs.3416 | 0 | 16 | adipophilin/cds = (0,1313)/gb = X97324/ |
| 182A4 | 147 | 334 | NM_001867 | Hs.3462 | 1.00E−102 | 1 | cytochrome c oxidase subunit VIIc (COX7C), mRN |
| 134D7 | 36 | 270 | NM_001025 | Hs.3463 | 1.00E−127 | 3 | ribosomal protein S23 (RPS23), mRNA/cds = (13,4 |
| 192B10 | 129 | 1135 | AL357536 | Hs.3576 | 0 | 3 | mRNA full length insert cDNA clone EUROIMAGE 37 |
| 112G12 | 56 | 687 | NM_003001 | Hs.3577 | 0 | 1 | succinate dehydrogenase complex, subunit C, |
| 526H6 | 143 | 537 | BF666961 | Hs.3585 | 0 | 1 | 602121608F1 cDNA, 5' end/clone = IMAGE: 4278768 |
| 599F10 | 2098 | 2351 | NM_004834 | Hs.3628 | 1.00E−118 | 2 | mitogen-activated protein kinase kinase kina |
| 594F1 | 239 | 1321 | NM_001551 | Hs.3631 | 0 | 4 | immunoglobulin (CD79A) binding protein 1 (IG |
| 463E7 | 911 | 1033 | AL359940 | Hs.3640 | 1.00E−63 | 1 | mRNA; cDNA DKFZp762P1915 (from clone DKFZp762P |
| 182A9 | 657 | 1179 | AL050268 | Hs.3642 | 0 | 2 | mRNA; cDNA DKFZp564B163 (from clone DKFZp564B1 |
| 38B4 | 257 | 568 | AB034205 | Hs.3688 | 1.00E−151 | 3 | for cisplatin resistance-associated ove |
| 185H6 | 769 | 995 | NM_006003 | Hs.3712 | 2.00E−88 | 1 | ubiquinol-cytochrome c reductase, Rieske iro |
| 587A1 | 716 | 1609 | NM_006007 | Hs.3776 | 0 | 2 | zinc finger protein 216 (ZNF216), mRNA/cds = (2 |
| 473B5 | 46 | 531 | NM_021633 | Hs.3826 | 0 | 1 | kelch-like protein C3IP1 (C3IP1), mRNA/cds = ( |
| 194G5 | 2456 | 2984 | AB002366 | Hs.3852 | 0 | 1 | mRNA for KIAA0368 gene, partial cds/cds = (0,4327)/ gb |
| 589B4 | 526 | 1337 | NM_000310 | Hs.3873 | 0 | 3 | palmitoyl-protein thioesterase 1 (ceroid-lip |
| 515A10 | 1618 | 2130 | NM_002267 | Hs.3886 | 0 | 1 | karyopherin alpha 3 (importin alpha 4) (KPNA3) |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 186A8 | 1160 | 1632 | NM_002807 | Hs.3887 | 0 | 1 | proteasome (prosome, macropain) 26S subunit, |
| 102F7 | 4226 | 4531 | AB023163 | Hs.4014 | 1.00E−158 | 1 | for KIAA0946 protein, partial cds/cds = (0 |
| 50B8 | 1 | 166 | AL117595 | Hs.4055 | 3.00E−89 | 2 | cDNA DKFZp564C2063 (from clone DKFZp564 |
| 473A10 | 1064 | 1709 | NM_006582 | Hs.4069 | 0 | 1 | glucocorticoid modulatory element binding pr |
| 524A12 | 2863 | 3386 | AL136105 | Hs.4082 | 0 | 1 | DNA sequence from clone RP4-670F13 on chromosome 1q42 |
| 525E1 | 521 | 974 | BC002435 | Hs.4096 | 0 | 1 | clone IMAGE: 3346451, mRNA, partial cds/cds = t-complex |
| 163G12 | 1130 | 1630 | X52882 | Hs.4112 | 0 | 6 | polypeptide 1 gene/cds = (21,1691)/ gb = X528 |
| 176A7 | 515 | 892 | BC000687 | Hs.4147 | 0 | 1 | translocating chain-associating membrane p |
| 185B5 | 3480 | 3707 | AB023216 | Hs.4278 | 1.00E−86 | 1 | mRNA for KIAA0999 protein, partial cds/cds = (0 |
| 154E12 | 1731 | 2531 | AF079566 | Hs.4311 | 0 | 2 | ubiquitin-like protein activating enzyme (UB |
| 331C9 | 1595 | 1966 | AF067008 | Hs.4747 | 0 | 1 | dyskerin (DKC1) mRNA, complete cds/cds = (60,16 |
| 182C8 | 1676 | 1966 | NM_001363 | Hs.4747 | 1.00E−148 | 2 | dyskeratosis congenita 1, dyskerin (DKC1), mR |
| 178C4 | 1623 | 2162 | AL136610 | Hs.4750 | 0 | 3 | mRNA; cDNA DKFZp564K0822 (from clone DKFZp564K |
| 107F9 | 3857 | 4266 | AB032976 | Hs.4779 | 0 | 1 | for KIAA1150 protein, partial cds/cds = (0 |
| 191C11 | 1945 | 2618 | AF240468 | Hs.4788 | 0 | 3 | nicastrin mRNA, complete cds/cds = (142,2271) |
| 143G11 | 869 | 2076 | AK022974 | Hs.4859 | 0 | 2 | FLJ12912 fis, clone NT2RP2004476, highly |
| 127H11 | 977 | 1666 | NM_020307 | Hs.4859 | 0 | 1 | cyclin L ania-6a (LOC57018), mRNA/cds = (54,163 |
| 479A11 | 215 | 544 | AK001942 | Hs.4863 | 1.00E−173 | 1 | cDNA FLJ11080 fis, clone PLACE1005181/cds = UN |
| 73C5 | 2314 | 2851 | AF105366 | Hs.4876 | 0 | 1 | K-Cl cotransporter KCC3a mRNA, alternatively |
| 525F9 | 1059 | 1764 | NM_006513 | Hs.4888 | 0 | 3 | seryl-tRNA synthetase (SARS), mRNA/cds = (75,1 |
| 114D8 | 931 | 1061 | Z24724 | Hs.4934 | 4.00E−52 | 1 | H. sapiens polyA site DNA/cds = UNKNOWN/ gb = Z24724/gi = 50503 |
| 587C10 | 1104 | 1343 | NM_006787 | Hs.4943 | 3.00E−94 | 1 | hepatocellular carcinoma associated protein; |
| 174F12 | 1749 | 2291 | NM_018107 | Hs.4997 | 0 | 3 | hypothetical protein FLJ10482 (FLJ10482), mR |
| 514C11 | 899 | 1489 | AK021776 | Hs.5019 | 0 | 1 | cDNA FLJ11714 fis, clone HEMBA1005219, weakly |
| 126H9 | 25 | 397 | BE379724 | Hs.5027 | 1.00E−118 | 1 | 601159415T1 cDNA, 3' end/clone = IMAGE: 3511107 |
| 599B5 | 801 | 970 | NM_017840 | Hs.5080 | 5.00E−73 | 1 | hypothetical protein FLJ20484 (FLJ20484), mR |
| 47E5 | 4 | 720 | AL034553 | Hs.5085 | 0 | 2 | DNA sequence from clone 914P20 on chromosome 20q13.13 |
| 122C11 | 492 | 860 | NM_003859 | Hs.5085 | 0 | 1 | dolichyl-phosphate mannosyltransferase pol |
| 116H6 | 1644 | 2902 | NM_014868 | Hs.5094 | 1.00E−102 | 2 | ring finger protein 10 (RNF10), mRNA/cds = (698, |
| 187G7 | 700 | 1268 | NM_004710 | Hs.5097 | 0 | 1 | synaptogyrin 2 (SYNGR2), mRNA/cds = (29,703)/ |
| 174G3 | 240 | 500 | NM_003746 | Hs.5120 | 1.00E−144 | 4 | dynein, cytoplasmic, light polypeptide (PIN) |
| 145B6 | 199 | 695 | BE539096 | Hs.5122 | 1.00E−165 | 2 | 601061641F1 cDNA, 5' end/clone = IMAGE: 3447850 |
| 486C1 | 1 | 529 | BG028906 | Hs.5122 | 0 | 2 | 602293015F1 cDNA, 5' end/clone = IMAGE: 4387778 |
| 69F6 | 62 | 455 | BF307213 | Hs.5174 | 0 | 1 | 601891365F1 cDNA, 5' end/clone = IMAGE: 4136752 |
| 583F4 | 82 | 477 | NM_001021 | Hs.5174 | 0 | 1 | ribosomal protein S17 (RPS17), mRNA/cds = (25,4 |
| 74C4 | 1955 | 2373 | AK025367 | Hs.5181 | 1.00E−179 | 1 | FLJ21714 fis, clone COL10256, highly sim |
| 73E12 | 702 | 987 | AL109840 | Hs.5184 | 1.00E−161 | 1 | DNA sequence from clone RP4-543J19 on chromosome 20 C |
| 180G4 | 26 | 639 | NM_002212 | Hs.5215 | 0 | 2 | integrin beta 4 binding protein (ITGB4BP), mRN |
| 98F1 | 17 | 636 | NM_014165 | Hs.5232 | 0 | 5 | HSPC125 protein (HSPC125), mRNA/cds = (79,606) |
| 525A8 | 479 | 992 | NM_006698 | Hs.5300 | 0 | 1 | bladder cancer associated protein (BLCAP), mR |
| 99C1 | 19 | 507 | NM_003333 | Hs.5308 | 0 | 3 | ubiquitin A-52 residue ribosomal protein fusi |
| 172D11 | 714 | 1805 | NM_005721 | Hs.5321 | 0 | 3 | ARP3 (actin-related protein 3, yeast) homolog |
| 591F6 | 475 | 970 | NM_015702 | Hs.5324 | 0 | 1 | hypothetical protein (CL25022), mRNA/cds = (1 |
| 68H8 | 724 | 1190 | NM_014106 | Hs.5327 | 0 | 2 | PRO1914 protein (PRO1914), mRNA/cds = (1222,14 |
| 194D12 | 2128 | 2499 | AB018305 | Hs.5378 | 0 | 1 | mRNA for KIAA0762 protein, partial cds/cds = (0 |
| 501G11 | 823 | 1322 | NM_020122 | Hs.5392 | 0 | 3 | potassium channel modulatory factor (DKFZP434 |
| 74B4 | 502 | 1257 | AF008442 | Hs.5409 | 0 | 7 | RNA polymerase I subunit hRPA39 mRNA, complete |
| 134H7 | 543 | 916 | NM_004875 | Hs.5409 | 0 | 1 | RNA polymerase I subunit (RPA40), mRNA/cds = (2 |
| 168A3 | 1909 | 2379 | AF090891 | Hs.5437 | 0 | 1 | clone HQ0105 PRO0105 mRNA, complete cds/cds = ( |
| 145C10 | 2375 | 2564 | AF016270 | Hs.5464 | 1.00E−104 | 2 | thyroid hormone receptor coactivating protein |
| 587H7 | 1857 | 2563 | NM_006696 | Hs.5464 | 0 | 4 | thyroid hormone receptor coactivating protein |
| 183D10 | 1199 | 1347 | NM_006495 | Hs.5509 | 9.00E−40 | 1 | ecotropic viral integration site 2B (EVI2B), m |
| 181D7 | 1385 | 1752 | AK002173 | Hs.5518 | 0 | 1 | cDNA FLJ11311 fis, clone PLACE1010102/cds = UNK |
| 173B1 | 1 | 642 | NM_003315 | Hs.5542 | 0 | 2 | tetratricopeptide repeat domain 2 (TTC2), mRN |
| 120F8 | 1782 | 2430 | AF157323 | Hs.5548 | 0 | 2 | p45SKP2-like protein mRNA, complete cds/cds = ribosomal |
| 464H2 | 46 | 357 | NM_000998 | Hs.5566 | 1.00E−163 | 2 | protein L37a (RPL37A), mRNA/cds = (1 |
| 75F5 | 1252 | 2194 | AK027192 | Hs.5615 | 0 | 9 | FLJ23539 fis, clone LNG08101, highly sim |
| 56E8 | 27 | 205 | AI570531 | Hs.5637 | 2.00E−95 | 1 | tm77g04.x1 cDNA, 3' end/clone = IMAGE: 2164182 |
| 524G2 | 2 | 926 | NM_006098 | Hs.5662 | 0 | 9 | guanine nucleotide binding protein (G protein |
| 39F6 | 2311 | 2902 | AB014579 | Hs.5734 | 0 | 1 | for KIAA0679 protein, partial cds/cds = (0 |
| 587G2 | 2883 | 4606 | NM_012215 | Hs.5734 | 0 | 11 | meningioma expressed antigen 5 (hyaluronidase |
| 469E5 | 5041 | 5393 | NM_014864 | Hs.5737 | 3.00E−75 | 2 | KIAA0475 gene product (KIAA0475), mRNA/cds = ( |
| 120H3 | 1022 | 1553 | NM_016230 | Hs.5741 | 0 | 1 | flavohemoprotein b5+b5R (LOC51167), mRNA/cd |
| 63H8 | 1049 | 1507 | AK025729 | Hs.5798 | 0 | 1 | FLJ22076 fis, clone HEP12479, highly sim |
| 590D9 | 1015 | 1470 | NM_015946 | Hs.5798 | 0 | 1 | pelota (Drosophila) homolog (PELO), mRNA/cds |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 102E3 | 665 | 1027 | AK000474 | Hs.5811 | 0 | 1 | FLJ20467 fis, clone KAT06638/cds = (360,77 |
| 187E5 | 665 | 1028 | NM_017835 | Hs.5811 | 0 | 1 | chromosome 21 open reading frame 59 (C21ORF59), |
| 39F9 | 1402 | 1728 | AK025773 | Hs.5822 | 0 | 3 | FLJ22120 fis, clone HEP18874/cds = UNKNOW |
| 39E12 | 1064 | 1843 | AF208844 | Hs.5862 | 0 | 1 | BM-002 mRNA, complete cds/cds = (39,296)/gb = A |
| 173H9 | 906 | 1684 | NM_016090 | Hs.5887 | 0 | 2 | RNA binding motif protein 7 (LOC51120), mRNA/ |
| 120E8 | 1702 | 2055 | NM_012179 | Hs.5912 | 1.00E−146 | 1 | F-box only protein 7 (FBXO7), mRNA/cds = (205,17 |
| 195D1 | 1309 | 2656 | AK025620 | Hs.5985 | 0 | 8 | cDNA: FLJ21967 fis, clone HEP05652, highly sim |
| 116A6 | 1451 | 2073 | AK024941 | Hs.6019 | 0 | 1 | cDNA: FLJ21288 fis, clone COL01927/cds = UNKNOW |
| 113F9 | 1232 | 1598 | NM_002896 | Hs.6106 | 1.00E−126 | 1 | RNA binding motif protein 4 (RBM4), mRNA/cds = ( |
| 520H1 | 563 | 1007 | NM_018285 | Hs.6118 | 0 | 2 | hypothetical protein FLJ10968 (FLJ10968), mR |
| 180H12 | 5224 | 5568 | AF315591 | Hs.6151 | 1.00E−135 | 1 | Pumilio 2 (PUMH2) mRNA, complete cds/cds = (23,3 |
| 185A7 | 612 | 1558 | NM_016001 | Hs.6153 | 0 | 6 | CGI-48 protein (LOC51096), mRNA/cds = (107,167 |
| 595G2 | 3207 | 4752 | Z97056 | Hs.6179 | 0 | 10 | DNA seq from clone RP3-434P1 on chromosome 22 |
| 592B11 | 234 | 4611 | AI745230 | Hs.6187 | 1.00E−130 | 6 | wg10e05.x1 cDNA, 3' end/clone = IMAGE: 2364704 |
| 590F2 | 994 | 1625 | NM_004517 | Hs.6196 | 0 | 3 | integrin-linked kinase (ILK), mRNA/cds = (156, |
| 188A3 | 1550 | 2929 | M61906 | Hs.6241 | 0 | 3 | PI3-kinase associated p85 mRNA sequence |
| 103C12 | 502 | 1129 | AF246238 | Hs.6289 | 0 | 1 | HT027 mRNA, complete cds/cds = (260,784)/gb = A |
| 100C2 | 804 | 1111 | AK024539 | Hs.6289 | 1.00E−122 | 1 | FLJ20886 fis, clone ADKA03257/cds = (359, |
| 480A11 | 1149 | 1242 | AB032977 | Hs.6298 | 1.00E−46 | 1 | mRNA for KIAA1151 protein, partial cds/cds = (0 |
| 473C8 | 3944 | 4149 | NM_014859 | Hs.6336 | 1.00E−106 | 1 | KIAA0672 gene product (KIAA0672), mRNA/cds = ( |
| 125A10 | 1293 | 1766 | NM_006791 | Hs.6353 | 0 | 1 | MORF-related gene 15 (MRG15), mRNA/cds = (131,1 |
| 182F5 | 143 | 2118 | NM_018471 | Hs.6375 | 0 | 3 | uncharacterized hypothalamus protein HT010 |
| 587E8 | 398 | 2287 | NM_016289 | Hs.6406 | 0 | 7 | MO25 protein (LOC51719), mRNA/cds = (53,1078) |
| 135C3 | 2519 | 3084 | AF130110 | Hs.6456 | 0 | 2 | clone FLB6303 PRO1633 mRNA, complete cds/cds = DNA |
| 178B5 | 1744 | 2425 | AL117352 | Hs.6523 | 0 | 2 | seq from clone RP5-876B10 on chromosome 1q42 |
| 522F10 | 2392 | 2591 | NM_001183 | Hs.6551 | 1.00E−110 | 2 | ATPase, H+ transporting, lysosomal (vacuolar |
| 595C4 | 1676 | 2197 | NM_021008 | Hs.6574 | 0 | 4 | suppressin (nuclear deformed epidermal autor |
| 481F3 | 745 | 904 | AL117565 | Hs.6607 | 9.00E−82 | 1 | mRNA; cDNA DKFZp566F164 (from clone DKFZp566F1 |
| 124A3 | 1046 | 1575 | NM_017792 | Hs.6631 | 0 | 1 | hypothetical protein FLJ20373 (FLJ20373), mR |
| 177F11 | 1966 | 2281 | AB046844 | Hs.6639 | 1.00E−152 | 1 | for KIAA1624 protein, partial cds/cds = (0 |
| 521G7 | 4600 | 5210 | NM_014856 | Hs.6684 | 0 | 2 | KIAA0476 gene product (KIAA0476), mRNA/cds = ( |
| 54C6 | 265 | 756 | AB037801 | Hs.6685 | 0 | 1 | for KIAA1380 protein, partial cds/cds = (0 |
| 75F7 | 95 | 3507 | AB014560 | Hs.6727 | 0 | 4 | for KIAA0660 protein, complete cds/cds = ( |
| 477H12 | 2 | 457 | BF976590 | Hs.6749 | 0 | 1 | 602244267F1 cDNA, 5' end/clone = IMAGE: 4335353 |
| 60A1 | 1028 | 1307 | AB026908 | Hs.6790 | 1.00E−155 | 1 | for microvascular endothelial differenti |
| 100G9 | 341 | 454 | BE875609 | Hs.6820 | 2.00E−58 | 1 | 601487048F1 cDNA, 5' end/clone = IMAGE: 3889762 |
| 184F7 | 1259 | 1633 | AF056717 | Hs.6856 | 0 | 5 | ash2l2 (ASH2L2) mRNA, complete cds/cds = (295,1 |
| 195E7 | 1250 | 1711 | NM_004674 | Hs.6856 | 0 | 3 | ash2 (absent, small, or homeotic, Drosophila, |
| 135F11 | 328 | 600 | NM_020188 | Hs.6879 | 1.00E−151 | 1 | DC13 protein (DC13), mRNA/cds = (175,414)/gb = DKFZP434D156 |
| 172G2 | 1477 | 1782 | NM_015530 | Hs.6880 | 1.00E−169 | 1 | protein (DKFZP434D156), mRNA/c |
| 483G5 | 3712 | 3947 | AL031681 | Hs.6891 | 3.00E−72 | 1 | DNA sequence from clone 862K6 on chromosome 20q12−13.1 |
| 184B1 | 1 | 622 | AF006086 | Hs.6895 | 0 | 3 | Arp2/3 protein complex subunit p21-Arc (ARC21 |
| 599C12 | 1 | 622 | NM_005719 | Hs.6895 | 0 | 24 | actin related protein 2/3 complex, subunit 3 ( |
| 43A1 | 2111 | 2312 | AF037204 | Hs.6900 | 9.00E−78 | 1 | RING zinc finger protein (RZF) mRNA, complete c |
| 105F6 | 638 | 1209 | AK026850 | Hs.6906 | 0 | 1 | FLJ23197 fis, clone REC00917/cds = UNKNOW |
| 178G10 | 5939 | 6469 | AJ238403 | Hs.6947 | 0 | 1 | mRNA for huntingtin interacting protein 1/cd |
| 72A2 | 178 | 2992 | AF001542 | Hs.6975 | 0 | 9 | AF001542/clone = alpha_est218/52C1/gb = FLJ12506 |
| 37F2 | 1757 | 2397 | AK022568 | Hs.7010 | 0 | 1 | fis, clone NT2RM2001700, weakly |
| 598D3 | 1153 | 1299 | NM_004637 | Hs.7016 | 8.00E−56 | 1 | RAB7, member RAS oncogene family (RAB7), mRNA |
| 524C11 | 5542 | 5678 | AB033034 | Hs.7041 | 3.00E−72 | 1 | mRNA for KIAA1208 protein, partial cds/cds = (2 |
| 109E10 | 452 | 1093 | AF104921 | Hs.7043 | 0 | 1 | succinyl-CoA synthetase alpha subunit (SUCLA1 |
| 595F7 | 449 | 1150 | NM_003849 | Hs.7043 | 0 | 2 | succinate-CoA ligase, GDP-forming, alpha sub |
| 104H2 | 644 | 992 | NM_020194 | Hs.7045 | 1.00E−156 | 1 | GL004 protein (GL004), mRNA/cds = (72,728)/gb |
| 155C1 | 3322 | 3779 | AK024478 | Hs.7049 | 0 | 2 | FLJ00071 protein, partial cds/cds = (3 |
| 473B1 | 3029 | 3439 | AB051492 | Hs.7076 | 1.00E−152 | 1 | mRNA for KIAA1705 protein, partial cds/cds = (1 |
| 125E3 | 3612 | 3948 | AL390127 | Hs.7104 | 0 | 1 | mRNA; cDNA DKFZp761P06121 (from clone DKFZp761 |
| 499B11 | 1451 | 1852 | NM_021188 | Hs.7137 | 0 | 2 | clones 23667 and 23775 zinc finger protein (LOC |
| 52B12 | 1850 | 2178 | U90919 | Hs.7137 | 1.00E−174 | 1 | clones 23667 and 23775 zinc finger protein mRNA, compl |
| 486A11 | 855 | 1186 | NM_003904 | Hs.7165 | 1.00E−132 | 1 | zinc finger protein 259 (ZNF259), mRNA/cds = (2 |
| 460B6 | 2514 | 3182 | NM_021931 | Hs.7174 | 0 | 1 | hypothetical protein FLJ22759 (FLJ22759), mR |
| 592H8 | 3999 | 4524 | AB051544 | Hs.7187 | 0 | 2 | mRNA for KIAA1757 protein, partial cds/cds = (3 |
| 180A10 | 102 | 468 | AL117502 | Hs.7200 | 1.00E−141 | 3 | mRNA; cDNA DKFZp434D0935 (from clone DKFZp434 |
| 127A12 | 1503 | 2688 | AL035661 | Hs.7218 | 0 | 2 | DNA sequence from clone RP4-568C11 on chromosome 20p1 |
| 592G9 | 12 | 263 | NM_015953 | Hs.7236 | 1.00E−138 | 2 | CGI-25 protein (LOC51070), mRNA/cds = (44,949) |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 127E3 | 2624 | 4554 | AB028980 | Hs.7243 | 0 | 3 | mRNA for KIAA1057 protein, partial cds/cds = (0 |
| 135F2 | 5029 | 5175 | AB033050 | Hs.7252 | 3.00E−78 | 1 | mRNA for KIAA1224 protein, partial cds/cds = (0 |
| 57G1 | 2299 | 2723 | NM_014319 | Hs.7256 | 0 | 1 | integral inner nuclear membrane protein (MAN1 |
| 122D11 | 2920 | 3123 | AB014558 | Hs.7278 | 5.00E−74 | 1 | mRNA for KIAA0658 protein, partial cds/cds = (0 |
| 471H6 | 1 | 449 | AV702692 | Hs.7312 | 0 | 1 | AV702692 cDNA 5' end/clone = ADBBQC12/clone_ |
| 104G12 | 4314 | 4797 | AF084555 | Hs.7351 | 0 | 2 | okadaic acid-inducible and cAMP-regulated ph |
| 590G7 | 771 | 1259 | NM_005662 | Hs.7381 | 0 | 5 | voltage-dependent anion channel 3 (VDAC3), mR |
| 159H2 | 355 | 1252 | AL137423 | Hs.7392 | 0 | 3 | mRNA; cDNA DKFZp761E0323 (from clone DKFZp761E |
| 161F3 | 1708 | 2371 | NM_024045 | Hs.7392 | 0 | 1 | hypothetical protein MGC3199 (MGC3199), mRNA |
| 195E1 | 1107 | 1362 | NM_022736 | Hs.7503 | 1.00E−129 | 1 | hypothetical protein FLJ14153 (FLJ14153), mR |
| 137F5 | 59 | 666 | NM_018491 | Hs.7535 | 0 | 2 | COBW-like protein (LOC55871), mRNA/cds = (64,9 |
| 597E1 | 2302 | 2893 | AF126028 | Hs.7540 | 0 | 2 | unknown mRNA/cds = (0,1261)/gb = AF126028/gi = cDNA: |
| 473B6 | 3006 | 3302 | AK025615 | Hs.7567 | 1.00E−158 | 1 | FLJ21962 fis, clone HEP05564/cds = UNKNOW |
| 519H1 | 232 | 720 | BG112505 | Hs.7589 | 0 | 2 | 602282107F1 cDNA, 5' end/clone = IMAGE: 4369729 |
| 73A9 | 106 | 3912 | M20681 | Hs.7594 | 0 | 8 | glucose transporter-like protein-III (GLUT3), compl |
| 51D3 | 106 | 3200 | NM_006931 | Hs.7594 | 0 | 2 | solute carrier family 2 (facilitated glucose t |
| 596E8 | 1512 | 1748 | M94046 | Hs.7647 | 1.00E−129 | 2 | zinc finger protein (MAZ) mRNA/cds = UNKNOWN/ gb = M9404 |
| 472A8 | 1575 | 1983 | NM_004576 | Hs.7688 | 0 | 1 | protein phosphatase 2 (formerly 2A), regulator |
| 191A10 | 386 | 889 | NM_007278 | Hs.7719 | 0 | 3 | GABA(A) receptor-associated protein (GABARAP |
| 459C4 | 5636 | 5897 | AB002323 | Hs.7720 | 2.00E−87 | 1 | mRNA for KIAA0325 gene, partial cds/cds = (0,6265)/ gb |
| 99A12 | 606 | 1253 | NM_018453 | Hs.7731 | 0 | 1 | uncharacterized bone marrow protein BM036 (BM |
| 72G8 | 5806 | 6409 | AB007938 | Hs.7764 | 0 | 5 | for KIAA0469 protein, complete cds/cds = ( |
| 45G2 | 6168 | 6404 | NM_014851 | Hs.7764 | 1.00E−132 | 1 | KIAA0469 gene product (KIAA0469), mRNA/cds = ( |
| 172A4 | 371 | 588 | NM_007273 | Hs.7771 | 1.00E−107 | 1 | B-cell associated protein (REA), mRNA/cds = (9 |
| 177B8 | 2055 | 2431 | AK023166 | Hs.7797 | 0 | 1 | FLJ13104 fis, clone NT2RP3002343/cds = (28 |
| 99B6 | 865 | 1244 | NM_012461 | Hs.7797 | 0 | 1 | TERF1 (TRF1)-interacting nuclear factor 2 (T |
| 160G8 | 727 | 860 | U94855 | Hs.7811 | 5.00E−66 | 1 | translation initiation factor 3 47 kDa subunit |
| 54G6 | 1 | 1007 | AK001319 | Hs.7837 | 1.00E−148 | 3 | FLJ10457 fis, clone NT2RP1001424/cds = UN |
| 594A7 | 1295 | 1793 | NM_013446 | Hs.7838 | 0 | 4 | makorin, ring finger protein, 1 (MKRN1), mRNA |
| 188A12 | 1 | 2013 | NM_017761 | Hs.7862 | 0 | 3 | hypothetical protein FLJ20312 (FLJ20312), mR |
| 594A2 | 3060 | 3588 | AK023813 | Hs.7871 | 0 | 2 | cDNA FLJ13751 fis, clone PLACE3000339, weakly |
| 124C12 | 472 | 1251 | NM_001550 | Hs.7879 | 0 | 1 | interferon-related developmental regulator |
| 147A8 | 1381 | 1711 | Y10313 | Hs.7879 | 1.00E−134 | 1 | for PC4 protein (IFRD1 gene)/cds = (219,158 |
| 74H3 | 4430 | 4978 | AF302505 | Hs.7886 | 0 | 2 | pellino 1 (PELI1) mRNA, complete cds/cds = (4038 |
| 71G3 | 473 | 1112 | NM_016224 | Hs.7905 | 0 | 2 | SH3 and PX domain-containing protein SH3PX1 (S |
| 52C7 | 1637 | 2231 | AB029551 | Hs.7910 | 0 | 1 | YEAF1 mRNA for YY1 and E4TF1 associated factor |
| 177H5 | 5411 | 6045 | AB002321 | Hs.7911 | 0 | 1 | KIAA0323 gene, partial cds/cds = (0,2175)/gb |
| 114C8 | 1678 | 3078 | NM_017657 | Hs.7942 | 1.00E−149 | 2 | hypothetical protein FLJ20080 (FLJ20080), mR |
| 169D8 | 1453 | 2158 | AK001437 | Hs.7943 | 0 | 1 | FLJ10575 fis, clone NT2RP2003295, highly |
| 599G8 | 618 | 1204 | NM_003796 | Hs.7943 | 0 | 1 | RPB5-mediating protein (RMP), mRNA/cds = (465, |
| 127E11 | 107 | 796 | NM_016099 | Hs.7953 | 0 | 3 | HSPC041 protein (LOC51125), mRNA/cds = (141,45 |
| 98D6 | 4769 | 6506 | NM_001111 | Hs.7957 | 0 | 20 | adenosine deaminase, RNA-specific (ADAR), tr |
| 37H10 | 2479 | 6594 | X79448 | Hs.7957 | 0 | 8 | IFI-4 mRNA for type I protein/cds = (1165,3960)/g |
| 178G4 | 4209 | 5132 | AB028981 | Hs.8021 | 0 | 4 | mRNA for KIAA1058 protein, partial cds/cds = (0 |
| 118E9 | 630 | 1688 | NM_006083 | Hs.8024 | 0 | 2 | IK cytokine, down-regulator of HLA II (IK), mRN |
| 171A8 | 1658 | 1973 | AK002026 | Hs.8033 | 1.00E−151 | 1 | FLJ11164 fis, clone PLACE1007226, weakly |
| 103G5 | 1504 | 1977 | NM_018346 | Hs.8033 | 0 | 1 | hypothetical protein FLJ11164 (FLJ11164), mR |
| 179G7 | 2860 | 3032 | AK022497 | Hs.8068 | 6.00E−46 | 1 | FLJ12435 fis, clone NT2RM1000059/cds = (88 |
| 594A11 | 2327 | 2658 | NM_018210 | Hs.8083 | 1.00E−167 | 1 | hypothetical protein FLJ10769 (FLJ10769), mR |
| 103B5 | 1968 | 2448 | AF267856 | Hs.8084 | 0 | 1 | HT033 mRNA, complete cds/cds = (203,931)/gb = A |
| 98E4 | 1367 | 1808 | AF113008 | Hs.8102 | 0 | 7 | clone FLB0708 mRNA sequence/cds = UNKNOWN/ gb = erbb2-interacting |
| 191H10 | 4581 | 5819 | NM_018695 | Hs.8117 | 0 | 3 | protein ERBIN (LOC55914), |
| 99F1 | 550 | 2672 | AB014550 | Hs.8118 | 0 | 4 | mRNA for KIAA0650 protein, partial cds/cds = (0 |
| 165H11 | 488 | 663 | NM_024408 | Hs.8121 | 3.00E−93 | 1 | Notch (Drosophila) homolog 2 (NOTCH2), mRNA/ |
| 515C7 | 2188 | 2514 | AL050371 | Hs.8128 | 1.00E−114 | 1 | mRNA; cDNA DKFZp566G2246 (from clone DKFZp566G |
| 166A12 | 234 | 1196 | AF131856 | Hs.8148 | 1.00E−155 | 2 | clone 24856 mRNA sequence, complete cds/cds = ( |
| 520H8 | 512 | 712 | NM_016275 | Hs.8148 | 1.00E−110 | 1 | selenoprotein T (LOC51714), mRNA/cds = (138,62 |
| 592D4 | 1 | 735 | NM_014886 | Hs.8170 | 1.00E−152 | 3 | hypothetical protein (YR-29), mRNA/cds = (82,8 |
| 105F12 | 349 | 760 | AK001665 | Hs.8173 | 0 | 1 | FLJ10803 fis, clone NT2RP4000833/cds = (1 |
| 75A7 | 737 | 1458 | AF000652 | Hs.8180 | 0 | 1 | syntenin (sycl) mRNA, complete cds/cds = (148,1 |
| 64H5 | 105 | 618 | NM_005625 | Hs.8180 | 0 | 3 | syndecan binding protein (syntenin) (SDCBP), |
| 61G9 | 3147 | 3660 | AB018339 | Hs.8182 | 0 | 2 | for KIAA0796 protein, partial cds/cds = (0 |
| 39G2 | 255 | 1675 | AF042284 | Hs.8185 | 0 | 4 | unknown mRNA/cds = (76,1428)/gb = AF042284/gi |
| 192G5 | 1054 | 1580 | NM_021199 | Hs.8185 | 0 | 8 | CGI-44 protein; sulfide dehydrogenase like (y |
| 109D3 | 1463 | 2503 | AF269150 | Hs.8203 | 0 | 2 | transmembrane protein TM9SF3 (TM9SF3) mRNA, c |
| 115H4 | 1251 | 3187 | NM_020123 | Hs.8203 | 0 | 12 | endomembrane protein emp70 precursor isolog ( |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 113F12 | 2349 | 3576 | AL355476 | Hs.8217 | 4.00E−35 | 2 | DNA sequence from clone RP11-517O1 on chromosome X Co |
| 125D5 | 582 | 1050 | NM_005006 | Hs.8248 | 0 | 1 | NADH dehydrogenase (ubiquinone) Fe-S protein |
| 460D3 | 4851 | 5043 | AF035947 | Hs.8257 | 7.00E−76 | 1 | cytokine-inducible inhibitor of signalling t |
| 111E7 | 729 | 3182 | NM_013995 | Hs.8262 | 0 | 2 | lysosomal-associated membrane protein 2 (LAM |
| 590F10 | 3012 | 4133 | AK022790 | Hs.8309 | 0 | 6 | cDNA FLJ12728 fis, clone NT2RP2000040, highly |
| 109B1 | 138 | 476 | AW973507 | Hs.8360 | 1.00E−161 | 1 | EST385607/gb = AW973507/gi = 8164686/ug = for |
| 61A3 | 1137 | 1649 | AB033017 | Hs.8594 | 0 | 1 | KIAA1191 protein, partial cds/cds = (0 |
| 523E12 | 905 | 2998 | NM_007271 | Hs.8724 | 0 | 4 | serine threonine protein kinase (NDR), mRNA/ |
| 590G2 | 3618 | 3932 | NM_018031 | Hs.8737 | 1.00E−166 | 3 | WD repeat domain 6 (WDR6), mRNA/cds = (39,3404) |
| 464C3 | 2299 | 2494 | NM_018255 | Hs.8739 | 1.00E−107 | 1 | hypothetical protein FLJ10879 (FLJ10879), mR |
| 128H8 | 1580 | 1711 | NM_018450 | Hs.8740 | 2.00E−64 | 1 | uncharacterized bone marrow protein BM029 (BM |
| 179D3 | 921 | 1457 | AF083255 | Hs.8765 | 0 | 1 | RNA helicase-related protein complete c |
| 195H11 | 1247 | 1481 | NM_007269 | Hs.8813 | 1.00E−100 | 1 | syntaxin binding protein 3 (STXBP3), mRNA/cds |
| 460F1 | 68 | 308 | AA454036 | Hs.8832 | 1.00E−105 | 1 | zx48b04.r1 cDNA, 5' end/clone = IMAGE: 795439/ |
| 110E10 | 3672 | 5371 | AB032252 | Hs.8858 | 0 | 3 | BAZ1A mRNA for bromodomain adjacent to zinc fi |
| 113D1 | 4814 | 5890 | NM_013448 | Hs.8858 | 0 | 2 | bromodomain adjacent to zinc finger domain, 1A |
| 120H7 | 373 | 633 | NM_017748 | Hs.8928 | 1.00E−143 | 1 | hypothetical protein FLJ20291 (FLJ20291), mR |
| 470F10 | 1670 | 2260 | NM_003917 | Hs.8991 | 0 | 2 | adaptor-related protein complex 1, gamma 2 su |
| 72H11 | 1785 | 2418 | M11717 | Hs.8997 | 1.00E−147 | 23 | heat shock protein (hsp 70) gene, complete cds/cds = (2 |
| 49H4 | 1769 | 2243 | NM_005345 | Hs.8997 | 1.00E−145 | 12 | heat shock 70 kD protein 1A (HSPA1A), mRNA/cds = VAMP |
| 519E7 | 270 | 729 | NM_003574 | Hs.9006 | 0 | 1 | (vesicle-associated membrane protein)-a |
| 142E2 | 1265 | 1518 | AK022215 | Hs.9043 | 1.00E−107 | 1 | FLJ12153 fis, clone MAMMA1000458/cds = UNK |
| 108B9 | 1160 | 1823 | AJ002030 | Hs.9071 | 0 | 1 | for putative progesterone binding protein |
| 47C7 | 452 | 795 | AB011420 | Hs.9075 | 0 | 1 | for DRAK1, complete cds/cds = (117,1361)/ |
| 590A4 | 791 | 1377 | NM_004760 | Hs.9075 | 0 | 4 | serine/threonine kinase 17a (apoptosis-induc |
| 168D11 | 1000 | 1641 | NM_017426 | Hs.9082 | 0 | 1 | nucleoporin p54 (NUP54), mRNA/cds = (25,1542) |
| 63H9 | 799 | 1163 | Y17829 | Hs.9192 | 0 | 1 | for Homer-related protein Syn47/cds = (75, |
| 167B11 | 1466 | 1863 | NM_006251 | Hs.9247 | 0 | 1 | protein kinase, AMP-activated, alpha 1 cataly |
| 196D5 | 1021 | 1492 | AK024327 | Hs.9343 | 0 | 1 | cDNA FLJ14265 fis, clone PLACE1002256/cds = UNK |
| 192F3 | 245 | 790 | NM_017983 | Hs.9398 | 0 | 1 | hypothetical protein FLJ10055 (FLJ10055), mR |
| 121C3 | 3381 | 3567 | AF217190 | Hs.9414 | 3.00E−90 | 1 | MLEL1 protein (MLEL1) mRNA, complete cds/cds = SWI/SNF |
| 196B6 | 959 | 1551 | NM_003601 | Hs.9456 | 0 | 1 | related, matrix associated, actin dep |
| 331B5 | 2624 | 2950 | AF027302 | Hs.9573 | 1.00E−179 | 1 | TNF-alpha stimulated ABC protein (ABC50) mRNA |
| 592E11 | 1 | 479 | NM_002520 | Hs.9614 | 1.00E−139 | 7 | nucleophosmin (nucleolar phosphoprotein B23 |
| 515D6 | 1739 | 2091 | AB037796 | Hs.9663 | 1.00E−160 | 1 | mRNA for KIAA1375 protein, partial cds/cds = (0 |
| 124A5 | 1387 | 1762 | NM_012068 | Hs.9754 | 0 | 2 | activating transcription factor 5 (ATF5), mRN |
| 122A7 | 1484 | 1928 | AB028963 | Hs. 9846 | 1.00E−154 | 1 | mRNA for KIAA1040 protein, partial cds/cds = (0 |
| 591E2 | 1626 | 2194 | AF123073 | Hs. 9851 | 0 | 5 | C/EBP-induced protein mRNA, complete cds/cds |
| 111G2 | 4208 | 5361 | AB033076 | Hs. 9873 | 0 | 2 | mRNA for KIAA1250 protein, partial cds/cds = (0 |
| 469D5 | 932 | 3551 | AK022758 | Hs. 9908 | 1.00E−178 | 6 | cDNA FLJ12696 fis, clone NT2RP1000513, highly |
| 590D5 | 172 | 742 | NM_001425 | Hs. 9999 | 2.00E−94 | 2 | epithelial membrane protein 3 (EMP3), mRNA/c |
| 112E7 | 1065 | 1753 | NM_001814 | Hs. 10029 | 0 | 1 | cathepsin C (CTSC), mRNA/cds = (33,1424)/gb = N |
| 106C7 | 1066 | 1641 | X87212 | Hs. 10029 | 0 | 1 | cathepsin C/cds = (33,1424)/gb = X87212/ |
| 127B1 | 1003 | 1429 | NM_014959 | Hs. 10031 | 0 | 1 | KIAA0955 protein (KIAA0955), mRNA/cds = (313,1 |
| 462E5 | 332 | 487 | AW293461 | Hs. 10041 | 3.00E−46 | 1 | UI-H-BI2-ahm-e-02-0-UI.s1 cDNA, 3' end/clon |
| 190E3 | 101 | 356 | NM_016551 | Hs. 10071 | 6.00E−98 | 1 | seven transmembrane protein TM7SF3 (TM7SF3), |
| 61B6 | 2571 | 2764 | AL163249 | Hs. 10175 | 7.00E−94 | 1 | chromosome 21 segment HS21C049/cds = (128,2599 |
| 110F6 | 5310 | 5808 | D87432 | Hs. 10315 | 0 | 1 | KIAA0245 gene, complete cds/cds = (261,1808) |
| 196E10 | 5312 | 5753 | NM_003983 | Hs. 10315 | 0 | 1 | solute carrier family 7 (cationic amino acid t |
| 49D8 | 315 | 2207 | AK024597 | Hs. 10362 | 0 | 3 | cDNA: FLJ20944 fis, clone ADSE01780/cds = UNKNO |
| 129C7 | 1000 | 1364 | AB018249 | Hs. 10458 | 0 | 1 | CC chemokine LEC, complete cds/cds = (1 |
| 62F11 | 1239 | 2034 | AL031685 | Hs. 10590 | 0 | 2 | DNA sequence from clone RP5-963K23 on chromosome 20q1 |
| 460D5 | 86 | 815 | AL357374 | Hs. 10600 | 0 | 4 | DNA sequence from clone RP11-353C18 on chromosome 20 |
| 179C12 | 3765 | 4300 | AK000005 | Hs. 10647 | 0 | 2 | FLJ00005 protein, partial cds/cds = (0 |
| 482D12 | 1753 | 2359 | NM_004848 | Hs. 10649 | 0 | 1 | basement membrane-induced gene (ICB-1), mRNA |
| 184F4 | 2686 | 3194 | AL137721 | Hs. 10702 | 0 | 1 | mRNA; cDNA DKFZp761H221 (from clone DKFZp761H2 |
| 186F10 | 2688 | 3084 | NM_017601 | Hs. 10702 | 1.00E−137 | 2 | hypothetical protein DKFZp761H221 (DKFZp761H |
| 461E3 | 593 | 1110 | NM_021821 | Hs. 10724 | 0 | 1 | MDS023 protein (MDS023), mRNA/cds = (335,1018) |
| 598D5 | 660 | 1191 | NM_014306 | Hs. 10729 | 0 | 2 | hypothetical protein (HSPC117), mRNA/cds = (75 |
| 125D9 | 104 | 397 | NM_002495 | Hs. 10758 | 1.00E−165 | 1 | NADH dehydrogenase (ubiquinone) Fe-S protein |
| 36A7 | 172 | 1114 | NM_006325 | Hs. 10842 | 0 | 11 | RAN, member RAS oncogene familyRAN, member RAS |
| 54H1 | 240 | 1467 | NM_012257 | Hs. 10882 | 0 | 2 | HMG-box containing protein 1 (HBP1), mRNA/cds |
| 596B8 | 1186 | 1895 | AK025212 | Hs. 10888 | 0 | 17 | cDNA: FLJ21559 fis, clone COL06406/cds = UNKNOW |
| 458G7 | 989 | 1492 | Z78330 | Hs. 10927 | 0 | 1 | HSZ78330 cDNA/clone = 2.49-(CEPH)/gb = Z78330 |
| 115D2 | 308 | 638 | BF793378 | Hs. 10957 | 1.00E−102 | 1 | 602254823F1 cDNA, 5' end/clone = IMAGE: 4347076 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 148H9 | 226 | 863 | AF021819 | Hs. 10958 | 0 | 1 | RNA-binding protein regulatory subunit mRNA, |
| 173D5 | 356 | 816 | NM_007262 | Hs. 10958 | 0 | 1 | RNA-binding protein regulatory subunit (DJ-1 |
| 39B7 | 1553 | 2256 | AF063605 | Hs. 11000 | 0 | 1 | brain my047 protein mRNA, complete cds/cds = (8 |
| 592H5 | 1553 | 2257 | NM_015344 | Hs. 11000 | 0 | 3 | MY047 protein (MY047), mRNA/cds = (84,479)/gb |
| 112G3 | 2591 | 3180 | AB046813 | Hs. 11123 | 0 | 1 | mRNA for KIAA1593 protein, partial cds/cds = (4 |
| 592E8 | 251 | 725 | NM_014041 | Hs. 11125 | 0 | 2 | HSPC033 protein (HSPC033), mRNA/cds = (168,443 |
| 477A2 | 1610 | 1697 | NM_003100 | Hs. 11183 | 8.00E−43 | 2 | sorting nexin 2 (SNX2), mRNA/cds = (29,1588)/g |
| 41G4 | 6498 | 6751 | AB014522 | Hs. 11238 | 1.00E−142 | 1 | for KIAA0622 protein, partial cds/cds = (0 |
| 519A3 | 759 | 987 | NM_018371 | Hs. 11260 | 1.00E−127 | 1 | hypothetical protein FLJ11264 (FLJ11264), mR |
| 175B4 | 404 | 688 | BE788546 | Hs. 11355 | 4.00E−75 | 1 | 601476186F1 cDNA, 5' end/clone = IMAGE: 3878948 |
| 114F11 | 245 | 401 | BF665055 | Hs. 11356 | 4.00E−55 | 1 | 602119656F1 cDNA, 5' end/clone = IMAGE: 4276860 |
| 40D2 | 96 | 824 | U59808 | Hs. 11383 | 0 | 1 | monocyte chemotactic protein-4 precursor (MCP-4) mR |
| 109C3 | 767 | 2345 | M74002 | Hs. 11482 | 0 | 2 | arginine-rich nuclear protein mRNA, complete cds/cds |
| 117G9 | 408 | 2345 | NM_004768 | Hs. 11482 | 0 | 8 | splicing factor, arginine/serine-rich 11 (SF |
| 458G6 | 2053 | 2164 | AK022628 | Hs. 11556 | 1.00E−54 | 1 | cDNA FLJ12566 fis, clone NT2RM4000852/cds = UNK |
| 181E7 | 644 | 1004 | AK021632 | Hs. 11571 | 1.00E−167 | 1 | cDNA FLJ11570 fis, clone HEMBA1003309/cds = UNK |
| 458B3 | 85 | 522 | R12665 | Hs. 11594 | 1.00E−137 | 1 | yf40a04.s1 cDNA, 3' end/clone = IMAGE: 129294/ |
| 146B6 | 498 | 677 | BE794595 | Hs. 11607 | 5.00E−82 | 1 | 601590368F1 5' end/clone = IMAGE: 3944489 |
| 516F12 | 388 | 711 | BG288429 | Hs. 11637 | 1.00E−132 | 1 | 602388093F1 cDNA, 5' end/clone = IMAGE: 4517086 |
| 60B1 | 1291 | 1882 | NM_005121 | Hs. 11861 | 0 | 1 | thyroid hormone receptor-associated protein, |
| 44C6 | 2613 | 2834 | NM_000859 | Hs. 11899 | 9.00E−72 | 1 | 3-hydroxy-3-methylglutaryl-Coenzyme A reduc |
| 39F10 | 1 | 221 | BF668230 | Hs. 12035 | 1.00E−120 | 2 | 602122419F1 cDNA, 5' end/clone = IMAGE: 4279300 |
| 596D8 | 234 | 849 | U72514 | Hs. 12045 | 0 | 2 | C2f mRNA, complete cds |
| 481E7 | 1902 | 2190 | AB028986 | Hs. 12064 | 1.00E−151 | 1 | mRNA for KIAA1063 protein, partial cds/cds = (0 |
| 465D9 | 2529 | 2699 | NM_004003 | Hs. 12068 | 8.00E−91 | 1 | carnitine acetyltransferase (CRAT), nuclear |
| 116H8 | 283 | 738 | NM_003321 | Hs. 12084 | 0 | 1 | Tu translation elongation factor, mitochondri |
| 44A4 | 319 | 836 | S75463 | Hs. 12084 | 0 | 1 | P43 = mitochondrial elongation factor homolog [human, live |
| 114F7 | 4254 | 4495 | AL137753 | Hs. 12144 | 1.00E−115 | 1 | mRNA; cDNA DKFZp434K1412 (from clone DKFZp434K |
| 123F12 | 1 | 219 | NM_021203 | Hs. 12152 | 1.00E−114 | 1 | APMCF1 protein (APMCF1), mRNA/cds = (82,225)/ |
| 519H7 | 166 | 753 | AK025775 | Hs. 12245 | 0 | 1 | cDNA: FLJ22122 fis, clone HEP19214/cds = UNKNOW |
| 70E3 | 953 | 4720 | AB014530 | Hs. 12259 | 0 | 3 | for KIAA0630 protein, partial cds/cds = (0 |
| 107H1 | 680 | 1078 | AK024756 | Hs. 12293 | 0 | 1 | FLJ21103 fis, clone CAS04883/cds = (107,1 |
| 71E5 | 4750 | 5283 | NM_003170 | Hs. 12303 | 0 | 1 | suppressor of Ty (S. cerevisiae) 6 homolog (SUP |
| 106F3 | 977 | 1490 | AL050272 | Hs. 12305 | 0 | 1 | cDNA DKFZp566B183 (from clone DKFZp566B1 |
| 481F4 | 1859 | 2403 | NM_015509 | Hs. 12305 | 0 | 1 | DKFZP566B183 protein (DKFZP566B183), mRNA/c |
| 114D3 | 1271 | 1520 | AF038202 | Hs. 12311 | 1.00E−118 | 1 | clone 23570 mRNA sequence/cds = UNKNOWN/ gb = AF0 |
| 463B9 | 1006 | 1224 | AK021670 | Hs. 12315 | 1.00E−121 | 1 | cDNA FLJ11608 fis, clone HEMBA1003976/cds = (56 |
| 167A8 | 71 | 723 | BG034192 | Hs. 12396 | 0 | 2 | 602302446F1 cDNA, 5' end/clone = IMAGE: 4403866 |
| 460E9 | 3808 | 4166 | D83776 | Hs. 12413 | 1.00E−176 | 1 | mRNA for KIAA0191 gene, partial cds/cds = (0,4552)/ gb |
| 157E1 | 1887 | 3154 | NM_020403 | Hs. 12450 | 0 | 3 | cadherin superfamily protein VR4-11 (LOC57123 |
| 69F11 | 2715 | 3447 | AK001676 | Hs. 12457 | 0 | 1 | FLJ10814 fis, clone NT2RP4000984/cds = (92 |
| 118B8 | 5781 | 6374 | AB032973 | Hs. 12461 | 0 | 1 | mRNA for KIAA1147 protein, partial cds/cds = (0 |
| 193G12 | 2069 | 2368 | NM_005993 | Hs. 12570 | 1.00E−169 | 1 | tubulin-specific chaperone d (TBCD), mRNA/cd |
| 459D11 | 2828 | 3122 | NM_021151 | Hs. 12743 | 1.00E−147 | 1 | carnitine octanoyltransferase (COT), mRNA/c |
| 196H4 | 1 | 5439 | AB046785 | Hs. 12772 | 0 | 2 | mRNA for KIAA1565 protein, partial cds/cds = (0 |
| 56G11 | 458 | 1088 | AL080156 | Hs. 12813 | 0 | 1 | cDNA DKFZp434J214 (from clone DKFZp434J2 |
| 476E6 | 1221 | 1638 | NM_006590 | Hs. 12820 | 0 | 1 | SnRNP assembly defective 1 homolog (SAD1), mRN |
| 109E7 | 1 | 180 | AF208855 | Hs. 12830 | 3.00E−79 | 1 | BM-013 mRNA, complete cds/cds = (67,459)/gb = A |
| 458A2 | 1818 | 2276 | AK026747 | Hs. 12969 | 0 | 1 | cDNA: FLJ23094 fis, clone LNG07379, highly sim |
| 466D10 | 1469 | 1745 | AK001822 | Hs. 12999 | 9.00E−39 | 1 | cDNA FLJ10960 fis, clone PLACE1000564/cds = UNK |
| 187A11 | 1866 | 2555 | NM_003330 | Hs. 13046 | 0 | 2 | thioredoxin reductase 1 (TXNRD1), mRNA/cds = ( |
| 60D9 | 1757 | 3508 | X91247 | Hs. 13046 | 0 | 3 | thioredoxin reductase/cds = (439,1932) |
| 75D7 | 2071 | 2550 | AF055581 | Hs. 13131 | 0 | 1 | adaptor protein Lnk mRNA, complete cds/cds = (3 |
| 196C2 | 190 | 845 | AK026239 | Hs. 13179 | 0 | 2 | cDNA: FLJ22586 fis, clone HSI02774/cds = UNKNOW |
| 480G6 | 11 | 380 | AL570416 | Hs. 13256 | 1.00E−161 | 1 | AL570416 cDNA/clone = CS0DI020YK05-(3-prime) |
| 196H3 | 2814 | 3382 | AB020663 | Hs. 13264 | 0 | 1 | mRNA for KIAA0856 protein, partial cds/cds = (0 |
| 460H3 | 127 | 431 | BF029796 | Hs. 13268 | 1.00E−151 | 1 | 601556721F1 cDNA, 5' end/clone = IMAGE: 3826637 |
| 170B2 | 1487 | 1635 | AB011164 | Hs. 13273 | 1.00E−69 | 1 | for KIAA0592 protein, partial cds/cds = (0, |
| 115E6 | 2153 | 2376 | AK025707 | Hs. 13277 | 1.00E−124 | 1 | cDNA: FLJ22054 fis, clone HEP09634/cds = (144,9 |
| 110F10 | 119 | 648 | BE537908 | Hs. 13328 | 0 | 1 | 601067373F1 cDNA, 5' end/clone = IMAGE: 3453594 |
| 36C2 | 427 | 4137 | AF054284 | Hs. 13453 | 0 | 5 | spliceosomal protein SAP 155 mRNA, complete cd |
| 594C3 | 5 | 4229 | NM_012433 | Hs. 13453 | 0 | 10 | splicing factor 3b, subunit 1, 155 kD (SF3B1), m |
| 110C6 | 4 | 1853 | AF131753 | Hs. 13472 | 0 | 5 | clone 24859 mRNA sequence/cds = UNKNOWN/ gb = AF |
| 173B6 | 1156 | 1672 | NM_013236 | Hs. 13493 | 0 | 1 | like mouse brain protein E46 (E46L), mRNA/cds = |
| 462C4 | 794 | 1093 | BC001909 | Hs. 13580 | 1.00E−115 | 1 | clone IMAGE: 3537447, mRNA, partial cds/cds = |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 597H11 | 412 | 936 | NM_014174 | Hs. 13645 | 0 | 1 | HSPC144 protein (HSPC144), mRNA/cds = (446,112 |
| 107F8 | 429 | 821 | AK025767 | Hs. 13755 | 0 | 1 | FLJ22114 fis, clone HEP18441/cds = UNKNOW |
| 102D12 | 3153 | 4764 | AF000993 | Hs. 13980 | 0 | 2 | ubiquitous TPR motif, X isoform (UTX) mRNA, alt |
| 515G12 | 1710 | 2120 | AK025425 | Hs. 14040 | 0 | 2 | cDNA: FLJ21772 fis, clone COLF7808/cds = UNKNOW |
| 480H5 | 1945 | 2259 | AK024228 | Hs. 14070 | 1.00E−119 | 1 | cDNA FLJ14166 fis, clone NT2RP1000796/cds = (20 |
| 61D1 | 73 | 499 | NM_014245 | Hs. 14084 | 0 | 1 | ring finger protein 7 (RNF7), mRNA/cds = (53,394 |
| 122E4 | 2162 | 2685 | NM_014454 | Hs. 14125 | 0 | 1 | p53 regulated PA26 nuclear protein (PA26), mRN |
| 123D9 | 22 | 722 | NM_001161 | Hs. 14142 | 0 | 1 | nudix (nucleoside diphosphate linked moiety |
| 460F11 | 1084 | 1322 | NM_017827 | Hs. 14220 | 4.00E−74 | 1 | hypothetical protein FLJ20450 (FLJ20450), mR |
| 458D2 | 127 | 536 | NM_018648 | Hs. 14317 | 0 | 1 | nucleolar protein family A, member 3 (H/ACA sm |
| 167G1 | 30 | 198 | AK022939 | Hs. 14347 | 3.00E−91 | 1 | cDNA FLJ12877 fis, clone NT2RP2003825/cds = (3 |
| 117H10 | 975 | 1721 | NM_003022 | Hs. 14368 | 0 | 1 | SH3 domain binding glutamic acid-rich protein |
| 591B12 | 1082 | 1801 | NM_001614 | Hs. 14376 | 0 | 9 | actin, gamma 1 (ACTG1), mRNA/cds = (74,1201)/g |
| 179H3 | 1160 | 1791 | X04098 | Hs. 14376 | 1.00E−178 | 5 | cytoskeletal gamma-actin/cds = (73,1200)/g |
| 116D9 | 5818 | 6073 | NM_012199 | Hs. 14520 | 5.00E−84 | 1 | eukaryotic translation initiation factor 2C, |
| 64D11 | 1901 | 2506 | NM_003592 | Hs. 14541 | 0 | 1 | cullin 1 (CUL1), mRNA/cds = (124,2382)/gb = NM_0 |
| 516F4 | 750 | 1331 | AK025166 | Hs. 14555 | 0 | 1 | cDNA: FLJ21513 fis, clone COL05778/cds = UNKNOW |
| 459G5 | 1 | 260 | AK025269 | Hs. 14562 | 5.00E−88 | 1 | cDNA: FLJ21616 fis, clone COL07477/cds = (119,1 |
| 521B7 | 7 | 1825 | NM_005335 | Hs. 14601 | 0 | 8 | hematopoietic cell-specific Lyn substrate 1 |
| 110D7 | 7 | 1295 | X16663 | Hs. 14601 | 0 | 3 | HS1 gene for heamatopoietic lineage cell specific pro |
| 114D11 | 1460 | 1559 | NM_003584 | Hs. 14611 | 1.00E−45 | 1 | dual specificity phosphatase 11 (RNA/RNP comp |
| 589A3 | 1665 | 2197 | NM_016293 | Hs. 14770 | 0 | 2 | bridging integrator 2 (BIN2), mRNA/cds = (38,17 |
| 104C8 | 2113 | 2380 | AB031050 | Hs. 14805 | 1.00E−135 | 2 | for organic anion transporter OATP-D, com |
| 481D10 | 2466 | 2694 | NM_013272 | Hs. 14805 | 1.00E−68 | 1 | solute carrier family 21 (organic anion transp |
| 125B2 | 2704 | 3183 | NM_001455 | Hs. 14845 | 0 | 1 | forkhead box O3A (FOXO3A), mRNA/cds = (924,2945 |
| 500D7 | 2174 | 2379 | AL050021 | Hs. 14846 | 1.00E−100 | 1 | mRNA; cDNA DKFZp564D016 (from clone DKFZp564D0 |
| 123B5 | 1793 | 2195 | NM_016598 | Hs. 14896 | 0 | 1 | DHHC1 protein (LOC51304), mRNA/cds = (214,1197 |
| 499E2 | 1266 | 1549 | AB020644 | Hs. 14945 | 1.00E−155 | 3 | mRNA for KIAA0837 protein, partial cds/cds = (0 |
| 123H6 | 2980 | 3652 | NM_007192 | Hs. 14963 | 0 | 3 | chromatin-specific transcription elongation |
| 61G10 | 264 | 528 | D13627 | Hs. 15071 | 1.00E−144 | 1 | KIAA0002 gene, complete cds/cds = (28,1674)/ |
| 460D10 | 2162 | 4305 | NM_014837 | Hs. 15087 | 0 | 4 | KIAA0250 gene product (KIAA0250), mRNA/cds = ( |
| 176E12 | 9289 | 9739 | NM_022473 | Hs. 15220 | 0 | 1 | zinc finger protein 106 (ZFP106), mRNA/cds = (3 |
| 487E11 | 1561 | 1989 | NM_006170 | Hs. 15243 | 0 | 1 | nucleolar protein 1 (120 kD) (NOL1), mRNA/cds = |
| 75E11 | 1628 | 2201 | AF127139 | Hs. 15259 | 0 | 20 | Bcl-2-binding protein BIS (BIS) mRNA, complete |
| 71H9 | 1656 | 2532 | NM_004281 | Hs. 15259 | 0 | 12 | BCL2-associated athanogene 3 (BAG3), mRNA/cd |
| 484G9 | 465 | 1006 | NM_005826 | Hs. 15265 | 0 | 1 | heterogeneous nuclear ribonucleoprotein R ( |
| 480H8 | 2013 | 2635 | AB037828 | Hs. 15370 | 0 | 1 | mRNA for KIAA1407 protein, partial cds/cds = (0 |
| 587G9 | 2436 | 2769 | AK024088 | Hs. 15423 | 1.00E−167 | 1 | cDNA FLJ14026 fis, clone HEMBA1003679, weakly |
| 483D6 | 5239 | 5810 | NM_004774 | Hs. 15589 | 0 | 1 | PPAR binding protein (PPARBP), mRNA/cds = (235, |
| 514A7 | 673 | 942 | NM_006833 | Hs. 15591 | 1.00E−151 | 1 | COP9 subunit 6 (MOV34 homolog, 34 kD) (MOV34-34 |
| 125A2 | 522 | 746 | NM_024348 | Hs. 15961 | 1.00E−112 | 1 | dynactin 3 (p22) (DCTN3), transcript variant |
| 591A5 | 295 | 704 | NM_005005 | Hs. 15977 | 0 | 3 | NADH dehydrogenase (ubiquinone) 1 beta subcom |
| 39H12 | 1641 | 1993 | X74262 | Hs. 16003 | 1.00E−180 | 1 | RbAp48 mRNA encoding retinoblastoma binding prot |
| 113A9 | 1328 | 1891 | NM_016334 | Hs. 16085 | 0 | 1 | putative G-protein coupled receptor (SH120), |
| 45C2 | 765 | 1674 | NM_006461 | Hs. 16244 | 0 | 2 | mitotic spindle coiled-coil related protein ( |
| 494H10 | 113 | 2576 | NM_016312 | Hs. 16420 | 0 | 3 | Npw38-binding protein NpwBP (LOC51729), mRNA |
| 40D8 | 52 | 246 | Y13710 | Hs. 16530 | 1.00E−107 | 1 | for alternative activated macrophage spe |
| 597E7 | 244 | 524 | AL523085 | Hs. 16648 | 1.00E−147 | 1 | AL523085 cDNA/clone = CS0DC001YF21-(5-prime) |
| 458D11 | 232 | 319 | AY007106 | Hs. 16773 | 1.00E−42 | 1 | clone TCCCIA00427 mRNA sequence/cds = UNKNOWN |
| 70F2 | 824 | 991 | AL021786 | Hs. 17109 | 2.00E−90 | 2 | DNA sequence from PAC 696H22 on chromosome Xq21.1−21.2 |
| 167C5 | 5768 | 5905 | D86964 | Hs. 17211 | 3.00E−62 | 1 | mRNA for KIAA0209 gene, partial cds/cds = (0,5530)/gb |
| 460H2 | 3424 | 3624 | AL162070 | Hs. 17377 | 1.00E−103 | 1 | mRNA; cDNA DKFZp762H186 (from clone DKFZp762H1 |
| 70G11 | 1384 | 1885 | AK023680 | Hs. 17448 | 0 | 2 | FLJ13618 fis, clone PLACE1010925/cds = UNK |
| 129C11 | 2458 | 3044 | U47924 | Hs. 17483 | 0 | 2 | chromosome 12p13 sequence/cds = (194,1570)/gb = U4792 |
| 467H3 | 4713 | 4908 | NM_014521 | Hs. 17667 | 1.00E−61 | 1 | SH3-domain binding protein 4 (SH3BP4), mRNA/ |
| 71A11 | 100 | 370 | BG035218 | Hs. 17719 | 1.00E−142 | 1 | 602324727F1 cDNA, 5' end/clone = IMAGE: 4412910 |
| 598C7 | 513 | 902 | NM_021622 | Hs. 17757 | 1.00E−178 | 1 | pleckstrin homology domain-containing, fami |
| 595A7 | 3296 | 5680 | AB046774 | Hs. 17767 | 0 | 5 | mRNA for KIAA1554 protein, partial cds/cds = (0 |
| 58D12 | 5225 | 5857 | AB007861 | Hs. 17803 | 0 | 1 | KIAA0401 mRNA, partial cds/cds = (0,1036)/gb = |
| 524G8 | 357 | 809 | NM_014350 | Hs. 17839 | 0 | 1 | TNF-induced protein (GG2-1), mRNA/cds = (197,7 |
| 521B10 | 1008 | 1476 | NM_002707 | Hs. 17883 | 0 | 2 | protein phosphatase 1G (formerly 2C), magnesiu |
| 69B12 | 1014 | 1490 | Y13936 | Hs. 17883 | 0 | 1 | for protein phosphatase 2C gamma/cds = (24, |
| 178E6 | 1903 | 4365 | NM_014827 | Hs. 17969 | 0 | 3 | KIAA0663 gene product (KIAA0663), mRNA/cds = ( |
| 173H3 | 481 | 2362 | AK001630 | Hs. 18063 | 0 | 4 | cDNA FLJ10768 fis, clone NT2RP4000150/cds = UN |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 113A8 | 1285 | 1393 | NM_005606 | Hs. 18069 | 5.00E−48 | 1 | protease, cysteine, 1 (legumain) (PRSC1), mRN |
| 118H9 | 3709 | 3950 | AB020677 | Hs. 18166 | 1.00E−125 | 1 | mRNA for KIAA0870 protein, partial cds/cds = (0 |
| 513H7 | 2204 | 2757 | NM_005839 | Hs. 18192 | 1.00E−112 | 3 | Ser/Arg-related nuclear matrix protein (plen |
| 523G9 | 507 | 768 | AB044661 | Hs. 18259 | 1.00E−147 | 1 | XAB1 mRNA for XPA binding protein 1, complete c |
| 105B9 | 695 | 1115 | AJ010842 | Hs. 18259 | 0 | 1 | for putative ATP(GTP)-binding protein, p |
| 589D12 | 335 | 715 | NM_016565 | Hs. 18552 | 0 | 2 | E2IG2 protein (LOC51287), mRNA/cds = (131,421) |
| 170C8 | 414 | 737 | AF072860 | Hs. 18571 | 0 | 2 | protein activator of the interferon-induced p |
| 189A12 | 414 | 736 | NM_003690 | Hs. 18571 | 0 | 1 | protein kinase, interferon-inducible double |
| 134B9 | 2751 | 3057 | AB046808 | Hs. 18587 | 1.00E−165 | 1 | mRNA for KIAA1588 protein, partial cds/cds = (2 |
| 519G5 | 1291 | 1581 | NM_012332 | Hs. 18625 | 1.00E−157 | 2 | Mitochondrial Acyl-CoA Thioesterase (MT-ACT4 |
| 526H2 | 827 | 1205 | NM_004208 | Hs. 18720 | 0 | 1 | programmed cell death 8 (apoptosis-inducing f |
| 462F12 | 409 | 556 | NM_017899 | Hs. 18791 | 2.00E−78 | 1 | hypothetical protein FLJ20607 (FLJ20607), mR |
| 138B2 | 388 | 995 | AF003938 | Hs. 18792 | 0 | 1 | thioredoxin-like protein complete cds |
| 36G12 | 935 | 1272 | AJ250014 | Hs. 18827 | 0 | 2 | for Familial Cylindromatosis cyld gene/ |
| 194D3 | 924 | 2123 | NM_018253 | Hs. 18851 | 0 | 2 | hypothetical protein FLJ10875 (FLJ10875), mR |
| 523E1 | 3653 | 4056 | NM_012290 | Hs. 18895 | 0 | 1 | tousled-like kinase 1 (TLK1), mRNA/cds = (212,2 |
| 587G5 | 1 | 350 | NM_016302 | Hs. 18925 | 1.00E−166 | 1 | protein x 0001 (LOC51185), mRNA/cds = (33,1043) |
| 595C10 | 161 | 1281 | AC006042 | Hs. 18987 | 0 | 4 | BAC clone RP11-505D17 from 7p22−p21/cds = (0,12 |
| 125G10 | 54 | 752 | NM_002492 | Hs. 19236 | 0 | 3 | NADH dehydrogenase (ubiquinone) 1 beta subcom |
| 478G7 | 1 | 193 | NM_021603 | Hs. 19520 | 9.00E−51 | 1 | FXYD domain-containing ion transport regulat |
| 595F11 | 3623 | 3736 | AB051481 | Hs. 19597 | 3.00E−49 | 1 | mRNA for KIAA1694 protein, partial cds/cds = (0 |
| 177C6 | 284 | 671 | AF161339 | Hs. 19807 | 0 | 2 | HSPC076 mRNA, partial cds/cds = (0,301)/gb = AF |
| 37E12 | 3485 | 3919 | AB018298 | Hs. 19822 | 0 | 1 | for KIAA0755 protein, complete cds/cds = ( |
| 64G8 | 962 | 1311 | NM_001902 | Hs. 19904 | 0 | 1 | cystathionase (cystathionine gamma-lyase) ( |
| 499D5 | 2829 | 3183 | AB011169 | Hs. 20141 | 0 | 1 | mRNA for KIAA0597 protein, partial cds/cds = (0, |
| 40D11 | 62 | 684 | NM_004166 | Hs. 20144 | 0 | 1 | small inducible cytokine subfamily A (Cys-Cys |
| 66C10 | 1240 | 2240 | U76248 | Hs. 20191 | 0 | 12 | hSIAH2 mRNA, complete cds/cds = (526,1500)/ gb = U76248 |
| 586B12 | 1686 | 4288 | AB040922 | Hs. 20237 | 0 | 2 | mRNA for KIAA1489 protein, partial cds/cds = (1 |
| 173G8 | 2578 | 3197 | AL096776 | Hs. 20252 | 0 | 1 | DNA sequence from clone RP4-646B12 on chromosome 1q42 |
| 98C6 | 3303 | 4699 | AB051487 | Hs. 20281 | 0 | 6 | mRNA for KIAA1700 protein, partial cds/cds = (1 |
| 107H11 | 781 | 1380 | AK022103 | Hs. 20281 | 0 | 1 | FLJ12041 fis, clone HEMBB1001945/cds = UNK |
| 121B8 | 778 | 1264 | NM_001548 | Hs. 20315 | 0 | 1 | interferon-induced protein with tetratricope |
| 110C4 | 1050 | 1431 | AF244137 | Hs. 20597 | 0 | 1 | hepatocellular carcinoma-associated antigen |
| 99H6 | 899 | 1412 | NM_014315 | Hs. 20597 | 0 | 2 | host cell factor homolog (LCP), mRNA/cds = (316, |
| 152B12 | 69 | 424 | AK025446 | Hs. 20760 | 0 | 1 | FLJ21793 fis, clone HEP00466/cds = UNKNOW |
| 459A8 | 1858 | 2143 | AL021366 | Hs. 20830 | 1.00E−155 | 1 | DNA sequence from cosmid ICK0721Q on chromosome |
| 587A11 | 720 | 1080 | AL137576 | Hs. 21015 | 0 | 1 | mRNA; cDNA DKFZp564L0864 (from clone DKFZp564L |
| 191E12 | 1688 | 2235 | AK025019 | Hs. 21056 | 0 | 2 | cDNA: FLJ21366 fis, clone COL03012, highly sim |
| 52G3 | 225 | 1652 | NM_005880 | Hs. 21189 | 0 | 6 | HIRA interacting protein 4 (dnaJ-like) (HIRIP |
| 181B7 | 3176 | 3316 | AB018325 | Hs. 21264 | 3.00E−72 | 1 | mRNA for KIAA0782 protein, partial cds/cds = (0 |
| 45E11 | 1378 | 1518 | NM_003115 | Hs. 21293 | 1.00E−72 | 1 | UDP-N-acteylglucosamine pyrophosphorylase |
| 109G1 | 2989 | 3487 | AB032948 | Hs. 21356 | 0 | 1 | for KIAA1122 protein, partial cds/cds = (0 |
| 116D4 | 5522 | 5741 | NM_016936 | Hs. 21479 | 1.00E−107 | 1 | ubinuclein 1 (UBN1), mRNA/cds = (114,3518)/gb |
| 37G10 | 294 | 3960 | M97935 | Hs. 21486 | 0 | 4 | transcription factor ISGF-3 mRNA, complete cd |
| 599E8 | 329 | 3568 | NM_007315 | Hs. 21486 | 0 | 6 | signal transducer and activator of transcripti |
| 592D10 | 2223 | 3204 | NM_002709 | Hs. 21537 | 0 | 3 | protein phosphatase 1, catalytic subunit, bet |
| 68A7 | 1327 | 1612 | AB028958 | Hs. 21542 | 1.00E−161 | 1 | for KIAA1035 protein, partial cds/cds = (0 |
| 72B3 | 2519 | 2862 | L03426 | Hs. 21595 | 1.00E−179 | 1 | XE7 mRNA, complete alternate coding regions/ cds = (166 |
| 592E6 | 2520 | 2854 | NM_005088 | Hs. 21595 | 1.00E−161 | 1 | DNA segment on chromosome X and (unique) 155 ex |
| 589G6 | 190 | 522 | AL573787 | Hs. 21732 | 1.00E−141 | 1 | AL573787 cDNA/clone = CS0DI055YM17-(3-prime) |
| 593H1 | 452 | 899 | NM_005875 | Hs. 21756 | 0 | 2 | translation factor sui1 homolog (GC20), mRNA |
| 59B8 | 2893 | 3273 | NM_012406 | Hs. 21807 | 0 | 1 | PR domain containing 4 (PRDM4), mRNA/cds = (122, |
| 196A6 | 12 | 543 | AL562895 | Hs. 21812 | 0 | 1 | AL562895 cDNA/clone = CS0DC021YO20-(3-prime) |
| 67D8 | 62 | 631 | AW512498 | Hs. 21879 | 1.00E−150 | 3 | xx75e03.x1 cDNA, 3' end/clone = IMAGE: 2849500 |
| 477B6 | 1969 | 2520 | D84454 | Hs. 21899 | 0 | 1 | mRNA for UDP-galactose translocator, complete cds/c |
| 515D1 | 2232 | 2647 | NM_007067 | Hs. 21907 | 0 | 2 | histone acetyltransferase (HBOA), mRNA/cds = |
| 100F8 | 1082 | 1508 | AK022554 | Hs. 21938 | 0 | 1 | FLJ12492 fis, clone NT2RM2001632, weakly |
| 470E4 | 1135 | 1244 | NM_020239 | Hs. 22065 | 4.00E−45 | 2 | small protein effector 1 of Cdc42 (SPEC1), mRNA |
| 68G4 | 1391 | 2013 | AK022057 | Hs. 22265 | 0 | 2 | FLJ11995 fis, clone HEMBB1001443, highly |
| 193H6 | 922 | 1328 | NM_022494 | Hs. 22353 | 1.00E−178 | 1 | hypothetical protein FLJ21952 (FLJ21952), mR |
| 151D2 | 1492 | 1694 | AL050122 | Hs.22370 | 4.00E−88 | 1 | cDNA DKFZp564O0122 (from clone DKFZp564O |
| 497E8 | 1581 | 4794 | D83781 | Hs.22559 | 0 | 3 | mRNA for KIAA0197 gene, partial cds/cds = (0,3945)/gb |
| 182D10 | 999 | 1830 | AL117513 | Hs.22583 | 0 | 5 | mRNA; cDNA DKFZp434K2235 (from clone DKFZp434K |
| 75B5 | 1775 | 2380 | AF006513 | Hs.22670 | 0 | 1 | CHD1 mRNA, complete cds/cds = (163,5292)/gb = A |
| 126H8 | 1776 | 2377 | NM_001270 | Hs.22670 | 0 | 1 | chromodomain helicase DNA binding protein 1 ( |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 73D5 | 1599 | 1696 | AK025485 | Hs.22678 | 2.00E−42 | 1 | FLJ21832 fis, clone HEP01571/cds = (32,15 |
| 481D11 | 128 | 562 | BF968270 | Hs.22790 | 1.00E−172 | 1 | 602269653F1 cDNA, 5' end/clone = lMAGE: 4357740 |
| 74E4 | 724 | 1195 | NM_012124 | Hs.22857 | 0 | 1 | chord domain-containing protein 1 (CHP1), mRN |
| 459C6 | 813 | 1472 | NM_012244 | Hs.22891 | 0 | 1 | solute carrier family 7 (cationic amino acid t |
| 462G7 | 2972 | 3144 | AB037784 | Hs.22941 | 2.00E−93 | 1 | mRNA for KIAA1363 protein, partial cds/cds = (0 |
| 70F12 | 37 | 846 | AB020623 | Hs.22960 | 0 | 3 | DAM1 mRNA, complete cds/cds = (48,725)/gb = AB0 |
| 585H10 | 91 | 748 | NM_005872 | Hs.22960 | 0 | 1 | breast carcinoma amplified sequence 2 (BCAS2) |
| 142C8 | 1359 | 1597 | AK024023 | Hs.23170 | 1.00E−103 | 1 | FLJ13961 fis, clone Y79AA1001236, highly |
| 164F2 | 1220 | 1474 | NM_012280 | Hs.23170 | 1.00E−135 | 1 | homolog of yeast SPB1 (JM23), mRNA/cds = (300,12 |
| 127F11 | 682 | 806 | AL046016 | Hs.23247 | 2.00E−58 | 1 | DKFZp434P246_r1 cDNA, 5' end/clone = DKFZp434P |
| 98G7 | 760 | 1368 | NM_022496 | Hs.23259 | 0 | 1 | hypothetical protein FLJ13433 (FLJ13433), mR |
| 470C9 | 2 | 538 | AL574514 | Hs.23294 | 0 | 2 | AL574514 cDNA/clone = CS0DI056YA07-(3-prime) |
| 458F12 | 4293 | 4917 | AB002365 | Hs.23311 | 0 | 1 | mRNA for KIAA0367 gene, partial cds/cds = (0,2150)/gb |
| 57D8 | 460 | 566 | BF439063 | Hs.23349 | 3.00E−54 | 1 | nab70e03.x1 cDNA/clone = IMAGE/gb = BF439063/ |
| 599G12 | 352 | 983 | NM_014814 | Hs.23488 | 0 | 2 | KIAA0107 gene product (KIAA0107), mRNA/cds = ( |
| 112B3 | 2400 | 2715 | NM_014887 | Hs.23518 | 1.00E−172 | 1 | hypothetical protein from BCRA2 region (CG005 |
| 167C10 | 1771 | 2107 | NM_004380 | Hs.23598 | 1.00E−175 | 1 | CREB binding protein (Rubinstein-Taybi syndr |
| 196G9 | 114 | 307 | BF970427 | Hs.23703 | 1.00E−101 | 1 | 602272760F1 cDNA, 5' end/clone = IMAGE: 4360767 |
| 184B3 | 2488 | 2882 | AK026983 | Hs.23803 | 0 | 1 | FLJ23330 fis, clone HEP12654/cds = (69,13 |
| 480H4 | 4871 | 5467 | AB023227 | Hs.23860 | 0 | 1 | mRNA for KIAA1010 protein, partial cds/cds = (0 |
| 479C12 | 4 | 190 | NM_005556 | Hs.23881 | 4.00E−91 | 1 | keratin 7 (KRT7), mRNA/cds = (56,1465)/gb = NM_ |
| 36E7 | 742 | 1126 | AL360135 | Hs.23964 | 0 | 1 | full length insert cDNA clone EUROIMAGE 12 |
| 598B5 | 544 | 1271 | NM_005870 | Hs.23964 | 0 | 12 | sin3-associated polypeptide, 18 kD (SAP18), m |
| 462D8 | 1205 | 1653 | NM_004790 | Hs.23965 | 0 | 1 | solute carrier family 22 (organic anion transp |
| 479A5 | 1817 | 2164 | NM_002967 | Hs.23978 | 0 | 1 | scaffold attachment factor B (SAFB), mRNA/cds |
| 188E2 | 1762 | 2160 | NM_014950 | Hs.24083 | 0 | 1 | KIAA0997 protein (KIAA0997), mRNA/cds = (262,2 |
| 67D2 | 1304 | 1856 | AK024240 | Hs.24115 | 0 | 2 | FLJ14178 fis, clone NT2RP2003339/cds = UNK |
| 177D8 | 4674 | 5185 | AF251039 | Hs.24125 | 0 | 1 | putative zinc finger protein mRNA, complete cd |
| 190E1 | 5222 | 5394 | NM_016604 | Hs.24125 | 8.00E−73 | 1 | putative zinc finger protein (LOC51780), mRNA |
| 192A5 | 1517 | 1985 | NM_003387 | Hs.24143 | 1.00E−135 | 2 | Wiskott-Aldrich syndrome protein interacting |
| 170A4 | 1666 | 3280 | X86019 | Hs.24143 | 4.00E−23 | 1 | PRPL-2 protein/cds = (204,1688)/gb = X860 |
| 480B6 | 1517 | 1937 | NM_012155 | Hs.24178 | 1.00E−133 | 1 | microtubule-associated protein like echinode |
| 143H11 | 177 | 656 | BE877357 | Hs.24181 | 0 | 2 | 601485590F1 cDNA, 5' end/clone = IMAGE: 3887951 |
| 473D10 | 146 | 491 | AW960486 | Hs.24252 | 0 | 1 | EST372557 cDNA/gb = AW960486/gi = 8150170/ug = |
| 98H1 | 23 | 562 | NM_003945 | Hs.24322 | 0 | 1 | ATPase, H+ transporting, lysosomal (vacuolar |
| 169G2 | 391 | 638 | BE612847 | Hs.24349 | 4.00E−75 | 2 | 601452239F1 5' end/clone = IMAGE: 3856304 |
| 479B12 | 1132 | 1599 | AY007126 | Hs.24435 | 0 | 1 | clone CDABP0028 mRNA sequence/cds = UNKNOWN/g |
| 480H9 | 4716 | 5012 | NM_006048 | Hs.24594 | 1.00E−145 | 1 | ubiquitination factor E4B (homologous to yeas |
| 110B10 | 520 | 1171 | AL163206 | Hs.24633 | 0 | 1 | chromosome 21 segment HS21C006/cds = (82,1203) |
| 99A3 | 519 | 1000 | NM_022136 | Hs.24633 | 0 | 2 | SAM domain, SH3 domain and nuclear localisation |
| 109G7 | 2024 | 2350 | AB037797 | Hs.24684 | 1.00E−141 | 1 | for KIAA1376 protein, partial cds/cds = (1 |
| 61B7 | 485 | 1656 | AK024029 | Hs.24719 | 0 | 4 | FLJ13967 fis, clone Y79AA1001402, weakly |
| 166C11 | 1216 | 1509 | AF006516 | Hs.24752 | 1.00E−165 | 1 | eps8 binding protein e3B1 mRNA, complete cds/ |
| 464D12 | 166 | 764 | NM_002882 | Hs.24763 | 0 | 1 | RAN binding protein 1 (RANBP1), mRNA/cds = (149 |
| 98C12 | 6523 | 8023 | AB051512 | Hs.25127 | 0 | 3 | mRNA for KIAA1725 protein, partial cds/cds = (0 |
| 63F7 | 2164 | 2802 | AL133611 | Hs.25362 | 0 | 1 | cDNA DKFZp434O1317 (from clone DKFZp434O |
| 41D11 | 45 | 463 | X53795 | Hs.25409 | 0 | 1 | R2 mRNA for an inducible membrane protein/ cds = (156,95 |
| 62G6 | 1452 | 1827 | V01512 | Hs.25647 | 0 | 3 | cellular oncogene c-fos (complete sequence)/cds = (15 |
| 593D12 | 1135 | 2111 | NM_015832 | Hs.25674 | 0 | 8 | methyl-CpG binding domain protein 2 (MBD2), tr |
| 172G9 | 2014 | 2371 | NM_021211 | Hs.25726 | 0 | 1 | transposon-derived Buster1 transposase-like |
| 106D6 | 432 | 1878 | AF058696 | Hs.25812 | 0 | 2 | cell cycle regulatory protein p95 (NBS1) mRNA, |
| 98A4 | 533 | 3758 | NM_002485 | Hs.25812 | 0 | 2 | Nijmegen breakage syndrome 1 (nibrin) (NBS1), |
| 477H5 | 6320 | 6599 | NM_004638 | Hs.25911 | 1.00E−111 | 3 | HLA-B associated transcript-2 (D6S51E), mRNA |
| 71F11 | 2070 | 2931 | NM_019555 | Hs.25951 | 0 | 3 | Rho guanine nucleotide exchange factor (GEF) |
| 164B9 | 2163 | 2502 | AK023999 | Hs.26039 | 1.00E−159 | 1 | cDNA FLJ13937 fis, clone Y79AA1000805/cds = UNK |
| 100A3 | 2043 | 2620 | M34668 | Hs.26045 | 0 | 1 | protein tyrosine phosphatase (PTPase-alpha) mRNA/c |
| 123A5 | 2046 | 2638 | NM_002836 | Hs.26045 | 0 | 1 | protein tyrosine phosphatase, receptor type, |
| 466E5 | 7817 | 8241 | NM_014112 | Hs.26102 | 0 | 2 | trichorhinophalangeal syndrome I gene (TRPS1) |
| 588A1 | 361 | 857 | AF070582 | Hs.26118 | 0 | 1 | clone 24766 mRNA sequence/cds = UNKNOWN/ gb = AF |
| 526H12 | 176 | 1809 | NM_018384 | Hs.26194 | 0 | 5 | hypothetical protein FLJ11296 (FLJ11296), mR |
| 149G7 | 96 | 1123 | AK027016 | Hs.26198 | 0 | 3 | FLJ23363 fis, clone HEP15507/cds = (206,1 |
| 122A4 | 1196 | 1332 | AL050166 | Hs.26295 | 3.00E−72 | 1 | mRNA; cDNA DKFZp586D1122 (from clone DKFZp586D |
| 122D5 | 1936 | 2435 | AB029006 | Hs.26334 | 0 | 1 | mRNA for KIAA1083 protein, complete cds/cds = ( |
| 137G5 | 137 | 452 | AK025778 | Hs.26367 | 1.00E−145 | 1 | FLJ22125 fis, clone HEP19410/cds = (119,5 |
| 595D2 | 1 | 372 | NM_022488 | Hs.26367 | 3.00E−89 | 3 | PC3-96 protein (PC3-96), mRNA/cds = (119,586) |
| 64D12 | 1024 | 1135 | NM_017746 | Hs.26369 | 2.00E−57 | 1 | hypothetical protein FLJ20287 (FLJ20287), mR |
| 39E4 | 2132 | 2750 | AK000367 | Hs.26434 | 0 | 1 | FLJ20360 fis, clone HEP16677/cds = (79,230 |
| 473C10 | 4318 | 4623 | AF051782 | Hs.26584 | 1.00E−154 | 1 | diaphanous 1 (HDIA1) mRNA, complete cds/cds = ( |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 590C4 | 1740 | 2198 | AL050205 | Hs.26613 | 0 | 1 | mRNA; cDNA DKFZp586F1323 (from clone DKFZp586F |
| 523F3 | 454 | 792 | AC002073 | Hs.26670 | 1.00E−164 | 1 | PAC clone RP3-515N1 from 22q11.2–q22/cds = (0,791)/g |
| 587E11 | 1226 | 1876 | NM_004779 | Hs.26703 | 0 | 2 | CCR4-NOT transcription complex, subunit 8 (C |
| 110G4 | 191 | 685 | BE868389 | Hs.26731 | 0 | 1 | 601444360F1 cDNA, 5' end/clone = IMAGE: 3848487 |
| 110E11 | 1001 | 3955 | AL117448 | Hs.26797 | 0 | 2 | cDNA DKFZp586B14I7 (from clone DKFZp586B |
| 152A8 | 12 | 112 | AI760224 | Hs.26873 | 2.00E−48 | 1 | wh62g06.x1 cDNA, 3' end/clone = IMAGE: 2385370 |
| 467G11 | 528 | 858 | NM_016106 | Hs.27023 | 1.00E−174 | 1 | vesicle transport-related protein (KIAA0917) |
| 465E11 | 634 | 1065 | AL136656 | Hs.27181 | 3.00E−83 | 1 | mRNA; cDNA DKFZp564C1664 (from clone DKFZp564C |
| 58E11 | 1 | 551 | AJ238243 | Hs.27182 | 0 | 1 | mRNA for phospholipase A2 activating protein |
| 590H2 | 398 | 1016 | NM_014412 | Hs.27258 | 0 | 1 | calcyclin binding protein (CACYBP), mRNA/cds |
| 179E9 | 1039 | 1905 | AK025586 | Hs.27268 | 0 | 4 | FLJ21933 fis, clone HEP04337/cds = UNKNOW |
| 459D7 | 1293 | 1936 | AL050061 | Hs.27371 | 0 | 1 | mRNA; cDNA DKFZp566J123 (from clone DKFZp566J1 |
| 54A11 | 709 | 1542 | AK022811 | Hs.27475 | 0 | 1 | FLJ12749 fis, clone NT2RP2001149/cds = UNK |
| 111A5 | 42 | 686 | NM_022485 | Hs.27556 | 0 | 1 | hypothetical protein FLJ22405 (FLJ22405), mR |
| 123D4 | 879 | 1005 | NM_016059 | Hs.27693 | 3.00E−49 | 1 | peptidylprolyl isomerase (cyclophilin)-like |
| 518E11 | 1245 | 2235 | AF332469 | Hs.27721 | 0 | 5 | putative protein WHSC1L1 (WHSG1L1) mRNA, comp |
| 103B11 | 631 | 1343 | NM_014805 | Hs.28020 | 0 | 1 | KIAA0766 gene product (KIAA0766), mRNA/cds = ( |
| 479H3 | 4 | 100 | AB007928 | Hs.28169 | 7.00E−37 | 1 | mRNA for KIAA0459 protein, partial cds/cds = (0 |
| 526B3 | 1901 | 1995 | NM_007218 | Hs.28285 | 4.00E−47 | 1 | patched related protein translocated in renal |
| 480E4 | 4088 | 4596 | AB046766 | Hs.28338 | 0 | 1 | mRNA for KIAA1546 protein, partial cds/cds = (0 |
| 164D10 | 651 | 970 | NM_002970 | Hs.28491 | 1.00E−163 | 2 | spermidine/spermine N1-acetyltransferase ( |
| 69E10 | 729 | 1588 | AB007888 | Hs.28578 | 0 | 2 | KIAA0428 mRNA, complete cds/cds = (1414,2526) |
| 49B1 | 632 | 4266 | NM_021038 | Hs.28578 | 0 | 4 | muscleblind (Drosophila)-like (MBNL), mRNA/ |
| 173A10 | 2105 | 2391 | AL034548 | Hs.28608 | 1.00E−161 | 2 | DNA sequence from clone RP5-1103G7 on chromosome 20p1 |
| 156H8 | 467 | 585 | AV691642 | Hs.28739 | 8.00E−43 | 1 | AV691642 5' end/clone = GKCDJG11/clone_ |
| 588D3 | 444 | 909 | NM_004800 | Hs.28757 | 1.00E−123 | 1 | transmembrane 9 superfamily member 2 (TM9SF2) |
| 493B12 | 500 | 930 | NM_003512 | Hs.28777 | 0 | 1 | H2A histone family, member L (H2AFL), mRNA/cd |
| 115C5 | 63 | 661 | BF341640 | Hs.28788 | 0 | 1 | 602016073F1 cDNA, 5' end/clone = IMAGE: 4151706 |
| 524C10 | 37 | 412 | NM_007217 | Hs.28866 | 1.00E−179 | 1 | programmed cell death 10 (PDCD10), mRNA/cds = ( |
| 39A8 | 1380 | 1873 | AK000196 | Hs.29052 | 0 | 1 | FLJ20189 fis, clone COLF0657/cds = (122,84 |
| 477H7 | 690 | 1047 | NM_005859 | Hs.29117 | 1.00E−163 | 1 | purine-rich element binding protein A (PURA), |
| 134C8 | 2462 | 2789 | NM_002894 | Hs.29287 | 1.00E−173 | 1 | retinoblastoma-binding protein 8 (RBBP8), mR |
| 108A11 | 182 | 992 | M31165 | Hs.29352 | 0 | 9 | tumor necrosis factor-inducible (TSG-6) mRNA fragme |
| 99E8 | 179 | 992 | NM_007115 | Hs.29352 | 0 | 7 | tumor necrosis factor, alpha-induced protein |
| 169B3 | 2219 | 2683 | AF039942 | Hs.29417 | 0 | 1 | HCF-binding transcription factor Zhangfei (Z |
| 526A7 | 2219 | 2670 | NM_021212 | Hs.29417 | 0 | 1 | HCF-binding transcription factor Zhangfei (Z |
| 184H12 | 2380 | 4852 | AB033042 | Hs.29679 | 0 | 2 | KIAA1216 protein, partial cds/cds = (0 |
| 125G9 | 1169 | 1814 | AB037791 | Hs.29716 | 0 | 1 | mRNA for KIAA1370 protein, partial cds/cds = (4 |
| 68F3 | 1011 | 1892 | AK027197 | Hs.29797 | 0 | 5 | FLJ23544 fis, clone LNG08336/cds = (125,5 |
| 72H12 | 2103 | 2564 | L27071 | Hs.29877 | 0 | 2 | tyrosine kinase (TXK) mRNA, complete cds/ cds = (86,166 |
| 588D5 | 793 | 1321 | NM_003328 | Hs.29877 | 0 | 1 | TXK tyrosine kinase (TXK), mRNA/cds = (86,1669) |
| 127C3 | 1 | 1424 | AK024961 | Hs.29977 | 0 | 4 | cDNA: FLJ21308 fis, clone COL02131/cds = (287,1 |
| 128H7 | 351 | 977 | NM_014188 | Hs.30026 | 0 | 1 | HSPC182 protein (HSPC182), mRNA/cds = (65,649) |
| 521G4 | 502 | 1260 | NM_004593 | Hs.30035 | 0 | 4 | splicing factor, arginine/serine-rich (trans |
| 47A2 | 503 | 1265 | U61267 | Hs.30035 | 0 | 4 | putative splice factor transformer2-beta mRN |
| 37G9 | 1287 | 1763 | M16967 | Hs.30054 | 0 | 2 | coagulation factor V mRNA, complete cds/ cds = (90,6764 |
| 459E1 | 43 | 536 | NM_015919 | Hs.30303 | 0 | 1 | Kruppel-associated box protein (LOC51595), m |
| 465F6 | 256 | 573 | NM_005710 | Hs.30570 | 7.00E−75 | 1 | polyglutamine binding protein 1 (PQBP1), mRNA |
| 120H1 | 5305 | 5634 | NM_012296 | Hs.30687 | 1.00E−172 | 2 | GRB2-associated binding protein 2 (GAB2), mRN |
| 189G2 | 1 | 147 | BG260954 | Hs.30724 | 2.00E−68 | 1 | 602372562F1 cDNA, 5' end/clone = IMAGE: 4480647 |
| 482E6 | 3086 | 3254 | AK023743 | Hs.30818 | 4.00E−91 | 1 | cDNA FLJ13681 fis, clone PLACE2000014, weakly |
| 179H5 | 20 | 1232 | AK001972 | Hs.30822 | 0 | 2 | FLJ11110 fis, clone PLACE1005921, weakly |
| 598B6 | 1 | 1169 | NM_018326 | Hs.30822 | 0 | 19 | hypothetical protein FLJ11110 (FLJ11110), mR |
| 126G10 | 1309 | 2463 | AK000689 | Hs.30882 | 0 | 18 | cDNA FLJ20682 fis, clone KAIA3543, highly simi |
| 126G7 | 5221 | 5904 | NM_019081 | Hs.30909 | 1.00E−163 | 2 | KIAA0430 gene product (KIAA0430), mRNA/cds = ( |
| 483D1 | 1481 | 2098 | NM_003098 | Hs.31121 | 0 | 1 | syntrophin, alpha 1(dystrophin-associated p |
| 464C9 | 1188 | 1755 | NM_003273 | Hs.31130 | 0 | 2 | transmembrane 7 superfamily member 2 (TM7SF2), |
| 478A6 | 3024 | 3837 | NM_012238 | Hs.31176 | 1.00E−176 | 2 | sir2-like 1 (SIRT1), mRNA/cds = (53,2296)/gb = |
| 122E5 | 1060 | 1294 | NM_002893 | Hs.31314 | 1.00E−113 | 1 | retinoblastoma-binding protein 7 (RBBP7), mR |
| 117B1 | 2056 | 2489 | AF153419 | Hs.31323 | 0 | 1 | IkappaBkinase complex-associated protein (I |
| 462E10 | 337 | 569 | AV752358 | Hs.31409 | 1.00E−108 | 1 | AV752358 cDNA, 5' end/clone = NPDBHG03/clone_ |
| 126E7 | 1962 | 2748 | AB014548 | Hs.31921 | 0 | 2 | mRNA for KIAA0648 protein, partial cds/cds = (0 |
| 186G11 | 729 | 954 | BC000152 | Hs.31989 | 1.00E−125 | 1 | Similar to DKFZP586G1722 protein, clone MGC: |
| 67H7 | 1705 | 2336 | AJ400877 | Hs.32017 | 0 | 2 | ASCL3 gene, CEGP1 gene, C11orf14 gene, C11orf1 |
| 102B11 | 175 | 874 | AK026455 | Hs.32148 | 0 | 1 | FLJ22802 fis, clone KAIA2682, highly sim |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 458D4 | 46 | 449 | H14103 | Hs.32149 | 1.00E−167 | 1 | ym62a02.r1 cDNA, 5' end/clone = IMAGE: 163466/ |
| 99A2 | 3991 | 4532 | AB007902 | Hs.32168 | 0 | 1 | KIAA0442 mRNA, partial cds/cds = (0,3519)/gb = |
| 458G5 | 27 | 540 | N30152 | Hs.32250 | 0 | 1 | yx81f03.s1 cDNA, 3' end/clone = IMAGE: 268157/ |
| 112D11 | 4399 | 5040 | NM_005922 | Hs.32353 | 0 | 1 | mitogen-activated protein kinase kinase kina |
| 48C8 | 3278 | 3988 | AB002377 | Hs.32556 | 0 | 2 | mRNA for KIAA0379 protein, partial cds/cds = (0, |
| 515F9 | 761 | 989 | NM_003193 | Hs.32675 | 1.00E−116 | 1 | tubulin-specific chaperone e (TBCE), mRNA/c |
| 158C12 | 342 | 809 | NM_016063 | Hs.32826 | 0 | 1 | CGI-130 protein (LOC51020),/cds = (63,575 |
| 585E6 | 128 | 512 | NM_005594 | Hs.32916 | 0 | 3 | nascent-polypeptide-associated complex alp |
| 459B5 | 1271 | 1972 | NM_017632 | Hs.32922 | 0 | 1 | hypothetical protein FLJ20036 (FLJ20036), mR |
| 469G12 | 2711 | 2978 | NM_001566 | Hs.32944 | 1.00E−136 | 1 | inositol polyphosphate-4-phosphatase, type |
| 71B7 | 483 | 1787 | NM_003037 | Hs.32970 | 0 | 29 | signaling lymphocytic activation molecule (S |
| 74G1 | 1 | 1780 | U33017 | Hs.32970 | 0 | 33 | signaling lymphocytic activation molecule (SLAM) mR |
| 473B11 | 2993 | 3361 | NM_006784 | Hs.33085 | 1.00E−111 | 1 | WD repeat domain 3 (WDR3), mRNA/cds = (47,2878) |
| 56B5 | 23 | 578 | AB019571 | Hs.33190 | 0 | 1 | expressed only in placental villi, clone |
| 469D12 | 187 | 394 | AL359654 | Hs.33756 | 1.00E−110 | 1 | mRNA full length insert cDNA clone EUROIMAGE 19 |
| 98H8 | 371 | 618 | AI114652 | Hs.33757 | 3.00E−98 | 1 | HA1247 cDNA/gb = AI114652/gi = 6359997/ug = Hs. |
| 594E7 | 2134 | 2320 | NM_012123 | Hs.33979 | 5.00E−93 | 1 | CGI-02 protein (CGI-02), mRNA/cds = (268,2124) |
| 110D1 | 1158 | 1349 | NM_018579 | Hs.34401 | 1.00E−105 | 1 | hypothetical protein PRO1278 (PRO1278), mRNA |
| 596A6 | 1950 | 2144 | NM_022766 | Hs.34516 | 1.00E−102 | 2 | hypothetical protein FLJ23239 (FLJ23239), mR |
| 37B10 | 237 | 563 | AI123826 | Hs.34549 | 1.00E−145 | 1 | ow61c10.x1 cDNA, 3' end/clone = IMAGE: 1651314 |
| 458H4 | 3656 | 4415 | AB040929 | Hs.35089 | 0 | 1 | mRNA for KIAA1496 protein, partial cds/cds = (0 |
| 100D1 | 3563 | 3777 | D25215 | Hs.35804 | 1.00E−105 | 1 | KIAA0032 gene, complete cds/cds = (166,3318) |
| 519A12 | 402 | 623 | AW960004 | Hs.36475 | 3.00E−48 | 1 | EST372075 cDNA/gb = AW960004/gi = 8149688/ug = |
| 498H2 | 11143 | 11490 | NM_000081 | Hs.36508 | 0 | 1 | Chediak-Higashi syndrome 1 (CHS1), mRNA/cds = ( |
| 521D6 | 304 | 791 | NM_002712 | Hs.36587 | 0 | 2 | protein phosphatase 1, regulatory subunit 7 ( |
| 460E1 | 1200 | 1542 | AF319476 | Hs.36752 | 0 | 2 | GKAP42 (FKSG21) mRNA, complete cds/cds = (174,1 |
| 184G9 | 498 | 1191 | AF082569 | Hs.36794 | 0 | 2 | D-type cyclin-interacting protein 1 (DIP1) mR |
| 462D3 | 493 | 1517 | NM_012142 | Hs.36794 | 0 | 3 | D-type cyclin-interacting protein 1 (DIP1), m |
| 74E12 | 659 | 3054 | D86956 | Hs.36927 | 0 | 23 | KIAA0201 gene, complete cds/cds = (347,2923) |
| 58G5 | 1268 | 2888 | NM_006644 | Hs.36927 | 0 | 12 | heat shock 105 kD (HSP105B), mRNA/cds = (313,275 |
| 52C10 | 1479 | 2588 | AK022546 | Hs.37747 | 0 | 2 | FLJ12484 fis, clone NT2RM1001102, weakly |
| 479F9 | 2066 | 2322 | AL136932 | Hs.37892 | 1.00E−119 | 1 | mRNA; cDNA DKFZp586H1322 (from clone DKFZp586H |
| 483C2 | 2222 | 2723 | NM_003173 | Hs.37936 | 0 | 1 | suppressor of variegation 3–9 (Drosophila) ho |
| 593G6 | 673 | 1213 | NM_004510 | Hs.38125 | 0 | 1 | interferon-induced protein 75, 52 kD (IFI75), |
| 101G12 | 118 | 436 | N39230 | Hs.38218 | 1.00E−173 | 1 | yy50c03.s1 cDNA, 3' end/clone = IMAGE: 276964/ |
| 107E5 | 238 | 525 | AW188135 | Hs.38664 | 1.00E−158 | 1 | xj92g04.x1 cDNA, 3' end/clone = IMAGE: 2664726 |
| 596F2 | 9 | 504 | BF892532 | Hs.38664 | 0 | 9 | IL0-MT0152-061100-501-e04 cDNA/gb = BF892532 |
| 469D7 | 47 | 474 | NM_014343 | Hs.38738 | 0 | 1 | claudin 15 (CLDN15), mRNA/cds = (254,940)/gb = |
| 166H8 | 1 | 81 | BF103848 | Hs.39457 | 9.00E−34 | 1 | 601647352F1 cDNA, 5' end/clone = IMAGE: 3931452 |
| 465F3 | 157 | 296 | NM_017859 | Hs.39850 | 2.00E−47 | 1 | hypothetical protein FLJ20517 (FLJ20517), mR |
| 195C12 | 2684 | 2944 | NM_000885 | Hs.4C034 | 1.00E−146 | 1 | integrin, alpha 4 (antigen CD49D, alpha 4 subu |
| 151F11 | 1393 | 1661 | AL031427 | Hs.40094 | 6.00E−81 | 1 | DNA sequence from clone 167A19 on chromosome 1p32.1–33 |
| 134C12 | 4532 | 4802 | NM_004973 | Hs.40154 | 1.00E−114 | 1 | jumonji (mouse) homolog (JMJ), mRNA/cds = (244, |
| 115C9 | 5279 | 5614 | AB033085 | Hs.40193 | 1.00E−157 | 1 | mRNA for KIAA1259 protein, partial cds/cds = (1 |
| 119A8 | 862 | 2087 | NM_006152 | Hs.40202 | 0 | 3 | lymphoid-restricted membrane protein (LRMP), |
| 104D4 | 924 | 1398 | U10485 | Hs.40202 | 0 | 2 | lymphoid-restricted membrane protein (Jaw1) mRNA, c |
| 155G3 | 226 | 530 | AF047472 | Hs.40323 | 1.00E−114 | 1 | spleen mitotic checkpoint BUB3 (BUB3) mRNA, c |
| 521C2 | 233 | 710 | NM_004725 | Hs.40323 | 0 | 1 | BUB3 (budding uninhibited by benzimidazoles 3 |
| 107B8 | 187 | 545 | AI927454 | Hs.40328 | 0 | 1 | wo90a02.x1 cDNA, 3' end/clone = IMAGE: 2462570 |
| 458F10 | 1 | 436 | BE782824 | Hs.40334 | 0 | 1 | 601472323F1 cDNA, 5' end/clone = IMAGE: 3875501 |
| 463G6 | 16 | 496 | AI266255 | Hs.40411 | 0 | 1 | qx69f01.x1 cDNA, 3' end/clone = IMAGE: 2006617 |
| 162F1 | 2711 | 2895 | D87468 | Hs.40888 | 4.00E−96 | 1 | KIAA0278 gene, partial cds/cds = (0,1383)/gb |
| 463E1 | 70 | 272 | AL137067 | Hs.40919 | 1.00E−109 | 1 | DNA sequence from clone RP11-13B9 on chromosome 9q22. |
| 458E7 | 107 | 774 | AK024474 | Hs.41045 | 0 | 1 | mRNA for FLJ00067 protein, partial cds/cds = (1 |
| 185G12 | 1051 | 2315 | AL050141 | Hs.41569 | 1.00E−140 | 11 | mRNA; cDNA DKFZp586O031 (from clone DKFZp586O0 |
| 593F5 | 2106 | 2490 | NM_006190 | Hs.41694 | 0 | 1 | origin recognition complex, subunit 2 (yeast h |
| 513H4 | 739 | 1249 | NM_002190 | Hs.41724 | 0 | 6 | interleukin 17 (cytotoxic T-lymphocyte-assoc |
| 155F4 | 739 | 1247 | U32659 | Hs.41724 | 0 | 1 | IL-17 mRNA, complete cds/cds = (53,520)/gb = U32659/g |
| 108H12 | 892 | 1227 | L40377 | Hs.41726 | 1.00E−170 | 1 | cytoplasmic antiproteinase 2 (CAP2) mRNA, com |
| 477E7 | 249 | 404 | BG033294 | Hs.41989 | 6.00E−75 | 1 | 602298548F1 cDNA, 5' end/clone = IMAGE: 4393186 |
| 143E2 | 5775 | 6018 | A8033112 | Hs.42179 | 1.00E−136 | 2 | for KIAA1286 protein, partial cds/cds = (1 |
| 586B10 | 720 | 1225 | NM_001952 | Hs.42287 | 0 | 1 | E2F transcription factor 6 (E2F6), mRNA/cds = ( |
| 583A10 | 346 | 883 | NM_012097 | Hs.42500 | 0 | 1 | ADP-ribosylation factor-like 5 (ARL5), mRNA |
| 459A7 | 152 | 251 | BC003525 | Hs.42712 | 2.00E−50 | 1 | Similar to Max, clone MGC: 10775, mRNA, comple |
| 37B7 | 43 | 2687 | AF006082 | Hs.42915 | 1.00E−130 | 2 | actin-related protein Arp2 (ARP2) mRNA, compl |
| 120E3 | 512 | 2426 | NM_005722 | Hs.42915 | 0 | 3 | ARP2 (actin-related protein 2, yeast) homolog |
| 99D1 | 3298 | 3761 | NM_014939 | Hs.42959 | 0 | 1 | KIAA1012 protein (KIAA1012), mRNA/cds = (57,43 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 473B2 | 3025 | 3425 | AK023647 | Hs.43047 | 1.00E−164 | 1 | cDNA FLJ13585 fis, clone PLACE1009150/cds = UNK |
| 460E6 | 2988 | 3184 | AB033093 | Hs.43141 | 1.00E−105 | 1 | mRNA for KIAA1267 protein, partial cds/cds = (9 |
| 471F7 | 232 | 575 | AW993524 | Hs.43148 | 0 | 1 | RC3-BN0034-120200-011-h06 cDNA/gb = AW993524 |
| 460B10 | 402 | 706 | BE781009 | Hs.43273 | 1.00E−78 | 1 | 601469768F1 cDNA, 5' end/clone = IMAGE: 3872704 |
| 36F6 | 2815 | 3403 | AK024439 | Hs.43616 | 0 | 1 | for FLJ00029 protein, partial cds/cds = (0 |
| 471G3 | 43 | 454 | NM_006021 | Hs.43628 | 1.00E−165 | 1 | deleted in lymphocytic leukemia, 2 (DLEU2), mR |
| 184H3 | 1819 | 2128 | D14043 | Hs.43910 | 1.00E−168 | 2 | MGC-24, complete cds/cds = (79,648)/gb = D1404 |
| 195F4 | 511 | 2370 | NM_006016 | Hs.43910 | 0 | 7 | CD164 antigen, sialomucin (CD164), mRNA/cds = |
| 188H9 | 1573 | 2277 | NM_006346 | Hs.43913 | 0 | 3 | PIBF1 gene product (PIBE1), mRNA/cds = (0,2276) |
| 177H6 | 1575 | 2272 | Y09631 | Hs.43913 | 0 | 2 | PIBF1 protein, complete/cds = (0,2276)/ |
| 481E6 | 2529 | 2873 | AB032952 | Hs.44087 | 1.00E−159 | 1 | mRNA for KIAA1126 protein, partial cds/cds = (0 |
| 112F5 | 1105 | 1701 | AF197569 | Hs.44143 | 0 | 1 | BAF180 (BAF180) mRNA, complete cds/cds = (96,48 |
| 146F5 | 2620 | 3147 | AL117452 | Hs.44155 | 0 | 1 | DKFZp586G1517 (from clone DKFZp586G |
| 514C5 | 166 | 431 | NM_018838 | Hs.44163 | 1.00E−149 | 3 | 13 kDa differentiation-associated protein (L |
| 71D9 | 1117 | 1800 | AF263613 | Hs.44198 | 0 | 2 | membrane-associated calcium-independent ph |
| 68E1 | 289 | 527 | AA576946 | Hs.44242 | 4.00E−83 | 1 | nm82b03.s1 cDNA, 3' end/clone = IMAGE: 1074701 |
| 53H12 | 1925 | 2112 | X75042 | Hs.44313 | 4.00E−84 | 1 | rel proto-oncogene mRNA/cds = (177,2036)/gb = X75 |
| 595D4 | 21 | 402 | NM_017867 | Hs.44344 | 0 | 1 | hypothetical protein FLJ20534 (FLJ20534), mR |
| 165B10 | 250 | 658 | BC000758 | Hs.44468 | 0 | 1 | clone MGC: 2698, mRNA, complete cds/cds = (168, |
| 592E9 | 37 | 2422 | NM_002687 | Hs.44499 | 0 | 5 | pinin, desmosome associated protein (PNN), mR |
| 69F10 | 14 | 1152 | Y09703 | Hs.44499 | 0 | 3 | MEMA protein/cds = (406,2166)/gb = Y09703 |
| 458H6 | 1 | 352 | NM_015697 | Hs.44563 | 0 | 1 | hypothetical protein (CL640), mRNA/cds = (0,39 |
| 182C11 | 690 | 1324 | AB046861 | Hs.44566 | 0 | 4 | mRNA for KIAA1641 protein, partial cds/cds = (6 |
| 115G3 | 318 | 731 | BG288837 | Hs.44577 | 0 | 1 | 602388170F1 cDNA, 5' end/clone = IMAGE: 4517129 |
| 70B11 | 1879 | 4363 | U58334 | Hs.44585 | 0 | 3 | Bcl2, p53 binding protein Bbp/53BP2 (BBP/53BP2) mRNA |
| 165F10 | 265 | 496 | AV726117 | Hs.44656 | 6.00E−66 | 1 | AV726117 cDNA, 5' end/clone = HTCAXB05/clone_ |
| 36F1 | 444 | 1176 | AK001332 | Hs.44672 | 0 | 1 | FLJ10470 fis, clone NT2RP2000032, weakly |
| 596H1 | 1073 | 2711 | AF288571 | Hs.44865 | 0 | 14 | lymphoid enhancer factor-1 (LEF1) mRNA, compl |
| 41C4 | 2876 | 3407 | X60708 | Hs.44926 | 0 | 1 | pcHDP7 mRNA for liver dipeptidyl peptidase IV/ cds = (75 |
| 588A7 | 7564 | 7849 | AL031667 | Hs.45207 | 1.00E−158 | 1 | DNA sequence from clone RP4-620E11 on chromosome 20q1 |
| 183G6 | 3967 | 4942 | AB020630 | Hs.45719 | 0 | 5 | mRNA for KIAA0823 protein, partial cds/cds = (0 |
| 465C9 | 700 | 1325 | BC002796 | Hs.46446 | 0 | 1 | lymphoblastic leukemia derived sequence 1, |
| 464B1 | 1519 | 1997 | NM_006019 | Hs.46465 | 0 | 1 | T-cell, immune regulator 1 (TCIRG1), mRNA/cds |
| 466C9 | 455 | 518 | AW974756 | Hs.46476 | 6.00E−26 | 1 | EST386846 cDNA/gb = AW974756/gi = 8165944/ug = |
| 110E7 | 620 | 1153 | AF223469 | Hs.46847 | 0 | 1 | AD022 protein (AD022) mRNA, complete cds/cds = |
| 112D5 | 618 | 1197 | NM_016614 | Hs.46847 | 0 | 4 | TRAF and TNF receptor-associated protein (AD0 |
| 172G6 | 4157 | 4527 | NM_003954 | Hs.47007 | 0 | 1 | mitogen-activated protein kinase kinase kina |
| 177C8 | 4217 | 4469 | Y10256 | Hs.47007 | 1.00E−96 | 1 | serine/threonine protein kinase, NIK/c |
| 458H9 | 18 | 457 | AW291458 | Hs.47325 | 0 | 1 | UI-H-BI2-agh-c-02-0-UI.s1 cDNA, 3' end/clon |
| 62B6 | 562 | 697 | BE872760 | Hs.47334 | 7.00E−54 | 1 | 601450902F1 cDNA, 5' end/clone = IMAGE: 3854544 |
| 178F12 | 169 | 2413 | AF307339 | Hs.47783 | 0 | 2 | B aggressive lymphoma short isoform (BAL) mRNA |
| 460G4 | 598 | 1081 | NM_005985 | Hs.48029 | 0 | 1 | snail 1 (drosophila homolog), zinc finger prot |
| 70D12 | 1 | 2038 | AK027070 | Hs.48320 | 0 | 13 | FLJ23417 fis, clone HEP20868/cds = (59,12 |
| 41G5 | 6587 | 7128 | NM_014345 | Hs.48433 | 0 | 1 | endocrine regulator (HRIHFB2436), mRNA/cds = |
| 516H2 | 1 | 212 | NM_017948 | Hs.48712 | 2.00E−90 | 2 | hypothetical protein FLJ20736 (FLJ20736), mR |
| 517G9 | 665 | 1649 | NM_004462 | Hs.48876 | 0 | 2 | farnesyl-diphosphate farnesyltransferase 1 |
| 146A2 | 88 | 440 | X76770 | Hs.49007 | 0 | 1 | PAP/cds = UNKNOWN/gb = X76770/gi = 556782/ug |
| 174H4 | 2612 | 3200 | AF189011 | Hs.49163 | 0 | 1 | ribonuclease III (RN3) mRNA, complete cds/cds |
| 121G3 | 463 | 829 | NM_017917 | Hs.49376 | 0 | 1 | hypothetical protein FLJ20644 (FLJ20644), mR |
| 170B9 | 2260 | 2948 | AK023825 | Hs.49391 | 0 | 1 | FLJ13763 fis, clone PLACE4000089/cds = (56 |
| 65E2 | 629 | 1798 | AF062075 | Hs.49587 | 0 | 4 | leupaxin, complete cds/cds = (93,1253)/g |
| 518B2 | 26 | 1798 | NM_004811 | Hs.49587 | 0 | 12 | leupaxin (LPXN), mRNA/cds = (93,1253)/gb = NM_0 |
| 472E8 | 1182 | 1516 | AL390132 | Hs.49822 | 0 | 1 | mRNA; cDNA DKFZp547E107 (from clone DKFZp547E1 |
| 41B12 | 57 | 576 | AB000887 | Hs.50002 | 0 | 1 | for EBI1-ligand chemokine, complete cds |
| 41D1 | 1 | 310 | U86358 | Hs.50404 | 1.00E−135 | 1 | chemokine (TECK) mRNA, complete cds/cds = (0,452)/gb |
| 107C9 | 2861 | 3541 | M64174 | Hs.50651 | 0 | 3 | protein-tyrosine kinase (JAK1) mRNA, complete cds/c |
| 599H12 | 202 | 3541 | NM_002227 | Hs.50651 | 0 | 11 | Janus kinase 1 (a protein tyrosine kinase) (JAK |
| 105E3 | 621 | 1101 | AF047442 | Hs.50785 | 0 | 1 | vesicle trafficking protein sec22b mRNA, comp |
| 129B5 | 2489 | 2919 | X16354 | Hs.50964 | 0 | 2 | transmembrane carcinoembryonic antigen BGPa |
| 587H2 | 748 | 1673 | NM_000521 | Hs.51043 | 0 | 2 | hexosaminidase B (beta polypeptide) (HEXB), m |
| 458H12 | 4043 | 4561 | NM_000887 | Hs.51077 | 0 | 1 | integrin, alpha X (antigen CD11C (p150), alpha |
| 129C9 | 4055 | 4567 | Y00093 | Hs.51077 | 0 | 1 | leukocyte adhesion glycoprotein p150,95 |
| 125D8 | 2502 | 3966 | AF016266 | Hs.51233 | 0 | 3 | TRAIL receptor 2 mRNA, complete cds/cds = (117,1 |
| 179E1 | 17 | 343 | M22538 | Hs.51299 | 1.00E−179 | 1 | nuclear-encoded mitochondrial NADH-ubiquinone redu |
| 165D7 | 35 | 754 | NM_021074 | Hs.51299 | 0 | 4 | NADH dehydrogenase (ubiquinone) flavoprotein |
| 107F10 | 2632 | 2993 | Y11251 | Hs.51957 | 0 | 2 | novel member of serine-arginine domain p |
| 195B12 | 1344 | 1590 | NM_017903 | Hs.52184 | 3.00E−96 | 1 | hypothetical protein FLJ20618 (FLJ20618), mR |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 69D7 | 3046 | 3568 | AB014569 | Hs.52526 | 0 | 4 | for KIAA0669 protein, complete cds/cds = ( |
| 55D1 | 2607 | 2847 | NM_014779 | Hs.52526 | 1.00E−130 | 1 | KIAA0669 gene product (KIAA0669), mRNA/cds = ( |
| 480B8 | 1943 | 2062 | AL080213 | Hs.52792 | 8.00E−44 | 1 | mRNA; cDNA DKFZp586I1823 (from clone DKFZp586I |
| 72G7 | 1236 | 1348 | NM_018607 | Hs.52891 | 2.00E−55 | 1 | hypothetical protein PRO1853 (PRO1853), mRNA |
| 526D1 | 1 | 256 | NM_004597 | Hs.53125 | 1.00E−114 | 1 | small nuclear ribonucleoprotein D2 polypeptid |
| 458E8 | 1182 | 1701 | NM_002621 | Hs.53155 | 0 | 1 | properdin P factor, complement (PFC), mRNA/cd |
| 458G2 | 2171 | 2836 | NM_001204 | Hs.53250 | 0 | 1 | bone morphogenetic protein receptor, type II |
| 458F7 | 30 | 650 | NM_002200 | Hs.54434 | 0 | 1 | interferon regulatory factor 5 (IRF5), mRNA/ |
| 459F12 | 2023 | 3325 | NM_006060 | Hs.54452 | 0 | 2 | zinc finger protein, subfamily 1A, 1 (lkaros) ( |
| 41A6 | 498 | 755 | U46573 | Hs.54460 | 1.00E−140 | 1 | eotaxin precursor mRNA, complete cds/cds = (53,346)/ |
| 590A10 | 243 | 659 | NM_004688 | Hs.54483 | 0 | 2 | N-myc (and STAT) interactor (NMI), mRNA/cds = ( |
| 461C11 | 872 | 1415 | NM_014291 | Hs.54609 | 0 | 1 | glycine C-acetyltransferase (2-amino-3-keto |
| 170H5 | 412 | 1630 | AJ243721 | Hs.54642 | 0 | 3 | for dTDP-4-keto-6-deoxy-D-glucose 4-re |
| 521F5 | 270 | 1491 | NM_013283 | Hs.54642 | 0 | 8 | methionine adenosyltransferase II, beta (MAT |
| 189H5 | 737 | 1049 | X76302 | Hs.54649 | 1.00E−131 | 2 | H. sapiens RY-1 mRNA for putative nucleic acid binding protei |
| 599D10 | 2614 | 3035 | AB029015 | Hs.54886 | 0 | 5 | mRNA for KIAA1092 protein, partial cds/cds = (0 |
| 458D5 | 1026 | 1676 | AK027243 | Hs.54890 | 0 | 1 | cDNA: FLJ23590 fis, clone LNG14491/cds = (709,1 |
| 37A10 | 1633 | 2040 | AK026024 | Hs.55024 | 0 | 1 | FLJ22371 fis, clone HRC06680/cds = (77,12 |
| 121A8 | 799 | 1217 | NM_018053 | Hs.55024 | 1.00E−160 | 1 | hypothetical protein FLJ10307 (FLJ10307), mR |
| 460B1 | 11195 | 11326 | AF231023 | Hs.55173 | 1.00E−45 | 1 | protocadherin Flamingo 1 (FMI1) mRNA, complete |
| 57F1 | 1450 | 2070 | NM_003447 | Hs.55481 | 0 | 2 | zinc finger protein 165 (ZNF165), mRNA/cds = (5 |
| 68D10 | 979 | 2070 | U78722 | Hs.55481 | 0 | 4 | zinc finger protein 165 (Zpf165) mRNA, complete |
| 584G7 | 268 | 1674 | NM_003753 | Hs.55682 | 0 | 4 | eukaryotic translation initiation factor 3, |
| 161C8 | 63 | 394 | NM_017897 | Hs.55781 | 1.00E−177 | 1 | hypothetical protein FLJ20604 (FLJ20604), mR |
| 588F6 | 1 | 387 | NM_016497 | Hs.55847 | 0 | 1 | hypothetical protein (LOC51258), mRNA/cds = ( |
| 597E10 | 334 | 2073 | NM_004446 | Hs.55921 | 0 | 5 | glutamyl-prolyl-tRNA synthetase (EPRS), mRN |
| 138H10 | 3603 | 4112 | X54326 | Hs.55921 | 0 | 1 | glutaminyl-tRNA synthetase/cds = (58,43 |
| 121D5 | 3959 | 4192 | AB018348 | Hs.55947 | 1.00E−130 | 1 | mRNA for KIAA0805 protein, partial cds/cds = (0 |
| 473D12 | 1428 | 1866 | AJ245539 | Hs.55968 | 0 | 2 | partial mRNA for GaINAc-T5 (GALNT5 gene)/cds = |
| 71E3 | 843 | 1724 | NM_005542 | Hs.56205 | 0 | 30 | insulin induced gene 1 (INSIG1), mRNA/cds = (414 |
| 73F4 | 843 | 2495 | U96876 | Hs.56205 | 0 | 32 | insulin induced protein 1 (INSIG1) mRNA, compl |
| 75C8 | 180 | 2439 | AJ277832 | Hs.56247 | 0 | 13 | for inducible T-cell co-stimulator (ICOS |
| 187A6 | 2073 | 2255 | AF195530 | Hs.56542 | 2.00E−99 | 1 | soluble aminopeptidase P (XPNPEP1) mRNA, comp |
| 584H5 | 1496 | 1889 | NM_001494 | Hs.56845 | 1.00E−151 | 1 | GDP dissociation inhibitor 2 (GDI2), mRNA/cds |
| 460C5 | 2395 | 2860 | AK022936 | Hs.56847 | 0 | 1 | cDNA FLJ12874 fis, clone NT2RP2003769/cds = UNK |
| 460B5 | 164 | 741 | BC003581 | Hs.56851 | 0 | 1 | Similar to RIKEN cDNA 2900073H19 gene, clone |
| 54G4 | 1359 | 1761 | AK027232 | Hs.57209 | 0 | 2 | FLJ23579 fis, clone LNG13017/cds = UNKNOW |
| 192D8 | 1576 | 2872 | AL136703 | Hs.57209 | 0 | 3 | mRNA; cDNA DKFZp566J091 (from clone DKFZp566J0 |
| 66F9 | 618 | 1056 | U41654 | Hs.57304 | 0 | 1 | adenovirus protein E3-14.7k interacting protein 1 ( |
| 183A1 | 2093 | 2334 | NM_003751 | Hs.57783 | 1.00E−132 | 1 | eukaryotic translation initiation factor 3, |
| 117B3 | 6933 | 7225 | NM_022898 | Hs.57987 | 1.00E−154 | 3 | B-cell lymphoma/leukaemia 11B (BCL11B), mRNA |
| 74C11 | 273 | 359 | BE739287 | Hs.58066 | 7.00E−21 | 1 | 601556492F1 cDNA, 5' end/clone = IMAGE: 3826247 |
| 174H2 | 5591 | 5977 | AJ131693 | Hs.58103 | 0 | 1 | mRNA for AKAP450 protein/cds = (222,11948)/gb |
| 599H8 | 26 | 993 | NM_003756 | Hs.58189 | 0 | 3 | eukaryotic translation initiation factor 3, |
| 168F12 | 295 | 593 | U54559 | Hs.58189 | 1.00E−166 | 1 | translation initiation factor eIF3 p40 subuni |
| 68B11 | 1 | 297 | BE867841 | Hs.58297 | 1.00E−146 | 1 | 601443614F1 cDNA, 5' end/clone = IMAGE: 3847827 |
| 104A6 | 376 | 2578 | AF001862 | Hs.58435 | 0 | 3 | FYN binding protein mRNA, complete cds/cds = (67 |
| 192E3 | 230 | 648 | NM_001465 | Hs.58435 | 0 | 4 | FYN-binding protein (FYB-120/130) (FYB), mRN |
| 73B4 | 1287 | 1763 | AK022834 | Hs.58488 | 0 | 1 | FLJ12772 fis, clone NT2RP2001634, highly |
| 100G3 | 1568 | 1786 | NM_004850 | Hs.58617 | 1.00E−108 | 1 | Rho-associated, coiled-coil containing prot |
| 116G9 | 1997 | 2464 | NM_013352 | Hs.58636 | 0 | 1 | squamous cell carcinoma antigen recognized by |
| 178C6 | 5 | 710 | AV760147 | Hs.58643 | 1.00E−111 | 5 | AV760147 cDNA, 5' end/clone = MDSEPB12/clone_ |
| 519B1 | 2203 | 2320 | NM_014207 | Hs.58685 | 1.00E−56 | 1 | CD5 antigen (p56−62) (CD5), mRNA/cds = (72,1559 |
| 40B6 | 1655 | 2283 | X04391 | Hs.58685 | 0 | 1 | lymphocyte glycoprotein T1/Leu-1/cds = (72,1 |
| 466B9 | 262 | 534 | AI684437 | Hs.58774 | 1.00E−107 | 1 | wa82a04.x1 cDNA, 3' end/clone = IMAGE: 2302638 |
| 480H7 | 86 | 234 | NM_006568 | Hs.59106 | 1.00E−54 | 1 | cell growth regulatory with ring finger domain |
| 44A7 | 2229 | 2703 | X17094 | Hs.59242 | 0 | 1 | fur mRNA for furin/cds = (216,2600)/gb = X17094/ gi = 314 |
| 106D12 | 21 | 380 | M96982 | Hs.59271 | 0 | 2 | U2 snRNP auxiliary factor small subunit, compl |
| 39C5 | 1821 | 2653 | AB011098 | Hs.59403 | 0 | 1 | for KIAA0526 protein, complete cds/cds = ( |
| 185H7 | 1826 | 2352 | NM_004863 | Hs.59403 | 0 | 1 | serine palmitoyltransferase, long chain base |
| 459C5 | 126 | 443 | AA889552 | Hs.59459 | 1.00E−158 | 1 | ak20d12.s1 cDNA, 3' end/clone = IMAGE: 1406519 |
| 108B8 | 2760 | 3079 | AJ132592 | Hs.59757 | 1.00E−138 | 1 | for zinc finger protein, 3115/cds = (107,27 |
| 194F7 | 2074 | 2461 | NM_018227 | Hs.59838 | 0 | 1 | hypothetical protein FLJ10808 (FLJ10808), mR |
| 465D4 | 2 | 132 | AI440512 | Hs.59844 | 7.00E−67 | 1 | tc83f09.x1 cDNA, 3' end/clone = IMAGE: 2072777 |
| 161H10 | 1 | 381 | AA004799 | Hs.60088 | 1.00E−169 | 1 | zh96b05.s1 cDNA, 3' end/clone IMAGE: 429105/ |
| 465B6 | 228 | 383 | NM_018986 | Hs.61053 | 1.00E−66 | 1 | hypothetical protein (FLJ20356), mRNA/cds = ( |
| 102G9 | 359 | 725 | D11094 | Hs.61153 | 0 | 1 | MSS1, complete cds/cds = (66,1367)/gb = D11094 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 193C6 | 359 | 725 | NM_002803 | Hs.61153 | 1.00E−174 | 2 | proteasome (prosome, macropain) 26S subunit, |
| 99E7 | 1768 | 2339 | AL023653 | Hs.61469 | 0 | 10 | DNA sequence from clone 753P9 on chromosome Xq25-26.1. |
| 462B9 | 5 | 411 | BE779284 | Hs.61472 | 1.00E−152 | 1 | 601464557F1 cDNA, 5' end/clone = IMAGE: 3867566 |
| 594F11 | 220 | 569 | NM_003905 | Hs.61828 | 1.00E−159 | 2 | amyloid beta precursor protein-binding prote |
| 102E7 | 1216 | 1921 | AF046001 | Hs.62112 | 0 | 3 | zinc finger transcription factor (ZNF207) mRN |
| 192B4 | 754 | 934 | NM_003457 | Hs.62112 | 2.00E−98 | 2 | zinc finger protein 207 (ZNF207), mRNA/cds = (2 |
| 41G9 | 1664 | 2096 | J02931 | Hs.62192 | 0 | 1 | placental tissue factor (two forms) mRNA, complete cd |
| 482E12 | 1857 | 2149 | NM_001993 | Hs.62192 | 5.00E−87 | 1 | coagulation factor III (thromboplastin, tiss |
| 459C10 | 1548 | 1845 | AB011114 | Hs.62209 | 1.00E−166 | 1 | mRNA for KIAA0542 protein, partial cds/cds = (39 |
| 114D6 | 2251 | 2712 | NM_002053 | Hs.62661 | 0 | 1 | guanylate binding protein 1, interferon-induc |
| 590C9 | 83 | 760 | NM_002032 | Hs.62954 | 0 | 43 | ferritin, heavy polypeptide 1 (FTH1), mRNA/c |
| 458C5 | 1798 | 2407 | AB033118 | Hs.63128 | 0 | 1 | mRNA for KIAA1292 protein, partial cds/cds = (0 |
| 109E5 | 4661 | 5114 | AB002369 | Hs.63302 | 0 | 1 | KIAA0371 gene, complete cds/cds = (247,3843) |
| 589G9 | 250 | 5650 | NM_021090 | Hs.63302 | 0 | 6 | myotubularin related protein 3 (MTMR3), mRNA |
| 182E4 | 1751 | 2144 | NM_002831 | Hs.63489 | 0 | 1 | protein tyrosine phosphatase, non-receptor t |
| 589C8 | 1787 | 2222 | AK023529 | Hs.63525 | 0 | 2 | cDNA FLJ13467 fis, clone PLACE1003519, highly |
| 458D7 | 1595 | 1912 | NM_022727 | Hs.63609 | 1.00E−180 | 1 | HpaII tiny fragments locus 9C (HTF9C), mRNA/c |
| 193A2 | 144 | 2588 | NM_003264 | Hs.63668 | 0 | 5 | toll-like receptor 2 (TLR2), mRNA/cds = (129,24 |
| 117C3 | 1504 | 2366 | AF131762 | Hs.64001 | 0 | 3 | clone 25218 mRNA sequence/cds = UNKNOWN/gb = AF |
| 109F1 | 568 | 2157 | AL031602 | Hs.64239 | 0 | 3 | DNA sequence from clone RP5-1174N9 on chromosome 1p34 |
| 40D5 | 698 | 1192 | U32324 | Hs.64310 | 0 | 1 | interleukin-11 receptor alpha chain mRNA, complete c |
| 522F4 | 12 | 504 | NM_006356 | Hs.64593 | 0 | 1 | ATP synthase, H+ transporting, mitochondrial |
| 462E9 | 215 | 891 | NM_015423 | Hs.64595 | 0 | 1 | aminoadipate-semialdehyde dehydrogenase-ph |
| 164G10 | 37 | 889 | NM_006851 | Hs.64639 | 0 | 2 | glioma pathogenesis-related protein (RTVP1), |
| 155G10 | 1 | 601 | U16307 | Hs.64639 | 0 | 1 | glioma pathogenesis-related protein (GliPR) mRNA, c |
| 110D11 | 341 | 712 | S60099 | Hs.64797 | 0 | 1 | APPH = amyloid precursor protein homolog [human, placenta, |
| 513E8 | 3411 | 3986 | AF148537 | Hs.65450 | 0 | 7 | reticulon 4a mRNA, complete cds/cds = (141,3719 |
| 460F4 | 1415 | 1749 | NM_018174 | Hs.66048 | 1.00E−163 | 1 | hypothetical protein FLJ10669 (FLJ10669), mR |
| 478H8 | 486 | 1037 | NM_001775 | Hs.66052 | 0 | 1 | CD38 antigen (p45) (CD38), mRNA/cds = (69,971) |
| 461A6 | 2977 | 3516 | AB051540 | Hs.66053 | 0 | 1 | mRNA for KIAA1753 protein, partial cds/cds = (0 |
| 191E7 | 1 | 494 | AL157438 | Hs.66151 | 0 | 6 | mRNA; cDNA DKFZp434A115 (from clone DKFZp434A1 |
| 464B6 | 76 | 623 | NM_002528 | Hs.66196 | 0 | 1 | nth (E. coli endonuclease III)-like 1 (NTHL1), |
| 473C6 | 149 | 517 | BE673759 | Hs.66357 | 0 | 1 | 7d69d02.x1 cDNA, 3' end/clone = IMAGE: 3278211 |
| 171G11 | 1001 | 1385 | Z98884 | Hs.66708 | 0 | 1 | DNA sequence from clone RP3-467L1 on chromosome 1p36. |
| 169H3 | 15 | 1800 | X82200 | Hs.68054 | 0 | 4 | Staf50/cds = (122,1450)/gb = X82200/gi = 8992 |
| 167G9 | 747 | 1104 | NM_005932 | Hs.68583 | 1.00E−101 | 1 | mitochondrial intermediate peptidase (MIPEP) |
| 170H3 | 747 | 1104 | U80034 | Hs.68583 | 6.00E−99 | 1 | mitochondrial intermediate peptidase precurs |
| 69F9 | 321 | 1348 | U78027 | Hs.69089 | 0 | 5 | Bruton's tyrosine kinase (BTK), alpha-D-galac |
| 586D6 | 16 | 676 | NM_006360 | Hs.69469 | 1.00E−173 | 2 | dendritic cell protein (GA17), mRNA/cds = (51,1 |
| 591E3 | 74 | 189 | NM_002385 | Hs.69547 | 2.00E−59 | 1 | myelin basic protein (MBP), mRNA/cds = (10,570) |
| 597H2 | 482 | 2702 | NM_007158 | Hs.69855 | 0 | 8 | NRAS-related gene (D15155E), mRNA/cds = (420,2 |
| 515C5 | 3257 | 3421 | NM_003169 | Hs.70186 | 8.00E−45 | 1 | suppressor of Ty (S.cerevisiae) 5 homolog (SUP |
| 461B9 | 44 | 425 | H06786 | Hs.70258 | 0 | 1 | yl83g05.r1 cDNA, 5' end/clone = IMAGE: 44737/c |
| 525H4 | 2834 | 2978 | NM_014933 | Hs.70266 | 4.00E−77 | 1 | yeast Sec31p homolog (KIAA0905), mRNA/cds = (53 |
| 521C3 | 1 | 1165 | NM_016628 | Hs.70333 | 1.00E−176 | 2 | hypothetical protein (LOC51322), mRNA/cds = ( |
| 460E5 | 414 | 994 | AF138903 | Hs.70337 | 0 | 1 | immunoglobulin superfamily protein beta-like |
| 190C7 | 1406 | 1788 | D50926 | Hs.70359 | 0 | 1 | mRNA for KIAA0136 gene, partial cds/cds = (0,2854)/gb |
| 497F10 | 653 | 1096 | NM_014210 | Hs.70499 | 0 | 3 | ecotropic viral integration site 2A (EVI2A), m |
| 37C11 | 820 | 1523 | AB002368 | Hs.70500 | 0 | 4 | KIAA0370 gene, partial cds/cds = (0,2406)/gb |
| 464B2 | 496 | 721 | BG283002 | Hs.71243 | 3.00E−99 | 1 | 602406192F1 cDNA, 5' end/clone = IMAGE: 4518214 |
| 69G4 | 1292 | 2708 | AL161991 | Hs.71252 | 0 | 4 | cDNA DKFZp761C169 (from clone DKFZp761C1 |
| 485E4 | 176 | 485 | AA131524 | Hs.71433 | 1.00E−151 | 1 | zl31h02.s1 cDNA, 3' end/clone = IMAGE: 503571/ |
| 161G2 | 1338 | 1877 | NM_003129 | Hs.71465 | 0 | 1 | squalene epoxidase (SQLE), mRNA/cds(214,193 |
| 188D6 | 328 | 597 | NM_016630 | Hs.71475 | 1.00E−129 | 1 | hypothetical protein (LOC51324), mRNA/cds = ( |
| 483B5 | 12 | 384 | NM_021128 | Hs.71618 | 0 | 1 | polymerase (RNA) II (DNA directed) polypeptide |
| 161F6 | 675 | 1114 | U79277 | Hs.71848 | 0 | 1 | clone 23548 mRNA sequence/cds = UNKNOWN/gb = U79277/g |
| 473F8 | 377 | 729 | BE889075 | Hs.71941 | 1.00E−146 | 1 | 601513514F1 cDNA, 5' end/clone = IMAGE: 3915003 |
| 102A6 | 1129 | 1560 | AK023183 | Hs.72782 | 0 | 1 | FLJ13121 fis, clone NT2RP3002687/cds = (39 |
| 41E2 | 56 | 539 | M57506 | Hs.72918 | 0 | 1 | secreted protein (I-309) gene, complete cds/cds = (72, |
| 476E12 | 1790 | 2311 | S76638 | Hs.73090 | 0 | 2 | p50-NF-kappa B homolog [human, peripheral blood T cells, mR |
| 41G7 | 3116 | 3469 | U64198 | Hs.73165 | 1.00E−173 | 1 | Il-12 receptor beta2 mRNA, complete cds/cds = (640,322 |
| 51C9 | 1721 | 2339 | NM_005263 | Hs.73172 | 0 | 4 | growth factor independent 1 (GFI1), mRNA/cds = |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 67H6 | 1723 | 2342 | U67369 | Hs.73172 | 0 | 1 | growth factor independence-1 (Gfi-1) mRNA, complete |
| 179E7 | 211 | 610 | M92444 | Hs.73722 | 0 | 1 | apurinic/apyrimidinic endonuclease (HAP1) g |
| 585G3 | 174 | 589 | NM_001641 | Hs.73722 | 0 | 8 | APEX nuclease (multifunctional DNA repair enz |
| 138A11 | 1360 | 1717 | M72709 | Hs.73737 | 1.00E−151 | 1 | alternative splicing factor mRNA, complete cds/cds = |
| 49C8 | 1628 | 2276 | AK001313 | Hs.73742 | 0 | 4 | cDNA FLJ10451 fis, clone NT2RP1000959, highly |
| 41D7 | 2760 | 3563 | J03565 | Hs.73792 | 0 | 1 | Epstein-Barr virus complement receptor type ll(cr2) |
| 121F8 | 2470 | 2815 | AL136131 | Hs.73793 | 1.00E−123 | 1 | DNA sequence from clone RP1-261G23 on chromosome 6p12 |
| 482C7 | 2864 | 3199 | NM_003005 | Hs.73800 | 1.00E−165 | 3 | selectin P (granule membrane protein 140 kD, an |
| 153E12 | 160 | 778 | D90144 | Hs.73817 | 0 | 22 | gene for LD78 alpha precursor, complete cds/c |
| 489E12 | 161 | 776 | NM_002983 | Hs.73817 | 0 | 6 | small inducible cytokine A3 (homologous to mo |
| 177D7 | 112 | 388 | BF673951 | Hs.73818 | 1.00E−143 | 1 | 602137331F1 cDNA, 5' end/clone = IMAGE: 4274094 |
| 587E10 | 5 | 387 | NM_006004 | Hs.73818 | 1.00E−155 | 6 | ubiquinol-cytochrome c reductase hinge prote |
| 142H11 | 119 | 436 | AL110183 | Hs.73851 | 1.00E−148 | 1 | cDNA DKFZp566A221 (from clone DKFZp566A2 |
| 190G11 | 1 | 375 | NM_001685 | Hs.73851 | 0 | 6 | ATP synthase, H+ transporting, mitochondrial |
| 119D10 | 675 | 1700 | BC001267 | Hs.73957 | 0 | 4 | RAB5A, member RAS oncogene family, clone MGC: |
| 135H12 | 1244 | 1772 | NM_003016 | Hs.73965 | 0 | 2 | splicing factor, arginine/serine-rich 2 (SFR |
| 160E6 | 1811 | 2196 | X75755 | Hs.73965 | 0 | 5 | PR264 gene/cds = (98,763)/gb = X75755/gi = 455418 |
| 175F9 | 791 | 1446 | L29218 | Hs.73986 | 0 | 2 | clk2 mRNA, complete cds/cds = (129,1628)/gb = L2 |
| 516D9 | 782 | 1144 | NM_003992 | Hs.73987 | 0 | 1 | CDC-like kinase 3 (CLK3), transcript variant p |
| 469F3 | 1778 | 1956 | NM_002286 | Hs.74011 | 4.00E−78 | 1 | lymphocyte-activation gene 3 (LAG3), mRNA/cd |
| 481D6 | 1323 | 1805 | Z22970 | Hs.74076 | 1.00E−173 | 1 | H. sapiens mRNA for M130 antigen cytoplasmic variant 2/cds = ( |
| 193H9 | 813 | 1569 | NM_007360 | Hs.74085 | 1.00E−127 | 3 | DNA segment on chromosome 12 (unique) 2489 expr |
| 39D9 | 810 | 994 | X54870 | Hs.74085 | 1.00E−100 | 1 | NKG2-D gene/cds = (338,988)/gb = X54870/gi = 3 |
| 71F3 | 3014 | 3858 | NM_004430 | Hs.74088 | 1.00E−114 | 4 | early growth response 3 (EGR3), mRNA/cds = (357, |
| 74B12 | 3651 | 4214 | S40832 | Hs.74088 | 1.00E−114 | 7 | EGR3 = EGR3 protein mRNA, |
| 105E11 | 2 | 142 | AL050391 | Hs.74122 | 6.00E−72 | 2 | cDNA DKFZp586A181 (from clone DKFZp586A1 |
| 174A12 | 141 | 1072 | NM_001225 | Hs.74122 | 0 | 9 | caspase 4, apoptosis-related cysteine protea |
| 599E9 | 351 | 1864 | AF279903 | Hs.74267 | 0 | 6 | 60S ribosomal protein L15 (EC45) mRNA, complet |
| 74F7 | 126 | 1867 | AF283772 | Hs.74267 | 0 | 8 | clone TCBAP0781 mRNA sequence/cds = (40,654)/ |
| 156G12 | 554 | 831 | AF034607 | Hs.74276 | 1.00E−156 | 1 | chloride channel ABP mRNA, complete cds/cds = ( |
| 118F4 | 1 | 148 | BG112085 | Hs.74313 | 7.00E−65 | 2 | 602283260F1 cDNA, 5' end/clone = IMAGE: 4370727 |
| 70G10 | 1 | 2177 | M16660 | Hs.74335 | 0 | 26 | 90-kDa heat-shock protein gene, cDNA, complete cds/c |
| 64D1 | 330 | 2219 | NM_007355 | Hs.74335 | 0 | 26 | heat shock 90 kD protein 1, beta (HSPCB), mRNA/ |
| 121E12 | 700 | 1033 | NM_006826 | Hs.74405 | 0 | 1 | tyrosine 3-monooxygenase/tryptophan 5-monoo |
| 177D3 | 480 | 1645 | X57347 | Hs.74405 | 0 | 2 | HS1 protein/cds = (100,837)/gb = X57347/ |
| 155A5 | 680 | 1176 | U86602 | Hs.74407 | 0 | 1 | nucleolar protein p40 mRNA, complete cds/cds = (142,10 |
| 181G10 | 1802 | 2302 | NM_012381 | Hs.74420 | 0 | 2 | origin recognition complex, subunit 3 (yeast h |
| 66D8 | 927 | 1490 | X86691 | Hs.74441 | 0 | 1 | 218 kD Mi-2 protein/cds = (89,5827)/gb = X |
| 189D10 | 383 | 1102 | NM_001749 | Hs.74451 | 0 | 7 | calpain 4, small subunit (30 K) (CAPN4), mRNA/ |
| 171A3 | 721 | 1092 | X04106 | Hs.74451 | 1.00E−174 | 1 | calcium dependent protease (small subunit)/ |
| 173F3 | 1069 | 1468 | NM_004559 | Hs.74497 | 0 | 1 | nuclease sensitive element binding protein 1 |
| 176B7 | 1592 | 1990 | NM_001178 | Hs.74515 | 0 | 1 | aryl hydrocarbon receptor nuclear translocato |
| 481A11 | 2012 | 2210 | NM_000947 | Hs.74519 | 2.00E−61 | 1 | primase, polypeptide 2A (58 kD) (PRIM2A), mRNA |
| 116G8 | 689 | 1417 | NM_002537 | Hs.74563 | 0 | 4 | ornithine decarboxylase antizyme 2 (OAZ2), mR |
| 526F6 | 185 | 1088 | NM_003145 | Hs.74564 | 0 | 3 | signal sequence receptor, beta (translocon-as |
| 104D3 | 713 | 1127 | X79353 | Hs.74576 | 0 | 1 | XAP-4 mRNA for GDP-dissociation inhibitor/cds = ( |
| 518E1 | 2725 | 2993 | NM_001357 | Hs.74578 | 1.00E−134 | 1 | DEAD/H (Asp-Glu-Ala-Asp/His) box polypeptide |
| 459H1 | 3093 | 3268 | NM_014767 | Hs.74583 | 3.00E−67 | 1 | KIAA0275 gene product (KIAA0275), mRNA/cds = ( |
| 69C5 | 2304 | 2781 | M97287 | Hs.74592 | 0 | 3 | MAR/SAR DNA binding protein (SATB1) mRNA |
| 587F12 | 930 | 2777 | NM_002971 | Hs.74592 | 0 | 6 | special AT-rich sequence binding protein 1 (b |
| 124H10 | 1240 | 1812 | NM_002808 | Hs.74621 | 0 | 2 | proteasome (prosome, macropain) 26S subunit, |
| 57F10 | 700 | 2310 | NM_000311 | Hs.74621 | 0 | 60 | prion protein (p27–30) (Creutzfeld-Jakob dis |
| 74A10 | 870 | 2252 | U29185 | Hs.74621 | 0 | 34 | prion protein (PrP) gene, complete cds/cds = (24 |
| 176H10 | 465 | 923 | NM_000108 | Hs.74635 | 0 | 1 | dihydrolipoamide dehydrogenase (E3 component |
| 98F4 | 870 | 2566 | NM_003217 | Hs.74637 | 0 | 7 | testis enhanced gene transcript (TEGT), mRNA |
| 179H8 | 1 | 1210 | X75861 | Hs.74637 | 0 | 3 | TEGT gene/cds = (40,753)/gb = X75861/gi = 456258/ |
| 125C4 | 417 | 1425 | NM_014280 | Hs.74711 | 0 | 2 | splicing factor similar to dnaJ (SPF31), mRNA |
| 74C5 | 21 | 177 | BE549137 | Hs.74861 | 4.00E−65 | 1 | 601076443F1 cDNA, 5' end/clone = IMAGE: 3462154 |
| 497B12 | 124 | 384 | NM_006713 | Hs.74861 | 1.00E−123 | 2 | activated RNA polymerase II transcription cof |
| 191E10 | 497 | 859 | NM_022451 | Hs.74899 | 0 | 1 | hypothetical protein FLJ12820 (FLJ12820), mR |
| 114A3 | 1032 | 1446 | AY007131 | Hs.75061 | 0 | 1 | clone CDABP0045 mRNA sequence |
| 117G3 | 279 | 799 | NM_004622 | Hs.75066 | 0 | 1 | translin (TSN), mRNA/cds = (81,767)/gb = NM_004 |
| 483G2 | 3293 | 3639 | NM_006148 | Hs.75075 | 1.00E−180 | 1 | LIM and SH3 protein 1 (LASP1),/cds = (75,860)/g |
| 181E11 | 8314 | 8804 | NM_000038 | Hs.75081 | 0 | 1 | adenomatosis polyposis coli (APC), mRNA/cds = |
| 597G6 | 374 | 2361 | NM_003406 | Hs.75103 | 0 | 6 | tyrosine 3-monooxygenase/tryptophan 5-monoo |
| 596F11 | 684 | 1088 | NM_002097 | Hs.75113 | 0 | 1 | general transcription factor IIIA (GTF3A), mR |
| 69C9 | 995 | 1564 | AF113702 | Hs.75117 | 0 | 4 | clone FLC1353 PRO3063 mRNA, complete cds/cds = |
| 46E7 | 128 | 1519 | NM_004515 | Hs.75117 | 1.00E−164 | 2 | interleukin enhancer binding factor 2, 45 kD ( |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 481B10 | 66 | 515 | NM_003201 | Hs.75133 | 0 | 1 | transcription factor 6-like 1 (mitochondrial |
| 469C5 | 368 | 969 | NM_006708 | Hs.75207 | 0 | 1 | glyoxalase I (GLO1), mRNA/cds = (87,641)/gb = N |
| 71B4 | 939 | 2049 | NM_002539 | Hs.75212 | 0 | 24 | ornithine decarboxylase 1 (ODC1) mRNA/cds = (33 |
| 75E10 | 173 | 1991 | X16277 | Hs.75212 | 0 | 51 | ornithine decarboxylase ODC (EC 4.1.1.17)/c |
| 166G9 | 2077 | 2632 | L36870 | Hs.75217 | 0 | 1 | MAP kinase kinase 4 (MKK4) mRNA, complete cds/ |
| 167A12 | 2074 | 2619 | NM_003010 | Hs.75217 | 0 | 1 | mitogen-activated protein kinase kinase 4 (M |
| 105B12 | 3030 | 5207 | D67029 | Hs.75232 | 0 | 3 | SEC14L mRNA, complete cds |
| 125D1 | 4782 | 5209 | NM_003003 | Hs.75232 | 0 | 1 | SEC14 (S. cerevisiae)-like 1 (SEC14L1), mRNA |
| 184E4 | 2075 | 3174 | D42040 | Hs.75243 | 0 | 5 | KIAA9001 gene, complete cds/cds = (1701,4106) |
| 191E5 | 2071 | 3174 | NM_005104 | Hs.75243 | 0 | 2 | bromodomain-containing 2 (BRD2), mRNA/cds = (1 |
| 186C12 | 4159 | 4866 | NM_001068 | Hs.75248 | 0 | 6 | topoisomerase (DNA) II beta (180 kD) (TOP2B), m |
| 177C9 | 4473 | 4866 | X68060 | Hs.75248 | 0 | 1 | topIIb mRNA for topoisomerase IIb/cds = (0,4865) |
| 39D8 | 743 | 1980 | D31885 | Hs.75249 | 0 | 6 | KIAA0069 gene, partial cds/cds = (0,680)/gb = |
| 127G2 | 1363 | 1769 | NM_016166 | Hs.75251 | 0 | 1 | DEAD/H (Asp-Glu-Ala-Asp/His) box binding pro |
| 64E5 | 4 | 1214 | NM_002922 | Hs.75256 | 0 | 6 | regulator of G-protein signalling 1 (RGS1), mR |
| 69G5 | 276 | 914 | S59049 | Hs.75256 | 0 | 6 | BL34 = B cell activation gene [human, mRNA, 1398 nt] |
| 101F6 | 315 | 758 | AF054174 | Hs.75258 | 0 | 1 | histone macroH2A1.2 mRNA, complete cds/cds = ( |
| 596E10 | 320 | 1667 | NM_004893 | Hs.75258 | 0 | 5 | H2A histone family, member Y (H2AFY), mRNA/cds |
| 587G10 | 639 | 953 | NM_001628 | Hs.75313 | 1.00E−147 | 1 | aldo-keto reductase family 1, member B1 (aldo |
| 128F7 | 181 | 933 | X06950 | Hs.75318 | 0 | 4 | HALPHA44 gene for alpha-tubulin, exons 1–3 |
| 74A1 | 321 | 3290 | D21262 | Hs.75337 | 0 | 10 | KIAA0035 gene, partial cds/cds = (0,2125)/gb |
| 50D8 | 2 | 667 | BF303895 | Hs.75344 | 0 | 4 | 601886515F2 cDNA, 5' end/clone = IMAGE: 4120514 |
| 179F7 | 379 | 720 | L07633 | Hs.75348 | 1.00E−179 | 4 | (clone 1950.2) interferon-gamma IEF SSP 5111 m |
| 191F3 | 158 | 872 | NM_006263 | Hs.75348 | 0 | 18 | proteasome (prosome, macropain) activator su |
| 463G4 | 1849 | 2394 | NM_001873 | Hs.75360 | 0 | 1 | carboxypeptidase E (CPE), mRNA/cds = (290,1720 |
| 117D6 | 224 | 671 | AB023200 | Hs.75361 | 0 | 1 | mRNA for KIAA0983 protein, complete cds/cds = ( |
| 73E8 | 1 | 2339 | D89077 | Hs.75367 | 0 | 8 | for Src-like adapter protein, complete cd |
| 49H5 | 1 | 2388 | NM_006748 | Hs.75367 | 0 | 4 | Src-like-adapter (SLA), mRNA/cds = (41,871)/ |
| 134A3 | 550 | 1126 | NM_005917 | Hs.75375 | 0 | 1 | malate dehydrogenase 1, NAD (soluble) (MDH1), |
| 462F2 | 73 | 361 | NM_004172 | Hs.75379 | 1.00E−158 | 1 | solute carrier family 1 (glial high affinity gl |
| 477G6 | 769 | 2043 | NM_004300 | Hs.75393 | 0 | 3 | acid phosphatase 1, soluble (ACP1), transcript |
| 62A10 | 1028 | 2528 | X87949 | Hs.75410 | 0 | 7 | BiP protein/cds = (222,2183)/gb = X87949 |
| 125H4 | 510 | 807 | NM_006010 | Hs.75412 | 1.00E−130 | 2 | Arginine-rich protein (ARP), mRNA/cds = (132,8 |
| 70H1 | 29 | 2349 | AK026463 | Hs.75415 | 0 | 30 | FLJ22810 fis, clone KAIA2933, highly sim |
| 60D3 | 160 | 1666 | D31767 | Hs.75416 | 0 | 6 | KIAA0058 gene, complete cds/cds = (69,575)/g |
| 98D5 | 103 | 1233 | NM_014764 | Hs.75416 | 0 | 10 | DAZ associated protein 2 (DAZAP2), mRNA/cds = ( |
| 55H1 | 1183 | 1390 | NM_016525 | Hs.75425 | 2.00E−81 | 1 | ubiquitin associated protein (UBAP), mRNA/cd |
| 44B12 | 51 | 480 | BF131654 | Hs.75428 | 0 | 3 | 601820480F1 cDNA, 5' end/clone = IMAGE: 4052586 |
| 64E11 | 1 | 177 | NM_000454 | Hs.75428 | 7.00E−94 | 1 | superoxide dismutase 1, soluble (amyotrophic |
| 65D3 | 387 | 969 | L33842 | Hs.75432 | 0 | 4 | (clone FFE-7) type II inosine monophosphate de |
| 58F9 | 379 | 672 | NM_000884 | Hs.75432 | 1.00E−149 | 1 | IMP (inosine monophosphate) dehydrogenase 2 |
| 73B1 | 87 | 291 | BE790474 | Hs.75458 | 5.00E−71 | 2 | 601476059F1 cDNA, 5' end/clone = IMAGE: 3878799 |
| 585G5 | 1 | 302 | NM_000979 | Hs.75458 | 1.00E−170 | 8 | ribosomal protein L18 (RPL18), mRNA/cds = (15,5 |
| 173A1 | 1893 | 2653 | NM_006763 | Hs.75462 | 0 | 2 | BTG family, member 2 (BTG2), mRNA/cds = (71,547) |
| 166A10 | 601 | 1147 | AB00015 | Hs.75470 | 0 | 1 | mRNA expressed in osteoblast, complete cds/cd |
| 180D10 | 601 | 1045 | NM_006820 | Hs.75470 | 0 | 1 | hypothetical protein, expressed in osteoblast |
| 122D9 | 3322 | 5191 | AB023173 | Hs.75478 | 0 | 2 | mRNA for KIAA0956 protein, partial cds/cds = (0 |
| 461E5 | 2484 | 2804 | AL133074 | Hs.75497 | 1.00E−144 | 1 | mRNA; cDNA DKFZp434M1317 (from clone DKFZp434M |
| 512D6 | 69 | 799 | NM_004591 | Hs.75498 | 0 | 12 | small inducible cytokine subfamily A (Cys-Cys |
| 146B12 | 54 | 783 | U64197 | Hs.75498 | 0 | 4 | chemokine exodus-1 mRNA, complete cds/cds = (4 |
| 596H5 | 685 | 1952 | NM_001157 | Hs.75510 | 0 | 5 | annexin A11 (ANXA11), mRNA/cds = (178,1695)/g |
| 179D6 | 215 | 603 | D23662 | Hs.75512 | 1.00E−168 | 2 | ubiquitin-like protein, complete cds |
| 522G12 | 52 | 603 | NM_006156 | Hs.75512 | 0 | 2 | neural precursor cell expressed, developmenta |
| 46B6 | 1108 | 1418 | NM_000270 | Hs.75514 | 1.00E−166 | 1 | nucleoside phosphorylase (NP), mRNA/cds = (109 |
| 73H11 | 83 | 1418 | X00737 | Hs.75514 | 1.00E−104 | 3 | purine nucleoside phosphorylase (PNP; EC 2. |
| 154F7 | 1279 | 2056 | L05425 | Hs.75528 | 0 | 3 | nucleolar GTPase mRNA, complete cds/cds = (79,2 |
| 164C10 | 1268 | 1910 | NM_013285 | Hs.75528 | 0 | 2 | nucleolar GTPase (HUMAUANTIG), mRNA/cds = (79, |
| 106C8 | 76 | 322 | Z25749 | Hs.75538 | 1.00E−130 | 3 | gene for ribosomal protein S7/cds = (81,665)/gb = |
| 98E5 | 474 | 1188 | NM_003405 | Hs.75544 | 0 | 1 | tyrosine 3-monooxygenase/tryptophan 5-monoo |
| 459G10 | 2160 | 2717 | NM_000418 | Hs.75545 | 0 | 1 | interleukin 4 receptor (IL4R), mRNA/cds = (175, |
| 44B2 | 71 | 692 | U03851 | Hs.75546 | 0 | 1 | capping protein alpha mRNA, partial cds/cds = (16,870) |
| 483F2 | 1207 | 1392 | NM_004357 | Hs.75564 | 1.00E−80 | 1 | CD151 antigen (CD151), mRNA/cds = (84,845)/gb |
| 596D6 | 1968 | 2392 | NM_021975 | Hs.75569 | 0 | 1 | v-rel avian reticuloendotheliosis viral onco |
| 466G10 | 679 | 896 | NM_014763 | Hs.75574 | 1.00E−120 | 2 | mitochondrial ribosomal protein L19 (MRPL19), |
| 524B3 | 6194 | 6477 | NM_001759 | Hs.75586 | 1.00E−147 | 1 | cyclin D2 (CCND2), mRNA/cds = (269,1138)/gb = N |
| 481B4 | 3423 | 3804 | NM_000878 | Hs.75596 | 1.00E−160 | 2 | interleukin 2 receptor, beta (IL2RB), mRNA/cd |
| 162B5 | 753 | 1694 | M29064 | Hs.75598 | 0 | 6 | hnRNP B1 protein mRNA/cds = (149,1210)/ gb = M29064/gi |
| 176F5 | 730 | 922 | NM_002137 | Hs.75598 | 1.00E−106 | 1 | heterogeneous nuclear ribonucleoprotein A2/ |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 106C2 | 1654 | 2589 | D10522 | Hs.75607 | 0 | 8 | for 80K-L protein, complete cds/cds = (369, |
| 98C5 | 1538 | 2589 | NM_002356 | Hs.75607 | 0 | 20 | myristoylated alanine-rich protein kinase C |
| 192E5 | 1007 | 1416 | NM_006819 | Hs.75612 | 0 | 1 | stress-induced-phosphoprotein 1 (Hsp70/Hsp9 |
| 40E12 | 836 | 1765 | M98399 | Hs.75613 | 0 | 2 | antigen CD36 (clone 21) mRNA, complete cds/cds(254,1 |
| 107C6 | 1491 | 1595 | AF113676 | Hs.75621 | 3.00E−51 | 1 | clone FLB2803 PRO0684 mRNA, complete cds/cds = |
| 117E9 | 149 | 1033 | NM_001779 | Hs.75626 | 0 | 2 | CD58 antigen, (lymphocyte function-associate |
| 482H10 | 740 | 1367 | NM_000591 | Hs.75627 | 0 | 1 | CD14 antigen (CD14), mRNA/cds = (119,1246)/gb |
| 482D4 | 1342 | 1659 | NM_006163 | Hs.75643 | 3.00E−82 | 1 | nuclear factor (erythroid-derived 2), 45 kD (N |
| 73F8 | 2864 | 3657 | L49169 | Hs.75678 | 0 | 20 | G0S3 mRNA, complete cds/cds = (593,1609)/ gb = L49169/ |
| 58G3 | 3222 | 3657 | NM_006732 | Hs.75678 | 0 | 6 | FBJ murine osteosarcoma viral oncogene homolo |
| 53A7 | 30 | 836 | J04130 | Hs.75703 | 0 | 138 | activation (Act-2) mRNA, complete cds/cds = (108,386) |
| 500E11 | 41 | 688 | NM_002984 | Hs.75703 | 0 | 128 | small inducible cytokine A4 (homologous to mo |
| 170E9 | 415 | 2376 | M16985 | Hs.75709 | 0 | 6 | cation-dependent mannose 6-phosphate-specific rece |
| 591E8 | 1759 | 2401 | NM_002355 | Hs.75709 | 0 | 3 | mannose-6-phosphate receptor (cation depende |
| 191A11 | 20 | 1900 | NM_002575 | Hs.75716 | 0 | 13 | serine (or cysteine) proteinase inhibitor, cl |
| 184F5 | 18 | 1900 | Y00630 | Hs.75716 | 0 | 8 | Arg-Serpin (plasminogen activator-inhibito |
| 593G8 | 238 | 747 | NM_005022 | Hs.75721 | 1.00E−110 | 2 | profilin 1 (PFN1), mRNA/cds = (127,549)/gb = NM |
| 178G9 | 504 | 2101 | NM_002951 | Hs.75722 | 0 | 2 | ribophorin II (RPN2), mRNA/cds = (288,2183)/g |
| 138F12 | 2341 | 2488 | Y00282 | Hs.75722 | 4.00E−60 | 1 | ribophorin II/cds = (288,2183)/gb = Y00282/g |
| 37F7 | 1328 | 1863 | AK023290 | Hs.75748 | 0 | 3 | FLJ13228 fis, clone OVARC1000085, highly |
| 119C7 | 3736 | 4103 | NM_003137 | Hs.75761 | 1.00E−172 | 1 | SFRS protein kinase 1 (SRPK1), mRNA/cds = (108,2 |
| 52E8 | 574 | 1106 | M36820 | Hs.75765 | 0 | 2 | cytokine (GRO-beta) mRNA, complete cds/ cds = (74,397) |
| 74C8 | 2055 | 3026 | M10901 | Hs.75772 | 0 | 4 | glucocorticoid receptor alpha mRNA, complete cds/cd |
| 196C5 | 2600 | 4591 | NM_000176 | Hs.75772 | 0 | 5 | nuclear receptor subfamily 3, group C, member |
| 68E7 | 2194 | 2597 | D87953 | Hs.75789 | 0 | 1 | RTP, complete cds/cds = (122,1306)/gb = D87953 |
| 116E3 | 289 | 621 | NM_016470 | Hs.75798 | 0 | 1 | hypothetical protein (HSPC207), mRNA/cds = (0 |
| 107C10 | 650 | 1165 | AK025732 | Hs.75811 | 0 | 1 | FLJ22079 fis, clone HEP13180, highly sim |
| 123C12 | 459 | 969 | NM_004315 | Hs.75811 | 0 | 1 | N-acylsphingosine amidohydrolase (acid cera |
| 99E11 | 1007 | 2346 | NM_014761 | Hs.75824 | 0 | 2 | KIAA0174 gene product (KIAA0174), mRNA/cds = ( |
| 128C11 | 377 | 906 | NM_006817 | Hs.75841 | 0 | 2 | endoplasmic reticulum lumenal protein (ERP28 |
| 175F5 | 455 | 843 | X94910 | Hs.75841 | 1.00E−173 | 1 | ERp28 protein/cds = (11,796)/gb = X9491 |
| 182F12 | 4263 | 4842 | D86550 | Hs.75842 | 0 | 1 | mRNA for serine/threonine protein kinase, complete c |
| 175E3 | 3255 | 3787 | AL110132 | Hs.75875 | 0 | 1 | mRNA; cDNA DKFZp564H192 (from clone DKFZp564H1 |
| 195G3 | 1435 | 2132 | NM_003349 | Hs.75875 | 0 | 2 | ubiquitin-conjugating enzyme E2 variant 1 (U |
| 184B12 | 17 | 282 | BF698920 | Hs.75879 | 1.00E−138 | 8 | 602126495F1 cDNA, 5' end/clone = IMAGE: 4283350 |
| 67G6 | 1218 | 1605 | AK000639 | Hs.75884 | 1.00E−173 | 1 | FLJ20632 fis, clone KAT03756, highly simi |
| 516A11 | 721 | 1109 | NM_015416 | Hs.75884 | 0 | 2 | DKFZP586A011 protein (DKFZP586A011), mRNA/c |
| 44B1 | 1066 | 4914 | NM_004371 | Hs.75887 | 0 | 4 | coatomer protein complex, subunit alpha (COPA |
| 594D3 | 3971 | 4158 | NM_003791 | Hs.75890 | 1.00E−73 | 1 | site-1 protease (subtilisin-like, sterol-reg |
| 459H8 | 5291 | 5688 | D87446 | Hs.75912 | 1.00E−160 | 1 | mRNA for KIAA0257 gene, partial cds/cds = (0,5418)/gb |
| 113F6 | 2281 | 2807 | NM_006842 | Hs.75916 | 0 | 1 | splicing factor 3b, subunit 2, 145 kD (SF382), m |
| 104F9 | 2334 | 2804 | U41371 | Hs.75916 | 0 | 1 | spliceosome associated protein (SAP 145) mRNA, compl |
| 100F12 | 656 | 825 | AK024890 | Hs.75932 | 6.00E−83 | 1 | FLJ21237 fis, clone COL01114/cds = UNKNOW |
| 39E1 | 40 | 526 | BF217687 | Hs.75968 | 1.00E−124 | 2 | 601882510F1 cDNA, 5' end/clone = IMAGE: 4094907 |
| 111G8 | 41 | 547 | NM_021109 | Hs.75968 | 1.00E−166 | 19 | thymosin, beta 4, X chromosome (TMSB4X), mRNA |
| 478A7 | 1335 | 1653 | NM_006813 | Hs.75969 | 1.00E−119 | 1 | proline-rich protein with nuclear targeting s |
| 70E9 | 652 | 1065 | U03105 | Hs.75969 | 0 | 1 | B4-2 protein mRNA, complete cds/cds = (113,1096)/ gb = U |
| 596B9 | 508 | 1461 | NM_003133 | Hs.75975 | 0 | 2 | signal recognition particle 9 kD (SRP9), mRNA |
| 513F12 | 1359 | 2169 | NM_005151 | Hs.75981 | 0 | 3 | ubiquitin specific protease 14 (tRNA-guanine |
| 74B3 | 1361 | 2166 | U30888 | Hs.75981 | 0 | 2 | tRNA-guanine transglycosylase mRNA, complete cds/c |
| 67B6 | 81 | 1457 | X17025 | Hs.76038 | 0 | 4 | homolog of yeast IPP isomerase/cds = (50,736)/ gb = X170 |
| 586F2 | 1471 | 2197 | NM_004396 | Hs.76053 | 0 | 13 | DEAD/H (Asp-Glu-Ala-Asp/His) box polypeptide |
| 70B3 | 762 | 2211 | X52104 | Hs.76053 | 0 | 12 | p68 protein/cds = (175,2019)/gb = X52104/gi = 3 |
| 73B2 | 32 | 494 | BF214146 | Hs.76064 | 0 | 1 | 601847762F1 cDNA, 5' end/clone = IMAGE: 4078622 |
| 523E6 | 10 | 441 | NM_000990 | Hs.76064 | 0 | 2 | ribosomal protein L27a (RPL27A), mRNA/cds = (1 |
| 38F7 | 6 | 372 | Z23090 | Hs.76067 | 0 | 2 | 28 kDa heat shock protein/cds = (491,1108) |
| 59B6 | 916 | 1274 | AF071596 | Hs.76095 | 1.00E−174 | 1 | apoptosis inhibitor (IEX-1L) gene, complete c |
| 493B3 | 540 | 1206 | NM_003897 | Hs.76095 | 0 | 3 | immediate early response 3 (IER3), mRNA/cds = ( |
| 483D7 | 1399 | 2063 | NM_005626 | Hs.76122 | 0 | 1 | splicing factor, arginine/serine-rich 4 (SFR |
| 591C12 | 13412 | 13873 | NM_003922 | Hs.76127 | 0 | 3 | hect (homologous to the E6-AP (UBE3A) carboxyl |
| 65H7 | 12209 | 12580 | U50078 | Hs.76127 | 0 | 1 | guanine nucleotide exchange factor p532 mRNA, complet |
| 160B6 | 79 | 535 | X77584 | Hs.76136 | 1.00E−140 | 1 | ATL-derived factor/thiredoxin/cds = (80 |
| 596A9 | 1 | 124 | NM_001009 | Hs.76194 | 3.00E−62 | 1 | ribosomal protein S5 (RPS5), mRNA/cds = (37,651 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 51H5 | 2834 | 3174 | AK025353 | Hs.76230 | 1.00E−180 | 1 | cDNA: FLJ21700 fis, clone COL09849, highly sim |
| 115C8 | 1589 | 2005 | NM_001748 | Hs.76288 | 0 | 1 | calpain 2, (m/II) large subunit (CAPN2), mRNA |
| 588C5 | 4 | 336 | NM_004492 | Hs.76362 | 0 | 2 | general transcription factor IIA, 2 (12 kD subu |
| 111D9 | 732 | 1077 | NM_004930 | Hs.76368 | 1.00E−161 | 2 | capping protein (actin filament) muscle Z-lin |
| 192A11 | 1589 | 1995 | NM_002462 | Hs.76391 | 0 | 3 | myxovirus (influenza) resistance 1, homolog o |
| 39F5 | 8481 | 8730 | Y00285 | Hs.76473 | 1.00E−111 | 1 | insuline-like growth factor II receptor/cds |
| 98C4 | 487 | 3719 | NM_002298 | Hs.76506 | 0 | 38 | lymphocyte cytosolic protein 1 (L-plastin) (L |
| 124H12 | 611 | 1747 | NM_004862 | Hs.76507 | 0 | 5 | LPS-induced TNF-alpha factor (PIG7), mRNA/cd |
| 37A6 | 920 | 1524 | U77396 | Hs.76507 | 1.00E−162 | 2 | LPS-Induced TNF-Alpha Factor (LITAF) mRNA, co |
| 71E9 | 759 | 3362 | D00099 | Hs.76549 | 0 | 4 | mRNA for Na,K-ATPase alpha-subunit, complete |
| 73F5 | 951 | 1277 | AK001361 | Hs.76556 | 1.00E−168 | 1 | FLJ10499 fis, clone NT2RP2000346, weakly |
| 48H6 | 1097 | 1603 | NM_014330 | Hs.76556 | 0 | 2 | growth arrest and DNA-damage-inducible 34 (G |
| 160C8 | 74 | 181 | BE730376 | Hs.76572 | 2.00E−40 | 1 | 601563816F1 5' end/clone = IMAGE: 3833690 |
| 589D11 | 86 | 455 | NM_001697 | Hs.76572 | 0 | 2 | ATP synthase, H+ transporting, mitochondrial |
| 38B1 | 227 | 886 | NM_014059 | Hs.76640 | 0 | 9 | RGC32 protein (RGC32), mRNA/cds = (146,499)/g |
| 174B12 | 3024 | 4628 | D80005 | Hs.76666 | 1.00E−136 | 4 | mRNA for KIAA0183 gene, partial cds/cds = (0,3190)/gb |
| 37A11 | 1788 | 3255 | AF070673 | Hs.76691 | 0 | 5 | stannin mRNA, complete cds/cds = (175,441)/gb |
| 58H11 | 1706 | 2088 | AL136807 | Hs.76698 | 0 | 2 | mRNA; cDNA DKFZp434L1621 (from clone DKFZp434L |
| 477F9 | 6930 | 7298 | AB002299 | Hs.76730 | 0 | 2 | mRNA for KIAA0301 gene, partial cds/cds = (0,6144)/gb |
| 40G7 | 293 | 819 | NM_000118 | Hs.76753 | 0 | 1 | endoglin (Osler-Rendu-Weber syndrome 1) (EN |
| 75C11 | 10 | 1113 | J00194 | Hs.76807 | 0 | 5 | human hla-dr antigen alpha-chain mrna & ivs fragments/cds = |
| 99F4 | 10 | 969 | NM_019111 | Hs.76807 | 0 | 6 | major histocompatibility complex, class II, |
| 61G12 | 1870 | 2511 | AL133096 | Hs.76853 | 0 | 1 | cDNA DKFZp434N1728 (from clone DKFZp434N |
| 599C2 | 41 | 346 | NM_002790 | Hs.76913 | 1.00E−124 | 1 | proteasome (prosome, macropain) subunit, alp |
| 155C2 | 508 | 870 | X61970 | Hs.76913 | 0 | 1 | for macropain subunit zeta/cds = (21,746)/g |
| 70C5 | 3398 | 3754 | AF002020 | Hs.76918 | 0 | 1 | Niemann-Pick C disease protein (NPC1) mRNA, co |
| 57A11 | 2173 | 2764 | NM_000271 | Hs.76918 | 0 | 1 | Niemann-Pick disease, type C1 (NPC1), mRNA/cd |
| 158C9 | 314 | 1233 | NM_001679 | Hs.76941 | 0 | 3 | ATPase, Na+/K+ transporting, beta 3 polypeptid |
| 520E1 | 4175 | 4502 | NM_014757 | Hs.76986 | 1.00E−158 | 1 | mastermind (Drosophila), homolog of (MAML1), |
| 587D8 | 22 | 869 | NM_001006 | Hs.77039 | 0 | 5 | ribosomal protein S3A (RPS3A), mRNA/cds = (36,8 |
| 481F2 | 440 | 1488 | NM_001731 | Hs.77054 | 0 | 3 | B-cell translocation gene 1, anti-proliferati |
| 53G11 | 340 | 1490 | X61123 | Hs.77054 | 0 | 3 | BTG1 mRNA/cds = (308,823)/gb = X61123/gi = 29508/ug = Hs |
| 521A6 | 147 | 1325 | D55716 | Hs.77152 | 0 | 2 | mRNA for P1cdc47, complete cds/cds = (116,2275)/gb = D |
| 37H9 | 2109 | 2530 | X07109 | Hs.77202 | 0 | 1 | protein kinase C (PKC) type/cds = (136,2157)/ |
| 167H5 | 3915 | 4508 | NM_006437 | Hs.77225 | 0 | 1 | ADP-ribosyltransferase (NAD+; poly (ADP-ribo |
| 139G5 | 2183 | 2389 | U61145 | Hs.77256 | 1.00E−111 | 1 | enhancer of zeste homolog 2 (EZH2) mRNA, complete cds |
| 109H2 | 2502 | 2893 | D38549 | Hs.77257 | 0 | 1 | KIAA0068 gene, partial cds/cds = (0,3816)/gb |
| 184B7 | 619 | 1111 | L25080 | Hs.77273 | 0 | 1 | GTP-binding protein (rhoA) mRNA, complete cds |
| 587H1 | 614 | 1371 | NM_001664 | Hs.77273 | 0 | 9 | ras homolog gene family, member A (ARHA), mRNA |
| 99G10 | 1387 | 2219 | NM_002658 | Hs.77274 | 0 | 1 | plasminogen activator, urokinase (PLAU), mRN |
| 143C12 | 2403 | 2905 | AL049332 | Hs.77311 | 0 | 2 | cDNA DKFZp564L176 (from clone DKFZp564L1 |
| 519B11 | 5248 | 5555 | NM_000430 | Hs.77318 | 1.00E−160 | 1 | platelet-activating factor acetylhydrolase, |
| 52F10 | 3249 | 3459 | AF095901 | Hs.77324 | 1.00E−114 | 2 | eRF1 gene, complete cds/cds = (136,1449)/gb = A |
| 494G1 | 3255 | 3453 | NM_004730 | Hs.77324 | 1.00E−109 | 2 | eukaryotic translation termination factor 1 |
| 517E4 | 305 | 973 | NM_014754 | Hs.77329 | 0 | 2 | phosphatidylserine synthase 1 (PTDSS1), mRNA |
| 72F9 | 1934 | 4605 | AF187320 | Hs.77356 | 0 | 10 | transferrin receptor (TFRC) gene, complete cd |
| 46D6 | 241 | 4902 | NM_003234 | Hs.77356 | 0 | 2 | transferrin receptor (p90, CD71) (TFRC), mRNA |
| 113A12 | 1028 | 1290 | NM_024033 | Hs.77365 | 1.00E−145 | 1 | hypothetical protein MGC5242 (MGC5242), mRNA |
| 173A7 | 1142 | 1649 | AK026164 | Hs.77385 | 0 | 2 | cDNA: FLJ22511 fis, clone HRC11837, highly sim |
| 189E7 | 466 | 798 | NM_002004 | Hs.77393 | 0 | 1 | farnesyl diphosphate synthase (farnesyl pyro |
| 479B1 | 306 | 482 | NM_000566 | Hs.77424 | 8.00E−55 | 1 | Fc fragment of IgG, high affinity Ia, receptor |
| 41E12 | 351 | 898 | X14356 | Hs.77424 | 0 | 1 | high affinity Fc receptor (FcRI)/cds = (36,116 |
| 122D3 | 562 | 855 | NM_002664 | Hs.77436 | 1.00E−145 | 1 | pleckstrin (PLEK), mRNA/cds = (60,1112)/gb = N |
| 59C11 | 1 | 2745 | X07743 | Hs.77436 | 0 | 5 | pleckstrin (P47)/cds = (60,1112)/gb = X07743 |
| 590B1 | 5185 | 5274 | NM_001379 | Hs.77462 | 1.00E−44 | 1 | DNA (cytosine-5-)-methyltransferase 1 (DNMT1 |
| 522D1 | 572 | 956 | NM_001929 | Hs.77494 | 0 | 1 | deoxyguanosine kinase (DGUOK), mRNA/cds = (11, |
| 109E12 | 723 | 2474 | D87684 | Hs.77495 | 1.00E−163 | 5 | for KIAA0242 protein, partial cds/cds = (0, |
| 148E2 | 61 | 271 | BE737246 | Hs.77496 | 1.00E−81 | 1 | 601305556F1 5' end/clone = IMAGE: 3640165 |
| 586D4 | 1887 | 2362 | NM_003363 | Hs.77500 | 0 | 1 | ubiquitin specific protease 4 (proto-oncogene |
| 57E8 | 29 | 2808 | BC001854 | Hs.77502 | 0 | 30 | methionine adenosyltransferase II, alpha, c |
| 70H9 | 87 | 1283 | X68836 | Hs.77502 | 0 | 14 | S-adenosylmethionine synthetase/cds = ( |
| 69B2 | 778 | 3033 | M20867 | Hs.77508 | 0 | 2 | glutamate dehydrogenase (GDH) mRNA, complete cds/cd |
| 513F9 | 2694 | 2929 | NM_005271 | Hs.77508 | 1.00E−105 | 1 | glutamate dehydrogenase 1 (GLUD1), mRNA/cds = |
| 75A3 | 190 | 701 | X62744 | Hs.77522 | 0 | 1 | RING6 mRNA for HLA class II alpha product/cds = (45,830 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 105E10 | 72 | 597 | BE673364 | Hs.77542 | 0 | 3 | 7d34a03.x1 cDNA, 3' end/clone = IMAGE: 3249100 |
| 124B2 | 85 | 683 | BF508702 | Hs.77542 | 0 | 8 | UI-H-BI4-aop-g-05-0-UI.s1 cDNA, 3' end/clon |
| 524C9 | 829 | 1233 | AK021563 | Hs.77558 | 0 | 3 | cDNA FLJ11501 fis, clone HEMBA1002100/cds = UNK |
| 523B12 | 7580 | 8153 | NM_004652 | Hs.77578 | 0 | 2 | ubiquitin specific protease 9, X chromosome (D |
| 166F3 | 169 | 340 | AL021546 | Hs.77608 | 7.00E−63 | 1 | DNA sequence from BAC 15E1 on chromosome 12. Contains |
| 195A11 | 164 | 451 | NM_003769 | Hs.77608 | 1.00E−162 | 1 | splicing factor, arginine/serine-rich 9 (SF |
| 595E1 | 618 | 1461 | AF056322 | Hs.77617 | 0 | 7 | SP100-HMG nuclear autoantigen (SP100) mRNA, c |
| 115A6 | 2954 | 3541 | AL137938 | Hs.77646 | 0 | 2 | mRNA; cDNA DKFZp761M0223 (from clone DKFZp761M |
| 592H6 | 261 | 951 | NM_014752 | Hs.77665 | 0 | 3 | KIAA0102 gene product (KIAA0102), mRNA/cds = ( |
| 461F3 | 4657 | 4980 | NM_014749 | Hs.77724 | 1.00E−174 | 1 | KIAA0586 gene product (KIAA0586), mRNA/cds = ( |
| 98C8 | 27 | 1961 | NM_002543 | Hs.77729 | 0 | 4 | oxidised low density lipoprotein (lectin-like |
| 598A12 | 101 | 1396 | NM_006759 | Hs.77837 | 0 | 4 | UDP-glucose pyrophosphorylase 2 (UGP2), mRNA |
| 594H8 | 1 | 872 | NM_006802 | Hs.77897 | 1.00E−144 | 2 | splicing factor 3a, subunit 3, 60 kD (SF3A3), mR |
| 171E4 | 1140 | 1394 | X81789 | Hs.77897 | 1.00E−110 | 1 | for splicing factor SF3a60/cds = (565,2070) |
| 500F1 | 2185 | 2496 | AK025736 | Hs.77910 | 1.00E−160 | 1 | cDNA: FLJ22083 fis, clone HEP14459, highly sim |
| 525B10 | 1696 | 2060 | NM_000122 | Hs.77929 | 0 | 1 | excision repair cross-complementing rodent r |
| 53E1 | 877 | 1539 | AK026595 | Hs.77961 | 0 | 7 | FLJ22942 fis, clone KAT08170, highly sim |
| 521C6 | 631 | 1089 | NM_005514 | Hs.77961 | 1.00E−115 | 4 | major histocompatibility complex, class I, B |
| 588C3 | 300 | 653 | NM_004792 | Hs.77965 | 0 | 1 | Clk-associating RS-cyclophilin (CYP), mRNA |
| 523C6 | 277 | 582 | NM_001912 | Hs.78056 | 1.00E−143 | 1 | cathepsin L (CTSL), mRNA/cds = (288,1289)/gb = |
| 140D10 | 292 | 1549 | X12451 | Hs.78056 | 0 | 3 | pro-cathepsin L (major excreted protein MEP) |
| 463E5 | 129 | 552 | NM_005969 | Hs.78103 | 0 | 1 | nucleosome assembly protein 1-like 4 (NAP1L4) |
| 166H3 | 540 | 895 | U77456 | Hs.78103 | 0 | 1 | nucleosome assembly protein 2 mRNA, complete cds/cd |
| 40B10 | 2433 | 2543 | M28526 | Hs.78146 | 5.00E−29 | 1 | platelet endothelial cell adhesion molecule (PECAM-1 |
| 114E5 | 1671 | 2029 | NM_000442 | Hs.78146 | 1.00E−162 | 1 | platelet/endothelial cell adhesion molecule |
| 513D11 | 28 | 1399 | NM_000700 | Hs.78225 | 0 | 5 | annexin A1 (ANXA1), mRNA/cds = (74,1114)/gb = N |
| 331B3 | 219 | 1370 | X05908 | Hs.78225 | 0 | 3 | lipocortin/cds = (74,1114)/gb = X05908/gi = 34 |
| 56A12 | 1383 | 2379 | X94232 | Hs.78335 | 0 | 4 | novel T-cell activation protein/cds = (14 |
| 465H1 | 386 | 904 | NM_002812 | Hs.78466 | 0 | 2 | proteasome (prosome, macropain) 26S subunit, |
| 108H7 | 2067 | 2486 | L42572 | Hs.78504 | 0 | 1 | p87/89 gene, complete cds/cds = (92,2368)/gb = |
| 187E9 | 729 | 1494 | NM_006839 | Hs.78504 | 0 | 2 | inner membrane protein, mitochondrial (mitofi |
| 102F2 | 672 | 2947 | L14561 | Hs.78546 | 0 | 2 | plasma membrane calcium ATPase isoform 1 (ATP |
| 591H12 | 42 | 1949 | NM_004034 | Hs.78637 | 0 | 3 | annexin A7 (ANXA7), transcript variant 2, mRN |
| 595H3 | 2775 | 3030 | NM_003470 | Hs.78683 | 3.00E−96 | 1 | ubiquitin specific protease 7 (herpes virus-as |
| 62F5 | 2775 | 3838 | Z72499 | Hs.78683 | 0 | 2 | herpesvirus associated ubiquitin-speci |
| 46G4 | 2632 | 3238 | NM_003580 | Hs.78687 | 0 | 1 | neutral sphingomyelinase (N-SMase) activatio |
| 513A11 | 342 | 1258 | NM_002635 | Hs.78713 | 0 | 10 | solute carrier family 25 (mitochondrial carri |
| 472A4 | 3018 | 3286 | NM_024298 | Hs.78768 | 1.00E−132 | 1 | malignant cell expression-enhanced gene/tumo |
| 177A3 | 377 | 1186 | AL049589 | Hs.78771 | 0 | 3 | DNA sequence from clone 570L12 on chromosome Xq13.1−2 |
| 71E6 | 303 | 1767 | NM_000291 | Hs.78771 | 0 | 12 | phosphoglycerate kinase 1 (PGK1), mRNA/cds = ( |
| 181D8 | 2104 | 3677 | NM_018834 | Hs.78825 | 0 | 4 | matrin 3 (MATR3), mRNA/cds = (254,2800)/gb = NM |
| 126G6 | 2498 | 2959 | AL162049 | Hs.78829 | 0 | 1 | mRNA; cDNA DKFZp762E1712 (from clone DKFZp762E |
| 41C3 | 1743 | 2340 | M31932 | Hs.78864 | 0 | 2 | IgG low affinity Fc fragment receptor (FcRIIa) mRNA, c |
| 166D11 | 1696 | 2156 | M81601 | Hs.78869 | 0 | 1 | transcription elongation factor (SII) mRNA, complete |
| 517B3 | 565 | 1392 | D42039 | Hs.78871 | 0 | 3 | mRNA for KIAA0081 gene, partial cds/cds = (0,702)/ gb = |
| 180G11 | 59 | 517 | NM_020548 | Hs.78888 | 0 | 1 | diazepam binding inhibitor (GABA receptor mod |
| 99B7 | 2356 | 3329 | U07802 | Hs.78909 | 0 | 45 | Tis11d gene, complete cds/cds = (291,1739)/ gb = U07802 |
| 54C4 | 557 | 1101 | U13045 | Hs.78915 | 0 | 1 | nuclear respiratory factor-2 subunit beta 1 mRNA, com |
| 44A5 | 634 | 1128 | U29607 | Hs.78935 | 0 | 2 | methionine aminopeptidase mRNA, complete cds/ cds = (2 |
| 63A2 | 964 | 1050 | X92106 | Hs.78943 | 7.00E−31 | 1 | bleomycin hydrolase/cds = (78,1445)/gb |
| 163G9 | 228 | 877 | L13463 | Hs.78944 | 0 | 3 | helix-loop-helix basic phosphoprotein (G0S8) mRNA, |
| 119H6 | 472 | 877 | NM_002923 | Hs.78944 | 0 | 1 | regulator of G-protein signalling 2,24 kD (RG |
| 166E2 | 5629 | 5764 | U51903 | Hs.78993 | 2.00E−69 | 1 | RasGAP-related protein (IQGAP2) mRNA, complete cds |
| 40F9 | 66 | 603 | M15796 | Hs.78996 | 0 | 1 | cyclin protein gene, complete cds/cds = (118,903)/gb |
| 593E5 | 156 | 854 | NM_012245 | Hs.79008 | 0 | 5 | SKI-INTERACTING PROTEIN (SNW1), mRNA/ cds = (2 |
| 485B7 | 276 | 599 | AF063591 | Hs.79015 | 1.00E−136 | 1 | brain my033 protein mRNA, complete cds/cds = (5 |
| 61B4 | 125 | 732 | X05323 | Hs.79015 | 0 | 2 | MRC OX-2 gene signal sequence/cds = (0,824)/ gb = X05323 |
| 71C8 | 330 | 1958 | NM_005261 | Hs.79022 | 0 | 24 | GTP-binding protein overexpressed in skeletal |
| 75G8 | 330 | 1957 | U10550 | Hs.79022 | 0 | 63 | Gem GTPase (gem) mRNA, complete cds/ cds = (213,1103)/ |
| 584G1 | 4424 | 5153 | AF226044 | Hs.79025 | 0 | 2 | HSNFRK (HSNFRK) mRNA, complete cds/ |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 117C5 | 358 | 933 | NM_012413 | Hs.79033 | 0 | 1 | cds = (641,2 glutaminyl-peptide cyclotransferase (glutam |
| 72B2 | 910 | 2015 | AJ250915 | Hs.79037 | 0 | 9 | p10 gene for chaperonin 10 (Hsp10 protein) and |
| 71G11 | 880 | 1981 | NM_002156 | Hs.79037 | 0 | 5 | heat shock 60 kD protein 1 (chaperonin) (HSPD1) |
| 193H12 | 1859 | 2474 | NM_003243 | Hs.79059 | 0 | 5 | transforming growth factor, beta receptor III |
| 460B4 | 846 | 1325 | NM_001930 | Hs.79064 | 0 | 1 | deoxyhypusine synthase (DHPS), transcript va |
| 75C4 | 1166 | 2087 | K02276 | Hs.79070 | 0 | 85 | (Daudi) translocated t(8;14) c-myc oncogene mRNA, co |
| 71G10 | 1274 | 2121 | NM_002467 | Hs.79070 | 0 | 12 | v-myc avian myelocytomatosis viral oncogene h |
| 183D8 | 385 | 741 | NM_002710 | Hs.79081 | 0 | 1 | protein phosphatase 1, catalytic subunit, gam |
| 170A12 | 741 | 1203 | X74008 | Hs.79081 | 0 | 1 | protein phosphatase 1 gamma/cds = (154,11 |
| 121D9 | 2920 | 3385 | NM_006378 | Hs.79089 | 0 | 1 | sema domain, immunoglobulin domain (Ig), tran |
| 40C12 | 2933 | 4108 | U60800 | Hs.79089 | 0 | 4 | semaphorin (CD100) mRNA, complete cds/ cds = (87,2675) |
| 104E1 | 1708 | 1932 | L35263 | Hs.79107 | 1.00E−101 | 1 | CSaids binding protein (CSBP1) mRNA, complete cds/cd |
| 70B2 | 913 | 2497 | AK000221 | Hs.79110 | 0 | 9 | FLJ20214 fis, clone COLF2014, highly simi |
| 123B12 | 1929 | 2644 | D42043 | Hs.79123 | 0 | 3 | mRNA for KIAA0084 gene, partial cds/cds = (0,1946)/gb |
| 193G7 | 802 | 1425 | NM_004379 | Hs.79194 | 0 | 2 | cAMP responsive element binding protein 1 (CR |
| 75D5 | 158 | 2139 | NM_004233 | Hs.79197 | 0 | 16 | CD83 antigen (activated B lymphocytes, immuno |
| 74H2 | 98 | 1357 | NM_001154 | Hs.79274 | 0 | 2 | annexin A5 (ANXA5), mRNA/cds = (192,1154)/gb = |
| 519G7 | 5358 | 5496 | D86985 | Hs.79276 | 2.00E−69 | 1 | mRNA for KIAA0232 protein, partial cds/cds = (0, |
| 462C2 | 1477 | 2031 | NM_003006 | Hs.79283 | 0 | 1 | selectin P ligand (SELPLG), mRNA/cds = (59,1267 |
| 65C6 | 23 | 1609 | M15353 | Hs.79306 | 0 | 6 | cap-binding protein mRNA, complete cds/cds = (1 |
| 64H8 | 326 | 1610 | NM_001968 | Hs.79306 | 0 | 3 | eukaryotic translation initiation factor 4E |
| 52C3 | 1333 | 1904 | X64318 | Hs.79335 | 0 | 1 | E4BP4 gene/cds = (213,1601)/gb = X64318/gi = 30955 |
| 39F7 | 1179 | 1740 | AF109733 | Hs.79335 | 0 | 1 | SWI/SNF-related, matrix-associated, actin-d |
| 194A7 | 1512 | 1803 | NM_003076 | Hs.79335 | 1.00E−118 | 1 | SWI/SNF related, matrix associated, actin dep |
| 463E12 | 4326 | 4831 | NM_015148 | Hs.79337 | 0 | 1 | KIAA0135 protein (KIAA0135), mRNA/cds = (1803, |
| 526B5 | 1420 | 1867 | NM_002958 | Hs.79350 | 0 | 2 | RYK receptor-like tyrosine kinase (RYK), mRNA |
| 460F3 | 1755 | 2242 | NM_006285 | Hs.79358 | 0 | 2 | testis-specific kinase 1 (TESK1), mRNA/cds = ( |
| 98B11 | 2076 | 4834 | X76061 | Hs.79362 | 0 | 11 | H. sapiens p130 mRNA for 130K protein/ cds = (69,3488)/gb = X76 |
| 45F3 | 2286 | 2666 | NM_001423 | Hs.79368 | 0 | 1 | epithelial membrane protein 1 (EMP1), mRNA/cd |
| 50C10 | 2016 | 2666 | Y07909 | Hs.79368 | 0 | 2 | Progression Associated Protein/cds = (21 |
| 118E3 | 549 | 1078 | NM_012198 | Hs.79381 | 0 | 1 | grancalcin (GCL), mRNA/cds = (119,772)/gb = NM_ |
| 181F4 | 657 | 1271 | NM_002805 | Hs.79387 | 0 | 2 | proteasome (prosome, macropain) 26S subunit, |
| 105H3 | 1114 | 1538 | D83018 | Hs.79389 | 0 | 1 | for nel-related protein 2, complete cds/ |
| 173B2 | 429 | 3009 | NM_006159 | Hs.79389 | 0 | 5 | nel (chicken)-like 2 (NELL2), mRNA/cds = (96,25 |
| 177B3 | 662 | 991 | AC004382 | Hs.79402 | 0 | 1 | Chromosome 16 BAC clone CIT987SK-A-152E5/cds |
| 590H3 | 663 | 1002 | NM_002694 | Hs.79402 | 0 | 1 | polymerase (RNA) II (DNA directed) polypeptide |
| 523B7 | 223 | 582 | NM_002946 | Hs.79411 | 0 | 1 | replication protein A2 (32 kD) (RPA2), mRNA/c |
| 182B10 | 472 | 1024 | U02019 | Hs.79625 | 1.00E−121 | 2 | AU-rich element RNA-binding protein AUF1 mRNA, comple |
| 479F3 | 100 | 301 | NM_001783 | Hs.79630 | 2.00E−86 | 1 | CD79A antigen (immunoglobulin-associated al |
| 40H9 | 582 | 1107 | U05259 | Hs.79630 | 0 | 1 | MB-1 gene, complete cds/cds = (36,716)/gb = U05259/gi |
| 116A2 | 1003 | 1368 | NM_006224 | Hs.79709 | 1.00E−176 | 1 | phosphotidylinositol transfer protein (PITPN |
| 74G8 | 252 | 1297 | D21853 | Hs.79768 | 0 | 5 | KIAA0111 gene, complete cds/cds = (214,1449) |
| 525G2 | 830 | 1297 | NM_014740 | Hs.79768 | 0 | 2 | KIAA0111 gene product (KIAA0111), mRNA/cds = ( |
| 125G3 | 2757 | 3339 | AF072928 | Hs.79877 | 0 | 1 | myotubularin related protein 6 mRNA, partial c |
| 184A2 | 532 | 1102 | AF135162 | Hs.79933 | 0 | 1 | cyclin I (CYC1) mRNA, complete cds/cds = (199,13 |
| 514C6 | 329 | 1256 | NM_006835 | Hs.79933 | 0 | 6 | cyclin I (CCNI), mRNA/cds = (0,1133)/gb = NM_006 |
| 116G5 | 824 | 1058 | NM_006875 | Hs.80205 | 1.00E−121 | 1 | pim-2 oncogene (PIM2), mRNA/cds = (185,1189)/ |
| 106C11 | 1700 | 1995 | U77735 | Hs.80205 | 1.00E−125 | 1 | pim-2 protooncogene homolog pim-2 h mRNA, complete cd |
| 110E3 | 276 | 653 | AL136139 | Hs.80261 | 0 | 1 | DNA sequence from clone RP4-76112 on chromosome 6 Con |
| 478D1 | 1067 | 2761 | NM_006403 | Hs.80261 | 2.00E−70 | 2 | enhancer of filamentation 1 (cas-like docking; |
| 178C8 | 880 | 1226 | AL050192 | Hs.80285 | 0 | 1 | mRNA; cDNA DKFZp586C1723 (from clone DKFZp586C |
| 494F11 | 477 | 5535 | NM_014739 | Hs.80338 | 0 | 8 | KIAA0164 gene product (KIAA0164), mRNA/cds = ( |
| 190A1 | 1165 | 1540 | NM_004156 | Hs.80350 | 1.00E−166 | 2 | protein phosphatase 2 (formerly 2A), catalytic |
| 461A1 | 4639 | 4913 | NM_004653 | Hs.80358 | 1.00E−140 | 1 | SMC (mouse) homolog, Y chromosome (SMCY), mRNA |
| 158A8 | 2656 | 3229 | L24498 | Hs.80409 | 0 | 1 | gadd45 gene, complete cds/cds = (2327,2824)/ gb = L2449 |
| 41E6 | 2385 | 2992 | U84487 | Hs.80420 | 0 | 2 | CX3C chemokine precursor, mRNA, alternatively splice |
| 40H4 | 2830 | 3605 | NM_000129 | Hs.80424 | 0 | 1 | coagulation factor XIII, A1 polypeptide (F13A |
| 464D3 | 214 | 835 | NM_004899 | Hs.80426 | 0 | 2 | brain and reproductive organ-expressed (TNFR |
| 75H8 | 1180 | 4930 | U12767 | Hs.80561 | 0 | 60 | mitogen induced nuclear orphan receptor (MINOR) mRNA |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 593E10 | 1 | 510 | NM_004552 | Hs.80595 | 1.00E−158 | 5 | NADH dehydrogenase (ubiquinone) Fe-S protein |
| 113C5 | 1182 | 1583 | NM_003336 | Hs.80612 | 0 | 1 | ubiquitin-conjugating enzyme E2A (RAD6 homol |
| 515B7 | 268 | 538 | NM_001020 | Hs.80617 | 2.00E−91 | 3 | ribosomal protein S16 (RPS16), mRNA/cds = (37,4 |
| 477F12 | 460 | 606 | NM_018996 | Hs.80618 | 1.00E−47 | 1 | hypothetical protein (FLJ20015), mRNA/cds = ( |
| 41A8 | 1331 | 1788 | L78440 | Hs.80642 | 0 | 1 | STAT4 mRNA, complete cds/cds = (81,2327)/gb = L |
| 594C1 | 1594 | 2586 | NM_003151 | Hs.80642 | 0 | 4 | signal transducer and activator of transcripti |
| 112C8 | 1802 | 1932 | NM_002198 | Hs.80645 | 2.00E−35 | 1 | interferon regulatory factor 1 (IRF1), mRNA/ |
| 522H8 | 1130 | 1533 | NM_003355 | Hs.80658 | 1.00E−135 | 4 | uncoupling protein 2 (mitochondrial, proton c |
| 123E4 | 259 | 757 | NM_002129 | Hs.80684 | 0 | 4 | high-mobility group (nonhistone chromosomal) |
| 109H1 | 263 | 754 | X62534 | Hs.80684 | 0 | 1 | HMG-2 mRNA/cds = (214,843)/gb = X62534/gi = 32332 |
| 149G9 | 1020 | 1607 | J05032 | Hs.80758 | 0 | 2 | aspartyl-tRNA synthetase alpha-2 subunit mRNA, compl |
| 461F12 | 1702 | 2246 | AL031600 | Hs.80768 | 0 | 1 | DNA sequence from clone 390E6 on chromosome 16. Contai |
| 102B2 | 1486 | 2008 | M16038 | Hs.80887 | 0 | 1 | lyn mRNA encoding a tyrosine kinase/cds = (297,1835)/ |
| 125B11 | 1260 | 2013 | NM_002350 | Hs.80887 | 0 | 5 | v-yes-1 Yamaguchi sarcoma viral related oncog |
| 37C9 | 2901 | 5260 | D79990 | Hs.80905 | 0 | 8 | KIAA0168 gene, complete cds/cds = (196,1176) |
| 196D6 | 2949 | 5261 | NM_014737 | Hs.80905 | 0 | 9 | Ras association (RalGDS/AF-6) domain family 2 |
| 584H1 | 4072 | 4296 | NM_002693 | Hs.80961 | 3.00E−91 | 1 | polymerase (DNA directed), gamma (POLG), nucl |
| 584F9 | 31 | 568 | AF174605 | Hs.81001 | 0 | 5 | F-box protein Fbx25 (FBX25) mRNA, partial cds |
| 102D11 | 1037 | 1632 | J03459 | Hs.81118 | 0 | 1 | leukotriene A-4 hydrolase mRNA, complete cds/ cds = (68 |
| 193F8 | 1037 | 1643 | NM_000895 | Hs.81118 | 0 | 2 | leukotriene A4 hydrolase (LTA4H), mRNA/cds = ( |
| 118H7 | 354 | 1148 | U65590 | Hs.81134 | 0 | 5 | IL-1 receptor antagonist IL-1Ra (IL-1RN) gene |
| 41H1 | 2549 | 2936 | X60992 | Hs.81226 | 0 | 1 | CD6 mRNA for T cell glycoprotein CD6/cds = (120,152 |
| 171B9 | 2070 | 2479 | AF248648 | Hs.81248 | 0 | 1 | RNA-binding protein BRUNOL2 (BRUNOL2) mRNA, c |
| 590A6 | 291 | 512 | NM_002961 | Hs.81256 | 3.00E−66 | 1 | S100 calcium-binding protein A4 (calcium prot |
| 73H2 | 389 | 1481 | M69043 | Hs.81328 | 0 | 14 | MAD-3 mRNA encoding IkB-like activity, complet |
| 513G1 | 637 | 1481 | NM_020529 | Hs.81328 | 0 | 13 | nuclear factor of kappa light polypeptide gene |
| 488F2 | 1065 | 1417 | NM_004499 | Hs.81361 | 1.00E−180 | 4 | heterogeneous nuclear ribonucleoprotein A/B |
| 151C8 | 1260 | 1423 | U76713 | Hs.81361 | 1.00E−61 | 1 | apobec-1 binding protein 1 mRNA, complete cds/ cds = (15 |
| 593B9 | 41 | 954 | NM_001688 | Hs.81634 | 0 | 3 | ATP synthase, H+ transporting, mitochondrial |
| 104H12 | 352 | 912 | X60221 | Hs.81634 | 0 | 1 | H+-ATP synthase subunit b/cds = (32,802) |
| 141G8 | 1132 | 1642 | AK001883 | Hs.81648 | 0 | 1 | FLJ11021 fis, clone PLACE1003704, weakly |
| 41A1 | 4214 | 4395 | X06182 | Hs.81665 | 5.00E−67 | 1 | c-kit proto-oncogene mRNA/cds = (21,2951)/ gb = X06182 |
| 102F5 | 3037 | 3646 | D38551 | Hs.81848 | 0 | 1 | KIAA0078 gene, complete cds/cds = (184,2079) |
| 111E11 | 1375 | 1752 | NM_006265 | Hs.81848 | 0 | 1 | RAD21 (S. pombe) homolog (RAD21), mRNA/cds = (1 |
| 592F8 | 38 | 720 | NM_014736 | Hs.81892 | 0 | 1 | KIAA0101 gene product (KIAA0101), mRNA/cds = ( |
| 194F1 | 6886 | 7115 | AF241785 | Hs.81897 | 1.00E−117 | 1 | NPD012 (NPD012) mRNA, complete cds/cds = (552,2 |
| 525C6 | 1 | 615 | NM_005563 | Hs.81915 | 0 | 4 | leukemia-associated phosphoprotein p18 (sta |
| 101D12 | 3249 | 3508 | D38555 | Hs.81964 | 1.00E−143 | 1 | KIAA0079 gene, complete cds/cds = (114,3491) |
| 176D11 | 2996 | 3168 | NM_004922 | Hs.81964 | 9.00E−94 | 2 | SEC24 (S. cerevisiae) related gene family, mem |
| 129B7 | 5068 | 5759 | D50683 | Hs.82028 | 0 | 4 | for TGF-betaIIR alpha, complete cds/cds = |
| 195H6 | 946 | 1208 | NM_006023 | Hs.82043 | 6.00E−74 | 1 | D123 gene product (D123), mRNA/cds = (280,1290) |
| 481D9 | 2709 | 3085 | NM_002184 | Hs.82065 | 1.00E−134 | 1 | interleukin 6 signal transducer (gp130, oncos |
| 129A5 | 1338 | 1802 | M14083 | Hs.82085 | 0 | 1 | beta-migrating plasminogen activator inhibitor I mR |
| 57G9 | 500 | 1561 | AF220656 | Hs.82101 | 1.00E−145 | 3 | apoptosis-associated nuclear protein PHLDA1 |
| 40C11 | 3748 | 4497 | M27492 | Hs.82112 | 0 | 1 | interleukin 1 receptor mRNA, complete cds/ cds = (82,17 |
| 481B6 | 3164 | 3609 | NM_000877 | Hs.82112 | 0 | 1 | interleukin 1 receptor, type I (IL1R1), mRNA/ |
| 40H6 | 161 | 557 | AB049113 | Hs.82113 | 0 | 1 | DUT mRNA for dUTP pyrophosphatase, complete cd |
| 592B7 | 184 | 568 | NM_001948 | Hs.82113 | 1.00E−111 | 2 | dUTP pyrophosphatase (DUT), mRNA/cds = (29,523 |
| 114F1 | 465 | 720 | U70451 | Hs.82116 | 1.00E−135 | 1 | myeloid differentiation primary response protein My |
| 71H5 | 194 | 3415 | NM_006186 | Hs.82120 | 0 | 36 | nuclear receptor subfamily 4, group A, member |
| 75C1 | 1264 | 3422 | X75918 | Hs.82120 | 0 | 84 | NOT/cds = (317,2113)/gb = X75918/gi = 4158 |
| 40D1 | 1621 | 2080 | M90391 | Hs.82127 | 0 | 1 | putative IL-16 protein precursor, mRNA, comple |
| 71C4 | 678 | 5065 | NM_002460 | Hs.82132 | 0 | 88 | interferon regulatory factor 4 (IRF4), mRNA/ |
| 75G12 | 3219 | 5316 | U52682 | Hs.82132 | 0 | 27 | lymphocyte specific interferon regulatory factor/in |
| 193G6 | 1118 | 2682 | NM_006874 | Hs.82143 | 1.00E−178 | 3 | E74-like factor 2 (ets domain transcription fa |
| 147F6 | 1484 | 1951 | AK025643 | Hs.82148 | 0 | 1 | FLJ21990 fis, clone HEP06386/cds = (22,49 |
| 155E4 | 853 | 1264 | M64992 | Hs.82159 | 0 | 1 | prosomal protein P30–33K (pros-30) mRNA, complete cd |
| 595F1 | 30 | 614 | NM_002786 | Hs.82159 | 0 | 3 | proteasome (prosome, macropain) subunit, alp |
| 58A4 | 473 | 1715 | NM_005655 | Hs.82173 | 0 | 3 | TGFB inducible early growth response (TIEG), m |
| 67E6 | 784 | 2109 | S81439 | Hs.82173 | 0 | 7 | EGR alpha = early growth response gene alpha [human, prostate |
| 593H2 | 132 | 722 | NM_000985 | Hs.82202 | 0 | 2 | ribosomal protein L17 (RPL17), mRNA/cds = (138, |
| 40H5 | 283 | 1442 | M37033 | Hs.82212 | 0 | 12 | CD53 glycoprotein mRNA, complete cds/ cds = (93,752)/ |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 592C4 | 1 | 1442 | NM_000560 | Hs.82212 | 0 | 11 | CD53 antigen (CD53), mRNA/cds = (93,752)/gb = N |
| 460D4 | 1519 | 1845 | NM_002510 | Hs.82226 | 1.00E−160 | 1 | glycoprotein (transmembrane) nmb (GPNMB), mR |
| 61A8 | 507 | 736 | AF045229 | Hs.82280 | 1.00E−116 | 1 | regulator of G protein signaling 10 mRNA, compl |
| 45F7 | 418 | 651 | NM_002925 | Hs.82280 | 1.00E−119 | 1 | regulator of G-protein signalling 10 (RGS10), |
| 49C2 | 416 | 1323 | NM_006417 | Hs.82316 | 0 | 7 | interferon-induced, hepatitis C-associated |
| 41C11 | 847 | 1716 | X63717 | Hs.82359 | 0 | 2 | APO-1 cell surface antigen/cds = (220,122 |
| 71H4 | 15 | 1627 | NM_001781 | Hs.82401 | 0 | 21 | CD69 antigen (p60, early T-cell activation ant |
| 75B10 | 9 | 1627 | Z22576 | Hs.82401 | 0 | 33 | CD69 gene/cds = (81,680)/gb = Z22576/gi = 397938/ |
| 117B7 | 1441 | 1515 | NM_022059 | Hs.82407 | 7.00E−28 | 1 | CXC chemokine ligand 16 (CXCL16), mRNA/cds = (4 |
| 110D6 | 1219 | 1721 | AF006088 | Hs.82425 | 0 | 1 | Arp2/3 protein complex subunit p16-Arc (ARC16) |
| 598F10 | 39 | 1497 | NM_005717 | Hs.82425 | 0 | 5 | actin related protein 2/3 complex, subunit 5 ( |
| 99A9 | 621 | 1214 | D26018 | Hs.82502 | 0 | 1 | mRNA for KIAA0039 gene, partial cds/cds = (0,1475)/gb |
| 183F6 | 222 | 2235 | NM_001637 | Hs.82542 | 0 | 2 | acyloxyacyl hydrolase (neutrophil) (AOAH), m |
| 459G4 | 5196 | 5801 | NM_003682 | Hs.82548 | 0 | 1 | MAP-kinase activating death domain (MADD), mR |
| 75A6 | 301 | 2231 | D85429 | Hs.82646 | 0 | 44 | heat shock protein 40, complete cds/c |
| 64A5 | 300 | 2008 | NM_006145 | Hs.82646 | 0 | 17 | heat shock 40 kD protein 1 (HSPF1), mRNA/cds = (4 |
| 50E5 | 628 | 2399 | AK025459 | Hs.82689 | 0 | 2 | FLJ21806 fis, clone HEP00829, highly sim |
| 115C6 | 23 | 589 | NM_005087 | Hs.82712 | 0 | 1 | fragile X mental retardation, autosomal homol |
| 105H10 | 1017 | 1429 | M61199 | Hs.82767 | 0 | 1 | cleavage signal 1 protein mRNA, complete cds/cds = (97, |
| 461A11 | 204 | 748 | NM_006296 | Hs.82771 | 0 | 1 | vaccinia related kinase 2 (VRK2), mRNA/cds = (1 |
| 39B4 | 1049 | 1203 | M25393 | Hs.82829 | 8.00E−83 | 1 | protein tyrosine phosphatase (PTPase) mRNA, complete |
| 590F5 | 123 | 436 | NM_002828 | Hs.82829 | 1.00E−178 | 1 | protein tyrosine phosphatase, non-receptor t |
| 517F10 | 1038 | 2618 | AK025583 | Hs.82845 | 0 | 9 | cDNA: FLJ21930 fis, clone HEP04301, highly sim |
| 40B7 | 972 | 1933 | M25280 | Hs.82848 | 0 | 6 | lymph node homing receptor mRNA, complete cds/cds = (11 |
| 515B1 | 1 | 2322 | NM_000655 | Hs.82848 | 0 | 12 | selectin L (lymphocyte adhesion molecule 1) ( |
| 587A10 | 190 | 685 | NM_001344 | Hs.82890 | 0 | 1 | defender against cell death 1 (DAD1), mRNA/cd |
| 113G9 | 1 | 2812 | AF208850 | Hs.82911 | 0 | 7 | BM-008 mRNA, complete cds/cds = (341,844)/gb = |
| 127H6 | 1828 | 2501 | NM_003591 | Hs.82919 | 0 | 2 | cullin 2 (CUL2), mRNA/cds = (146,2383)/gb = NM_0 |
| 477E3 | 931 | 1777 | NM_006416 | Hs.82921 | 0 | 2 | solute carrier family 35 (CMP-sialic acid tran |
| 184D2 | 1355 | 1773 | AL049795 | Hs.83004 | 1.00E−164 | 1 | DNA sequence from clone RP4-622L5 on chromosome 1p34. |
| 41F10 | 507 | 774 | D49950 | Hs.83077 | 1.00E−150 | 1 | for interferon-gamma inducing factor(IGI |
| 482E7 | 499 | 774 | NM_001562 | Hs.83077 | 5.00E−97 | 1 | interleukin 18 (interferon-gamma-inducing f |
| 515C6 | 111 | 1162 | L38935 | Hs.83086 | 1.00E−107 | 2 | GT212 mRNA/cds = UNKNOWN/gb = L38935/gi = 100884 |
| 479D3 | 1775 | 2028 | NM_001760 | Hs.83173 | 1.00E−122 | 1 | cyclin D3 (CCND3), mRNA/cds = (165,1043)/gb = N |
| 583H12 | 945 | 1655 | NM_012151 | Hs.83363 | 0 | 9 | coagulation factor VIII-associated (intronic |
| 47B3 | 2140 | 3625 | M58603 | Hs.83428 | 0 | 13 | nuclear factor kappa-B DNA binding subunit (NF-kappa- |
| 58G1 | 2538 | 3625 | NM_003998 | Hs.83428 | 0 | 4 | nuclear factor of kappa light polypeptide gene |
| 477C6 | 1628 | 2131 | Z49995 | Hs.83465 | 0 | 1 | H. sapiens mRNA (non-coding; clone h2A)/cds = UNKNOWN/gb = Z4 |
| 587D10 | 1576 | 1900 | AF064839 | Hs.83530 | 0 | 2 | map 3p21; 3.15 cR from WI-9324 region, complete |
| 516B9 | 1662 | 3296 | X59405 | Hs.83532 | 0 | 4 | H. sapiens, gene for Membrane cofactor protein/cds = UNKNOWN |
| 459A5 | 120 | 298 | NM_017459 | Hs.83551 | 7.00E−42 | 1 | microfibrillar-associated protein 2 (MFAP2), |
| 591A12 | 321 | 1116 | NM_005731 | Hs.83583 | 0 | 17 | actin related protein 2/3 complex, subunit 2 ( |
| 102C1 | 554 | 1127 | AK025198 | Hs.83623 | 0 | 1 | FLJ21545 fis, clone COL06195/cds = UNKNOW |
| 458C8 | 1022 | 1831 | NM_001619 | Hs.83636 | 0 | 1 | adrenergic, beta, receptor kinase 1 (ADRBK1), |
| 107G1 | 303 | 1008 | L20688 | Hs.83656 | 0 | 4 | GDP-dissociation inhibitor protein (Ly-GDI) mRNA, c |
| 597F8 | 293 | 1180 | NM_001175 | Hs.83656 | 0 | 55 | Rho GDP dissociation inhibitor (GDI) beta (AR |
| 591G5 | 1 | 216 | NM_003142 | Hs.83715 | 1.00E−108 | 3 | Sjogren syndrome antigen B (autoantigen La) ( |
| 184H9 | 240 | 392 | X69804 | Hs.83715 | 4.00E−77 | 2 | for La/SS-B protein/cds = UNKNOWN/gb = X69804 |
| 193C10 | 1 | 1605 | BC000957 | Hs.83724 | 1.00E−154 | 4 | Similar to hypothetical protein MNCb-2146, c |
| 40A2 | 1101 | 1294 | U90904 | Hs.83724 | 1.00E−72 | 1 | clone 23773 mRNA sequence/cds = UNKNOWN/gb = U90904/g |
| 57H2 | 191 | 422 | NM_001827 | Hs.83758 | 1.00E−126 | 1 | CDC28 protein kinase 2 (CKS2), mRNA/cds = (95,33 |
| 60E10 | 191 | 422 | X54942 | Hs.83758 | 1.00E−129 | 1 | ckshs2 mRNA for Cks1 protein homologue/cds = (95,3 |
| 164F5 | 1896 | 2293 | NM_016325 | Hs.83761 | 0 | 1 | zinc finger protein 274 (ZNF274), mRNA/cds = (4 |
| 463E6 | 555 | 1128 | NM_000791 | Hs.83765 | 0 | 1 | dihydrofolate reductase (DHFR), mRNA/cds = (47 |
| 194F8 | 1806 | 2223 | NM_002199 | Hs.83795 | 1.00E−161 | 1 | interferon regulatory factor 2 (IRF2), mRNA/ |
| 520D11 | 180 | 1229 | NM_000365 | Hs.83848 | 0 | 5 | triosephosphate isomerase 1 (TPI1), mRNA/cds |
| 168B6 | 530 | 891 | U47924 | Hs.83848 | 0 | 1 | chromosome 12p13 sequence/cds = (373,1122)/gb = U4792 |
| 331E11 | 2591 | 3485 | NM_000480 | Hs.83918 | 0 | 8 | adenosine monophosphate deaminase (isoform E |
| 458A11 | 125 | 409 | NM_000396 | Hs.83942 | 1.00E−108 | 1 | cathepsin K (pycnodysostosis) (CTSK), mRNA/ |
| 185H2 | 2501 | 2690 | NM_000195 | Hs.83951 | 3.00E−85 | 1 | Hermansky-Pudlak syndrome (HPS), mRNA/cds = (2 |
| 99D2 | 977 | 1191 | NM_019006 | Hs.83954 | 1.00E−97 | 1 | protein associated with PRK1 (AWP1), mRNA/cds |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 167D5 | 2275 | 2755 | NM_000211 | Hs.83968 | 0 | 4 | integrin, beta 2 (antigen CD18 (p95), lymphocyt |
| 524B2 | 262 | 575 | BF028896 | Hs.83992 | 1.00E−155 | 1 | 601765270F1 cDNA, 5' end/clone = lMAGE: 3997576 |
| 523B2 | 688 | 1065 | NM_015937 | Hs.84038 | 0 | 1 | CGI-06 protein (LOC51604), mRNA/cds = (6,1730) |
| 102F1 | 951 | 1416 | M63180 | Hs.84131 | 0 | 1 | threonyl-tRNA synthetase mRNA, complete cds/cds = (13 |
| 589D5 | 863 | 1700 | NM_006400 | Hs.84153 | 0 | 3 | dynactin 2 (p50) (DCTN2), mRNA/cds = (136,1356) |
| 108F6 | 448 | 704 | U70439 | Hs.84264 | 1.00E−117 | 1 | silver-stainable protein SSP29 mRNA, complete cds/ |
| 146D6 | 1022 | 1253 | K01144 | Hs.84298 | 6.00E−95 | 2 | major histocompatibility class II antigen gamma chain |
| 188B10 | 823 | 1302 | NM_004355 | Hs.84298 | 0 | 1 | CD74 antigen (invariant polypeptide of major |
| 175D2 | 1060 | 1479 | M63488 | Hs.84318 | 1.00E−158 | 1 | replication protein A 70 kDa subunit mRNA complete cds |
| 115F4 | 2305 | 2393 | NM_002945 | Hs.84318 | 2.00E−43 | 1 | replication protein A1 (70 kD) (RPA1), mRNA/cd |
| 595H4 | 5400 | 5649 | NM_004239 | Hs.85092 | 1.00E−131 | 1 | thyroid hormone receptor interactor 11 (TRIP1 |
| 106F1 | 493 | 1371 | NM_017491 | Hs.85100 | 0 | 3 | WD repeat domain 1 (WDR1), transcript variant 1 |
| 40C10 | 438 | 880 | X57025 | Hs.85112 | 0 | 1 | IGF-I mRNA for insulin-like growth factor I/cds = (166, |
| 44C5 | 2247 | 2430 | AF017257 | Hs.85146 | 5.00E−89 | 1 | chromosome 21 derived BAC containing erythrobl |
| 45D4 | 1962 | 3324 | X79067 | Hs.85155 | 0 | 6 | H. sapiens ERF-1 mRNA 3' end/cds = UNKNOWN/gb = X79067/gi = 483 |
| 591B9 | 2378 | 2603 | NM_002880 | Hs.85181 | 1.00E−109 | 1 | v-raf-1 murine leukemia viral oncogene homolo |
| 39E2 | 67 | 2493 | X76488 | Hs.85226 | 0 | 3 | lysosomal acid lipase/cds = (145,1344)/ |
| 62H12 | 1249 | 1975 | M12824 | Hs.85258 | 0 | 3 | T-cell differentiation antigen Leu-2/T8 mRNA, partia |
| 40C8 | 4505 | 4856 | X53587 | Hs.85266 | 0 | 1 | integrin beta 4/cds = UNKNOWN/gb = X53587/gi = |
| 40E11 | 1983 | 2633 | S53911 | Hs.85289 | 0 | 1 | CD34 = glycoprotein expressed in lymphohematopoietic proge |
| 135A2 | 121 | 695 | BC001646 | Hs.85301 | 0 | 2 | clone MGC: 2392, mRNA, complete cds/cds = (964, |
| 459H4 | 33 | 244 | AK027067 | Hs.85567 | 2.00E−90 | 1 | cDNA: FLJ23414 fis, clone HEP20704/cds = (37,10 |
| 479A4 | 5556 | 5974 | AB040974 | Hs.85752 | 1.00E−171 | 1 | mRNA for KIAA1541 protein, partial cds/cds = (9 |
| 146C3 | 1610 | 2062 | AL049796 | Hs.85769 | 0 | 1 | DNA sequence from clone RP4-561L24 on chromosome 1p22 |
| 463H11 | 871 | 1153 | NM_006546 | Hs.86088 | 5.00E−83 | 1 | IGF-II mRNA-binding protein 1 (IMP-1), mRNA/ |
| 480A12 | 2 | 165 | NM_004876 | Hs.86371 | 7.00E−84 | 1 | zinc finger protein 254 (ZNF254), mRNA/cds = (1 |
| 192F7 | 2854 | 3462 | AF198614 | Hs.86386 | 0 | 3 | Mcl-1 (MCL-1) and Mcl-1 delta S/TM (MCL-1) gene |
| 459G3 | 12 | 577 | AL049340 | Hs.86405 | 0 | 1 | mRNA; cDNA DKFZp564P056 (from clone DKFZp564P0 |
| 460E4 | 2361 | 2787 | NM_000161 | Hs.86724 | 0 | 2 | GTP cyclohydrolase 1 (dopa-responsive dystoni |
| 62F9 | 834 | 1282 | M60724 | Hs.86858 | 0 | 1 | p70 ribosomal S6 kinase alpha-1 mRNA, complete cds/cd |
| 187E7 | 84 | 766 | NM_001695 | Hs.86905 | 0 | 1 | ATPase, H+ transporting, lysosomal (vacuolar |
| 159D4 | 315 | 559 | J03798 | Hs.86948 | 1.00E−113 | 1 | autoantigen small nuclear ribonucleoprotein Sm-D mR |
| 459F9 | 1557 | 1619 | NM_006938 | Hs.86948 | 2.00E−25 | 1 | small nuclear ribonucleoprotein D1 polypeptid |
| 480G11 | 87 | 603 | BG168139 | Hs.87113 | 0 | 1 | 602341526F1 cDNA, 5' end/clone = IMAGE: 4449343 |
| 41D6 | 2208 | 2320 | M35999 | Hs.87149 | 4.00E−39 | 1 | platelet glycoprotein lll a (GPllla) mRNA, complete c |
| 462H11 | 387 | 648 | NM_003806 | Hs.87247 | 1.00E−133 | 1 | harakiri, BCL2-interacting protein (contains |
| 99D7 | 614 | 5517 | NM_003246 | Hs.87409 | 0 | 62 | thrombospondin 1 (THBS1), mRNA/cds = (111,3623 |
| 39B8 | 2130 | 5517 | X14787 | Hs.87409 | 0 | 33 | thrombospondin/cds = (111,3623)/gb = X14787 |
| 525A2 | 329 | 560 | NM_007047 | Hs.87497 | 1.00E−129 | 2 | butyrophilin, subfamily 3, member A2 (BTN3A2) |
| 583F2 | 3303 | 3622 | D63876 | Hs.87726 | 1.00E−155 | 1 | mRNA for KIAA0154 gene, partial cds/cds = (0,2080)/gb |
| 184D7 | 2211 | 2556 | M34181 | Hs.87773 | 1.00E−165 | 1 | testis-specific cAMP-dependent protein kinase catal |
| 460A4 | 499 | 1074 | AL117637 | Hs.87794 | 0 | 1 | mRNA; cDNA DKFZp4341225 (from clone DKFZp43412 |
| 459G2 | 258 | 452 | AW967701 | Hs.87912 | 8.00E−88 | 1 | EST379776 cDNA/gb = AW967701/gi = 8157540/ug = |
| 74H7 | 1660 | 2397 | AK026960 | Hs.88044 | 0 | 9 | FLJ23307 fis, clone HEP11549, highly sim |
| 463D12 | 351 | 568 | AI184553 | Hs.88130 | 1.00E−118 | 1 | qd60a05.x1 cDNA, 3' end/clone = IMAGE: 1733840 |
| 595B1 | 309 | 986 | NM_003454 | Hs.88219 | 0 | 1 | zinc finger protein 200 (ZNF200), mRNA/cds = (2 |
| 458D3 | 1018 | 1285 | NM_000487 | Hs.88251 | 6.00E−74 | 1 | arylsulfatase A (ARSA), mRNA/cds = (375,1898) |
| 462F4 | 4272 | 4846 | AJ271878 | Hs.88414 | 0 | 1 | mRNA for putative transcription factor (BACH2 |
| 460B12 | 1267 | 2022 | NM_006800 | Hs.88764 | 0 | 3 | male-specific lethal-3 (Drosophila)-like 1 |
| 461A4 | 2039 | 2421 | AL161659 | Hs.88820 | 0 | 1 | DNA sequence from clone RP11-526K24 on chromosome 20 |
| 460F9 | 3413 | 3654 | NM_000397 | Hs.88974 | 1.00E−133 | 1 | cytochrome b-245, beta polypeptide (chronic g |
| 459G9 | 790 | 1160 | NM_006228 | Hs.89040 | 1.00E−145 | 1 | prepronociceptin (PNOC), mRNA/cds = (211,741) |
| 70H12 | 1 | 661 | AV716500 | Hs.89104 | 0 | 274 | AV716500 cDNA, 5' end/clone = DCBAKA08/clone_ |
| 469H5 | 1620 | 2142 | AB040961 | Hs.89135 | 0 | 1 | mRNA for KIAA1528 protein, partial cds = (4 |
| 175G6 | 2069 | 2501 | D83243 | Hs.89385 | 0 | 1 | NPAT mRNA, complete cds/cds = (66,4349)/gb = D83243/g |
| 592B10 | 3703 | 3936 | NM_002519 | Hs.89385 | 1.00E−130 | 1 | nuclear protein, ataxia-telangiectasia locu |
| 120B7 | 337 | 630 | NM_005176 | Hs.89399 | 1.00E−114 | 1 | ATP synthase, H+ transporting, mitochondrial |
| 39D2 | 370 | 1892 | AF147204 | Hs.89414 | 0 | 68 | chemokine receptor CXCR4-Lo (CXCR4) mRNA, alt |
| 99H4 | 7 | 1625 | NM_003467 | Hs.89414 | 0 | 137 | chemokine (C-X-C motif), receptor 4 (fusin) (C |
| 106D2 | 2 | 266 | U03644 | Hs.89421 | 1.00E−143 | 1 | recepin mRNA, complete cds/cds = (32,1387)/gb = U03644 |
| 41F5 | 1203 | 1522 | M16336 | Hs.89476 | 1.00E−170 | 1 | T-cell surface antigen CD2 (T11) mRNA, complete |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| | | | | | | | cds, c |
| 463A3 | 876 | 1025 | NM_000698 | Hs.89499 | 1.00E−79 | 1 | arachidonate 5-lipoxygenase (ALOX5), mRNA/c |
| 47D12 | 1198 | 4887 | AB028969 | Hs.89519 | 0 | 2 | for KIAA1046 protein, complete cds/cds = ( |
| 498G2 | 4420 | 5265 | NM_014928 | Hs.89519 | 0 | 2 | KIAA1046 protein (KIAA1046), mRNA/cds = (577,1 |
| 589G3 | 598 | 689 | NM_002796 | Hs.89545 | 4.00E−45 | 2 | proteasome (prosome, macropain) subunit, bet |
| 331B1 | 699 | 788 | S71381 | Hs.89545 | 1.00E−41 | 1 | prosome beta-subunit = multicatalytic proteinase complex |
| 110A2 | 1403 | 1739 | AK026432 | Hs.89555 | 1.00E−177 | 1 | FLJ22779 fis, clone KAIA1741/cds = (234,1 |
| 118E4 | 780 | 1672 | NM_002110 | Hs.89555 | 0 | 5 | hemopoietic cell kinase (HCK), mRNA/cds = (168, |
| 41B8 | 570 | 1166 | M89957 | Hs.89575 | 0 | 1 | immunoglobulin superfamily member B cell receptor co |
| 44A11 | 2567 | 2808 | L20814 | Hs.89582 | 1.00E−115 | 1 | glutamate receptor 2 (HBGR2) mRNA, complete cds/cds = ( |
| 191G11 | 309 | 596 | NM_006284 | Hs.89657 | 1.00E−162 | 11 | TATA box binding protein (TBP)-associated fac |
| 72G5 | 1172 | 1575 | AX023367 | Hs.89679 | 0 | 38 | Sequence 38 from Patent WO0006605 |
| 71B12 | 40 | 559 | NM_000586 | Hs.89679 | 0 | 13 | interleukin 2 (IL2), mRNA/cds = (47,517)/gb = N |
| 179G12 | 158 | 737 | M36821 | Hs.89690 | 0 | 1 | cytokine (GRO-gamma) mRNA, complete cds |
| 193B5 | 680 | 1146 | NM_002994 | Hs.89714 | 0 | 17 | small inducible cytokine subfamily B (Cys-X-Cy |
| 182G10 | 681 | 1146 | X78686 | Hs.89714 | 0 | 7 | ENA-78 mRNA/cds = (106,450)/gb = X78686/gi = 47124 |
| 191C6 | 617 | 1597 | NM_021950 | Hs.89751 | 0 | 2 | membrane-spanning 4-domains, subfamily A, m |
| 40H3 | 1347 | 1597 | X07203 | Hs.89751 | 3.00E−71 | 1 | CD20 receptor (S7)/cds = (90,983)/gb = X07203 |
| 458H2 | 3524 | 4331 | NM_002024 | Hs.89764 | 0 | 2 | fragile X mental retardation 1 (FMR1), mRNA/c |
| 40F6 | 1665 | 2210 | D38081 | Hs.89887 | 0 | 1 | thromboxane A2 receptor, complete cds/cds = (9 |
| 473E1 | 578 | 956 | AL515381 | Hs.89986 | 1.00E−172 | 1 | AL515381 cDNA/clone = CLOBB017ZH06-(3-prime) |
| 126A12 | 770 | 982 | AL558028 | Hs.90035 | 1.00E−102 | 1 | AL558028 cDNA/clone = CS0DJ002YF02-(5-prime) |
| 183E12 | 2203 | 2814 | NM_001316 | Hs.90073 | 0 | 1 | chromosome segregation 1 (yeast homolog)-like |
| 145H12 | 1602 | 1811 | AK026766 | Hs.90077 | 1.00E−113 | 2 | FLJ23113 fis, clone LNG07875, highly sim |
| 62C2 | 1472 | 2610 | AB023420 | Hs.90093 | 0 | 2 | for heat shock protein apg-2, complete cds |
| 46H6 | 3172 | 3411 | D26488 | Hs.90315 | 6.00E−86 | 1 | mRNA for KIAA0007 gene, partial cds/cds = (0,2062)/gb |
| 116E2 | 1637 | 2016 | AK025800 | Hs.90421 | 1.00E−118 | 1 | cDNA: FLJ22147 fis, clone HEP22163, highly sim |
| 525H3 | 6 | 1231 | NM_004261 | Hs.90606 | 0 | 2 | 15 kDa selenoprotein (SEP15), mRNA/cds = (4,492 |
| 184D8 | 287 | 387 | BE888304 | Hs.90654 | 1.00E−46 | 2 | 601514033F1 cDNA, 5' end/clone = IMAGE: 3915177 |
| 99D4 | 1948 | 4309 | D50918 | Hs.90998 | 0 | 5 | mRNA for KIAA0128 gene, partial cds/cds = (0,1276)/gb |
| 72B9 | 571 | 1312 | AK026954 | Hs.91065 | 0 | 1 | FLJ23301 fis, clone HEP11120/cds = (2,188 |
| 586H8 | 189 | 478 | NM_000987 | Hs.91379 | 2.00E−83 | 1 | ribosomal protein L26 (RPL26), mRNA/cds = (6,44 |
| 160A12 | 1 | 132 | X69392 | Hs.91379 | 4.00E−69 | 5 | ribosomal protein L26/cds = (6,443)/gb = |
| 331H4 | 1632 | 2166 | AK027210 | Hs.91448 | 0 | 1 | FLJ23557 fis, clone LNG09686, highly sim |
| 473E6 | 915 | 1390 | NM_004556 | Hs.91640 | 0 | 2 | nuclear factor of kappa light polypeptide gene |
| 69E4 | 673 | 1328 | A8007956 | Hs.92381 | 1.00E−122 | 2 | mRNA, chromosome 1 specific transcript KIAA04 |
| 182F10 | 117 | 781 | AF070523 | Hs.92384 | 0 | 1 | JWA protein mRNA, complete cds/cds = (115,681) |
| 585F10 | 77 | 1890 | NM_006407 | Hs.92384 | 0 | 13 | vitamin A responsive; cytoskeleton related (J |
| 469G3 | 2061 | 2293 | AK025683 | Hs.92414 | 1.00E−110 | 1 | cDNA: FLJ22030 fis, clone HEP08669/cds = UNKNOW |
| 472H4 | 247 | 671 | AW978555 | Hs.92448 | 0 | 1 | EST390664 cDNA/gb = AW978555/gi = 8169822/ug = |
| 193F11 | 2051 | 4721 | NM_003103 | Hs.92909 | 0 | 3 | SON DNA binding protein (SON), mRNA/cds = (414,4 |
| 37E7 | 1287 | 1805 | AK002059 | Hs.92918 | 0 | 1 | FLJ11197 fis, clone PLACE1007690/cds = (37 |
| 111D7 | 244 | 596 | NM_016623 | Hs.92918 | 1.00E−166 | 1 | hypothetical protein (BM-009), mRNA/cds = (385 |
| 41B10 | 1216 | 1530 | U24577 | Hs.93304 | 1.00E−173 | 1 | LDL-phospholipase A2 mRNA, complete cds/cds = (216,15 |
| 48B4 | 76 | 723 | NM_001417 | Hs.93379 | 0 | 5 | eukaryotic translation initiation factor 4B |
| 39F8 | 76 | 876 | X55733 | Hs.93379 | 0 | 1 | initiation factor 4B cDNA/cds = (0,1835)/gb = X557 |
| 471B10 | 660 | 886 | NM_007020 | Hs.93502 | 1.00E−125 | 1 | U1-snRNP binding protein homolog (70 kD) (U1SN |
| 467A3 | 1189 | 1284 | X91348 | Hs.93522 | 3.00E−36 | 1 | H. sapiens predicted non coding cDNA (DGCR5)/cds = UNKNOWN/ |
| 461B5 | 652 | 874 | NM_003367 | Hs.93649 | 1.00E−104 | 1 | upstream transcription factor 2, c-fos intera |
| 62B8 | 1386 | 1739 | J05016 | Hs.93659 | 1.00E−170 | 1 | (clone pA3) protein disulfide isomerase related prote |
| 461E7 | 1931 | 2086 | NM_004911 | Hs.93659 | 1.00E−65 | 1 | protein disulfide isomerase related protein ( |
| 458G11 | 2423 | 3161 | AB040959 | Hs.93836 | 0 | 1 | mRNA for KIAA1526 protein, partial cds/cds = |
| 104E3 | 516 | 981 | AK000967 | Hs.93872 | 0 | 1 | FLJ10105 fis, clone HEMBA 1002542/cds = UN |
| 41B6 | 87 | 846 | X04430 | Hs.93913 | 0 | 2 | IFN-beta 2a mRNA for interferon-beta-2/cds = (86,724) |
| 179H7 | 1610 | 1682 | AF009746 | Hs.94395 | 9.00E−34 | 1 | peroxisomal membrane protein 69 (PMP69) mRNA, |
| 470G3 | 74 | 493 | NM_007221 | Hs.94446 | 0 | 1 | polyamine-modulated factor 1 (PMF1), mRNA/c |
| 472A5 | 2325 | 2429 | AK022267 | Hs.94576 | 2.00E−48 | 1 | cDNA FLJ12205 fis, clone MAMMA1000931/cds = UNK |
| 459C9 | 5356 | 6120 | NM_006421 | Hs.94631 | 0 | 3 | brefeldin A-inhibited guanine nucleotide-exc |
| 465F8 | 3580 | 4049 | NM_015125 | Hs.94970 | 0 | 1 | KIAA0306 protein (KIAA0306), mRNA/cds = (0,436 |
| 57B9 | 4145 | 4379 | NM_005109 | Hs.95220 | 1.00E−126 | 1 | oxidative-stress responsive 1 (OSR1), mRNA/c |
| 160D6 | 30 | 480 | X01451 | Hs.95327 | 0 | 1 | gene for 20 K T3 glycoprotein (T3-delta-chain) of T-c |
| 512G1 | 1 | 415 | BF107010 | Hs.95388 | 1.00E−175 | 2 | 601824367F1 cDNA, 5' end/clone = IMAGE: 4043920 |
| 593E11 | 24 | 273 | BG291649 | Hs.95835 | 1.00E−79 | 10 | 602385778F1 cDNA, 5' end/clone = IMAGE: 4514827 |
| 41H2 | 1011 | 1306 | M28170 | Hs.96023 | 1.00E−114 | 1 | cell surface protein CD19 (CD19) gene, complete cds/c |
| 149G8 | 213 | 435 | BF222826 | Hs.96487 | 1.00E−119 | 2 | 7q23f06.x1/clone = IMAGE/gb = BF222826/g |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 101G7 | 2266 | 3173 | AL133227 | Hs.96560 | 0 | 2 | DNA sequence from clone RP11-394O2 on chromosome 20 C |
| 103E6 | 2840 | 3451 | BC000143 | Hs.96560 | 0 | 1 | Similar to hypothetical protein FLJ11656, cl |
| 107G5 | 226 | 2349 | BF673956 | Hs.96566 | 7.00E−24 | 1 | 602137338F1 cDNA, 5' end/clone = IMAGE: 4274048 |
| 461A12 | 3602 | 4135 | AB014555 | Hs.96731 | 0 | 2 | mRNA for KIAA0655 protein, partial cds/cds = (0 |
| 595A8 | 82 | 1571 | NM_000734 | Hs.97087 | 1.00E−147 | 10 | CD3Z antigen, zeta polypeptide (TiT3 complex) |
| 479H8 | 883 | 1378 | NM_014373 | Hs.97101 | 0 | 3 | putative G protein-coupled receptor (GPCR150) |
| 466D12 | 2001 | 5732 | NM_012072 | Hs.97199 | 0 | 2 | complement component C1q receptor (C1QR), mRN |
| 194B3 | 1835 | 2898 | NM_002990 | Hs.97203 | 0 | 2 | small inducible cytokine subfamily A (Cys-Cys) |
| 109E9 | 2880 | 3536 | AF083322 | Hs.97437 | 0 | 1 | centriole associated protein CEP110 mRNA, com |
| 459H5 | 9 | 230 | BF438062 | Hs.97896 | 1.00E−116 | 1 | 7q66e08.x1 cDNA/clone = IMAGE/gb = BF438062/g |
| 473A4 | 871 | 1327 | NM_007015 | Hs.97932 | 0 | 1 | chondromodulin I precursor (CHM-I), mRNA/cds |
| 466E9 | 1408 | 1808 | AL442083 | Hs.98026 | 1.00E−172 | 2 | mRNA; cDNA DKFZp547D144 (from clone DKFZp547D1 |
| 460E3 | 1290 | 1687 | AF038564 | Hs.98074 | 0 | 1 | atrophin-1 interacting protein 4 (AIP4) mRNA, |
| 462E6 | 103 | 642 | NM_016440 | Hs.98289 | 0 | 1 | VRK3 for vaccinia related kinase 3 (LOC51231), |
| 460B8 | 114 | 546 | AA418743 | Hs.98306 | 1.00E−178 | 1 | zv98f06.s1 cDNA, 3' end/clone = IMAGE: 767843/ |
| 124A8 | 1 | 157 | NM_019044 | Hs.98324 | 2.00E−69 | 1 | hypothetical protein (FLJ10996), mRNA/cds = ( |
| 71B10 | 79 | 520 | AI761058 | Hs.98531 | 1.00E−112 | 34 | wi69b03.x1 cDNA, 3' end/clone = IMAGE: 2398541 |
| 49F1 | 36 | 435 | AA913840 | Hs.98903 | 0 | 1 | ol39d11.s1 cDNA, 3' end/clone = IMAGE: 1525845 |
| 462F6 | 61 | 201 | AC006276 | Hs.99093 | 2.00E−74 | 1 | chromosome.19, cosmid R28379/cds = (0,633)/gb |
| 473A2 | 47 | 475 | BE326857 | Hs.99237 | 0 | 1 | hr65h06.x1 cDNA, 3' end/clone = IMAGE: 3133403 |
| 599D8 | 1468 | 1748 | NM_005825 | Hs.99491 | 1.00E−132 | 1 | RAS guanyl releasing protein 2 (calcium and DA |
| 459F8 | 300 | 541 | AW444899 | Hs.99665 | 1.00E−123 | 1 | UI-H-BI3-ajz-d-07-0-UI.s1 cDNA, 3' end/clon |
| 163H9 | 8 | 141 | AL049319 | Hs.99821 | 2.00E−58 | 1 | cDNA DKFZp564C046 (from clone DKFZp564C0 |
| 165H8 | 1176 | 1930 | NM_015400 | Hs.99843 | 0 | 2 | DKFZP586N0721 protein (DKFZP586N0721), mRNA |
| 188C9 | 543 | 998 | NM_001436 | Hs.99853 | 0 | 2 | fibrillarin (FBL), mRNA/cds = (59,1024)/gb = N |
| 37H2 | 759 | 2017 | AC018755 | Hs.99855 | 0 | 4 | chromosome 19, BAC BC330783 (CIT-HSPC_470E3), |
| 127H3 | 758 | 2183 | NM_001462 | Hs.99855 | 0 | 5 | formyl peptide receptor-like 1 (FPRL1), mRNA |
| 62F2 | 1 | 642 | BF315159 | Hs.99858 | 0 | 6 | 601899519F1 cDNA, 5' end/clone = IMAGE: 4128749 |
| 599A7 | 26 | 838 | NM_000972 | Hs.99858 | 0 | 11 | ribosomal protein L7a (RPL7A), mRNA/cds = (31,8 |
| 167B3 | 1994 | 2101 | AB032251 | Hs.99872 | 2.00E−37 | 1 | BPTF mRNA for bromodomain PHD finger transcript |
| 41G8 | 461 | 751 | L08096 | Hs.99899 | 1.00E−161 | 1 | CD27 ligand mRNA, complete cds/cds = (150,731)/ gb = L08 |
| 479C10 | 327 | 738 | NM_001252 | Hs.99899 | 0 | 1 | tumor necrosis factor (ligand) superfamily, m |
| 36D8 | 1180 | 2315 | AL162047 | Hs.99908 | 0 | 7 | cDNA DKFZp762E1112 (from clone DKFZp762E |
| 593E2 | 62 | 435 | NM_000983 | Hs.99914 | 1.00E−145 | 1 | ribosomal protein L22 (RPL22), mRNA/cds = (51,4 |
| 478C8 | 48 | 311 | NM_000023 | Hs.99931 | 1.00E−112 | 1 | sarcoglycan, alpha (50 kD dystrophin-associat |
| 61A1 | 827 | 1053 | S62140 | Hs.99969 | 1.00E−126 | 1 | TLS − translocated in liposarcoma [human, mRNA, 1824 nt]/cd |
| 40C7 | 971 | 1724 | X69819 | Hs.99995 | 0 | 1 | ICAM-3 mRNA/cds = (8,1651)/gb = X69819/gi = 32627 |
| 116F8 | 109 | 376 | NM_002964 | Hs.100000 | 1.00E−123 | 5 | S100 calcium-binding protein A8 (calgranulin |
| 121F4 | 30 | 540 | NM_001629 | Hs.100194 | 1.00E−118 | 7 | arachidonate 5-lipoxygenase-activating pro |
| 46G10 | 5175 | 5624 | NM_003605 | Hs.100293 | 0 | 2 | O-linked N-acetylglucosamine (GlcNAc) transf |
| 49E4 | 1279 | 2585 | NM_006773 | Hs.100555 | 0 | 4 | DEAD/H (Asp-Glu-Ala-Asp/His) box polypeptide |
| 61E1 | 1279 | 1767 | X98743 | Hs.100555 | 0 | 2 | RNA helicase (Myc-regulated dead box pro |
| 460A10 | 824 | 1321 | NM_018099 | Hs.100895 | 0 | 1 | hypothetical protein FLJ10462 (FLJ10462), mR |
| 458F1 | 1 | 303 | R18757 | Hs.100896 | 1.00E−157 | 1 | yg17e04.r1 cDNA, 5' end/clone = IMAGE: 32522/c |
| 64B8 | 2062 | 2711 | AB007859 | Hs.100955 | 0 | 1 | mRNA for KIAA0399 protein, partial cds/cds = (0, |
| 515H6 | 131 | 201 | NM_001207 | Hs.101025 | 6.00E−33 | 1 | basic transcription factor 3 (BTF3), mRNA/cd |
| 472H12 | 10 | 358 | AW968686 | Hs.101340 | 0 | 1 | EST380762 cDNA/gb = AW968686/gi = 8158527/ug = |
| 99G6 | 2427 | 4860 | AB002384 | Hs.101359 | 0 | 9 | mRNA for KIAA0386 gene, complete cds/ cds = (177,3383) |
| 62E12 | 193 | 573 | AI936516 | Hs.101370 | 1.00E−100 | 6 | wd28h07.x1 cDNA, 3' end/clone = IMAGE: 2329501 |
| 493B9 | 3 | 638 | AL583391 | Hs.101370 | 0 | 8 | AL583391 cDNA/clone = CS0DL012YA12-(3-prime) |
| 117D4 | 2812 | 2966 | NM_006291 | Hs.101382 | 7.00E−79 | 1 | tumor necrosis factor, alpha-induced protein |
| 462A9 | 382 | 620 | BC000764 | Hs.101514 | 1.00E−133 | 1 | hypothetical protein FLJ10342, clone MGC: 27 |
| 193G3 | 3368 | 3659 | AL139349 | Hs.102178 | 3.00E−88 | 1 | DNA sequence from clone RP11-261P9 on chromosome 20. |
| 62H6 | 3035 | 4257 | AF193339 | Hs.102506 | 0 | 5 | eukaryotic translation initiation factor 2 a |
| 46E2 | 3223 | 4023 | NM_004836 | Hs.102506 | 0 | 2 | eukaryotic translation initiation factor 2-a |
| 460C4 | 151 | 635 | AW978361 | Hs.102630 | 0 | 2 | EST390470 cDNA/gb = AW978361/gi = 8169626/ug = |
| 58E4 | 1 | 321 | BF970875 | Hs.102647 | 1.00E−177 | 2 | 602271536F1 cDNA, 5' end/clone = IMAGE: 4359609 |
| 189G9 | 5473 | 6137 | NM_018489 | Hs.102652 | 0 | 2 | hypothetical protein ASH1 (ASH1), mRNA/cds = ( |
| 111H5 | 3043 | 3331 | AK000354 | Hs.102669 | 1.00E−125 | 1 | cDNA FLJ20347 fis, clone HEP13790/cds = (708,14 |
| 465B8 | 27 | 348 | AI707589 | Hs.102793 | 1.00E−164 | 1 | as30b05.x1 cDNA, 3' end/clone = IMAGE: 2318673 |
| 126G11 | 1069 | 1431 | NM_016128 | Hs.102950 | 0 | 2 | coat protein gamma-cop (LOC51137), mRNA/cds = ( |
| 165H5 | 326 | 564 | BF698884 | Hs.103180 | 4.00E−71 | 1 | 602126455F1 cDNA, 5' end/clone = IMAGE: 4283340 |
| 108H6 | 2135 | 2505 | AB023187 | Hs.103329 | 1.00E−59 | 1 | for KIAA0970 protein, complete cds/cds = ( |
| 521C9 | 1440 | 1962 | AL136885 | Hs.103378 | 0 | 2 | mRNA; cDNA DKFZp434P116 (from clone DKFZp434P1 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 458C9 | 3876 | 4415 | AF254411 | Hs.103521 | 0 | 1 | ser/arg-rich pre-mRNA splicing factor SR-A1 ( |
| 99F6 | 349 | 767 | NM_018623 | Hs.103657 | 0 | 5 | hypothetical protein PRO2219 (PRO2219), mRNA |
| 162G11 | 1745 | 2161 | AF117829 | Hs.103755 | 1.00E−151 | 1 | 8q21.3: RICK gene/cds = (224,1846)/gb = AF11782 |
| 188G1 | 1757 | 2566 | NM_004501 | Hs.103804 | 0 | 2 | heterogeneous nuclear ribonucleoprotein U ( |
| 470F7 | 56 | 302 | NM_024056 | Hs.103834 | 1.00E−137 | 1 | hypothetical protein MGC5576 (MGC5576), mRNA |
| 460A11 | 225 | 288 | BG033732 | Hs.103902 | 3.00E−29 | 1 | 602301101F1 cDNA, 5' end/clone = IMAGE: 4402465 |
| 522H7 | 2157 | 2397 | NM_006342 | Hs.104019 | 1.00E−132 | 1 | transforming, acidic coiled-coil containing |
| 39E5 | 1007 | 2535 | L12168 | Hs.104125 | 0 | 10 | adenylyl cyclase-associated protein (CAP) mRN |
| 98C11 | 1023 | 2558 | NM_006367 | Hs.104125 | 0 | 29 | adenylyl cyclase-associated protein (CAP), m |
| 461B2 | 88 | 221 | AW968823 | Hs.104157 | 1.00E−38 | 1 | EST380899 cDNA/gb = AW968823/gi = 8158664/ug = |
| 110A4 | 4010 | 4306 | AB023143 | Hs.104305 | 1.00E−125 | 1 | for KIAA0926 protein, complete cds/cds = ( |
| 122H5 | 4634 | 5232 | NM_014922 | Hs.104305 | 0 | 2 | KIAA0926 protein (KIAA0926), mRNA/cds = (522,4 |
| 105C2 | 1817 | 2174 | AB020669 | Hs.104315 | 0 | 1 | for KIAA0862 protein, complete cds/cds = ( |
| 37G4 | 1321 | 2886 | AF016495 | Hs.104624 | 0 | 46 | small solute channel 1 (SSC1) mRNA, complete cd |
| 98D4 | 1578 | 2946 | NM_020980 | Hs.104624 | 0 | 71 | aquaporin 9 (AQP9), mRNA/cds = (286,1173)/gb = |
| 458E6 | 1007 | 1399 | NM_015898 | Hs.104640 | 0 | 1 | HIV-1 inducer of short transcripts binding pro |
| 462C11 | 1037 | 1532 | NM_018492 | Hs.104741 | 0 | 1 | PDZ-binding kinase; T-cell originated protein |
| 118G4 | 1940 | 2513 | BC002538 | Hs.104879 | 0 | 2 | serine (or cysteine) proteinase inhibitor, c |
| 496A7 | 1 | 618 | BG035120 | Hs.104893 | 0 | 4 | 602324815F1 cDNA, 5' end/clone = IMAGE: 4413099 |
| 112G4 | 3421 | 3933 | NM_003633 | Hs.104925 | 0 | 2 | ectodermal-neural cortex (with BTB-like doma |
| 460E2 | 16 | 460 | AI479075 | Hs.104985 | 0 | 1 | tm30h01.x1 cDNA, 3' end/clone = IMAGE: 2158129 |
| 461H4 | 1500 | 1781 | NM_020979 | Hs.105052 | 1.00E−148 | 1 | adaptor protein with pleckstrin homology and |
| 469C7 | 231 | 380 | NM_018331 | Hs.105216 | 1.00E−77 | 1 | hypothetical protein FLJ11125 (FLJ11125), mR |
| 461B6 | 84 | 489 | AA489227 | Hs.105230 | 0 | 1 | aa57f07.s1 cDNA, 3' end/clone = IMAGE: 825061/ |
| 462D5 | 1735 | 2129 | NM_015393 | Hs.105460 | 0 | 1 | DKFZP564O0823 protein (DKFZP564O0823), mRNA |
| 465H7 | 1 | 624 | NM_017780 | Hs.105461 | 0 | 1 | hypothetical protein FLJ20357 (FLJ20357), mR |
| 471F3 | 819 | 1126 | AY007243 | Hs.105484 | 1.00E−160 | 1 | regenerating gene type IV mRNA, complete cds/ |
| 473C1 | 42 | 479 | AW970759 | Hs.105621 | 0 | 1 | EST382842 cDNA/gb = AW970759/gi = 8160604/ug = |
| 102A9 | 1 | 331 | AK025947 | Hs.105664 | 0 | 1 | FLJ22294 fis, clone HRC04426/cds = (240,6 |
| 465G9 | 193 | 524 | AI475680 | Hs.105676 | 0 | 1 | tc93d12.x1 cDNA, 3' end/clone = IMAGE: 2073719 |
| 469G2 | 1528 | 1625 | AK022481 | Hs.105779 | 8.00E−38 | 1 | cDNA FLJ12419 fis, clone MAMMA1003047, highly |
| 482A9 | 289 | 839 | NM_012483 | Hs.105806 | 0 | 3 | granulysin (GNLY), transcript variant 519, m |
| 595B11 | 918 | 1300 | NM_002343 | Hs.105938 | 0 | 1 | lactotransferrin (LTF), mRNA/cds = (294,2429) |
| 69B3 | 3649 | 4226 | Y13247 | Hs.106019 | 0 | 1 | fb19 mRNA/cds = (539,3361)/gb = Y13247/gi = 2117 |
| 459E8 | 106 | 563 | NM_013322 | Hs.106260 | 0 | 1 | sorting nexin 10 (SNX10), mRNA/cds = (128,733) |
| 459E2 | 1939 | 2361 | NM_003171 | Hs.106469 | 0 | 1 | suppressor of var1 ( S. cerevisiae) 3-like 1 (S |
| 98H12 | 658 | 1040 | BC002748 | Hs.106650 | 0 | 2 | Similar to hypothetical protein FLJ20533, cl |
| 594H5 | 1418 | 1501 | NM_001568 | Hs.106673 | 6.00E−36 | 1 | eukaryotic translation initiation factor 3, |
| 194H12 | 751 | 1233 | NM_021626 | Hs.106747 | 0 | 1 | serine carboxypeptidase 1 precursor protein ( |
| 138G6 | 2749 | 3214 | AF189723 | Hs.106778 | 0 | 3 | calcium transport ATPase ATP2C1 (ATP2C1A) mRN |
| 56A5 | 1 | 1089 | AL355722 | Hs.106875 | 0 | 2 | EST from clone 35214, full insert/cds = UNKNOWN |
| 67H8 | 844 | 1102 | X71490 | Hs.106876 | 1.00E−103 | 1 | vacuolar proton ATPase, subunit D/cds = (2 |
| 463G10 | 538 | 725 | AF035306 | Hs.106890 | 1.00E−102 | 1 | clone 23771 mRNA sequence/cds = UNKNOWN/ gb = AF |
| 121H2 | 14 | 394 | NM_016619 | Hs.107139 | 0 | 1 | hypothetical protein (LOC51316), mRNA/cds = ( |
| 185D12 | 118 | 884 | NM_001564 | Hs.107153 | 0 | 3 | inhibitor of growth family, member 1-like (ING |
| 186D6 | 1140 | 1507 | NM_017892 | Hs.107213 | 0 | 1 | hypothetical protein FLJ20585 (FLJ20585), mR |
| 462B10 | 192 | 541 | AI707896 | Hs.107369 | 1.00E−168 | 1 | as34a10.x1 cDNA, 3' end/clone = IMAGE: 2319066 |
| 59A10 | 1694 | 2335 | AJ270952 | Hs.107393 | 0 | 3 | for putative membrane protein (GENX-3745 |
| 499G1 | 2987 | 4266 | AL035683 | Hs.107526 | 1.00E−104 | 2 | DNA sequence from clone RP5-1063B2 on chromosome 20q1 |
| 466F11 | 327 | 493 | AI391443 | Hs.107622 | 9.00E−90 | 1 | tf96e06.x1 cDNA, 3' end/clone = IMAGE: 2107138 |
| 182F9 | 153 | 649 | AF265439 | Hs.107707 | 0 | 1 | DC37 mRNA, complete cds/cds = (5,856)/gb = AF26 |
| 481F9 | 1216 | 1609 | NM_016270 | Hs.107740 | 0 | 2 | Kruppel-like factor (LOC51713), mRNA/cds = (84 |
| 184H4 | 189 | 576 | AF081282 | Hs.107979 | 0 | 1 | small membrane protein 1 (SMP1) mRNA, complete |
| 103E11 | 1006 | 2137 | NM_014313 | Hs.107979 | 0 | 4 | small membrane protein 1 (SMP1), mRNA/cds = (99, |
| 596H7 | 1265 | 1771 | NM_004078 | Hs.108080 | 0 | 3 | cysteine and glycine-rich protein 1 (CSRP1), m |
| 46H8 | 777 | 914 | AF070640 | Hs.108112 | 2.00E−47 | 1 | clone 24781 mRNA sequence/cds = UNKNOWN/ gb = AF |
| 53B4 | 1552 | 1967 | U32986 | Hs.108327 | 0 | 2 | xeroderma pigmentosum group E UV-damaged DNA binding |
| 124A10 | 1089 | 1733 | AK001428 | Hs.108332 | 0 | 3 | cDNA FLJ10566 fis, clone NT2RP2002959, highly |
| 127F8 | 428 | 746 | AL136941 | Hs.108338 | 0 | 1 | mRNA; cDNA DKFZp586C1924 (from clone DKFZp586 |
| 191G10 | 518 | 883 | AL136640 | Hs.108548 | 0 | 2 | mRNA; cDNA DKFZp564F163 (from clone DKFZp564F1 |
| 458G8 | 2374 | 5101 | NM_016227 | Hs.108636 | 0 | 2 | membrane protein CH1 (CH1), mRNA/cds = (124,434 |
| 58F11 | 735 | 798 | NM_006963 | Hs.108642 | 2.00E−28 | 1 | zinc finger protein 22 (KOX 15) (ZNF22), mRNA/ |
| 118B5 | 2715 | 2797 | AK022874 | Hs.108779 | 2.00E−38 | 1 | cDNA FLJ12812 fis, clone NT2RP2002498/cds = (3, |
| 110H2 | 18 | 661 | AF026292 | Hs.108809 | 0 | 1 | chaperonin containing t-complex polypeptide |
| 181G4 | 1008 | 1142 | NM_006429 | Hs.108809 | 2.00E−71 | 1 | chaperonin containing TCP1, subunit 7 (eta) (C |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 189F11 | 415 | 615 | AK024569 | Hs.108854 | 2.00E−79 | 1 | cDNA: FLJ20916 fis, clone ADSE00738, highly s |
| 596F8 | 5958 | 6097 | AB011087 | Hs.108945 | 8.00E−48 | 1 | mRNA for KIAA0515 protein, partial cds/cds = (0, |
| 157D8 | 399 | 830 | NM_016145 | Hs.108969 | 0 | 1 | PTD008 protein (PTD008),/cds = (233,553) |
| 175E7 | 712 | 1849 | AL133111 | Hs.109150 | 0 | 2 | mRNA; cDNA DKFZp434H068 (from clone DKFZp434H0 |
| 514E1 | 66 | 613 | NM_012417 | Hs.109219 | 0 | 4 | retinal degeneration B beta (RDGBB), mRNA/cd |
| 106A4 | 1864 | 2220 | AJ011895 | Hs.109281 | 1.00E−111 | 1 | for HIV-1, Nef-associated factor 1 alpha |
| 169E1 | 938 | 1331 | AK024297 | Hs.109441 | 0 | 2 | FLJ14235 fis, clone NT2RP4000167/cds = (82 |
| 100B8 | 1 | 191 | NM_012456 | Hs.109571 | 3.00E−85 | 1 | translocase of inner mitochondrial membrane 1 |
| 115B7 | 983 | 1193 | NM_007074 | Hs.109606 | 1.00E−116 | 1 | coronin, actin-binding protein, 1A (CORO1A), |
| 62H11 | 1 | 626 | BF245892 | Hs.109641 | 1.00E−154 | 10 | 601864070F1 cDNA, 5' end/clone = lMAGE: 4082465 |
| 595B2 | 4976 | 5286 | AB040884 | Hs.109694 | 1.00E−142 | 1 | mRNA for KIAA1451 protein, partial cds/cds = (0 |
| 75H11 | 227 | 482 | BF244603 | Hs.109697 | 1.00E−129 | 1 | 601862620F1 cDNA, 5' end/clone = IMAGE: 4080412 |
| 118G3 | 219 | 392 | NM_024292 | Hs.109701 | 2.00E−66 | 1 | ubiquitin-like 5 (UBL5), mRNA/cds = (65,286)/ |
| 105A5 | 3271 | 3532 | AL117407 | Hs.109727 | 1.00E−147 | 2 | cDNA DKFZp434D2050 (from clone DKFZp434D |
| 481B7 | 1101 | 1201 | NM_006026 | Hs.109804 | 9.00E−42 | 1 | H1 histone family, member X (H1FX), mRNA/cds = ( |
| 476H12 | 1018 | 1429 | NM_004310 | Hs.109918 | 0 | 3 | ras homolog gene family, member H (ARHH), mRNA |
| 144C8 | 1252 | 1429 | Z35227 | Hs.109918 | 7.00E−92 | 1 | TTF for small G protein/cds = (579,1154)/gb = |
| 141E10 | 630 | 1269 | AK001779 | Hs.110445 | 0 | 4 | FLJ10917 fis, clone OVARC1000321/cds = (18 |
| 494D8 | 4102 | 4476 | NM_014918 | Hs.110488 | 0 | 1 | KIAA0990 protein (KIAA0990), mRNA/cds = (494,2 |
| 47C3 | 2298 | 2431 | D86974 | Hs.110613 | 1.00E−60 | 1 | KIAA0220 gene, partial cds/cds = (0,1661)/gb |
| 194C10 | 1210 | 1704 | AL157477 | Hs.110702 | 0 | 1 | mRNA; cDNA DKFZp761E212 (from clone DKFZp761E2 |
| 192F1 | 3254 | 3686 | NM_015726 | Hs.110707 | 1.00E−150 | 2 | H326 (H326), mRNA/cds = (176,1969)/gb = NM_0157 |
| 595B8 | 1148 | 1414 | NM_003472 | Hs.110713 | 1.00E−147 | 1 | DEK oncogene (DNA binding) (DEK), mRNA/cds = (3 |
| 459F3 | 3337 | 3915 | NM_001046 | Hs.110736 | 0 | 1 | solute carrier family 12 (sodium/potassium/ch |
| 195F5 | 1051 | 1482 | AK025557 | Hs.110771 | 0 | 2 | cDNA: FLJ21904 fis, clone HEP03585/cds = UNKNOW |
| 53B10 | 163 | 742 | NM_020150 | Hs.110796 | 0 | 1 | SAR1 protein (SAR1), mRNA/cds = (100,696)/gb = |
| 164B11 | 122 | 932 | NM_016039 | Hs.110803 | 0 | 5 | CGI-99 protein (LOC51637), mRNA/cds = (161,895 |
| 594H4 | 982 | 1454 | AK026528 | Hs.111222 | 6.00E−95 | 3 | cDNA: FLJ22875 fis, clone KAT02879/cds = (30,51 |
| 50A10 | 1688 | 2095 | AF119897 | Hs.111334 | 0 | 2 | PRO2760 mRNA, complete cds/cds = UNKNOWN/ gb = A |
| 102H11 | 175 | 498 | AI436587 | Hs.111377 | 1.00E−148 | 1 | ti03d11.x1 cDNA, 3' end/clone = IMAGE: 2129397 |
| 109G11 | 1324 | 1388 | AB016811 | Hs.111554 | 2.00E−29 | 1 | for ADP ribosylation factor-like protein, |
| 144E10 | 77 | 304 | BF219474 | Hs.111611 | 1.00E−122 | 2 | 601884269F1 5' end/clone = IMAGE: 4102769 |
| 583C9 | 4 | 272 | NM_000988 | Hs.111611 | 1.00E−148 | 10 | ribosomal protein L27 (RPL27), mRNA/cds = (17,4 |
| 111F4 | 31 | 380 | NM_014463 | Hs.111632 | 0 | 1 | Lsm3 protein (LSM3), mRNA/cds = (29,337)/gb = N |
| 106E6 | 2646 | 2892 | AL096723 | Hs.111801 | 1.00E−135 | 1 | cDNA DKFZp564H2023 (from clone DKFZp564H |
| 169A2 | 773 | 1015 | D14696 | Hs.111894 | 1.00E−135 | 2 | KIAA0108 gene, complete cds/cds = (146,847)/ |
| 182D6 | 264 | 748 | NM_014713 | Hs.111894 | 0 | 1 | lysosomal-associated protein transmembrane |
| 460D11 | 205 | 452 | AI557431 | Hs.111973 | 4.00E−60 | 1 | PT2.1_7_C05.r cDNA, 3' end/clone_end = 3' /gb = |
| 121A7 | 355 | 589 | NM_020382 | Hs.111988 | 1.00E−128 | 1 | PR/SET domain containing protein 07 (SET07), m |
| 476C12 | 254 | 463 | AA442585 | Hs.112071 | 1.00E−111 | 1 | zv57f09.r1 cDNA, 5' end/clone = IMAGE: 757769/ |
| 172E7 | 469 | 736 | AF228422 | Hs.112242 | 1.00E−143 | 1 | normal mucosa of esophagus specific 1 (NMES1) |
| 108E10 | 4800 | 4901 | AF071076 | Hs.112255 | 6.00E−48 | 1 | cell-line HeLa Nup98-Nup96 precursor, mRNA, c |
| 47G12 | 1 | 301 | BF237710 | Hs.112318 | 1.00E−165 | 5 | 601842210F1 cDNA, 5' end/clone = IMAGE: 4079930 |
| 599G7 | 38 | 455 | NM_019059 | Hs.112318 | 0 | 32 | 6.2 kd protein (LOC54543), mRNA/cds = (93,260) |
| 469F9 | 226 | 546 | NM_002638 | Hs.112341 | 1.00E−107 | 1 | protease inhibitor 3, skin-derived (SKALP) (P |
| 589G11 | 482 | 1336 | AK026396 | Hs.112497 | 0 | 2 | cDNA: FLJ22743 fis, clone HUV00901/ cds = UNKNOW |
| 464F10 | 1686 | 1917 | NM_002978 | Hs.112842 | 1.00E−119 | 1 | sodium channel, nonvoltage-gated 1, delta (SC |
| 54B11 | 1 | 423 | BF025727 | Hs.113029 | 0 | 26 | 601670406F1 cDNA, 5' end/clone = IMAGE: 3953425 |
| 591C5 | 31 | 469 | NM_001028 | Hs.113029 | 0 | 10 | ribosomal protein S25 (RPS25), mRNA/cds = (71,4 |
| 585F4 | 1882 | 3918 | AK027136 | Hs.113205 | 1.00E−130 | 3 | cDNA: FLJ23483 fis, clone KAIA04052/cds = UNKNO |
| 61B12 | 1168 | 2386 | AF105253 | Hs.113368 | 0 | 5 | neuroendocrine secretory protein 55 mRNA, com |
| 163D9 | 3470 | 4109 | Y08890 | Hs.113503 | 0 | 1 | mRNA for Ran_GTP binding protein 5 |
| 466C4 | 276 | 946 | AL359916 | Hs.113872 | 0 | 1 | DNA sequence from clone RP11-550O8 on chromosome 20 C |
| 592C12 | 2506 | 2696 | AF323540 | Hs.114309 | 2.00E−80 | 1 | apolipoprotein L-I mRNA, splice variant B, co |
| 476A11 | 121 | 528 | AA702108 | Hs.114931 | 0 | 1 | zi85e01.s1 cDNA, 3' end/clone = IMAGE: 447576/ |
| 109F4 | 3123 | 3521 | D30783 | Hs.115263 | 0 | 1 | for epiregulin, complete cds/cds = (166,67 |
| 123D1 | 3123 | 3526 | NM_001432 | Hs.115263 | 0 | 1 | epiregulin (EREG), mRNA/cds = (166,675)/gb = N |
| 465D7 | 1 | 175 | BG288391 | Hs.115467 | 1.00E−94 | 1 | 602388053F1 cDNA, 5' end/clone = IMAGE: 4517076 |
| 74H9 | 346 | 602 | AK027114 | Hs.115659 | 1.00E−108 | 1 | FLJ23461 fis, clone HSI07757/cds = UNKNOW |
| 585E4 | 384 | 1146 | NM_024061 | Hs.115659 | 0 | 3 | hypothetical protein MGC5521 (MGC5521), mRNA |
| 462C1 | 945 | 1222 | NM_024036 | Hs.115960 | 1.00E−152 | 1 | hypothetical protein MGC3103 (MGC3103), mRNA |
| 464E4 | 1276 | 1635 | AK023633 | Hs.116278 | 1.00E−138 | 1 | cDNA FLJ13571 fis, clone PLACE1008405/cds = UNK |
| 43B10 | 1601 | 1798 | AF283777 | Hs.116481 | 9.00E−47 | 1 | clone TCBAP0702 mRNA sequence/cds = UNKNOWN/g |
| 465G1 | 374 | 654 | NM_001782 | Hs.116481 | 5.00E−85 | 2 | CD72 antigen (CD72), mRNA/cds = (108,1187)/gb |
| 51G8 | 29 | 203 | BF341330 | Hs.116567 | 6.00E−26 | 1 | 602013274F1 cDNA, 5' end/clone = IMAGE: 4149066 |
| 40D10 | 2694 | 3430 | X68742 | Hs.116774 | 0 | 1 | integrin, alpha subunit/cds = UNKNOWN/g |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 107D1 | 1778 | 1943 | U71383 | Hs.117005 | 1.00E−84 | 1 | OB binding protein-2 (OB-BP2) mRNA, complete cds/cds |
| 459D4 | 2882 | 3522 | AK025364 | Hs.117268 | 0 | 1 | cDNA: FLJ21711 fis, clone COL10156/cds = UNKNOW |
| 473E8 | 2104 | 2233 | AB029016 | Hs.117333 | 2.00E−65 | 3 | mRNA for KIAA1093 protein, partial cds/cds = (0 |
| 458E2 | 88 | 627 | AI825645 | Hs.117906 | 0 | 2 | wb75b09.x1 cDNA, 3' end/clone = IMAGE: 2311481 |
| 163A7 | 1160 | 1420 | X53793 | Hs.117950 | 1.00E−109 | 1 | ADE2H1 mRNA showing homologies to SAICAR syntheta |
| 123B8 | 18 | 740 | NM_002799 | Hs.118065 | 0 | 1 | proteasome (prosome, macropain) subunit, bet |
| 583G3 | 924 | 1199 | AB011182 | Hs.118087 | 1.00E−155 | 4 | mRNA for KIAA0610 protein, partial cds/cds = (0, |
| 127A1 | 263 | 557 | NM_006441 | Hs.118131 | 1.00E−141 | 1 | 5,10-methenyltetrahydrofolate synthetase ( |
| 459A10 | 188 | 817 | AL522477 | Hs.118142 | 0 | 1 | AL522477 cDNA/clone = CS0DB008YK14-(3-prime) |
| 584A10 | 8484 | 8875 | NM_003316 | Hs.118174 | 0 | 1 | tetratricopeptide repeat domain 3 (TTC3), mRN |
| 52D4 | 1287 | 1752 | AK026486 | Hs.118183 | 0 | 1 | FLJ22833 fis, clone KAIA4266/cds = (479,8 |
| 470B6 | 68 | 532 | BF030930 | Hs.118303 | 0 | 1 | 601558648F1 cDNA, 5' end/clone = IMAGE: 3828706 |
| 41B3 | 5041 | 5669 | M14648 | Hs.118512 | 0 | 1 | cell adhesion protein (vitronectin) receptor alpha s |
| 125B8 | 999 | 1573 | NM_003733 | Hs.118633 | 0 | 1 | 2'-5'oligoadenylate synthetase-like (OASL), |
| 459D3 | 3 | 427 | AI052447 | Hs.118659 | 0 | 1 | oz07g04.x1 cDNA, 3' end/clone = IMAGE: 1674678 |
| 112F11 | 191 | 387 | NM_006923 | Hs.118684 | 1.00E−103 | 1 | stromal cell-derived factor 2 (SDF2), mRNA/c |
| 129E4 | 1727 | 1891 | AL050404 | Hs.118695 | 2.00E−86 | 1 | DNA sequence from clone 955M13 on chromosome 20. Conta |
| 126H2 | 1512 | 2209 | NM_000358 | Hs.118787 | 0 | 2 | transforming growth factor, beta-induced, 68 |
| 598D9 | 817 | 1106 | NM_001155 | Hs.118796 | 1.00E−108 | 1 | annexin A6 (ANXA6), transcript variant 1, mRN |
| 331E6 | 89 | 475 | BE311727 | Hs.118857 | 0 | 1 | 601143334F1 cDNA, 5' end/clone = IMAGE: 3507009 |
| 521C1 | 700 | 1180 | NM_006292 | Hs.118910 | 0 | 2 | tumor susceptibility gene 101 (TSG101), mRNA |
| 139E8 | 463 | 1198 | AJ012506 | Hs.118958 | 0 | 1 | activated in tumor suppression, clone TSA |
| 69H2 | 578 | 1117 | U05040 | Hs.118962 | 0 | 1 | FUSE binding protein mRNA, complete cds/cds = (26,1960 |
| 461F1 | 1241 | 1715 | AK024119 | Hs.118990 | 0 | 1 | cDNA FLJ14057 fis, clone HEMBB1000337/cds = UNK |
| 481E1 | 1682 | 1969 | NM_017544 | Hs.119018 | 1.00E−129 | 1 | transcription factor NRF (NRF), mRNA/cds = (653 |
| 479B4 | 45 | 203 | AL109806 | Hs.119057 | 5.00E−43 | 1 | DNA sequence from clone RP5-1153D9 on chromosome 20 C |
| 520F1 | 177 | 672 | NM_012423 | Hs.119122 | 1.00E−148 | 8 | ribosomal protein L13a (RPL13A), mRNA/cds = (1 |
| 477F1 | 46 | 1565 | AL109786 | Hs.119155 | 0 | 3 | mRNA full length insert cDNA clone EUROIMAGE 81 |
| 166F10 | 304 | 814 | M37583 | Hs.119192 | 0 | 3 | histone (H2A.Z) mRNA, complete cds/cds = (106,492)/g |
| 592E5 | 302 | 814 | NM_002106 | Hs.119192 | 0 | 7 | H2A histone family, member Z (H2AFZ), mRNA/cd |
| 54B1 | 47 | 1144 | AJ400717 | Hs.119252 | 0 | 9 | TPT1 gene for translationally controlled tumo |
| 594H9 | 609 | 1013 | NM_000520 | Hs.119252 | 0 | 1 | hexosaminidase A (alpha polypeptide) (HEXA), |
| 492D9 | 30 | 272 | NM_001004 | Hs.119500 | 1.00E−135 | 2 | ribosomal protein, large P2 (RPLP2), mRNA/cd |
| 59H8 | 14 | 1890 | NM_016091 | Hs.119503 | 0 | 12 | HSPC025 (HSPC025), mRNA/cds = (33,1727)/gb = N |
| 525E8 | 12 | 446 | NM_006432 | Hs.119529 | 0 | 2 | epididymal secretory protein (19.5 kD) (HE1), |
| 166G7 | 1323 | 2293 | M88108 | Hs.119537 | 0 | 3 | p62 mRNA, complete cds/cds = (106,1437)/gb = M88108/g |
| 112D10 | 1054 | 1722 | NM_006559 | Hs.119537 | 0 | 1 | GAP-associated tyrosine phosphoprotein p62 |
| 158E9 | 847 | 1273 | AL022326 | Hs.119598 | 0 | 1 | DNA sequence from clone 333H23 on chromosome 22q12.1−1 |
| 161H7 | 738 | 1272 | NM_000967 | Hs.119598 | 0 | 1 | ribosomal protein L3 (RPL3), mRNA/cds = (6,1217 |
| 168F8 | 284 | 778 | M34671 | Hs.119663 | 0 | 1 | lymphocytic antigen CD59/MEM43 mRNA, complete cds/c |
| 585C9 | 285 | 783 | NM_000611 | Hs.119663 | 0 | 1 | CD59 antigen p18−20 (antigen identified by mo |
| 143G12 | 753 | 1329 | AK023975 | Hs.119908 | 0 | 4 | FLJ13913 fis, clone Y79AA1000231, highly |
| 55D12 | 1107 | 1365 | NM_015934 | Hs.119908 | 1.00E−119 | 1 | nucleolar protein NOP5/NOP58 (NOP5/NOP58), m |
| 467E7 | 37 | 419 | AI492066 | Hs.119923 | 0 | 1 | tg12b03.x1 cDNA, 3' end/clone = IMAGE: 2108525 |
| 462C10 | 2669 | 3025 | NM_012318 | Hs.120165 | 0 | 1 | leucine zipper-EF-hand containing transmembr |
| 473F11 | 396 | 1006 | AK025068 | Hs.120170 | 0 | 1 | cDNA: FLJ21415 fis, clone COL04030/cds = (138,7 |
| 98E11 | 211 | 458 | AW081455 | Hs.120219 | 1.00E−114 | 2 | xc31c07.x1 cDNA, 3' end/clone = IMAGE: 2585868 |
| 471C8 | 60 | 301 | NM_014487 | Hs.120766 | 1.00E−120 | 1 | nucleolar cysteine-rich protein (HSA6591), m |
| 134C4 | 284 | 529 | AK000470 | Hs.120769 | 9.00E−98 | 1 | cDNA FLJ20463 fis, clone KAT06143/cds = UNKNOWN |
| 469C10 | 1 | 441 | AA677952 | Hs.120891 | 0 | 1 | zi14a06.s1 cDNA, 3' end/clone = IMAGE: 430738/ |
| 60C9 | 1022 | 1615 | AB011421 | Hs.120996 | 0 | 1 | for DRAK2, complete cds/cds = (261,1379)/ |
| 461A7 | 738 | 1274 | NM_014205 | Hs.121025 | 0 | 1 | chromosome 11 open reading frame 5 (C11ORF5), m |
| 104A4 | 557 | 1942 | D89974 | Hs.121102 | 0 | 4 | for glycosylphosphatidyl inositol-ancho |
| 196C9 | 557 | 1463 | NM_004665 | Hs.121102 | 0 | 9 | vanin 2 (VNN2), mRNA/cds = (11,1573)/gb = NM_004 |
| 467F4 | 4 | 328 | AW972196 | Hs.121210 | 1.00E−162 | 1 | EST384285 cDNA/gb = AW972196/gi = 8162042/ug = |
| 587A12 | 224 | 367 | AW975541 | Hs.121572 | 1.00E−62 | 1 | EST387650 cDNA/gb = AW975541/gi = 8166755/ug = |
| 36G5 | 13 | 604 | AL008729 | Hs.121591 | 0 | 1 | DNA sequence from PAC 257A7 on chromosome 6p24. Contai |
| 464C1 | 120 | 413 | AA772692 | Hs.121709 | 1.00E−120 | 1 | ai35b09.s1 cDNA, 3' end/clone = 1358969/clone |
| 36E2 | 411 | 821 | AK025556 | Hs.121849 | 0 | 1 | FLJ21903 fis, clone HEP03579/cds = (84,46 |
| 196A6 | 411 | 1113 | NM_022818 | Hs.121849 | 0 | 1 | Microtubule-associated proteins 1A and 1B, I |
| 471G2 | 176 | 333 | AW469546 | Hs.122116 | 2.00E−64 | 1 | hd19e09.x1 cDNA, 3' end/clone = IMAGE: 2909992 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 462F5 | 218 | 611 | BF677944 | Hs.122406 | 1.00E−166 | 1 | 602084766F1 cDNA, 5' end/clone = IMAGE: 4248905 |
| 465A6 | 376 | 478 | AV762642 | Hs.122431 | 2.00E−28 | 1 | AV762642 cDNA, 5' end/clone = MDSEMB08/clone_ |
| 467G10 | 603 | 803 | AL040371 | Hs.122487 | 9.00E−96 | 1 | DKFZp434P0213_r1 cDNA, 5' end/clone = DKFZp434 |
| 465C12 | 66 | 260 | AI804629 | Hs.122848 | 3.00E−83 | 1 | tc81g03.x1 cDNA, 3' end/clone = IMAGE: 2072596 |
| 98H6 | 442 | 591 | AI081246 | Hs.122983 | 5.00E−78 | 1 | oy67b06.x1 cDNA, 3' end/clone = IMAGE: 1670867 |
| 52B4 | 123 | 236 | BE676541 | Hs.123254 | 8.00E−46 | 1 | 7f31g03.x1 cDNA, 3' end/clone = IMAGE: 3296308 |
| 128C7 | 4875 | 5186 | AB020631 | Hs.123654 | 1.00E−131 | 1 | mRNA for KIAA0824 protein, partial cds/cds = (0 |
| 184B5 | 594 | 1187 | AL109865 | Hs.124186 | 0 | 1 | DNA sequence from clone GS1-120K12 on chromosome 1q25 |
| 106A6 | 1135 | 1456 | AK026776 | Hs.124292 | 9.00E−99 | 1 | FLJ23123 fis, clone LNG08039/cds = UNKNOW |
| 525G12 | 314 | 503 | BF996704 | Hs.124344 | 1.00E−72 | 1 | MR1-GN0173-071100-009-g10 cDNA/gb = BF996704 |
| 466C3 | 120 | 496 | AA831838 | Hs.124391 | 1.00E−172 | 1 | oc85h06.s1 cDNA, 3' end/clone = IMAGE: 1356539 |
| 48G4 | 1 | 568 | AA203497 | Hs.124601 | 0 | 1 | zx58g05.r1 cDNA, 5' end/clone = IMAGE: 446744/ |
| 517G2 | 577 | 756 | AA858297 | Hs.124675 | 3.00E−61 | 1 | ob13b08.s1 cDNA, 3' end/clone = IMAGE: 1323543 |
| 107H3 | 913 | 1220 | AK023013 | Hs.124762 | 1.00E−174 | 1 | FLJ12951 fis, clone NT2RP2005457, highly |
| 473A7 | 729 | 929 | NM_019062 | Hs.124835 | 4.00E−82 | 1 | hypothetical protein (FLJ20225), mRNA/cds = ( |
| 108D12 | 3225 | 3531 | AF023142 | Hs.125134 | 1.00E−142 | 2 | pre-mRNA splicing SR protein rA4 mRNA, partial |
| 463E11 | 158 | 519 | AI380443 | Hs.125608 | 0 | 1 | tg02f04.x1 cDNA, 3' end/clone = IMAGE: 2107615 |
| 104F6 | 1581 | 2028 | NM_019853 | Hs.125682 | 0 | 1 | protein phosphatase 4 regulatory subunit 2 (P |
| 462A5 | 5 | 282 | AW975851 | Hs.125815 | 1.00E−149 | 1 | EST387960 cDNA/gb = AW975851/gi = 8167072/ug = |
| 462B1 | 534 | 702 | AI378032 | Hs.125892 | 1.00E−69 | 1 | te67g08.x1 cDNA, 3' end/clone = IMAGE: 2091806 |
| 121A6 | 3074 | 3494 | AB028978 | Hs.126084 | 1.00E−174 | 1 | mRNA for KIAA1055 protein, partial cds/cds = (0 |
| 171G12 | 94 | 1240 | M15330 | Hs.126256 | 0 | 7 | interleukin 1-beta (IL1B) mRNA, complete cds/ cds = (86 |
| 183D12 | 100 | 1275 | NM_000576 | Hs.126256 | 0 | 9 | interleukin 1, beta (IL1B), mRNA/cds = (86,895) |
| 458B2 | 6 | 415 | AI393205 | Hs.126265 | 0 | 1 | tg14b07.x1 cDNA, 3' end/clone = IMAGE: 2108725 |
| 102G6 | 885 | 1906 | AJ271684 | Hs.126355 | 1.00E−171 | 2 | for myeloid DAP12-associating lectin (MD |
| 463E4 | 847 | 1015 | NM_013252 | Hs.126355 | 2.00E−89 | 1 | C-type (calcium dependent, carbohydrate-reco |
| 167B2 | 2468 | 2721 | AF195514 | Hs.126550 | 1.00E−142 | 1 | VPS4-2 ATPase (VPS42) mRNA, complete cds/cds = |
| 473D8 | 19 | 397 | BF445163 | Hs.126594 | 0 | 1 | nad21d12.x1 cDNA, 3' end/clone = IMAGE: 3366191 |
| 143C9 | 333 | 551 | BE250027 | Hs.126701 | 1.00E−121 | 1 | 600943030F1 cDNA, 5' end/clone = IMAGE: 2959639 |
| 471E10 | 806 | 945 | AK021519 | Hs.126707 | 2.00E−71 | 1 | cDNA FLJ11457 fis, clone HEMBA1001522/cds = (1 |
| 462B4 | 159 | 572 | NM_017762 | Hs.126721 | 0 | 1 | hypothetical protein FLJ20313 (FLJ20313), mR |
| 41D8 | 1 | 2519 | AK023275 | Hs.126925 | 0 | 5 | FLJ13213 fis, clone NT2RP4001126, weakly |
| 463F5 | 2 | 563 | NM_014464 | Hs.127011 | 0 | 1 | tubulointerstitial nephritis antigen (TIN-A |
| 597C8 | 2662 | 2905 | AB046765 | Hs.127270 | 1.00E−136 | 1 | mRNA for KIAA1545 protein, partial cds/cds = (0 |
| 458F11 | 15 | 212 | BF508731 | Hs.127311 | 8.00E−81 | 1 | UI-H-BI4-aoq-b-08-0-UI.s1 cDNA, 3' end/clon |
| 462B3 | 76 | 389 | AW978753 | Hs.127327 | 1.00E−133 | 1 | EST390862 cDNA/gb = AW978753/gi = 8170027/ug = |
| 463E2 | 176 | 787 | AI028267 | Hs.127514 | 0 | 1 | ow01d06.x1 cDNA, 3' end/clone = IMAGE: 1645547 |
| 465G5 | 181 | 372 | AA953396 | Hs.127557 | 6.00E−78 | 1 | on63h10.s1 cDNA, 3' end/clone = IMAGE: 1561411 |
| 125B8 | 999 | 1573 | NM_003733 | Hs.118633 | 0 | 1 | 2'-5'oligoadenylate synthetase-like (OASL), |
| 459D3 | 3 | 427 | AI052447 | Hs.118659 | 0 | 1 | oz07g04.x1 cDNA, 3' end/clone = IMAGE: 1674678 |
| 112F11 | 191 | 387 | NM_006923 | Hs.118684 | 1.00E−103 | 1 | stromal cell-derived factor 2 (SDF2), mRNA/c |
| 129E4 | 1727 | 1891 | AL050404 | Hs.118695 | 2.00E−86 | 1 | DNA sequence from clone 955M13 on chromosome 20. Conta |
| 126H2 | 1512 | 2209 | NM_000358 | Hs.118787 | 0 | 2 | transforming growth factor, beta-induced, 68 |
| 598D9 | 817 | 1106 | NM_001155 | Hs.118796 | 1.00E−108 | 1 | annexin A6 (ANXA6), transcript variant 1, mRN |
| 331E6 | 89 | 475 | BE311727 | Hs.118857 | 0 | 1 | 601143334F1 cDNA, 5' end/clone = IMAGE: 3507009 |
| 521C1 | 700 | 1180 | NM_006292 | Hs.118910 | 0 | 2 | tumor susceptibility gene 101 (TSG101), mRNA |
| 139E8 | 463 | 1198 | AJ012506 | Hs.118958 | 0 | 1 | activated in tumor suppression, clone TSA |
| 69H2 | 578 | 1117 | U05040 | Hs.118962 | 0 | 1 | FUSE binding protein mRNA, complete cds/ cds = (26,1960 |
| 461F1 | 1241 | 1715 | AK024119 | Hs.118990 | 0 | 1 | cDNA FLJ14057 fis, clone HEMBB1000337/cds = UNK |
| 481E1 | 1682 | 1969 | NM_017544 | Hs.119018 | 1.00E−129 | 1 | transcription factor NRF (NRF), mRNA/cds = (653 |
| 479B4 | 45 | 203 | AL109806 | Hs.119057 | 5.00E−43 | 1 | DNA sequence from clone RP5-1153D9 on chromosome 20 C |
| 520F1 | 177 | 672 | NM_012423 | Hs.119122 | 1.00E−148 | 8 | ribosomal protein L13a (RPL13A), mRNA/cds = (1 |
| 477E4 | 46 | 1565 | AL109786 | Hs.119155 | 0 | 3 | mRNA full length insert cDNA clone EUROIMAGE 81 |
| 166F10 | 304 | 814 | M37583 | Hs.119192 | 0 | 3 | histone (H2A.Z) mRNA, complete cds/cds = (106,492)/g |
| 592E5 | 302 | 814 | NM_002106 | Hs.119192 | 0 | 7 | H2A histone family, member Z (H2AFZ), mRNA/cd |
| 54B1 | 47 | 1144 | AJ400717 | Hs.119252 | 0 | 9 | TPT1 gene for translationally controlled tumo |
| 594H9 | 609 | 1013 | NM_000520 | Hs.119403 | 0 | 1 | hexosaminidase A (alpha polypeptide) (HEXA), |
| 492D9 | 30 | 272 | NM_001004 | Hs.119500 | 1.00E−135 | 2 | ribosomal protein, large P2 (RPLP2), mRNA/cd |
| 59H8 | 14 | 1890 | NM_016091 | Hs.119503 | 0 | 12 | HSPC025 (HSPC025), mRNA/cds = (33,1727)/gb = N |
| 525E8 | 12 | 446 | NM_006432 | Hs.119529 | 0 | 2 | epididymal secretory protein (19.5 kD) (HE1), |
| 166G7 | 1323 | 2293 | M88108 | Hs.119537 | 0 | 3 | p62 mRNA, complete cds/cds = (106,1437)/ gb = M88108/g |
| 112D10 | 1054 | 1722 | NM_006559 | Hs.119537 | 0 | 1 | GAP-associated tyrosine phosphoprotein p62 |
| 158E9 | 847 | 1273 | AL022326 | Hs.119598 | 0 | 1 | DNA sequence from clone 333H23 on chromosome 22q12.1–1 |
| 161H7 | 738 | 1272 | NM_000967 | Hs.119598 | 0 | 1 | ribosomal protein L3 (RPL3), mRNA/cds = (6,1217 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 168F8 | 284 | 778 | M34671 | Hs.119663 | 0 | 1 | lymphocytic antigen CD59/MEM43 mRNA, complete cds/c |
| 585C9 | 285 | 783 | NM_000611 | Hs.119663 | 0 | 1 | CD59 antigen p18–20 (antigen identified by mo |
| 143G12 | 753 | 1329 | AK023975 | Hs.119908 | 0 | 4 | FLJ13913 fis, clone Y79AA1000231, highly |
| 55D12 | 1107 | 1365 | NM_015934 | Hs.119908 | 1.00E−119 | 1 | nucleolar protein NOP5/NOP58 (NOP5/NOP58), m |
| 467E7 | 37 | 419 | AI492066 | Hs.119923 | 0 | 1 | tg12b03.x1 cDNA, 3' end/clone = IMAGE: 2108525 |
| 462C10 | 2669 | 3025 | NM_012318 | Hs.120165 | 0 | 1 | leucine zipper-EF-hand containing transmembr |
| 473F11 | 396 | 1006 | AK025068 | Hs.120170 | 0 | 1 | cDNA: FLJ21415 fis, clone COL04030/cds = (138,7 |
| 98E11 | 211 | 458 | AW081455 | Hs.120219 | 1.00E−114 | 2 | xc31c07.x1 cDNA, 3' end/clone = IMAGE: 2585868 |
| 471C8 | 60 | 301 | NM_014487 | Hs.120766 | 1.00E−120 | 1 | nucleolar cysteine-rich protein (HSA6591), m |
| 134C4 | 284 | 529 | AK000470 | Hs.120769 | 9.00E−98 | 1 | cDNA FLJ20463 fis, clone KAT06143/ cds = UNKNOWN |
| 469C10 | 1 | 441 | AA677952 | Hs.120891 | 0 | 1 | zi14a06.s1 cDNA, 3' end/clone = 430738/ |
| 60C9 | 1022 | 1615 | AB011421 | Hs.120996 | 0 | 1 | for DRAK2, complete cds/cds = (261,1379)/ |
| 461A7 | 738 | 1274 | NM_014205 | Hs.121025 | 0 | 1 | chromosome 11 open reading frame 5 (C11ORF5), m |
| 104A4 | 557 | 1942 | D89974 | Hs.121102 | 0 | 4 | for glycosylphosphatidyl inositol-ancho |
| 196C9 | 557 | 1463 | NM_004665 | Hs.121102 | 0 | 9 | vanin 2 (VNN2), mRNA/cds = (11,1573)/gb = NM_004 |
| 467F4 | 4 | 328 | AW972196 | Hs.121210 | 1.00E−162 | 1 | EST384285 cDNA/gb = AW972196/gi = 8162042/ug = |
| 587A12 | 224 | 367 | AW975541 | Hs.121572 | 1.00E−62 | 1 | EST387650 cDNA/gb = AW975541/gi = 8166755/ug = |
| 36G5 | 13 | 604 | AL008729 | Hs.121591 | 0 | 1 | DNA sequence from PAC 257A7 on chromosome 6p24. Contai |
| 464C1 | 120 | 413 | AA772692 | Hs.121709 | 1.00E−120 | 1 | ai35b09.s1 cDNA, 3' end/clone = 1358969/clone |
| 36E2 | 411 | 821 | AK025556 | Hs.121849 | 0 | 1 | FLJ21903 fis, clone HEP03579/cds = (84,46 |
| 196A6 | 411 | 1113 | NM_022818 | Hs.121849 | 0 | 1 | Microtubule-associated proteins 1A and 1B, I |
| 471G2 | 176 | 333 | AW469546 | Hs.122116 | 2.00E−64 | 1 | hd19e09.x1 cDNA, 3' end/clone = IMAGE: 2909992 |
| 462F5 | 218 | 611 | BF677944 | Hs.122406 | 1.00E−166 | 1 | 602084766F1 cDNA, 5' end/clone = IMAGE: 4248905 |
| 465A6 | 376 | 478 | AV762642 | Hs.122431 | 2.00E−28 | 1 | AV762642 cDNA, 5' end/clone = MDSEMB08/clone_ |
| 467G10 | 603 | 803 | AL040371 | Hs.122487 | 9.00E−96 | 1 | DKFZp434P0213_r1 cDNA, 5' end/clone = DKFZp434 |
| 465C12 | 66 | 260 | AI804629 | Hs.122848 | 3.00E−83 | 1 | tc81g03.x1 cDNA, 3' end/clone = IMAGE: 2072596 |
| 98H6 | 442 | 591 | AI081246 | Hs.122983 | 5.00E−78 | 1 | oy67b06.x1 cDNA, 3' end/clone = IMAGE: 1670867 |
| 52B4 | 123 | 236 | BE676541 | Hs.123254 | 8.00E−46 | 1 | 7f31g03.x1 cDNA, 3' end/clone = IMAGE: 3296308 |
| 128C7 | 4875 | 5186 | AB020631 | Hs.123654 | 1.00E−131 | 1 | mRNA for KIAA0824 protein, partial cds/cds = (0 |
| 184B5 | 594 | 1187 | AL109865 | Hs.124186 | 0 | 1 | DNA sequence from clone GS1-120K12 on chromosome 1q25 |
| 106A6 | 1135 | 1456 | AK026776 | Hs.124292 | 9.00E−99 | 1 | FLJ23123 fis, clone LNG08039/cds = UNKNOW |
| 525G12 | 314 | 503 | BF996704 | Hs.124344 | 1.00E−72 | 1 | MR1-GN0173-071100-009-g10 cDNA/gb = BF996704 |
| 466C3 | 120 | 496 | AA831838 | Hs.124391 | 1.00E−172 | 1 | oc85h06.s1 cDNA, 3' end/clone = IMAGE: 1356539 |
| 48G4 | 1 | 568 | AA203497 | Hs.124601 | 0 | 1 | zx58g05.r1 cDNA, 5' end/clone = IMAGE: 446744/ |
| 517G2 | 577 | 756 | AA858297 | Hs.124675 | 3.00E−61 | 1 | ob13b08.s1 cDNA, 3' end/clone = IMAGE: 1323543 |
| 107H3 | 913 | 1220 | AK023013 | Hs.124762 | 1.00E−174 | 1 | FLJ12951 fis, clone NT2RP2005457, highly |
| 473A7 | 729 | 929 | NM_019062 | Hs.124835 | 4.00E−82 | 1 | hypothetical protein (FLJ20225), mRNA/cds = ( |
| 108D12 | 3225 | 3531 | AF023142 | Hs.125134 | 1.00E−142 | 2 | pre-mRNA splicing SR protein rA4 mRNA, partial |
| 463E11 | 158 | 519 | AI380443 | Hs.125608 | 0 | 1 | tg02f04.x1 cDNA, 3' end/clone = IMAGE: 2107615 |
| 104F6 | 1581 | 2028 | NM_019853 | Hs.125682 | 0 | 1 | protein phosphatase 4 regulatory subunit 2 (P |
| 462A5 | 5 | 282 | AW975851 | Hs.125815 | 1.00E−149 | 1 | EST387960 cDNA/gb = AW975851/gi = 8167072/ug = |
| 462B1 | 534 | 702 | AI378032 | Hs.125892 | 1.00E−69 | 1 | te67g08.x1 cDNA, 3' end/clone = IMAGE: 2091806 |
| 121A6 | 3074 | 3494 | AB028978 | Hs.126084 | 1.00E−174 | 1 | mRNA for KIAA1055 protein, partial cds/cds = (0 |
| 171G12 | 94 | 1240 | M15330 | Hs.126256 | 0 | 7 | interleukin 1-beta (IL1B) mRNA, complete cds/ cds = (86 |
| 183D12 | 100 | 1275 | NM_000576 | Hs.126256 | 0 | 9 | interleukin 1, beta (IL1B), mRNA/cds = (86,895) |
| 458B2 | 6 | 415 | AI393205 | Hs.126265 | 0 | 1 | tg14b07.x1 cDNA, 3' end/clone = IMAGE: 2108725 |
| 102G6 | 885 | 1906 | AJ271684 | Hs.126355 | 1.00E−171 | 2 | for myeloid DAP12-associating lectin (MD |
| 463E4 | 847 | 1015 | NM_013252 | Hs.126355 | 2.00E−89 | 1 | C-type (calcium dependent, carbohydrate-reco |
| 167G2 | 2468 | 2721 | AF195514 | Hs.126550 | 1.00E−142 | 1 | VPS4-2 ATPase (VPS42) mRNA, complete cds/cds = |
| 473D8 | 19 | 397 | BF445163 | Hs.126594 | 0 | 1 | nad21d12.x1 cDNA, 3' end/clone = IMAGE: 3366191 |
| 143C9 | 333 | 551 | BE250027 | Hs.126701 | 1.00E−121 | 1 | 600943030F1 cDNA, 5' end/clone = IMAGE: 2959639 |
| 471E10 | 806 | 945 | AK021519 | Hs.126707 | 2.00E−71 | 1 | cDNA FLJ11457 fis, clone HEMBA1001522/cds = (1 |
| 462B4 | 159 | 572 | NM_017762 | Hs.126721 | 0 | 1 | hypothetical protein FLJ20313 (FLJ20313), mR |
| 41D8 | 1 | 2519 | AK023275 | Hs.126925 | 0 | 5 | FLJ13213 fis, clone NT2RP4001126, weakly |
| 463F5 | 2 | 563 | NM_014464 | Hs.127011 | 0 | 1 | tubulointerstitial nephritis antigen (TIN-A |
| 597C8 | 2662 | 2905 | AB046765 | Hs.127270 | 1.00E−136 | 1 | mRNA for KIAA1545 protein, partial cds/cds = (0 |
| 458F11 | 15 | 212 | BF508731 | Hs.127311 | 8.00E−81 | 1 | UI-H-BI4-aoq-b-08-0-UI.s1 cDNA, 3' end/clon |
| 462B3 | 76 | 389 | AW978753 | Hs.127327 | 1.00E−133 | 1 | EST390862 cDNA/gb = AW978753/gi = 8170027/ug = |
| 463E2 | 176 | 787 | AI028267 | Hs.127514 | 0 | 1 | ow01d06.x1 cDNA, 3' end/clone = IMAGE: 1645547 |
| 465G5 | 181 | 372 | AA953396 | Hs.127557 | 6.00E−78 | 1 | on63h10.s1 cDNA, 3' end/clone = IMAGE: 1561411 |
| 463E10 | 11190 | 11634 | NM_016239 | Hs.127561 | 0 | 1 | unconventional myosin-15 (LOC51168), mRNA/c |
| 476A9 | 27 | 216 | AW384918 | Hs.127574 | 1.00E−101 | 1 | PM1-HT0422-291299-002-d01 cDNA/gb = AW384918 |
| 111B10 | 1825 | 2463 | NM_014007 | Hs.127649 | 0 | 1 | KIAA0414 protein (KIAA0414), mRNA/cds = (1132, |
| 499A7 | 2134 | 5198 | AF070674 | Hs.127799 | 0 | 8 | inhibitor of apoptosis protein-1 (MIHC) mRNA, |
| 331F5 | 4 | 460 | BF342439 | Hs.127863 | 0 | 1 | 602013944F1 cDNA, 5' end/clone = IMAGE: 4149562 |
| 176A12 | 796 | 1351 | NM_022900 | Hs.128003 | 0 | 1 | hypothetical protein FLJ21213 (FLJ21213), mR |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 462B5 | 1766 | 1949 | NM_014406 | Hs.128342 | 5.00E−82 | 1 | potassium large conductance calcium-activate |
| 467D5 | 157 | 279 | AI222805 | Hs.128630 | 6.00E−62 | 1 | qp39c07.x1 cDNA, 3' end/clone = IMAGE: 1925388 |
| 465G3 | 1 | 529 | BE222032 | Hs.128675 | 0 | 1 | hr61g11.x1 cDNA, 3' end/clone = IMAGE: 3133028 |
| 467C7 | 1172 | 1726 | AF118274 | Hs.128740 | 0 | 1 | DNb-5 mRNA, partial cds/cds = (0,1601)/gb = AF11 |
| 175G11 | 358 | 724 | AL110151 | Hs.128797 | 0 | 1 | mRNA; cDNA DKFZp586D0824 (from clone DKFZp586 |
| 472A12 | 402 | 782 | BE745645 | Hs.129135 | 1.00E−153 | 1 | 601578727F1 cDNA, 5' end/clone = IMAGE: 3927535 |
| 473C7 | 46 | 217 | BE670584 | Hs.129192 | 3.00E−37 | 1 | 7e36h08.x1 cDNA, 3' end/clone = IMAGE: 3284607 |
| 463G11 | 7 | 397 | AA746320 | Hs.129572 | 0 | 1 | ob08f01.s1 cDNA, 3' end/clone = IMAGE: 1323097 |
| 63D8 | 18 | 1167 | D13748 | Hs.129673 | 0 | 4 | eukaryotic initiation factor 4AI/cds = (16,12 |
| 57F3 | 19 | 1279 | NM_001416 | Hs.129673 | 0 | 4 | eukaryotic translation initiation factor 4A, |
| 144G5 | 1071 | 1192 | AF064090 | Hs.129708 | 3.00E−62 | 3 | ligand for herpesvirus entry mediator (HVEM-L) |
| 118A9 | 2684 | 3198 | AB046805 | Hs.129750 | 0 | 1 | mRNA for KIAA1585 protein, partial cds/cds = (2 |
| 50G5 | 1119 | 1440 | AK024068 | Hs.129872 | 1.00E−172 | 1 | FLJ14006 fis, clone Y79AA1002399, highly |
| 469D6 | 376 | 603 | D43968 | Hs.129914 | 1.00E−126 | 1 | AML1 mRNA for AML1b protein (alternatively spliced pr |
| 590G11 | 823 | 1571 | NM_003563 | Hs.129951 | 0 | 3 | speckle-type POZ protein (SPOP), mRNA/cds = (15 |
| 591C7 | 68 | 571 | NM_005243 | Hs.129953 | 0 | 1 | Ewing sarcoma breakpoint region 1 (EWSR1), tra |
| 459F5 | 579 | 768 | AI763262 | Hs.130059 | 1.00E−35 | 1 | wi66c04.x1 cDNA, 3' end/clone = IMAGE: 2398278 |
| 479A10 | 259 | 448 | AI089359 | Hs.130232 | 1.00E−103 | 1 | qb05h03.x1 cDNA, 3' end/clone = IMAGE: 1695413 |
| 461G5 | 193 | 347 | AW898615 | Hs.130729 | 2.00E−68 | 1 | RC1-NN0073-090500-012-f02 cDNA/gb = AW898615 |
| 466B1 | 373 | 569 | AI347054 | Hs.130879 | 1.00E−76 | 1 | qp60a04.x1 cDNA, 3' end/clone = IMAGE: 1927374 |
| 463G3 | 3212 | 5430 | AJ404611 | Hs.130881 | 0 | 2 | mRNA for B-cell lymphoma/leukaemia 11A extra |
| 462C3 | 48 | 468 | AI421806 | Hs.131067 | 0 | 1 | tf44h11.x1 cDNA, 3' end/clone = IMAGE: 2099109 |
| 596C10 | 39 | 491 | NM_006294 | Hs.131255 | 0 | 3 | ubiquinol-cytochrome c reductase binding pro |
| 469G10 | 189 | 361 | AI024984 | Hs.131580 | 1.00E−81 | 1 | ov39d11.x1 cDNA, 3' end/clone = IMAGE: 1639701 |
| 458B7 | 169 | 659 | AW978870 | Hs.131828 | 0 | 1 | EST390979 cDNA/gb = AW978870/gi = 8170147/ug = |
| 63D1 | 185 | 500 | AF176706 | Hs.131859 | 1.00E−133 | 1 | F-box protein FBX11 mRNA, partial cds/cds = (0, |
| 58C10 | 4188 | 4313 | NM_014913 | Hs.131915 | 2.00E−65 | 1 | KIAA0863 protein (KIAA0863), mRNA/cds = (185,3 |
| 117H2 | 282 | 569 | NM_003608 | Hs.131924 | 1.00E−143 | 1 | G protein-coupled receptor 65 (GPR65), mRNA/ |
| 462D11 | 441 | 683 | AW976422 | Hs.132064 | 1.00E−118 | 1 | EST388531 cDNA/gb = AW976422/gi = 8167649/ug = |
| 586F11 | 161 | 1094 | NM_017830 | Hs.132071 | 0 | 2 | hypothetical protein FLJ20455 (FLJ20455), mR |
| 466A8 | 118 | 224 | AI042377 | Hs.132156 | 2.00E−44 | 1 | ox62c03.x1 cDNA, 3' end/clone = IMAGE: 1660900 |
| 472F6 | 979 | 1431 | AK022463 | Hs.132221 | 0 | 1 | cDNA FLJ12401 fis, clone MAMMA 1002796/cds = (3, |
| 462E4 | 19 | 567 | AI031656 | Hs.132237 | 0 | 1 | ow48e06.x1 cDNA, 3' end/clone = IMAGE: 1650082 |
| 462E2 | 4 | 539 | AI829569 | Hs.132238 | 0 | 1 | wf28e02.x1 cDNA, 3' end/clone = IMAGE: 2356922 |
| 461H9 | 453 | 618 | BG037042 | Hs.132555 | 4.00E−57 | 1 | 602288311F1 cDNA, 5' end/clone = IMAGE: 4374122 |
| 467D10 | 4518 | 4689 | AK024449 | Hs.132569 | 2.00E−55 | 1 | mRNA for FLJ00041 protein, partial cds/cds = (0 |
| 463H7 | 162 | 438 | AI346336 | Hs.132594 | 1.00E−132 | 1 | qp50b04.x1 cDNA, 3' end/clone = IMAGE: 1926415 |
| 592B8 | 2415 | 2957 | NM_005337 | Hs.132834 | 0 | 1 | hematopoietic protein 1 (HEM1), mRNA/cds = (158 |
| 70H2 | 6370 | 6718 | AF047033 | Hs.132904 | 1.00E−175 | 1 | sodium bicarbonate cotransporter 3 (SLC4A7) m |
| 50G10 | 1167 | 2041 | AL121985 | Hs.132906 | 0 | 4 | DNA sequence from clone RP11-404F10 on chromosome 1q2 |
| 123C10 | 1323 | 1570 | NM_015071 | Hs.132942 | 1.00E−136 | 1 | GTPase regulator associated with the focal adh |
| 121B10 | 92 | 503 | AA504269 | Hs.133032 | 0 | 1 | aa61c09.s1 cDNA, 3' end/clone = IMAGE: 825424/ |
| 171A12 | 696 | 909 | AL050035 | Hs.133130 | 6.00E−83 | 1 | mRNA; cDNA DKFZp566H0124 (from clone DKFZp566 |
| 463B5 | 123 | 449 | AI051673 | Hs.133175 | 1.00E−176 | 1 | oy77g06.x1 cDNA, 3' end/clone = IMAGE: 1671898 |
| 463B7 | 966 | 1103 | AL044498 | Hs.133262 | 3.00E−46 | 1 | DKFZp4341082_s1 cDNA, 3' end/clone = DKFZp4341 |
| 463B8 | 1 | 322 | AV661783 | Hs.133333 | 1.00E−176 | 1 | AV661783 cDNA, 3' end/clone = GLCGXE12/clone_ |
| 463A10 | 431 | 694 | AW966876 | Hs.133543 | 1.00E−110 | 1 | EST378950 cDNA/gb = AW966876/gi = 8156712/ug = |
| 464B10 | 63 | 547 | BF965766 | Hs.133864 | 0 | 1 | 602276890F1 cDNA, 5' end/clone = IMAGE: 4364495 |
| 460C6 | 454 | 653 | AW009671 | Hs.134272 | 8.00E−70 | 1 | ws85g09.x1 cDNA, 3' end/clone = IMAGE: 2504800 |
| 459C12 | 3337 | 3745 | AJ278245 | Hs.134342 | 1.00E−121 | 1 | mRNA for LanC-like protein 2 (lancl2 gene)/cds |
| 462G1 | 33 | 454 | AI074016 | Hs.134473 | 0 | 1 | oy66g02.x1 cDNA, 3' end/clone = IMAGE: 1670834 |
| 462G6 | 260 | 597 | BE676210 | Hs.134648 | 1.00E−156 | 1 | 7f25c05.x1 cDNA, 3' end/clone = IMAGE: 3295688 |
| 466H12 | 505 | 662 | AV706481 | Hs.134829 | 3.00E−65 | 1 | AV706481 cDNA, 5' end/clone = ADBBYF02 |
| 148H11 | 16 | 474 | BE786820 | Hs.135056 | 0 | 1 | 601477630F1 5' end/clone = IMAGE: 3880471 |
| 462E1 | 139 | 487 | BF109873 | Hs.135106 | 0 | 1 | 7170e11.x1 cDNA, 5' end/clone = IMAGE: 3526772 |
| 147E6 | 11 | 364 | AV712376 | Hs.135167 | 0 | 2 | AV712376 cDNA, 5' end/clone = DCAAND12/clone_ |
| 465B4 | 1993 | 2237 | AJ271326 | Hs.135187 | 1.00E−92 | 1 | mRNA for unc-93 related protein (UNC93 gene)/ |
| 463B4 | 185 | 352 | AI051664 | Hs.135339 | 4.00E−48 | 1 | oy77f06.x1 cDNA, 3' end/clone = IMAGE: 1671875 |
| 478H4 | 2126 | 2458 | AK024921 | Hs.135570 | 1.00E−170 | 1 | cDNA: FLJ21268 fis, clone COL01718/cds = UNKNOW |
| 148B6 | 119 | 444 | AI004582 | Hs.135764 | 3.00E−82 | 8 | ou04a11.x1 3' end/clone = IMAGE: 1625276 |
| 598E9 | 1948 | 2184 | NM_022117 | Hs.136164 | 3.00E−93 | 1 | cutaneous T-cell lymphoma-associated tumor a |
| 514C10 | 398 | 840 | AL049597 | Hs.136309 | 0 | 2 | DNA sequence from clone RP4-612B15 on chromosome 1p22 |
| 461C6 | 18 | 219 | BF513274 | Hs.136375 | 1.00E−101 | 1 | UI-H-BW1-amo-d-11-0-UI.s1 cDNA, 3' end/clon |
| 482E4 | 291 | 699 | BF526066 | Hs.136537 | 1.00E−142 | 1 | 602071176F1 cDNA, 5' end/clone = IMAGE: 4214059 |
| 461G7 | 43 | 466 | NM_013378 | Hs.136713 | 0 | 1 | pre-B lymphocyte gene 3 (VPREB3), mRNA/cds = (4 |
| 119B10 | 10 | 677 | NM_013269 | Hs.136748 | 0 | 2 | lectin-like NK cell receptor (LLT1), mRNA/cd |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 462A10 | 1233 | 1727 | AK024426 | Hs.137354 | 0 | 1 | mRNA for FLJ00015 protein, partial cds/cds = (3 |
| 41F2 | 2684 | 3000 | AJ223324 | Hs.137548 | 1.00E−156 | 1 | for MAX.3 cell surface antigen/cds = (44,10 |
| 74E8 | 16 | 2000 | D10923 | Hs.137555 | 0 | 15 | HM74/cds = (60,1223)/gb = D10923/gi = 219866/ |
| 58D10 | 8 | 2000 | NM_006018 | Hs.137555 | 0 | 9 | putative chemokine receptor; GTP-binding pro |
| 120E2 | 210 | 814 | NM_002027 | Hs.138381 | 0 | 1 | farnesyltransferase, CAAX box, alpha (FNTA), |
| 168E12 | 1953 | 2522 | D38524 | Hs.138593 | 0 | 1 | 5'-nucleotidase/cds = (83,1768)/gb = D38524 |
| 178F7 | 573 | 824 | NM_006413 | Hs.139120 | 1.00E−115 | 1 | ribonuclease P (30 kD) (RPP30), mRNA/cds = (27,8 |
| 473D1 | 1635 | 1767 | AL049942 | Hs.139240 | 6.00E−50 | 1 | mRNA; cDNA DKFZp564F1422 (from clone DKFZp564F |
| 188A8 | 924 | 1038 | NM_017523 | Hs.139262 | 1.00E−56 | 2 | XIAP associated factor-1 (HSXIAPAF1), mRNA/c |
| 168F7 | 933 | 1038 | X99699 | Hs.139262 | 1.00E−53 | 1 | for XIAP associated factor-1/cds = (0,953)/ |
| 181B10 | 1556 | 2517 | NM_005816 | Hs.142023 | 0 | 3 | T cell activation, increased late expression ( |
| 514E7 | 2052 | 2339 | NM_003150 | Hs.142258 | 1.00E−114 | 1 | signal transducer and activator of transcripti |
| 196C7 | 355 | 524 | NM_016123 | Hs.142295 | 9.00E−92 | 1 | putative protein kinase NY-REN-64 antigen (LO |
| 585B10 | 3261 | 3465 | AK023129 | Hs.142442 | 1.00E−100 | 1 | cDNA FLJ13067 fis, clone NT2RP3001712, highly |
| 458F2 | 283 | 413 | BE293343 | Hs.142737 | 3.00E−68 | 1 | 601143756F1 cDNA, 5' end/clone = IMAGE: 3051493 |
| 134C6 | 289 | 572 | BE886127 | Hs.142838 | 1.00E−160 | 1 | 601509912F1 cDNA, 5' end/clone = IMAGE: 3911451 |
| 110A11 | 345 | 584 | AI126688 | Hs.143049 | 1.00E−102 | 1 | qb94a06.x1 cDNA, 3' end/clone = IMAGE: 1707730 |
| 472G7 | 127 | 452 | AW976331 | Hs.143254 | 0 | 1 | EST388440 cDNA/gb = AW976331/gi = 8167557/ug = |
| 464G11 | 425 | 547 | AI357640 | Hs.143314 | 1.00E−56 | 1 | qy15b06.x1 cDNA, 3' end/clone = IMAGE: 2012051 |
| 463F11 | 257 | 640 | BF446017 | Hs.143389 | 0 | 1 | 7p18a11.x1 cDNA, 3' end/clone = IMAGE: 3646004 |
| 463H2 | 107 | 443 | AA825245 | Hs.143410 | 1.00E−151 | 1 | oe59g09.s1 cDNA, 3' end/clone = IMAGE: 1415968 |
| 48B7 | 1 | 3366 | NM_005813 | Hs.143460 | 0 | 2 | protein kinase C, nu (PRKCN), mRNA/cds = (555,32 |
| 463C9 | 290 | 405 | AW173163 | Hs.143525 | 5.00E−41 | 1 | xj84b08.x1 cDNA, 3' end/clone = IMAGE: 2663895 |
| 463C8 | 330 | 473 | AI095189 | Hs.143534 | 5.00E−57 | 2 | oy83b06.s1 cDNA, 3' end/clone = IMAGE: 1672403 |
| 464G5 | 94 | 189 | BG033028 | Hs.143554 | 1.00E−38 | 1 | 602300135F1 cDNA, 5' end/clone = IMAGE: 4401776 |
| 463D7 | 120 | 563 | NM_006777 | Hs.143604 | 0 | 1 | Kaiso (ZNF-kaiso), mRNA/cds = (0,2018)/gb = NM |
| 471A10 | 132 | 586 | AK026372 | Hs.143631 | 0 | 1 | cDNA: FLJ22719 fis, clone HSI14307/cds = UNKNOW |
| 74G2 | 5129 | 5285 | AF073310 | Hs.143648 | 2.00E−79 | 2 | insulin receptor substrate-2 (IRS2) mRNA, com |
| 471G11 | 7 | 320 | AI568622 | Hs.143951 | 1.00E−154 | 2 | tn41e10.x1 cDNA, 3' end/clone = IMAGE: 2170218 |
| 478H12 | 963 | 1532 | NM_018270 | Hs.143954 | 0 | 1 | hypothetical protein FLJ10914 (FLJ10914), mR |
| 462G3 | 100 | 529 | AI074020 | Hs.144114 | 0 | 1 | oy66g06.x1 cDNA, 3' end/clone = IMAGE: 1670842 |
| 463C1 | 52 | 151 | AI090305 | Hs.144119 | 1.00E−42 | 1 | oy81b01.s1 cDNA, 3' end/clone = IMAGE: 1672201 |
| 472H8 | 157 | 485 | BF509758 | Hs.144265 | 1.00E−178 | 1 | UI-H-B14-apg-d-04-0-UI.s1 cDNA, 3' end/clon |
| 166E1 | 23 | 443 | D63874 | Hs.144321 | 0 | 1 | HMG-1, complete cds/cds = (76,723)/gb = D63874 |
| 145G8 | 125 | 1606 | NM_018548 | Hs.144477 | 0 | 2 | hypothetical protein PRO2975 (PRO2975), mRNA |
| 191H8 | 46 | 624 | BF036686 | Hs.144559 | 0 | 1 | 601459771F1 cDNA, 5' end/clone = IMAGE: 3863248 |
| 151B1 | 1983 | 2561 | M93651 | Hs.145279 | 0 | 2 | set gene, complete cds/cds = (3,836)/gb = M93651/gi = 33 |
| 514B2 | 115 | 1583 | NM_003011 | Hs.145279 | 0 | 4 | SET translocation (myeloid leukemia-associat |
| 596D4 | 89 | 734 | AA631938 | Hs.145668 | 0 | 8 | fmfc5 cDNA/clone = CR6-21/gb = AA631938/gi = 25 |
| 492B3 | 512 | 2226 | NM_004902 | Hs.145696 | 0 | 2 | splicing factor (CC1.3) (CC1.3), mRNA/cds = (14 |
| 192E4 | 1483 | 1837 | AF246126 | Hs.145956 | 0 | 1 | zinc finger protein mRNA, complete cds/cds = (1 |
| 480B9 | 1094 | 1426 | AL136874 | Hs.146037 | 1.00E−111 | 1 | mRNA; cDNA DKFZp434C135 (from clone DKFZp434C1 |
| 49H1 | 1761 | 2182 | NM_022894 | Hs.146123 | 0 | 1 | hypothetical protein FLJ12972 (FLJ12972), mR |
| 129C6 | 517 | 603 | BE220959 | Hs.146215 | 6.00E−21 | 1 | hu02b06.x1 cDNA, 3' end/clone = IMAGE: 3165395 |
| 583D9 | 249 | 646 | NM_003641 | Hs.146360 | 0 | 1 | interferon induced transmembrane protein 1 ( |
| 589D9 | 125 | 1866 | NM_002139 | Hs.146381 | 0 | 5 | RNA binding motif protein, X chromosome (RBMX) |
| 68H11 | 122 | 1567 | Z23064 | Hs.146381 | 0 | 2 | mRNA gene for hnRNP G protein/cds = (11,1186)/gb = |
| 174A8 | 461 | 1008 | NM_004757 | Hs.146401 | 0 | 1 | small inducible cytokine subfamily E, member 1 |
| 171A6 | 461 | 686 | U10117 | Hs.146401 | 1.00E−100 | 1 | endothelial-monocyte activating polypeptide II mRN |
| 465C4 | 53 | 342 | AI141004 | Hs.146627 | 3.00E−89 | 1 | oy68f02.x1 cDNA, 3' end/clone = IMAGE: 1671003 |
| 190H7 | 1306 | 3107 | AB033079 | Hs.146668 | 0 | 3 | mRNA for KIAA1253 protein, partial cds/cds = (0 |
| 102E9 | 412 | 1022 | AF054187 | Hs.146763 | 0 | 3 | alpha NAC mRNA, complete cds/cds = (309,956)/g |
| 179B1 | 364 | 843 | D16481 | Hs.146812 | 0 | 1 | mitochondrial 3-ketoacyl-CoA thiolas |
| 126H12 | 1 | 358 | NM_000183 | Hs.146812 | 0 | 1 | hydroxyacyl-Coenzyme A dehydrogenase/3-keto |
| 476C9 | 20 | 249 | AI187423 | Hs.147040 | 1.00E−128 | 2 | qf31d04.x1 cDNA, 3' end/clone = IMAGE: 1751623 |
| 70H11 | 47 | 1593 | AF272148 | Hs.147644 | 0 | 7 | KRAB zinc finger protein (RITA) mRNA, complete |
| 51F1 | 635 | 1039 | NM_018555 | Hs.147644 | 0 | 3 | C2H2-like zinc finger protein (ZNF361), mRNA |
| 72H1 | 948 | 5026 | AF000982 | Hs.147916 | 0 | 7 | dead box, X isoform (DBX) mRNA, alternative tra |
| 37F10 | 3128 | 3652 | X63563 | Hs.148027 | 0 | 1 | RNA polymerase II 140 kDa/cds = (43,3567) |
| 64C11 | 163 | 279 | AA908367 | Hs.148288 | 6.00E−29 | 1 | og76c11.s1 cDNA, 3' end/clone = IMAGE: 1454228 |
| 463G2 | 52 | 473 | AI335004 | Hs.148558 | 0 | 1 | tb21e09.x1 cDNA, 3' end/clone = IMAGE: 2055016 |
| 471F8 | 17 | 463 | AI471866 | Hs.149095 | 0 | 1 | ti67d04.x1 cDNA, 3' end/clone = IMAGE: 2137063 |
| 169C12 | 449 | 1711 | L06132 | Hs.149155 | 0 | 2 | voltage-dependent anion channel isoform 1 (VDAC) mRN |
| 189G6 | 1353 | 1711 | NM_003374 | Hs.149155 | 0 | 5 | voltage-dependent anion channel 1 (VDAC1), mR |
| 481E3 | 501 | 669 | NM_007022 | Hs.149443 | 5.00E−84 | 1 | putative tumor suppressor (101F6), mRNA/cds = |
| 472B3 | 93 | 182 | BF029894 | Hs.149595 | 6.00E−44 | 1 | 601557056F1 cDNA, 5' end/clone = IMAGE: 3827172 |
| 173D1 | 3719 | 3877 | AB037901 | Hs.149918 | 3.00E−83 | 1 | GASC-1 mRNA, complete cds/cds = (150,3320)/gb |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 153G12 | 1429 | 1787 | M31627 | Hs.149923 | 0 | 2 | X box binding protein-1 (XBP-1) mRNA, complete cds/cd |
| 116B10 | 1435 | 1787 | NM_005080 | Hs.149923 | 1.00E−180 | 1 | X-box binding protein 1 (XBP1), mRNA/cds = (12,7 |
| 111G4 | 480 | 1891 | L12052 | Hs.150395 | 0 | 2 | cAMP phosphodiesterase PDE7 (PDE7A1) mRNA, co |
| 461D6 | 1407 | 1904 | NM_000790 | Hs.150403 | 0 | 1 | dopa decarboxylase (aromatic L-amino acid dec |
| 73B3 | 896 | 1779 | AL050005 | Hs.150580 | 0 | 23 | cDNA DKFZp564A153 (from clone DKFZp564A1 |
| 465G12 | 1 | 549 | AJ272212 | Hs.150601 | 0 | 1 | mRNA for protein serine kinase (PSKH1 gene)/c |
| 140G12 | 2 | 195 | BF028489 | Hs.150675 | 1.00E−100 | 1 | 601763692F1 cDNA, 5' end/clone = IMAGE: 3995950 |
| 496E10 | 17 | 1686 | BC000167 | Hs.151001 | 0 | 5 | clone IMAGE: 2900671, mRNA, partial cds/cds = |
| 597G7 | 623 | 1488 | NM_005015 | Hs.151134 | 0 | 2 | oxidase (cytochrome c) assembly 1-like (OXA1L |
| 50C9 | 1051 | 1467 | X80695 | Hs.151134 | 0 | 1 | OXA1Hs mRNA/cds = (6,1313)/gb = X80695/ gi = 619490 |
| 125H7 | 3154 | 3957 | NM_001421 | Hs.151139 | 0 | 3 | E74-like factor 4 (ets domain transcription fa |
| 111F2 | 306 | 638 | BG286500 | Hs.151239 | 1.00E−149 | 1 | 602382992F1 cDNA, 5' end/clone = IMAGE: 4500527 |
| 177A4 | 9686 | 10035 | AF075587 | Hs.151411 | 0 | 1 | protein associated with Myc mRNA, complete cds |
| 185C7 | 6934 | 13968 | NM_015057 | Hs.151411 | 0 | 3 | KIAA0916 protein (KIAA0916), mRNA/cds = (146,1 |
| 115E7 | 3406 | 4005 | NM_004124 | Hs.151413 | 0 | 1 | glia maturation factor, beta (GMFB), mRNA/cds |
| 182H7 | 234 | 833 | AF099032 | Hs.151461 | 0 | 1 | embryonic ectoderm development protein short |
| 169C10 | 4247 | 4727 | U38847 | Hs.151518 | 0 | 1 | TAR RNA loop binding protein (TRP-185) mRNA, complete |
| 167D6 | 1013 | 1197 | NM_002870 | Hs.151536 | 6.00E−83 | 1 | RAB13, member RAS oncogene family (RAB13), mRN |
| 588G11 | 1249 | 1898 | AK023362 | Hs.151604 | 1.00E−157 | 9 | cDNA FLJ13300 fis, clone OVARC1001342, highly |
| 479G10 | 1 | 277 | NM_007210 | Hs.151678 | 1.00E−103 | 1 | UDP-N-acetyl-alpha-D-galactosamine: polype |
| 178B7 | 2664 | 3033 | NM_004247 | Hs.151787 | 0 | 4 | U5 snRNP-specific protein, 116 kD (U5-116 KD), |
| 59A6 | 382 | 860 | D42054 | Hs.151791 | 0 | 1 | KIAA0092 gene, complete cds/cds = (53,1477)/ |
| 521B6 | 2017 | 2205 | NM_014679 | Hs.151791 | 2.00E−93 | 1 | KIAA0092 gene product (KIAA0092), mRNA/cds = ( |
| 59C10 | 37 | 697 | AF070525 | Hs.151903 | 0 | 5 | clone 24706 mRNA sequence/cds = UNKNOWN/ gb = AF |
| 519A7 | 165 | 686 | NM_005792 | Hs.152720 | 0 | 1 | M-phase phosphoprotein 6 (MPHOSPH6), mRNA/c |
| 481E11 | 3990 | 4280 | NM_005154 | Hs.152818 | 1.00E−135 | 1 | ubiquitin specific protease 8 (USP8), mRNA/cd |
| 110F2 | 1210 | 1841 | L25931 | Hs.152931 | 0 | 2 | lamin B receptor (LBR) mRNA, complete cds/ cds = (75,192 |
| 516F8 | 1217 | 1708 | NM_002296 | Hs.152931 | 0 | 1 | lamin B receptor (LBR), mRNA/cds = (75,1922)/g |
| 462B2 | 93 | 2385 | AF244129 | Hs.153042 | 0 | 2 | cell-surface molecule Ly-9 mRNA, complete cds |
| 41F4 | 617 | 905 | X14046 | Hs.153053 | 1.00E−162 | 1 | leukocyte antigen CD37/cds = (63,908)/gb = X14 |
| 462G8 | 2312 | 2843 | AF311312 | Hs.153057 | 0 | 1 | infertility-related sperm protein mRNA, comp |
| 142H5 | 17 | 221 | M94856 | Hs.153179 | 1.00E−92 | 1 | fatty acid binding protein homologue (PA-FABP) mRNA, |
| 486G9 | 3 | 431 | NM_001444 | Hs.153179 | 0 | 1 | fatty acid binding protein 5 (psoriasis-associ |
| 40A1 | 2158 | 2716 | X79201 | Hs.153221 | 0 | 1 | SYT/cds = (3,1178)/gb = X79201/gi = 531105 |
| 101D9 | 1524 | 2060 | AB014601 | Hs.153293 | 0 | 1 | for KIAA0701 protein, partial cds/cds = (0 |
| 460H4 | 1457 | 6107 | AB032972 | Hs.153489 | 0 | 2 | mRNA for KIAA1146 protein, partial cds/cds = (0 |
| 106A5 | 445 | 547 | AI761622 | Hs.153523 | 2.00E−37 | 1 | wg66f05.x1 cDNA, 3' end/clone = IMAGE: 2370081 |
| 482A6 | 49 | 369 | AI859076 | Hs.153551 | 1.00E−106 | 1 | wl33b04.x1 cDNA, 3' end/clone = IMAGE: 2426671 |
| 589B2 | 1054 | 1556 | AF261091 | Hs.153612 | 0 | 1 | iron inhibited ABC transporter 2 mRNA, complet |
| 57A3 | 1586 | 1757 | NM_004073 | Hs.153640 | 9.00E−87 | 1 | cytokine-inducible kinase (CNK), mRNA/cds = (3 |
| 466H3 | 2 | 257 | NM_003866 | Hs.153687 | 1.00E−133 | 1 | inositol polyphosphate-4-phosphatase, type |
| 483B6 | 3337 | 3544 | NM_002526 | Hs.153952 | 2.00E−72 | 1 | 5' nucleotidase (CD73) (NT5), mRNA/cds = (49,17 |
| 41F1 | 2749 | 3371 | X55740 | Hs.153952 | 0 | 1 | placental cDNA coding for 5' nucleotidase (EC 3.1.3.5) |
| 44C3 | 1319 | 1574 | X82206 | Hs.153961 | 1.00E−130 | 1 | alpha-centractin/cds = (66,1196)/gb = X8 |
| 64F12 | 2578 | 2713 | NM_022790 | Hs.154057 | 1.00E−26 | 1 | matrix metalloproteinase 19 (MMP19), transcri |
| 72E11 | 1886 | 2717 | U38320 | Hs.154057 | 0 | 15 | clone rasi-3 matrix metalloproteinase RASI-1 |
| 165H12 | 414 | 663 | AW970676 | Hs.154172 | 2.00E−22 | 1 | EST382759 cDNA/gb = AW970676/gi = 8160521/ug = |
| 37A4 | 1151 | 2746 | M31210 | Hs.154210 | 0 | 2 | endothelial differentiation protein (edg-1) gene mR |
| 597G8 | 1125 | 2395 | NM_001400 | Hs.154210 | 0 | 11 | endothelial differentiation, sphingolipid G |
| 106F2 | 24 | 1657 | U22897 | Hs.154230 | 0 | 2 | nuclear domain 10 protein (ndp52) mRNA, comple |
| 466E2 | 116 | 373 | AB023149 | Hs.154296 | 1.00E−131 | 2 | mRNA for KIAA0932 protein, partial cds/cds = (0 |
| 107F11 | 1386 | 1743 | AL117566 | Hs.154320 | 0 | 1 | cDNA DKFZp566J164 (from clone DKFZp566J1 |
| 166E12 | 4490 | 4894 | D86967 | Hs.154332 | 0 | 1 | KIAA0212 gene, complete cds/cds = (58,2031)/ |
| 188D12 | 5148 | 5666 | NM_014674 | Hs.154332 | 0 | 2 | KIAA0212 gene product (KIAA0212), mRNA/cds = ( |
| 66A1 | 88 | 615 | M82882 | Hs.154365 | 0 | 1 | cis-acting sequence/cds = UNKNOWN/gb = M82882/ gi = 180 |
| 37C1 | 4320 | 4776 | AB028999 | Hs.154525 | 0 | 1 | for KIAA1076 protein, partial cds/cds = (0 |
| 98D2 | 2317 | 4907 | NM_000104 | Hs.154654 | 0 | 6 | cytochrome P450, subfamily I (dioxin-inducibl |
| 37C4 | 4445 | 4907 | U03688 | Hs.154654 | 0 | 3 | dioxin-inducible cytochrome P450 (CYP1B1) mRNA, comp |
| 464A5 | 1418 | 2027 | NM_006636 | Hs.154672 | 0 | 3 | methylene tetrahydrofolate dehydrogenase (N |
| 36C5 | 615 | 1689 | X16396 | Hs.154672 | 0 | 7 | NAD-dependent methylene tetrahydrofolate d |
| 67C8 | 1 | 397 | U85773 | Hs.154695 | 0 | 1 | phosphomannomutase (PMM2) mRNA, complete cds/ cds = ( |
| 525D3 | 2084 | 2533 | NM_002651 | Hs.154846 | 0 | 1 | phosphatidylinositol 4-kinase, catalytic, b |
| 109A7 | 1979 | 3148 | D10040 | Hs.154890 | 0 | 2 | for long-chain acyl-CoA synthetase, compl |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 167F6 | 1817 | 3359 | NM_021122 | Hs.154890 | 0 | 8 | fatty-acid-Coenzyme A ligase, long-chain 2 ( |
| 182A1 | 344 | 793 | NM_021825 | Hs.154938 | 0 | 1 | hypothetical protein MDS025 (MDS025), mRNA/ |
| 104E2 | 1254 | 1762 | D87450 | Hs.154978 | 0 | 1 | KIAA0261 gene, partial cds/cds = (0,3865)/gb |
| 519G10 | 4912 | 5303 | NM_003489 | Hs.155017 | 0 | 1 | nuclear receptor interacting protein 1 (NRIP1 |
| 595C6 | 4067 | 4631 | NM_006526 | Hs.155040 | 0 | 2 | zinc finger protein 217 (ZNF217), mRNA/cds = (2 |
| 105D4 | 1768 | 2418 | L42373 | Hs.155079 | 0 | 1 | phosphatase 2A B56-alpha (PP2A) mRNA, complete |
| 174B7 | 1768 | 2320 | NM_006243 | Hs.155079 | 0 | 1 | protein phosphatase 2, regulatory subunit B ( |
| 75G4 | 920 | 1775 | X59066 | Hs.155101 | 0 | 2 | mitochondrial ATP synthase (F1-ATPase) alpha |
| 523G12 | 20 | 848 | NM_004681 | Hs.155103 | 0 | 3 | eukaryotic translation initiation factor 1A, |
| 74D7 | 292 | 1094 | M16942 | Hs.155122 | 0 | 3 | MHC class II HLA-DRw53-associated glycoprotein beta- |
| 137D4 | 2500 | 2822 | AL049761 | Hs.155140 | 1.00E−176 | 1 | DNA sequence from clone RP5-863C7 on chromosome 20p12 |
| 471B5 | 908 | 1168 | AK023379 | Hs.155160 | 1.00E−141 | 1 | cDNA FLJ13317 fis, clone OVARC1001577, highly |
| 176C9 | 2104 | 2635 | NM_003664 | Hs.155172 | 0 | 1 | adaptor-related protein complex 3, beta 1 sub |
| 99F5 | 212 | 671 | NM_005642 | Hs.155188 | 0 | 1 | TATA box binding protein (TBP)-associated fac |
| 166E9 | 1215 | 1637 | U18062 | Hs.155188 | 0 | 1 | TFIID subunit TAFII55 (TAFII55) mRNA, complete cds/c |
| 163A11 | 60 | 3052 | AL162086 | Hs.155191 | 0 | 8 | cDNA DKFZp762H157 (from clone DKFZp762H1 |
| 71E4 | 44 | 558 | NM_003379 | Hs.155191 | 1.00E−175 | 4 | villin 2 (ezrin) (VIL2), mRNA/cds = (117,1877) |
| 145D8 | 2135 | 2669 | L47345 | Hs.155202 | 0 | 1 | elongin A mRNA, complete cds/cds = (32,2350)/g |
| 477H9 | 357 | 2812 | NM_014670 | Hs.155291 | 0 | 2 | KIAA0005 gene product (KIAA0005), mRNA/cds = ( |
| 58D8 | 38 | 336 | NM_000518 | Hs.155376 | 1.00E−100 | 1 | hemoglobin, beta (HBB), mRNA/cds = (50,493)/g |
| 48F11 | 576 | 2131 | NM_006164 | Hs.155396 | 0 | 2 | nuclear factor (erythroid-derived 2)-like 2 |
| 65G11 | 426 | 1179 | S74017 | Hs.155396 | 0 | 1 | Nrf2 = NF-E2-like basic leucine zipper transcriptional act |
| 480G12 | 852 | 1246 | NM_001352 | Hs.155402 | 0 | 1 | D site of albumin promoter (albumin D-box) bind |
| 182B12 | 245 | 592 | NM_006899 | Hs.155410 | 0 | 1 | isocitrate dehydrogenase 3 (NAD+) beta (IDH3B |
| 599C9 | 3188 | 3487 | NM_021643 | Hs.155418 | 1.00E−163 | 1 | GS3955 protein (GS3955), mRNA/cds = (1225,2256 |
| 68H2 | 563 | 1749 | AF037448 | Hs.155489 | 0 | 2 | RRM RNA binding protein Gry-rbp (GRY-RBP) mRNA |
| 173F6 | 1243 | 1811 | AF208043 | Hs.155530 | 0 | 2 | IFI16b (IFI16b) mRNA, complete cds/cds = (264,2 |
| 170B3 | 1061 | 1342 | D50063 | Hs.155543 | 1.00E−139 | 1 | proteasome subunit p40_/Mov34 protein, comp |
| 590E9 | 494 | 1323 | NM_002811 | Hs.155543 | 0 | 2 | proteasome (prosome, macropain) 26S subunit, |
| 522D11 | 1463 | 1710 | AB029003 | Hs.155546 | 1.00E−138 | 2 | mRNA for KIAA1080 protein, partial cds/cds = (0 |
| 587A8 | 3514 | 3923 | NM_001746 | Hs.155560 | 0 | 1 | calnexin (CANX), mRNA/cds = (89,1867)/gb = NM_0 |
| 39A6 | 830 | 1474 | D63878 | Hs.155595 | 0 | 1 | KIAA0158 gene, complete cds/cds = (258,1343) |
| 167F5 | 745 | 2735 | NM_004404 | Hs.155595 | 0 | 3 | neural precursor cell expressed, developmenta |
| 106E10 | 1922 | 2340 | U15173 | Hs.155596 | 1.00E−179 | 2 | BCL2/adenovirus E1B 19 kD-interacting protein |
| 524A8 | 1639 | 2229 | NM_014666 | Hs.155623 | 0 | 1 | KIAA0171 gene product (KIAA0171), mRNA/cds = ( |
| 166D6 | 12177 | 12974 | U47077 | Hs.155637 | 0 | 3 | DNA-dependent protein kinase catalytic subuni |
| 488A10 | 1961 | 2426 | NM_002827 | Hs.155894 | 0 | 3 | protein tyrosine phosphatase, non-receptor t |
| 65D6 | 696 | 1107 | S68271 | Hs.155924 | 0 | 3 | cyclic AMP-responsive element modulator (CRE |
| 113E8 | 682 | 1435 | NM_004054 | Hs.155935 | 0 | 1 | complement component 3a receptor 1 (C3AR1), mR |
| 105F10 | 119 | 1591 | U62027 | Hs.155935 | 0 | 3 | anaphylatoxin C3a receptor (HNFAG09) mRNA, complete |
| 111C1 | 4122 | 4779 | NM_005541 | Hs.155939 | 0 | 5 | inositol polyphosphate-5-phosphatase, 145 kD |
| 40A9 | 1727 | 2300 | D76444 | Hs.155968 | 0 | 1 | hkf-1 mRNA, complete cds/cds = (922,2979)/gb = |
| 124F1 | 1464 | 2121 | NM_005667 | Hs.155968 | 0 | 1 | zinc finger protein homologous to Zfp103 in mo |
| 481E12 | 2237 | 2691 | NM_003588 | Hs.155976 | 0 | 1 | cullin 4B (CUL4B), mRNA/cds = (78,2231)/gb = NM |
| 109H3 | 36 | 440 | NM_020414 | Hs.155986 | 0 | 1 | DEAD/H (Asp-Glu-Ala-Asp/His) box polypeptide |
| 193B10 | 1103 | 1892 | AK024974 | Hs.156110 | 1.00E−180 | 5 | cDNA: FLJ21321 fis, clone COL02335, highly sim |
| 463H6 | 26 | 149 | AI337347 | Hs.156339 | 5.00E−57 | 1 | tb98e10.x1 cDNA, 3' end/clone = IMAGE: 2062410 |
| 107H5 | 34 | 253 | AI146787 | Hs.156601 | 7.00E−93 | 1 | qb83f02.x1 cDNA, 3' end/clone = IMAGE: 1706715 |
| 517E8 | 209 | 822 | NM_015646 | Hs.156764 | 0 | 3 | RAP1B, member of RAS oncogene family (RAP1B), |
| 478H11 | 456 | 768 | NM_005819 | Hs.157144 | 1.00E−172 | 1 | syntaxin 6 (STX6), mRNA/cds = (0,767)/gb = NM_0 |
| 463G12 | 44 | 283 | AI351144 | Hs157213 | 3.00E−95 | 1 | qt23f10.x1 cDNA, 3' end/clone = IMAGE: 1948459 |
| 520A2 | 2359 | 2565 | BC001913 | Hs.157236 | 1.00E−95 | 2 | Similar to membrane protein of cholinergic sy |
| 473A8 | 2944 | 3570 | AK026394 | Hs.157240 | 0 | 1 | cDNA: FLJ22741 fis, clone HUV00774/ cds = UNKNOW |
| 464D5 | 433 | 601 | AW207701 | Hs.157315 | 8.00E−37 | 1 | UI-H-BI2-age-e-03-0-UI.s1 cDNA, 3' end/clon |
| 464B8 | 288 | 633 | BF184881 | Hs.157396 | 2.00E−99 | 1 | 601843756F1 cDNA, 5' end/clone = IMAGE: 4064508 |
| 463A6 | 225 | 554 | AW976630 | Hs.157447 | 1.00E−169 | 1 | EST388739 cDNA/gb = AW976630/gi = 8167861/ug = |
| 464G10 | 423 | 661 | AI356405 | Hs.157556 | 1.00E−103 | 1 | qz26g04.x1 cDNA, 3' end/clone = IMAGE: 2028054 |
| 464H3 | 396 | 642 | AI568755 | Hs.157564 | 1.00E−123 | 1 | th15f03.x1 cDNA, 3' end/clone = IMAGE: 2118365 |
| 466C1 | 110 | 384 | AI760026 | Hs.157569 | 1.00E−135 | 1 | wh83c05.x1 cDNA, 3' end/clone = IMAGE: 2387336 |
| 465A2 | 11 | 178 | AI823541 | Hs.157710 | 1.00E−79 | 1 | wh55c11.x1 cDNA, 3' end/clone = IMAGE: 2384660 |
| 464A8 | 2000 | 2248 | AK023779 | Hs.157777 | 1.00E−134 | 1 | cDNA FLJ13717 fis, clone PLACE2000425/cds = UNK |
| 464G1 | 122 | 447 | AI361761 | Hs.157813 | 1.00E−163 | 2 | qz19a07.x1 cDNA, 3' end/clone = IMAGE: 2021940 |
| 464G7 | 293 | 395 | AI361849 | Hs.157815 | 4.00E−30 | 1 | qz19h11.x1 cDNA, 3' end/clone = IMAGE: 2022021 |
| 145B8 | 238 | 598 | BF303931 | Hs.157850 | 1.00E−179 | 3 | 601886564F2 cDNA, 5' end/clone = IMAGE: 4120574 |
| 115D1 | 111 | 712 | NM_000661 | Hs.157850 | 1.00E−159 | 2 | ribosomal protein L9 (RPL9), mRNA/cds = (29,607 |
| 102F8 | 4161 | 4818 | AB023198 | Hs.158135 | 0 | 1 | for KIAA0981 protein, partial cds/cds = (0 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 597H12 | 1253 | 2625 | NM_000593 | Hs.158164 | 0 | 5 | ATP-binding cassette, sub-family B (MDR/TAP), |
| 465A3 | 172 | 342 | T78173 | Hs.158193 | 5.00E−64 | 1 | yd79c05.r1 cDNA, 5' end/clone = IMAGE: 114440/ |
| 465H8 | 740 | 1171 | NM_006354 | Hs.158196 | 1.00E−149 | 1 | transcriptional adaptor 3 (ADA3, yeast homolo |
| 59H12 | 1646 | 6883 | NM_002313 | Hs.158203 | 0 | 4 | actin-binding LIM protein (ABLIM), transcript |
| 464A2 | 32 | 549 | NM_004571 | Hs.158225 | 0 | 1 | PBX/knotted 1 hoemobox 1 (PKNOX1), mRNA/cds = ( |
| 124F12 | 6603 | 6907 | AB007915 | Hs.158286 | 1.00E−172 | 1 | mRNA for KIAA0446 protein, partial cds/cds = (3 |
| 519F5 | 80 | 268 | AI199223 | Hs.158289 | 1.00E−86 | 1 | qi47c06.x1 cDNA, 3' end/clone = IMAGE: 1859626 |
| 463F8 | 33 | 286 | BF433857 | Hs.158501 | 1.00E−123 | 1 | 7q71b07.x1 cDNA/clone = IMAGE/gb = BF433857/g |
| 137A8 | 204 | 452 | AI370965 | Hs.158653 | 5.00E−32 | 1 | ta29b11.x1 cDNA, 3' end/clone = IMAGE: 2045469 |
| 466A11 | 1 | 565 | BE676408 | Hs.158714 | 0 | 1 | 7f29b11.x1 cDNA, 3' end/clone = IMAGE: 3296061 |
| 73C2 | 5 | 396 | AW362008 | Hs.158794 | 0 | 1 | PM2-CT0265-211099-002-d04/gb = AW362008 |
| 465C6 | 242 | 433 | AI378113 | Hs.158877 | 2.00E−95 | 1 | tc80c12.x1 cDNA, 3' end/clone = IMAGE: 2072470 |
| 465C2 | 29 | 153 | AI378457 | Hs.158894 | 4.00E−60 | 2 | tc79d10.x1 cDNA, 3' end/clone = IMAGE: 2072371 |
| 465C10 | 47 | 442 | AI379953 | Hs.158943 | 0 | 1 | tc81a07.x1 cDNA, 3' end/clone = IMAGE: 2072532 |
| 477B9 | 151 | 396 | AI380220 | Hs.158965 | 1.00E−109 | 2 | tf94a04.x1 cDNA, 3' end/clone = IMAGE: 2106894 |
| 477B10 | 1 | 414 | AI380236 | Hs.158966 | 0 | 2 | tf94b10.x1 cDNA, 3' end/clone = IMAGE: 2106907 |
| 466F8 | 128 | 233 | AI380388 | Hs.158975 | 4.00E−30 | 1 | tf96a03.x1 cDNA, 3' end/clone = IMAGE: 2107084 |
| 467E12 | 109 | 350 | AI799909 | Hs.158989 | 1.00E−82 | 1 | wc46c08.x1 cDNA, 3' end/clone = IMAGE: 2321678 |
| 469G6 | 169 | 470 | AI631850 | Hs.158992 | 1.00E−119 | 1 | wa36h07.x1 cDNA, 3' end/clone = IMAGE: 2300221 |
| 467H4 | 17 | 292 | BF508694 | Hs.158999 | 1.00E−117 | 1 | UI-H-BI4-aop-f-09-0-UI.s1 cDNA, 3' end/clon |
| 469B2 | 179 | 388 | AI568751 | Hs.159014 | 4.00E−94 | 1 | th15d09.x1 cDNA, 3' end/clone = IMAGE: 2118353 |
| 464E8 | 742 | 945 | AL538276 | Hs.159065 | 1.00E−110 | 1 | AL538276 cDNA/clone = CS0DF027YC09-(5-prime) |
| 469D9 | 1 | 413 | AI431873 | Hs.159103 | 0 | 1 | ti26b11.x1 cDNA, 3' end/clone = IMAGE: 2131581 |
| 122C7 | 1916 | 2375 | NM_003266 | Hs.159239 | 0 | 1 | toll-like receptor 4 (TLR4), mRNA/cds = (284,26 |
| 462H4 | 79 | 239 | BF307871 | Hs.159336 | 7.00E−66 | 1 | 601890687F1 cDNA, 5' end/clone = IMAGE: 4132028 |
| 179C1 | 428 | 734 | AJ225093 | Hs.159386 | 3.00E−88 | 1 | single-chain antibody, complete cds |
| 473D11 | 267 | 339 | AI380255 | Hs.159424 | 5.00E−34 | 1 | tf94d08.x1 cDNA, 3' end/clone = IMAGE: 2106927 |
| 107B2 | 1 | 617 | BE783628 | Hs.159441 | 1.00E−160 | 2 | 601471696F1 cDNA, 5' end/clone = IMAGE: 3874823 |
| 590E12 | 52 | 654 | BG290141 | Hs.159441 | 0 | 6 | 602385221F1 cDNA, 5' end/clone = IMAGE: 4514380 |
| 70E1 | 2095 | 2333 | AK027194 | Hs.159483 | 1.00E−119 | 1 | FLJ23541 fis, clone LNG08276, highly sim |
| 58A5 | 10448 | 12675 | AF193556 | Hs.159492 | 0 | 10 | sacsin (SACS) gene, complete cds/cds = (76,1156 |
| 482E11 | 2064 | 2559 | NM_000061 | Hs.159494 | 0 | 1 | Bruton agammaglobulinemia tyrosine kinase (B |
| 147A11 | 755 | 2415 | AF001622 | Hs.159523 | 0 | 7 | class-I MHC-restricted T cell associated mole |
| 486H6 | 1164 | 1382 | NM_019604 | Hs.159523 | 1.00E−117 | 2 | class-I MHC-restricted T cell associated mole |
| 465A5 | 2693 | 3039 | NM_000033 | Hs.159546 | 1.00E−148 | 1 | ATP-binding cassette, sub-family D (ALD), mem |
| 60C4 | 1102 | 1962 | AK024833 | Hs.159557 | 1.00E−147 | 4 | FLJ21180 fis, clone CAS11176, highly sim |
| 465B11 | 457 | 1126 | NM_016952 | Hs.159565 | 0 | 1 | surface glycoprotein, Ig superfamily member ( |
| 477A12 | 89 | 581 | AI797788 | Hs.159577 | 0 | 5 | wh78b11.x1 cDNA, 3' end/clone = IMAGE: 2386845 |
| 595H8 | 19 | 912 | NM_004632 | Hs.159627 | 0 | 2 | death associated protein 3 (DAP3), mRNA/cds = ( |
| 74D2 | 7 | 2119 | AF153609 | Hs.159640 | 0 | 9 | serine/threonine protein kinase sgk mRNA, com |
| 71B2 | 8 | 533 | NM_005627 | Hs.159640 | 0 | 1 | serum/glucocorticoid regulated kinase (SGK) |
| 467G8 | 310 | 488 | AW006352 | Hs.159643 | 2.00E−92 | 1 | wt04d12.x1 cDNA, 3' end/clone = IMAGE: 2506487 |
| 467B8 | 11 | 363 | AI392893 | Hs.159655 | 1.00E−173 | 1 | tg05d07.x1 cDNA, 3' end/clone = IMAGE: 2107885 |
| 471F11 | 16 | 303 | AI827950 | Hs.159659 | 1.00E−162 | 1 | wk31a11.x1 cDNA, 3' end/clone = IMAGE: 2413916 |
| 467C11 | 18 | 501 | BF508053 | Hs.159678 | 0 | 1 | UI-H-B14-apx-b-11-0-UI.s1 cDNA, 3' end/clon |
| 477F4 | 3 | 405 | AI394671 | Hs.159678 | 0 | 2 | tg24a07.x1 cDNA, 3' end/clone = IMAGE: 2109684 |
| 472F5 | 194 | 366 | NM_018490 | Hs.160271 | 1.00E−93 | 1 | G protein-coupled receptor 48 (GPR48), mRNA/ |
| 468B11 | 72 | 481 | AI393041 | Hs.160273 | 0 | 1 | tg25b10.x1 cDNA, 3' end/clone = IMAGE: 2109787 |
| 477D3 | 5 | 484 | AI393906 | Hs.160401 | 0 | 2 | tg05f08.x1 cDNA, 3' end/clone = IMAGE: 2107911 |
| 477D12 | 11 | 389 | AI393962 | Hs.160405 | 1.00E−178 | 1 | tg11d08.x1 cDNA, 3' end/clone = IMAGE: 2108463 |
| 477D5 | 15 | 262 | AI393992 | Hs.160408 | 1.00E−138 | 1 | tg06c05.x1 cDNA, 3' end/clone = IMAGE: 2107976 |
| 65A9 | 4106 | 5547 | AF137030 | Hs.160417 | 0 | 5 | transmembrane protein 2 (TMEM2) mRNA, complete |
| 513A2 | 4109 | 5547 | NM_013390 | Hs.160417 | 0 | 5 | transmembrane protein 2 (TMEM2), mRNA/cds = (14 |
| 463F12 | 688 | 1425 | AF188032 | Hs.160422 | 0 | 1 | clone PP902 unknown mRNA/cds = (693,1706)/gb = |
| 165C1 | 2625 | 2987 | X85116 | Hs.160483 | 0 | 1 | H. sapiens epb72 gene exon 1/cds = (61,927)/ gb = X85116/gi = 1 |
| 469G4 | 145 | 550 | AI634652 | Hs.160795 | 0 | 1 | wa07e10.x1 CDNA, 3' end/clone = IMAGE: 2297418 |
| 472C7 | 343 | 565 | AI760020 | Hs.160951 | 1.00E−105 | 1 | wh83b05.x1 cDNA, 3' end/clone = IMAGE: 2387313 |
| 466F12 | 485 | 662 | BF207290 | Hs.160954 | 2.00E−62 | 1 | 601870777F1 cDNA, 5' end/clone = IMAGE: 4100850 |
| 477C10 | 5 | 290 | BF437585 | Hs.160980 | 1.00E−149 | 1 | 7p74d12.x1 cDNA, 3' end/clone = IMAGE: 3651526 |
| 61E8 | 4435 | 6593 | U83115 | Hs.161002 | 0 | 3 | non-lens beta gamma-crystallin like protein (AIM1) m |
| 458E5 | 1 | 462 | R84314 | Hs.161043 | 1.00E−159 | 1 | yq23a01.r1 cDNA, 5' end/clone = IMAGE: 274443/ |
| 466E12 | 117 | 447 | BF001821 | Hs.161075 | 0 | 1 | 7g93g02.x1 cDNA, 3' end/clone = IMAGE: 3314066 |
| 102H4 | 7 | 219 | AW963155 | Hs.161786 | 1.00E−111 | 1 | EST375228/gb = AW963155/gi = 8152991/ug = |
| 118B6 | 2050 | 2260 | NM_022570 | Hs.161786 | 2.00E−75 | 1 | C-type (calcium dependent, carbohydrate-reco |
| 593C4 | 3863 | 4092 | U86453 | Hs.162808 | 9.00E−92 | 1 | phosphatidylinositol 3-kinase catalytic subunit p1 |
| 467B7 | 129 | 455 | AI023714 | Hs.163442 | 1.00E−164 | 1 | ow91h05.x1 cDNA, 3' end/clone = IMAGE: 1654233 |
| 107G8 | 592 | 1016 | AK023670 | Hs.163495 | 0 | 1 | FLJ13608 fis, clone PLACE1010628/cds = UNK |
| 74F3 | 229 | 449 | AA627122 | Hs.163787 | 4.00E−77 | 1 | nq70g02.s1 cDNA, 3' end/clone = IMAGE: 1157714 |
| 68B3 | 1094 | 1771 | AK023494 | Hs.164005 | 0 | 5 | FLJ13432 fis, clone PLACE1002537/cds = UNK |
| 469H10 | 420 | 850 | NM_002993 | Hs.164021 | 0 | 1 | small inducible cytokine subfamily B (Cys-X-C |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 464E9 | 86 | 424 | AA811244 | Hs.164168 | 1.00E−166 | 1 | ob58h11.s1 cDNA, 3' end/clone = IMAGE: 1335621 |
| 467E11 | 788 | 1330 | NM_007063 | Hs.164170 | 0 | 1 | vascular Rab-GAP/TBC-containing (VRP), mRNA |
| 597C5 | 59 | 1251 | AY007135 | Hs.164280 | 1.00E−126 | 3 | clone CDABP0051 mRNA sequence/cds = (89,985)/ |
| 464H11 | 2 | 202 | BF689700 | Hs.164675 | 9.00E−65 | 1 | 602186609F1 cDNA, 5' end/clone = IMAGE: 4298402 |
| 459D5 | 6 | 496 | AI248204 | Hs.165051 | 0 | 1 | qh64h11.x1 cDNA, 3' end/clone = IMAGE: 1849509 |
| 120F12 | 23 | 502 | NM_001017 | Hs.165590 | 1.00E−159 | 5 | ribosomal protein S13 (RPS13), mRNA/cds = (32,4 |
| 469C11 | 301 | 613 | AW364833 | Hs.165681 | 1.00E−136 | 1 | QV3-DT0043-211299-044-d03 cDNA/gb = AW364833 |
| 465D3 | 289 | 481 | AI766638 | Hs.165693 | 2.00E−62 | 1 | wi02a10.x1 cDNA, 3' end/clone = IMAGE: 2389050 |
| 465D6 | 107 | 238 | AW850041 | Hs.165695 | 3.00E−61 | 1 | IL3-CT0216-170300-097-C07 cDNA/gb = AW850041 |
| 466C7 | 166 | 421 | AI538546 | Hs.165696 | 1.00E−122 | 1 | td08b07.x1 cDNA, 3' end/clone = IMAGE: 2075029 |
| 469C4 | 351 | 691 | AI436561 | Hs.165703 | 1.00E−148 | 1 | ti03b03.x1 cDNA, 3' end/clone = IMAGE: 2129357 |
| 62A12 | 32 | 256 | AV727063 | Hs.165980 | 1.00E−120 | 4 | AV727063 cDNA, 5' end/clone = HTCCED11/clone_ |
| 107C2 | 2427 | 2613 | AJ250865 | Hs.165986 | 1.00E−82 | 1 | for TESS 2 protein (TESS/cds = (128,1393)/ |
| 461D5 | 1762 | 1935 | NM_004031 | Hs.166120 | 8.00E−81 | 1 | interferon regulatory factor 7 (IRF7), transc |
| 147D11 | 38 | 1283 | AL022097 | Hs.166203 | 0 | 5 | DNA sequence from PAC 256G22 on chromosome 6p24 |
| 595H12 | 1321 | 1597 | NM_002636 | Hs.166204 | 1.00E−135 | 2 | PHD finger protein 1 (PHF1), mRNA/cds = (56,1429 |
| 58H7 | 41 | 2036 | AL136711 | Hs.166254 | 0 | 2 | mRNA; cDNA DKFZp566I133 (from clone DKFZp566I1 |
| 98D12 | 5559 | 6110 | NM_014646 | Hs.166318 | 0 | 1 | lipin 2 (LPIN2), mRNA/cds = (239,2929)/gb = NM_0 |
| 468G1 | 146 | 509 | AW873324 | Hs.166338 | 1.00E−168 | 2 | hl92a07.x1 cDNA, 3' end/clone = IMAGE: 3009396 |
| 477D7 | 2900 | 3748 | L14922 | Hs.166563 | 0 | 1 | DNA-binding protein (PO-GA) mRNA, complete cd |
| 177E7 | 3265 | 3595 | L23320 | Hs.166563 | 0 | 1 | replication factor C large subunit mRNA, complete cds |
| 584H2 | 206 | 1613 | NM_006925 | Hs.166975 | 1.00E−112 | 5 | splicing factor, arginine/serine-rich 5 (SFR |
| 481F5 | 647 | 917 | NM_002643 | Hs.166982 | 1.00E−128 | 1 | phosphatidylinositol glycan, class F (PIGF), |
| 598E4 | 112 | 538 | NM_002788 | Hs.167106 | 1.00E−174 | 1 | proteasome (prosome, macropain) subunit, alp |
| 466D8 | 46 | 470 | AI805131 | Hs.167206 | 0 | 1 | td11f04.x1 cDNA, 3' end/clone = IMAGE:2075359 |
| 464C8 | 342 | 469 | BE674762 | Hs.167208 | 4.00E−50 | 1 | 7e98d05.x1 cDNA, 3' end/clone = IMAGE: 3293193 |
| 468A6 | 1177 | 1417 | NM_003658 | Hs.167218 | 4.00E−85 | 1 | BarH-like homeobox 2 (BARX2), mRNA/cds = (96,93 |
| 74H10 | 1 | 1271 | AF107405 | Hs.167460 | 0 | 12 | pre-mRNA splicing factor (SFRS3) mRNA, comple |
| 60E9 | 3154 | 3926 | U43185 | Hs.167503 | 1.00E−143 | 2 | signal transducer and activator of transcription Sta |
| 517G3 | 1129 | 2787 | NM_006994 | Hs.167741 | 0 | 3 | butyrophilin, subfamily 3, member A3 (BTN3A3), |
| 175H2 | 2261 | 2467 | U90548 | Hs.167741 | 2.00E−86 | 1 | butyrophilin (BTF3) mRNA, complete cds/cds = (171,192 |
| 588H5 | 1324 | 1735 | NM_002901 | Hs.167791 | 0 | 1 | reticulocalbin 1, EF-hand calcium binding dom |
| 331D7 | 53 | 625 | AF116909 | Hs.167827 | 4.00E−22 | 1 | clone HH419 unknown mRNA/cds = (189,593)/gb = A |
| 39C11 | 938 | 1672 | AF026402 | Hs.168103 | 0 | 1 | U5 snRNP 100 kD protein mRNA, cds/cds = (39,2501 |
| 583C8 | 906 | 1669 | NM_004818 | Hs.168103 | 0 | 5 | prp28, U5 snRNP 100 kd protein (U5-100K), mRNA |
| 43B1 | 1156 | 1224 | AF031167 | Hs.168132 | 1.00E−22 | 1 | interleukin 15 precursor (IL-15) mRNA, complet |
| 479A7 | 424 | 801 | NM_000585 | Hs.168132 | 1.00E−149 | 1 | interleukin 15 (IL15), mRNA/cds = (316,804)/g |
| 67D6 | 1783 | 2336 | AK024030 | Hs.168232 | 0 | 1 | FLJ13968 fis, clone Y79AA1001493, weakly |
| 122H3 | 1646 | 2894 | NM_023079 | Hs.168232 | 0 | 2 | hypothetical protein FLJ13855 (FLJ13855), mR |
| 459H3 | 9 | 504 | AI392830 | Hs.168287 | 0 | 1 | tg10b09.x1 cDNA, 3' end/clone = IMAGE: 2108345 |
| 463G5 | 103 | 851 | NM_003002 | Hs.168289 | 0 | 1 | succinate dehydrogenase complex, subunit D, |
| 144G9 | 5588 | 5937 | AL049935 | Hs.168350 | 0 | 2 | DKFZp564O1116 (from clone DKFZp564O |
| 459A9 | 2293 | 2727 | NM_000201 | Hs.168383 | 0 | 2 | intercellular adhesion molecule 1 (CD54), hum |
| 123G3 | 2194 | 2675 | AB046801 | Hs.168640 | 0 | 2 | mRNA for KIAA1581 protein, partial cds/cds = (0 |
| 112H10 | 505 | 864 | AF007155 | Hs.168694 | 1.00E−175 | 2 | clone 23763 unknown mRNA, partial cds/cds = (0, |
| 60H7 | 223 | 897 | AF083420 | Hs.168913 | 0 | 1 | brain-specific STE20-like protein kinase 3 ( |
| 105C12 | 1698 | 2052 | AK026671 | Hs.169078 | 1.00E−176 | 1 | FLJ23018 fis, clone LNG00903/cds = (27,14 |
| 181B9 | 1148 | 1610 | NM_003937 | Hs.169139 | 0 | 1 | kynureninase (L-kynurenine hydrolase) (KYNU) |
| 462B7 | 13 | 478 | AA977148 | Hs.169168 | 0 | 1 | oq24g08.s1 cDNA, 3' end/clone = IMAGE: 1587326 |
| 41H5 | 197 | 624 | U58913 | Hs.169191 | 0 | 1 | chemokine (hmrp-2a) mRNA, complete cds/cds = (71,484) |
| 69G6 | 11 | 552 | BF214508 | Hs.169248 | 1.00E−160 | 4 | 601845758F1 cDNA, 5' end/clone = IMAGE: 4076510 |
| 460B2 | 904 | 2904 | NM_003202 | Hs.169294 | 1.00E−161 | 2 | transcription factor 7 (T-cell specific, HMG- |
| 464G12 | 543 | 994 | D26121 | Hs.169303 | 0 | 1 | mRNA for ZFM1 protein alternatively spliced product, |
| 464B5 | 163 | 762 | NM_013259 | Hs.169330 | 0 | 1 | neuronal protein (NP25), mRNA/cds = (49,897)/ |
| 593G4 | 787 | 1353 | Z97989 | Hs.169370 | 0 | 2 | DNA sequence from PAC 66H14 on chromosome 6q21–22. Con |
| 165F12 | 1177 | 1751 | AK001725 | Hs.169407 | 0 | 1 | cDNA FLJ10863 fis, clone NT2RP4001575, highly |
| 483B12 | 10871 | 11349 | NM_004010 | Hs.169470 | 0 | 1 | dystrophin (muscular dystrophy, Duchenne and |
| 518B3 | 22 | 1257 | NM_002046 | Hs.169476 | 0 | 5 | glyceraldehyde-3-phosphate dehydrogenase ( |
| 67E7 | 1289 | 1597 | U34995 | Hs.169476 | 3.00E−88 | 1 | normal keratinocyte substraction library mRNA, clon |
| 47E9 | 2148 | 2452 | NM_005461 | Hs.169487 | 1.00E−172 | 1 | Kreisler (mouse) maf-related leucine zipper h |
| 69C3 | 846 | 3195 | U41387 | Hs.169531 | 0 | 24 | Gu protein mRNA, partial cds/cds = (0,2405)/gb = U41387 |
| 468G7 | 73 | 450 | AI523598 | Hs.169541 | 1.00E−178 | 1 | th08g11.x1 cDNA, 3' end/clone = IMAGE: 2117732 |
| 72E12 | 490 | 3074 | AJ251595 | Hs.169610 | 0 | 29 | for transmembrane glycoprotein (CD44 gen |
| 471F2 | 97 | 533 | AW172306 | Hs.169738 | 0 | 1 | xj37a08.x1 cDNA, 3' end/clone = IMAGE: 2659382 |
| 589D4 | 96 | 488 | NM_000994 | Hs.169793 | 1.00E−163 | 2 | ribosomal protein L32 (RPL32), mRNA/cds = (34,4 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 105B6 | 1590 | 2215 | AK027212 | Hs.169854 | 0 | 1 | FLJ23559 fis, clone LNG09844/cds = UNKNOW |
| 462A8 | 1043 | 1529 | NM_000305 | Hs.169857 | 0 | 1 | paraoxonase 2 (PON2), mRNA/cds = (32,1096)/gb |
| 175D11 | 390 | 929 | AF061736 | Hs.169895 | 1.00E−132 | 2 | ubiquitin-conjugating enzyme RIG-B mRNA, com |
| 149A2 | 2442 | 2942 | U75686 | Hs.169900 | 0 | 1 | polyadenylate binding protein mRNA, complete |
| 524B9 | 2484 | 2709 | NM_007049 | Hs.169963 | 1.00E−125 | 2 | butyrophilin, subfamily 2, member A1 (BTN2A1), |
| 169G8 | 1192 | 1684 | U90543 | Hs.169963 | 0 | 1 | butyrophilin (BTF1) mRNA, complete cds/ cds = (210,179 |
| 129E9 | 686 | 1227 | X70340 | Hs.170009 | 0 | 1 | transforming growth factor alpha/cds = (3 |
| 589C1 | 1893 | 3451 | NM_004350 | Hs.170019 | 0 | 5 | runt-related transcription factor 3 (RUNX3), |
| 331E1 | 5084 | 5496 | NM_001621 | Hs.170087 | 0 | 1 | aryl hydrocarbon receptor (AHR) mRNA/cds = (643 |
| 595H7 | 659 | 4185 | NM_002838 | Hs.170121 | 0 | 34 | protein tyrosine phosphatase, receptor type, |
| 184G8 | 1083 | 3762 | Y00062 | Hs.170121 | 0 | 10 | T200 leukocyte common antigen (CD45, LC-A)/c |
| 109D4 | 4529 | 4876 | AF032885 | Hs.170133 | 0 | 1 | forkhead protein (FKHR) mRNA, complete cds/cd |
| 98A12 | 4529 | 4882 | NM_002015 | Hs.170133 | 1.00E−160 | 1 | forkhead box O1A (rhabdomyosarcoma) (FOXO1A), |
| 99E3 | 2098 | 2334 | NM_004761 | Hs.170160 | 1.00E−125 | 1 | RAB2, member RAS oncogene family-like (RAB2L), |
| 498F10 | 3472 | 4909 | AL161952 | Hs.170171 | 0 | 28 | mRNA; cDNA DKFZp434M0813 (from clone DKFZp434M |
| 465G7 | 390 | 462 | AI475666 | Hs.170288 | 2.00E−31 | 1 | tc93c08.x1 cDNA, 3' end/clone = IMAGE: 2073710 |
| 467E6 | 68 | 482 | AK025743 | Hs.170296 | 0 | 1 | cDNA: FLJ22090 fis, clone HEP16084/cds = UNKNOW |
| 459H9 | 4659 | 5168 | NM_014636 | Hs.170307 | 0 | 1 | Ral guanine nucleotide exchange factor RalGPS |
| 38D9 | 618 | 992 | 089678 | Hs.170311 | 0 | 25 | for A + U-rich element RNA binding factor, |
| 589F11 | 1033 | 2022 | NM_005463 | Hs.170311 | 0 | 13 | heterogeneous nuclear ribonucleoprotein D-l |
| 469B9 | 127 | 573 | AI436418 | Hs.170326 | 0 | 1 | ti01h02.x1 cDNA, 3' end/clone = IMAGE: 2129235 |
| 183E4 | 2725 | 3777 | NM_002444 | Hs.170328 | 0 | 7 | moesin (MSN), mRNA/cds = (100,1833)/gb = NM_002 |
| 170G2 | 1693 | 3305 | Z98946 | Hs.170328 | 0 | 4 | DNA sequence from clone 376D21 on chromosome Xq11.1−12 |
| 464F6 | 162 | 534 | AI492865 | Hs.170331 | 1.00E−163 | 1 | th78a05.x1 cDNA, 3' end/clone = IMAGE: 2124752 |
| 472F8 | 412 | 554 | AI373163 | Hs.170333 | 1.00E−75 | 1 | qz13a07.x1 cDNA, 3' end/clone = IMAGE: 2021364 |
| 473C3 | 376 | 610 | AW291507 | Hs.170381 | 1.00E−123 | 1 | UI-H-BI2-aga-g-11-0-UI.s1 cDNA, 3' end/clon |
| 465E5 | 421 | 547 | BE676049 | Hs.170584 | 3.00E−54 | 1 | 7f21a03.x1 cDNA, 3' end/clone = IMAGE: 3295276 |
| 477A3 | 25 | 202 | AI475884 | Hs.170587 | 4.00E−92 | 2 | tc95c12.x1 cDNA, 3' end/clone = IMAGE: 2073910 |
| 477A4 | 34 | 489 | AI475905 | Hs.170588 | 0 | 1 | tc95f06.x1 cDNA, 3' end/clone = IMAGE: 2073923 |
| 469F2 | 238 | 490 | AI478556 | Hs.170777 | 2.00E−84 | 1 | tm53e03.x1 cDNA, 3' end/clone = IMAGE: 2161852 |
| 472C5 | 357 | 474 | AI479022 | Hs.170784 | 1.00E−53 | 1 | tm30a05.x1 cDNA, 3' end/clone = IMAGE: 2158064 |
| 477D6 | 23 | 407 | AI492034 | Hs.170909 | 0 | 2 | tg06f12.x1 cDNA, 3' end/clone = lMAGE: 2108015 |
| 471D4 | 187 | 416 | AI492181 | Hs.170913 | 1.00E−106 | 1 | tg07e06.x1 cDNA, 3' end/clone = IMAGE: 2108098 |
| 464F8 | 14 | 142 | AI492651 | Hs.170934 | 7.00E−53 | 1 | qz18b10.x1 cDNA, 3' end/clone = IMAGE: 2021851 |
| 466D3 | 173 | 461 | AI540204 | Hs.170935 | 1.00E−131 | 1 | td10h12.x1 cDNA, 3' end/clone = IMAGE: 2075303 |
| 478F10 | 314 | 461 | AI761144 | Hs.171004 | 4.00E−45 | 1 | wh97h01.x1 cDNA, 3' end/clone = IMAGE: 2388721 |
| 476E2 | 187 | 253 | AI494612 | Hs.171009 | 2.00E−30 | 2 | qz17a03.x1 cDNA, 3' end/clone = IMAGE: 2021740 |
| 107G12 | 2413 | 2929 | AK024436 | Hs.171118 | 0 | 1 | for FLJ00026 protein, partial cds/cds = (0 |
| 478H3 | 1237 | 1509 | AL161725 | Hs.171118 | 1.00E−107 | 1 | DNA sequence from clone RP11-165F24 on chromosome 9. |
| 477H10 | 252 | 489 | BE674709 | Hs.171120 | 3.00E−87 | 1 | 7e94f05.x1 cDNA, 3' end/clone = IMAGE: 3292833 |
| 477H11 | 18 | 521 | AI524202 | Hs.171122 | 0 | 1 | th10d11.x1 cDNA, 3' end/clone = IMAGE: 2117877 |
| 466C10 | 24 | 216 | BE816212 | Hs.171261 | 8.00E−81 | 1 | MR1-BN0212-280600-001-c06 cDNA/gb = BE816212 |
| 470A4 | 22 | 562 | AI628893 | Hs.171262 | 0 | 1 | ty95h02.x1 cDNA, 3' end/clone = IMAGE: 2286867 |
| 477C4 | 216 | 464 | AI540161 | Hs.171264 | 1.00E−112 | 2 | td10c10.x1 cDNA, 3' end/clone = IMAGE: 2075250 |
| 519E12 | 1 | 321 | NM_016468 | Hs.171566 | 1.00E−167 | 2 | hypothetical protein (LOC51241), mRNA/cds = ( |
| 44C11 | 5363 | 5829 | AF012872 | Hs.171625 | 0 | 1 | phosphatidylinositol 4-kinase 230 (pi4K230) |
| 517D4 | 19 | 559 | NM_003197 | Hs.171626 | 0 | 3 | transcription elongation factor B (SIII), pol |
| 48E9 | 1563 | 1809 | NM_004417 | Hs.171695 | 1.00E−138 | 2 | dual specificity phosphatase 1 (DUSP1), mRNA |
| 520H5 | 941 | 3667 | NM_002719 | Hs.171734 | 0 | 2 | protein phosphatase 2, regulatory subunit B ( |
| 106G2 | 1 | 308 | BF243010 | Hs.171774 | 1.00E−167 | 2 | 601877795F1 cDNA, 5' end/clone = IMAGE: 4106303 |
| 524A7 | 14 | 359 | NM_015933 | Hs.171774 | 0 | 14 | hypothetical protein (HSPC016), mRNA/cds = (3 |
| 117A11 | 311 | 614 | BF966361 | Hs.171802 | 1.00E−143 | 2 | 602286929F1 cDNA, 5' end/clone = IMAGE: 4375783 |
| 38H11 | 885 | 2087 | M55543 | Hs.171862 | 0 | 6 | guanylate binding protein isoform II (GBP-2) mRNA, co |
| 512F8 | 232 | 1971 | NM_004120 | Hs.171862 | 0 | 12 | guanylate binding protein 2, interferon-induc |
| 111B9 | 3748 | 4161 | NM_004941 | Hs.171872 | 0 | 1 | DEAD/H (Asp-Glu-Ala-Asp/His) box polypeptide |
| 192H11 | 5738 | 5903 | NM_000937 | Hs.171880 | 2.00E−68 | 1 | polymerase (RNA) II (DNA directed) polypeptide |
| 176F11 | 1322 | 4789 | AL109935 | Hs.171917 | 0 | 3 | DNA sequence from clone RP5-1022P6 on chromosome 20 C |
| 596G12 | 2472 | 3152 | NM_001110 | Hs.172028 | 0 | 5 | a disintegrin and metalloproteinase domain 10 |
| 170A5 | 2438 | 2767 | AK023154 | Hs.172035 | 0 | 1 | FLJ13092 fis, clone NT2RP3002147/cds = (34 |
| 469D11 | 71 | 535 | AI474074 | Hs.172070 | 0 | 1 | ti68h11.x1 cDNA, 3' end/clone = IMAGE: 2137221 |
| 100G4 | 5574 | 5662 | U02882 | Hs.172081 | 3.00E−24 | 1 | rolipram-sensitive 3',5'-cyclic AMP phosphodiester |
| 524A11 | 1 | 2517 | AL110202 | Hs.172089 | 0 | 20 | mRNA; cDNA DKFZp586I2022 (from clone DKFZp586 |
| 49A2 | 929 | 2845 | NM_002568 | Hs.172182 | 0 | 30 | poly(A)-binding protein, cytoplasmic 1 (PABP |
| 54C5 | 929 | 2484 | Y00345 | Hs.172182 | 0 | 9 | polyA binding protein/cds = (502,2403)/gb = Y0 |
| 586B1 | 1042 | 1504 | NM_002408 | Hs.172195 | 0 | 1 | mannosyl (alpha-1,6-)-glycoprotein beta-1,2 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 169H6 | 5576 | 5958 | D25538 | Hs.172199 | 0 | 1 | KIAA0037 gene, complete cds/cds = (265,3507) |
| 115G7 | 4531 | 4976 | NM_001114 | Hs.172199 | 0 | 1 | adenylate cyclase 7 (ADCY7), mRNA/cds = (265,35 |
| 120F2 | 1 | 2496 | NM_007363 | Hs.172207 | 0 | 11 | non-POU-domain-containing, octamer-binding |
| 74A3 | 860 | 1364 | Y11289 | Hs.172207 | 0 | 1 | p54nrb gene, exon 3 (and joined/cds = (136,1551) |
| 60B7 | 695 | 1160 | NM_000202 | Hs.172458 | 0 | 1 | iduronate 2-sulfatase (Hunter syndrome) (IDS |
| 479D10 | 4059 | 4347 | NM_000632 | Hs.172631 | 1.00E−125 | 1 | integrin, alpha M (complement component recep |
| 167B10 | 1 | 389 | NM_003761 | Hs.172684 | 0 | 4 | vesicle-associated membrane protein 8 (endob |
| 189E11 | 1773 | 2038 | NM_001345 | Hs.172690 | 1.00E−149 | 2 | diacylglycerol kinase, alpha (80 kD) (DGKA), m |
| 177C2 | 983 | 1489 | X62535 | Hs.172690 | 0 | 1 | diacylglycerol kinase/cds = (103,2310) |
| 458B12 | 535 | 1002 | NM_012326 | Hs.172740 | 0 | 1 | microtubule-associated protein, RP/EB family |
| 53A11 | 69 | 430 | W26908 | Hs.172762 | 1.00E−180 | 1 | 16b3/gb = W26908/gi = 1306136/ug = Hs.17276 |
| 151H2 | 2016 | 2572 | M80359 | Hs.172766 | 0 | 1 | protein p78 mRNA, complete cds/cds = (171,2312)/ gb = M8 |
| 100G10 | 3983 | 4302 | AB037808 | Hs.172789 | 1.00E−149 | 1 | for KIAA1387 protein, partial cds/cds = (0 |
| 515D9 | 354 | 548 | NM_004182 | Hs.172791 | 3.00E−65 | 1 | ubiquitously-expressed transcript (UXT), mR |
| 193D9 | 2282 | 2757 | AL109669 | Hs.172803 | 0 | 3 | mRNA full length insert cDNA clone EUROIMAGE 31 |
| 460H10 | 12 | 490 | NM_016466 | Hs.172918 | 0 | 1 | hypothetical protein (LOC51239), mRNA/cds = ( |
| 483D3 | 3473 | 3941 | AB011102 | Hs.173081 | 0 | 1 | mRNA for KIAA0530 protein, partial cds/cds = (0, |
| 195B9 | 380 | 854 | NM_005729 | Hs.173125 | 0 | 2 | peptidylprolyl isomerase F (cyclophilin F) ( |
| 173H6 | 6008 | 6412 | NM_006283 | Hs.173159 | 0 | 1 | transforming, acidic coiled-coil containing |
| 113E6 | 142 | 240 | AI554733 | Hs.173182 | 3.00E−49 | 1 | tn27f08.x1 cDNA, 3' end/clone = IMAGE: 2168871 |
| 56G8 | 140 | 630 | AK002009 | Hs.173203 | 0 | 2 | FLJ11147 fis, clone PLACE1006678, weakly |
| 69E6 | 1 | 463 | BF131656 | Hs.173205 | 1.00E−147 | 8 | 601820483F1 cDNA, 5' end/clone = IMAGE: 4052348 |
| 44A2 | 6 | 196 | X06347 | Hs.173255 | 1.00E−94 | 1 | U1 small nuclear RNP-specific A protein/cds = clone |
| 149G1 | 79 | 498 | AY007165 | Hs.173274 | 1.00E−117 | 2 | CDABP0163 mRNA sequence/cds = UNKNOWN/g |
| 464F3 | 53 | 500 | AW005376 | Hs.173280 | 0 | 1 | ws94a12.x1 cDNA, 3' end/clone = IMAGE: 2505598 |
| 587H5 | 3299 | 4083 | NM_014633 | Hs.173288 | 0 | 2 | KIAA0155 gene product (KIAA0155), mRNA/cds = ( |
| 499B9 | 1032 | 1923 | NM_012081 | Hs.173334 | 0 | 2 | ELL-RELATED RNA POLYMERASE II, ELONGATION FAC |
| 54F11 | 368 | 1923 | U88629 | Hs.173334 | 0 | 2 | RNA polymerase II elongation factor ELL2, complete cd |
| 459A4 | 2170 | 2775 | AK001362 | Hs.173374 | 0 | 1 | cDNA FLJ10500 fis, clone NT2RP2000369/cds = UNK |
| 124B1 | 2566 | 3019 | AB046825 | Hs.173422 | 0 | 1 | mRNA for KIAA1605 protein, partial cds/cds = (3 |
| 126H6 | 1080 | 1626 | NM_006363 | Hs.173497 | 0 | 1 | Sec23 (*S. cerevisiae*) homolog B (SEC23B), mRNA |
| 596D5 | 1233 | 1365 | NM_004550 | Hs.173611 | 8.00E−63 | 5 | NADH dehydrogenase (ubiquinone) Fe-S protein |
| 108C5 | 1709 | 1864 | AK022681 | Hs.173685 | 2.00E−83 | 1 | FLJ12619 fis, clone NT2RM4001682/cds = (39 |
| 583D12 | 3 | 1960 | AK025703 | Hs.173705 | 0 | 4 | cDNA: FLJ22050 fis, clone HEP09454/cds = UNKNOW |
| 70B6 | 579 | 1140 | AL049610 | Hs.173714 | 0 | 2 | DNA sequence from clone 1055C14 on chromosome Xq22.1- |
| 46D7 | 590 | 1150 | NM_012286 | Hs.173714 | 0 | 1 | MORF-related gene X (KIAA0026), mRNA/cds = (305 |
| 467G5 | 17 | 283 | AA534537 | Hs.173720 | 1.00E−104 | 1 | nf80h10.s1 cDNA, 3' end/clone = IMAGE: 926275/ |
| 168H5 | 1 | 1066 | D25274 | Hs.173737 | 0 | 5 | mRNA, clone: PO2ST9/cds = UNKNOWN/gb = D25274/ |
| 471B8 | 5347 | 5922 | NM_014832 | Hs.173802 | 0 | 1 | KIAA0603 gene product (KIAA0603), mRNA/cds = ( |
| 177F4 | 1053 | 1622 | U51166 | Hs.173824 | 0 | 1 | G/T mismatch-specific thymine DNA glycosylase mRNA, |
| 471C3 | 396 | 719 | AF277292 | Hs.173840 | 1.00E−176 | 1 | C4orf1 mRNA/cds = (0,281)/gb = AF277292/gi = 96 |
| 477F7 | 2053 | 2694 | U80735 | Hs.173854 | 0 | 3 | CAGF28 mRNA, partial cds/cds = (0,2235)/gb = U80 |
| 41F3 | 3595 | 3890 | M37435 | Hs.173894 | 1.00E−143 | 1 | macrophage-specific colony-stimulating factor (CSF |
| 460C8 | 1542 | 1939 | NM_014225 | Hs.173902 | 0 | 1 | protein phosphatase 2 (formerly 2A), regulator |
| 458A9 | 292 | 414 | AI763121 | Hs.173904 | 4.00E−57 | 1 | wi06d12.x1 cDNA, 3' end/clone = IMAGE: 2389463 |
| 170B10 | 1230 | 3510 | AL137681 | Hs.173912 | 1.00E−176 | 5 | cDNA DKFZp434M0326 (from clone DKFZp434M |
| 126E10 | 1061 | 1795 | Z17227 | Hs.173936 | 1.00E−111 | 2 | mRNA for transmembrane receptor protein/cds = (4 |
| 72H7 | 1210 | 1907 | U08316 | Hs.173965 | 0 | 2 | insulin-stimulated protein kinase 1 (ISPK-1) mRNA, c |
| 123G7 | 554 | 858 | NM_005777 | Hs.173993 | 1.00E−168 | 1 | RNA binding motif protein 6 (RBM6), mRNA/cds = ( |
| 469C8 | 261 | 528 | BE674902 | Hs.174010 | 1.00E−113 | 1 | 7e97a04.x1 cDNA, 3' end/clone = IMAGE: 3293070 |
| 117G6 | 2450 | 2657 | NM_003089 | Hs.174051 | 1.00E−112 | 1 | small nuclear ribonucleoprotein 70 kD polypept |
| 103A5 | 4907 | 5011 | NM_002209 | Hs.174103 | 1.00E−48 | 1 | integrin, alpha L (antigen CD11A (p180), lymph |
| 159F4 | 333 | 925 | AF261087 | Hs.174131 | 0 | 7 | DNA-binding protein TAXREB107 mRNA, complete |
| 588F9 | 333 | 926 | NM_000970 | Hs.174131 | 0 | 8 | ribosomal protein L6 (RPL6), mRNA/cds = (26,892 |
| 187A2 | 2993 | 3464 | NM_001096 | Hs.174140 | 0 | 2 | ATP citrate lyase (ACLY), mRNA/cds = (84,3401) |
| 41C6 | 3652 | 3992 | X03663 | Hs.174142 | 0 | 1 | c-fms proto-oncogene/cds = (300,3218)/gb = X0 |
| 465G10 | 199 | 489 | BE674951 | Hs.174144 | 1.00E−152 | 1 | 7e97g10.x1 cDNA, 3' end/clone = IMAGE: 3293154 |
| 468H10 | 28 | 159 | AI524263 | Hs.174193 | 6.00E−62 | 1 | th11g07.x1 cDNA, 3' end/clone = IMAGE: 2118012 |
| 99C7 | 402 | 733 | NM_006435 | Hs.174195 | 1.00E−179 | 2 | interferon induced transmembrane protein 2 ( |
| 467E4 | 162 | 516 | BF062628 | Hs.174215 | 1.00E−157 | 1 | 7h62h05.x1 cDNA, 3' end/clone = IMAGE: 3320601 |
| 74E5 | 2 | 485 | D63789 | Hs.174228 | 0 | 15 | DNA for SCM-1beta precursor, complete cds/cd |
| 470F11 | 108 | 305 | AI590337 | Hs.174258 | 1.00E−104 | 1 | tn49c03.x1 cDNA, 3' end/clone = IMAGE: 2171716 |
| 463D2 | 1 | 194 | AV734916 | Hs.175971 | 1.00E−94 | 1 | AV734916 cDNA, 5' end/clone = cdAAHE11/clone_ |
| 477E5 | 75 | 222 | AI380955 | Hs.176374 | 2.00E−33 | 1 | tg18b08.x1 cDNA, 3' end/clone = IMAGE: 2109111 |
| 473A9 | 1 | 296 | AI708327 | Hs.176430 | 1.00E−162 | 1 | at04c02.x1 cDNA, 3' end/clone = IMAGE: 2354114 |
| 468C3 | 24 | 235 | AW081098 | Hs.176498 | 6.00E−91 | 1 | xc29a12.x1 cDNA, 3' end/clone = IMAGE: 2585662 |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 479D11 | 595 | 1810 | J04162 | Hs.176663 | 0 | 14 | leukocyte IgG receptor (Fc-gamma-R) mRNA, complete c |
| 108G2 | 388 | 579 | AI638800 | Hs.176920 | 6.00E−78 | 4 | tt32e01.x1 cDNA, 3' end/clone = IMAGE: 2242488 |
| 467A10 | 98 | 170 | AI865603 | Hs.177045 | 6.00E−27 | 1 | wk47g03.x1 cDNA, 3' end/clone = IMAGE: 2418580 |
| 117A6 | 1179 | 1403 | AF116606 | Hs.177415 | 1.00E−112 | 2 | PRO0890 mRNA, complete cds/cds = (1020,1265)/ |
| 73F2 | 236 | 919 | NM_016406 | Hs.177507 | 0 | 4 | hypothetical protein (HSPC155), mRNA/cds = (2 |
| 516D8 | 24 | 340 | NM_006886 | Hs.177530 | 1.00E−179 | 1 | ATP synthase, H+ transporting, mitochondrial |
| 479F4 | 163 | 676 | NM_002414 | Hs.177543 | 0 | 1 | antigen identified by monoclonal antibodies 1 |
| 126A9 | 906 | 2105 | NM_005534 | Hs.177559 | 0 | 35 | interferon gamma receptor 2 (interferon gamma |
| 41H6 | 905 | 1826 | U05875 | Hs.177559 | 0 | 10 | clone pSK1 interferon gamma receptor accessory factor |
| 37G1 | 1690 | 2420 | U62961 | Hs.177584 | 0 | 1 | succinyl CoA: 3-oxoacid CoA transferase precursor (O |
| 597H7 | 1764 | 2520 | AF218002 | Hs.177596 | 0 | 7 | clone PP2464 unknown mRNA/cds = (675,2339)/gb |
| 520B8 | 1036 | 1202 | NM_006888 | Hs.177656 | 4.00E−90 | 3 | calmodulin 1 (phosphorylase kinase, delta) (C |
| 151G7 | 2439 | 3048 | J03473 | Hs.177766 | 0 | 1 | poly(ADP-ribose) synthetase mRNA, complete cds/cds = clone |
| 116C6 | 318 | 834 | BC001980 | Hs.177781 | 1.00E−144 | 4 | MGC: 5618, mRNA, complete cds/cds = (156, |
| 179C11 | 211 | 737 | X07834 | Hs.177781 | 0 | 3 | manganese superoxide dismutase (EC 1.15.1.1) |
| 98A9 | 213 | 648 | M73547 | Hs.178112 | 0 | 4 | polyposis locus (DP1 gene) mRNA, complete cds/cds = (82 |
| 459E10 | 149 | 789 | AK023719 | Hs.178357 | 0 | 1 | cDNA FLJ13657 fis, clone PLACE1011563/cds = (8 |
| 120H6 | 137 | 404 | NM_021029 | Hs.178391 | 1.00E−136 | 1 | ribosomal protein L44 (RPL44), mRNA/cds = (37,3 |
| 589E9 | 371 | 596 | NM_000973 | Hs.178551 | 1.00E−125 | 1 | ribosomal protein L8 (RPL8), mRNA/cds = (43,816 |
| 142F5 | 1848 | 2210 | D21090 | Hs.178658 | 1.00E−179 | 1 | XP-C repair complementing protein (p58/HHR23 |
| 120H11 | 402 | 532 | AV716627 | Hs.178703 | 9.00E−69 | 1 | AV716627 cDNA, 5' end/clone = DCBBCH05/clone_ |
| 98G11 | 3287 | 6017 | NM_004859 | Hs.178710 | 0 | 5 | clathrin, heavy polypeptide (Hc) (CLTC), mRNA |
| 177H1 | 142 | 421 | BF130300 | Hs.178732 | 1.00E−139 | 1 | 601818357F1 cDNA, 5' end/clone = IMAGE: 4041902 |
| 472A10 | 421 | 562 | AI681868 | Hs.178784 | 4.00E−63 | 1 | tx50a12.x1 cDNA, 3' end/clone = IMAGE: 2272990 |
| 467G6 | 194 | 292 | AW138461 | Hs.179003 | 1.00E−49 | 1 | UI-H-BI1-adg-e-06-0-UI.s1 cDNA, 3' end/clon |
| 465C11 | 3312 | 3606 | NM_016562 | Hs.179152 | 1.00E−166 | 1 | toll-like receptor 7 (LOC51284), mRNA/cds = (13 |
| 469F7 | 268 | 405 | AI568459 | Hs.179419 | 3.00E−45 | 1 | tn39e07.x1 cDNA, 3' end/clone = IMAGE: 2170020 |
| 99F11 | 750 | 2687 | NM_006472 | Hs.179526 | 0 | 73 | upregulated by 1,25-dihydroxyvitamin D-3 (VD |
| 39G9 | 526 | 2687 | S73591 | Hs.179526 | 0 | 17 | brain-expressed HHCPA78 homolog VDUP1 (Gene) |
| 102A1 | 2235 | 2659 | AL034343 | Hs.179565 | 0 | 1 | DNA sequence from clone RP1-108C2 on chromosome 6p12. |
| 492B2 | 1074 | 2126 | NM_002717 | Hs.179574 | 1.00E−131 | 3 | protein phosphatase 2 (formerly 2A), regulator |
| 143F2 | 242 | 457 | NM_005771 | Hs.179608 | 1.00E−117 | 1 | retinol dehydrogenase homolog (RDHL]) mRNA/ |
| 111G7 | 626 | 898 | NM_002659 | Hs.179657 | 1.00E−153 | 1 | plasminogen activator, urokinase receptor (P |
| 585D2 | 61 | 3189 | AL162068 | Hs.179662 | 0 | 6 | mRNA; cDNA DKFZp762G106 (from clone DKFZp762G1 |
| 125G4 | 1159 | 1627 | NM_000389 | Hs.179665 | 1.00E−130 | 2 | cyclin-dependent kinase inhibitor 1A (p21, Ci |
| 331A1 | 51 | 377 | AK026642 | Hs.179666 | 1.00E−161 | 2 | FLJ22989 fis, clone KAT11824, highly sim |
| 516H12 | 19 | 362 | NM_000997 | Hs.179779 | 1.00E−180 | 3 | ribosomal protein L37 (RPL37), mRNA/cds = (28,3 |
| 170A11 | 1390 | 2087 | L20298 | Hs.179881 | 0 | 1 | transcription factor (CBFB) mRNA, 3' end/cds = ( |
| 195H8 | 1732 | 2110 | NM_001755 | Hs.179881 | 1.00E−173 | 1 | core-binding factor, beta subunit (CBFB), tra |
| 127G6 | 2406 | 2924 | AK022499 | Hs.179882 | 0 | 2 | cDNA FLJ12437 fis, clone NT2RM1000118, weakly |
| 461E6 | 610 | 1148 | NM_014153 | Hs.179898 | 0 | 1 | HSPC055 protein (HSPC055), mRNA/cds = (1400,19 |
| 516B3 | 4 | 584 | NM_000975 | Hs.179943 | 1.00E−136 | 2 | ribosomal protein L11 (RPL11), mRNA/cds = (0,53 |
| 62F8 | 24 | 537 | X79234 | Hs.179943 | 1.00E−175 | 1 | ribosomal protein L11/cds = (0,536)/gb = tumor |
| 471B11 | 1990 | 2496 | NM_005802 | Hs.179982 | 0 | 1 | protein p53-binding protein (TP53BPL), |
| 194B4 | 693 | 956 | NM_004159 | Hs.180062 | 1.00E−112 | 1 | proteasome (prosome, macropain) subunit, bet |
| 49D4 | 1002 | 1259 | NM_002690 | Hs.180107 | 1.00E−125 | 1 | polymerase (DNA directed), beta (POLB), mRNA |
| 184A11 | 26 | 515 | AK024823 | Hs.180139 | 0 | 2 | FLJ21170 fis, clone CAS10946, highly sim |
| 593A8 | 43 | 535 | NM_006937 | Hs.180139 | 0 | 13 | SMT3 (suppressor of mif two 3, yeast) homolog 2 |
| 61D10 | 102 | 722 | AF161415 | Hs.180145 | 0 | 1 | HSPC297 mRNA, partial cds/cds = (0,438)/gb = AF |
| 178A4 | 131 | 628 | NM_017924 | Hs.180201 | 0 | 2 | hypothetical protein FLJ20671 (FLJ20671), mR |
| 463H9 | 54 | 171 | NM_005507 | Hs.180370 | 1.00E−60 | 1 | cofilin 1 (non-muscle) (CFL1), mRNA/cds = (51,5 |
| 162B9 | 2139 | 2386 | AB013382 | Hs.180383 | 1.00E−124 | 1 | for DUSP6, complete cds/cds = (351,1496)/ |
| 190B7 | 1743 | 2386 | NM_001946 | Hs.180383 | 1.00E−124 | 2 | dual specificity phosphatase 6 (DUSP6), trans |
| 589B11 | 21 | 1566 | NM_006597 | Hs.180414 | 0 | 11 | heat shock 70 kD protein 8 (HSPA8), mRNA/cds = (8 |
| 73G2 | 21 | 1567 | Y00371 | Hs.180414 | 0 | 16 | hsc70 gene for 71 kd heat shock protein/ cds = (83,2023) |
| 62G1 | 985 | 1559 | X89602 | Hs.180433 | 0 | 1 | rTS beta protein/cds = (17,1267)/gb = X896 |
| 98F9 | 1479 | 3653 | L38951 | Hs.180446 | 0 | 9 | importin beta subunit mRNA, complete cds/cds = ( |
| 590F12 | 283 | 614 | NM_001026 | Hs.180450 | 0 | 1 | ribosomal protein S24 (RPS24), mRNA/cds = (142, |
| 597F2 | 2670 | 3046 | AF187554 | Hs.180532 | 0 | 47 | sperm antigen-36 mRNA, complete cds/cds = (234, |
| 482E2 | 85 | 366 | AL571386 | Hs.180546 | 1.00E−106 | 1 | AL571386 cDNA/clone = CS0DI009YL09-(3-prime) |
| 109C2 | 324 | 682 | BE540238 | Hs.180549 | 1.00E−143 | 1 | 601059809F1 cDNA, 5' end/clone = IMAGE: 3446283 |
| 68G8 | 1447 | 3594 | AF123094 | Hs.180566 | 0 | 3 | API2-MLT fusion protein (API2-MLT) mRNA, comp |
| 180B9 | 1851 | 2142 | NM_002087 | Hs.180577 | 1.00E−160 | 2 | granulin (GRN), mRNA/cds = (62,1843)/gb = NM_00 |
| 51E4 | 880 | 2466 | NM_005066 | Hs.180610 | 0 | 6 | splicing factor proline/glutamine rich (poly |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 50G4 | 880 | 1280 | X70944 | Hs.180610 | 0 | 1 | PTB-associated splicing factor/cds = (85 |
| 127C8 | 317 | 3175 | AK023143 | Hs.180638 | 0 | 5 | cDNA FLJ13081 fis, clone NT2RP3002033/cds = (17 |
| 125E2 | 287 | 1692 | AL117621 | Hs.180777 | 0 | 2 | mRNA; cDNA DKFZp564M0264 (from clone DKFZp564 |
| 521F11 | 1969 | 2431 | AF126964 | Hs.180799 | 0 | 1 | C3HC4-type zinc finger protein (LZK1) mRNA, co |
| 479C11 | 1186 | 2245 | AK000271 | Hs.180804 | 1.00E−155 | 2 | cDNA FLJ20264 fis, clone COLF7912/ cds = UNKNOWN |
| 479C2 | 732 | 911 | NM_001242 | Hs.180841 | 3.00E−62 | 1 | tumor necrosis factor receptor superfamily, m |
| 596D2 | 67 | 942 | NM_000977 | Hs.180842 | 0 | 11 | ribosomal protein L13 (RPL13), mRNA/cds = (51,6 |
| 41E9 | 884 | 1779 | AL050337 | Hs.180866 | 0 | 2 | DNA sequence from clone 503F13 on chromosome 6q24.1–25 |
| 196C10 | 679 | 1338 | NM_000416 | Hs.180866 | 0 | 2 | interferon gamma receptor 1 (IFNGR1), mRNA/cd |
| 99A10 | 1 | 1655 | AF218029 | Hs.180877 | 0 | 11 | clone PP781 unknown mRNA/cds = (113,523)/gb = A |
| 65H9 | 1 | 1320 | Z48950 | Hs.180877 | 0 | 6 | hH3.3B gene for histone H3.3/cds = (10,420)/gb = Z |
| 160G1 | 2065 | 2538 | AF045555 | Hs.180900 | 0 | 2 | wbscr1 (WBSCR1) and wbscr5 (WBSCR5) genes, com |
| 596B1 | 5 | 860 | NM_001008 | Hs.180911 | 0 | 5 | ribosomal protein S4, Y-linked (RPS4Y), mRNA |
| 192F11 | 1857 | 2521 | AK000299 | Hs.180952 | 0 | 1 | cDNA FLJ20292 fis, clone HEP05374/cds = (21,140 |
| 75D10 | 94 | 1656 | AY007118 | Hs.181013 | 0 | 8 | clone CDABP0006 mRNA sequence/cds = (20,784)/ |
| 46H2 | 105 | 1661 | NM_002629 | Hs.181013 | 0 | 5 | phosphoglycerate mutase 1 (brain) (PGAM1), mR |
| 107G10 | 4869 | 5527 | AK024391 | Hs.181043 | 0 | 1 | FLJ14329 fis, clone PLACE4000259, highly |
| 179A1 | 22 | 908 | AK001934 | Hs.181112 | 0 | 2 | FLJ11072 fis, clone PLACE1004982/cds = (2 |
| 118D5 | 610 | 1130 | NM_014166 | Hs.181112 | 0 | 1 | HSPC126 protein (HSPC126), mRNA/cds = (25,837) |
| 483D9 | 659 | 915 | X57809 | Hs.181125 | 1.00E−123 | 1 | rearranged immunoglobulin lambda light chain mRNA/c |
| 596B10 | 499 | 1198 | NM_005517 | Hs.181163 | 0 | 2 | high-mobility group (nonhistone chromosomal) |
| 74A12 | 34 | 1674 | AK026650 | Hs.181165 | 0 | 192 | FLJ22997 fis, clone KAT11962, highly sim |
| 99H8 | 1079 | 2742 | BC001412 | Hs.181165 | 0 | 260 | eukaryotic translation elongation factor 1 |
| 70F10 | 144 | 840 | AB015798 | Hs.181195 | 0 | 1 | HSJ2 mRNA for DnaJ homolog, complete cds/cds = MRJ |
| 64E10 | 72 | 856 | BC002446 | Hs.181195 | 0 | 2 | gene for a member of protein family, clone |
| 597F6 | 1119 | 1767 | NM_001675 | Hs.181243 | 0 | 3 | activating transcription factor 4 (tax-respon |
| 109D8 | 825 | 1233 | D32129 | Hs.181244 | 0 | 1 | HLA class-I (HLA-A26) heavy chain, complete c |
| 593H10 | 465 | 1222 | NM_016057 | Hs.181271 | 0 | 3 | CGI-120 protein (LOC51644), mRNA/cds = (37,570 |
| 127H10 | 4782 | 5154 | AB020335 | Hs.181300 | 0 | 1 | Pancreas-specific TSA305 mRNA, complete cds |
| 150F7 | 509 | 1238 | M11353 | Hs.181307 | 1.00E−175 | 5 | H3.3 histone class C mRNA, complete cds/ cds = (374,784) |
| 127F7 | 895 | 1057 | NM_002107 | Hs.181307 | 3.00E−85 | 2 | H3 histone, family 3A (H3F3A), mRNA/cds = (374,7 |
| 39H10 | 6 | 416 | BF676042 | Hs.181357 | 0 | 7 | 602084011F1 cDNA, 5' end/clone = IMAGE: 4248195 |
| 99G12 | 193 | 842 | NM_002295 | Hs.181357 | 0 | 28 | laminin receptor 1 (67 kD, ribosomal protein SA |
| 66A12 | 312 | 1084 | M20430 | Hs.181366 | 0 | 4 | MHC class II HLA-DR-beta (DR2-DQw1/DR4 DQw3) mRNA, co |
| 71H11 | 748 | 1096 | NM_002125 | Hs.181366 | 1.00E−176 | 1 | major histocompatibility complex, class II, |
| 56E4 | 272 | 521 | AI827911 | Hs.181400 | 1.00E−126 | 1 | wf34e11.x1 cDNA, 3' end/clone = IMAGE: 2357516 |
| 170F6 | 5255 | 5724 | D63486 | Hs.181418 | 0 | 1 | KIAA0152 gene, complete cds/cds = (128,1006) |
| 464A11 | 5981 | 6322 | NM_014730 | Hs.181418 | 1.00E−159 | 1 | KIAA0152 gene product (KIAA0152), mRNA/cds = ( |
| 514F6 | 1 | 232 | AW955745 | Hs.181426 | 1.00E−117 | 1 | EST367815 cDNA/gb = AW955745/gi = 8145428/ug = TRAF4 |
| 177E2 | 690 | 947 | U81002 | Hs.181466 | 1.00E−130 | 2 | associated factor 1 mRNA, partial cds/c |
| 99B5 | 260 | 1660 | NM_001549 | Hs.181874 | 0 | 6 | interferon-induced protein with tetratricope |
| 595H9 | 104 | 645 | M90356 | Hs.181967 | 0 | 1 | BTF3 protein homologue gene, complete cds/ cds = (0,644 |
| 67E2 | 1057 | 1782 | AK026664 | Hs.182225 | 4.00E−85 | 3 | FLJ23011 fis, clone LNG00572/cds = (288,7 |
| 190A3 | 319 | 1615 | NM_014052 | Hs.182238 | 0 | 7 | GW128 protein (GW128), mRNA/cds = (698,889)/g |
| 140B10 | 1770 | 2034 | U46751 | Hs.182248 | 2.00E−92 | 1 | phosphotyrosine independent ligand p62 for the Lck S |
| 158H11 | 371 | 597 | D50420 | Hs.182255 | 1.00E−126 | 1 | OTK27, complete cds/cds = (94,480)/gb |
| 584A12 | 95 | 1397 | NM_005008 | Hs.182255 | 0 | 3 | non-histone chromosome protein 2 (S. cerevisia |
| 40G2 | 735 | 908 | Y00503 | Hs.182265 | 7.00E−41 | 1 | keratin 19/cds = (32,1234)/gb = Y00503/gi = 340 |
| 596E7 | 1 | 886 | NM_001743 | Hs.182278 | 0 | 3 | calmodulin 2 (phosphorylase kinase, delta) (C |
| 129E10 | 36 | 350 | L29348 | Hs.182378 | 1.00E−174 | 2 | granulocyte-macrophage colony-stimulating |
| 487G1 | 184 | 934 | NM_002952 | Hs.182426 | 0 | 3 | ribosomal protein S2 (RPS2), mRNA/cds = (240,90 |
| 517G6 | 126 | 1497 | NM_005742 | Hs.182429 | 0 | 4 | protein disulfide isomerase-related protein |
| 60E12 | 10 | 1329 | M16342 | Hs.182447 | 0 | 4 | nuclear ribonucleoprotein particle (hnRNP) C protein |
| 98E9 | 10 | 1184 | NM_004500 | Hs.182447 | 0 | 8 | heterogeneous nuclear ribonucleoprotein C ( |
| 496A4 | 87 | 1835 | NM_014394 | Hs.182470 | 0 | 2 | PTD10 protein (PTD010), mRNA/cds = (129,1088) |
| 110F11 | 947 | 1571 | AF061738 | Hs.182579 | 0 | 2 | leucine aminopeptidase mRNA, complete cds/cd |
| 124E1 | 1330 | 1889 | NM_005739 | Hs.182591 | 0 | 2 | RAS guanyl releasing protein 1 (calcium and DA |
| 143B2 | 32 | 565 | Z47087 | Hs.182643 | 0 | 1 | RNA polymerase II elongation factor-like |
| 103D2 | 161 | 538 | NM_001015 | Hs.182740 | 8.00E−97 | 5 | ribosomal protein S11 (RPS11), mRNA/cds = (15,4 |
| 331C2 | 1310 | 1585 | D64015 | Hs.182741 | 1.00E−136 | 1 | for T-cluster binding protein, complete c |
| 59E9 | 27 | 269 | BF245224 | Hs.182825 | 1.00E−105 | 1 | 601863885F1 cDNA, 5' end/clone = IMAGE: 4082396 |
| 525E3 | 12 | 261 | NM_007209 | Hs.182825 | 1.00E−135 | 2 | ribosomal protein L35 (RPL35), mRNA/cds = (27,3 |
| 70C9 | 189 | 625 | BE963551 | Hs.182928 | 1.00E−129 | 1 | 601657346R1 cDNA, 3' end/clone = IMAGE: 3866266 |
| 177B9 | 14 | 561 | BF242969 | Hs.182937 | 0 | 2 | 601877739F1 cDNA, 5' end/clone = IMAGE: 4106289 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 519H3 | 34 | 526 | NM_021130 | Hs.182937 | 0 | 1 | peptidylprolyl isomerase A (cyclophilin A) ( |
| 159A5 | 3163 | 3579 | AK026491 | Hs.182979 | 1.00E−141 | 2 | FLJ22838 fis, clone KAIA4494, highly sim |
| 106G11 | 2956 | 3527 | AF204231 | Hs.182982 | 1.00E−138 | 2 | 88-kDa Golgi protein (GM88) mRNA, complete cds |
| 169A3 | 2117 | 2495 | M33336 | Hs.183037 | 1.00E−105 | 3 | cAMP-dependent protein kinase type I-alpha subunit ( |
| 124H9 | 2767 | 2955 | NM_002734 | Hs.183037 | 7.00E−91 | 1 | protein kinase, cAMP-dependent, regulatory, |
| 107B3 | 2877 | 3182 | U17989 | Hs.183105 | 1.00E−170 | 1 | nuclear autoantigen GS2NA mRNA, complete cds/ |
| 476A6 | 538 | 893 | NM_016523 | Hs.183125 | 0 | 1 | killer cell lectin-like receptor F1 (KLRF1), m |
| 75A1 | 629 | 1222 | AK001433 | Hs.183297 | 0 | 1 | FLJ10571 fis, clone NT2RP2003121, weakly |
| 597E11 | 97 | 1656 | AF248966 | Hs.183434 | 0 | 5 | HT028 mRNA, complete cds/cds = (107,1159)/gb = cDNA |
| 124A2 | 2015 | 2756 | AK024275 | Hs.183506 | 0 | 1 | FLJ14213 fis, clone NT2RP3003572/cds = (11 |
| 74F2 | 2082 | 2418 | U53347 | Hs.183556 | 1.00E−177 | 2 | neutral amino acid transporter B mRNA, complete cds/ |
| 482C5 | 1211 | 1688 | NM_018399 | Hs.183656 | 0 | 1 | VNN3 protein (HSA238982), mRNA/cds = (45,1550) |
| 594H12 | 1718 | 3458 | NM_001418 | Hs.183684 | 0 | 4 | eukaryotic translation initiation factor 4 g |
| 61H11 | 1457 | 2024 | U73824 | Hs.183684 | 0 | 2 | p97 mRNA, complete cds/cds = (306,3029)/ gb = U73824/g |
| 75H7 | 342 | 2258 | M26880 | Hs.183704 | 0 | 7 | ubiquitin mRNA, complete cds/cds = (135,2192)/ gb = M26 |
| 599E7 | 2306 | 3111 | D44640 | Hs.183706 | 0 | 6 | HUMSUPY040 cDNA/clone = 035-00-1/gb = D44640/ |
| 518H4 | 1554 | 1973 | NM_002078 | Hs.183773 | 0 | 1 | golgi autoantigen, golgin subfamily a, 4 (GOL |
| 520C3 | 98 | 255 | NM_018955 | Hs.183842 | 3.00E−64 | 1 | ubiquitin B (UBB), mRNA/cds = (94,783)/gb = NM_ |
| 102C11 | 1730 | 1808 | M15182 | Hs.183868 | 8.00E−33 | 2 | beta-glucuronidase mRNA, complete cds/ cds = (26,1981 |
| 523D3 | 1730 | 2183 | NM_000181 | Hs.183868 | 0 | 2 | glucuronidase, beta (GUSB), mRNA/cds = (26,198 |
| 187A12 | 122 | 828 | NM_003589 | Hs.183874 | 0 | 1 | cullin 4A (CUL4A), mRNA/cds = (160,2139)/gb = N |
| 156F4 | 228 | 907 | AF119665 | Hs.184011 | 0 | 4 | inorganic pyrophosphatase complete cds |
| 525B8 | 225 | 791 | NM_021129 | Hs.184011 | 0 | 2 | pyrophosphatase (inorganic) (PP), nuclear ge |
| 589B1 | 3 | 394 | NM_000993 | Hs.184014 | 0 | 10 | ribosomal protein L31 (RPL31), mRNA/cds = (7,38 |
| 99D6 | 3909 | 4308 | NM_004985 | Hs.184050 | 1.00E−145 | 1 | v-Ki-ras2 Kirsten rat sarcoma 2 viral oncogene |
| 166B3 | 12 | 345 | BE964596 | Hs.184052 | 1.00E−90 | 1 | 601658521R1 cDNA, 3' end/clone = IMAGE: 3885796 |
| 591G6 | 1348 | 1958 | NM_022152 | Hs.184052 | 0 | 3 | PP1201 protein (PP1201), mRNA/cds = (66,1001) |
| 114E11 | 1780 | 1942 | AK025645 | Hs.184062 | 4.00E−59 | 1 | cDNA: FLJ21992 fis, clone HEP06554/cds = (60,84 |
| 597E4 | 8 | 407 | NM_000982 | Hs.184108 | 1.00E−114 | 6 | ribosomal protein L21 (gene or pseudogene) (RP |
| 162C5 | 295 | 1062 | L41887 | Hs.184167 | 0 | 3 | splicing factor, arginine/serine-rich 7 (SFR |
| 109F6 | 151 | 749 | AF054182 | Hs.184211 | 0 | 1 | mitochondrial processing peptidase beta-subu |
| 462C6 | 4590 | 5087 | NM_015001 | Hs.184245 | 0 | 1 | KIAA0929 protein Msx2 interacting nuclear tar |
| 517D1 | 1510 | 1936 | NM_004252 | Hs.184276 | 1.00E−162 | 7 | solute carrier family 9 (sodium/hydrogen exch |
| 55E3 | 174 | 427 | NM_018370 | Hs.184465 | 1.00E−107 | 1 | hypothetical protein FLJ11259 (FLJ11259), mR |
| 50F9 | 2484 | 3108 | AB023182 | Hs.184523 | 0 | 1 | for KIAA0965 protein, partial cds/cds = (0 |
| 100A4 | 297 | 1941 | AK025730 | Hs.184542 | 1.00E−149 | 3 | FLJ22077 fis, clone HEP12728, highly sim |
| 113D4 | 950 | 1623 | NM_016061 | Hs.184542 | 0 | 1 | CGI-127 protein (LOC51646), mRNA/cds = (125,49 |
| 145D11 | 41 | 339 | BE730026 | Hs.184582 | 1.00E−111 | 1 | 601562642F1 cDNA, 5' end/clone = IMAGE: 3832258 |
| 595F4 | 69 | 548 | NM_000986 | Hs.184582 | 0 | 1 | ribosomal protein L24 (RPL24), mRNA/cds = (39,5 |
| 108H10 | 250 | 701 | U00946 | Hs.184592 | 0 | 1 | clone A9A2BRB5 (CAC)n/(GTG)n repeat-containing mRN |
| 43B5 | 4399 | 4488 | AF104032 | Hs.184601 | 3.00E−24 | 1 | L-type amino acid transporter subunit LAT1 mRNA |
| 104F12 | 298 | 1713 | NM_014999 | Hs.184627 | 0 | 2 | KIAA0118 protein (KIAA0118), mRNA/cds = (255,9 |
| 122E8 | 513 | 995 | AF035307 | Hs.184697 | 2 | | clone 23785 mRNA sequence/cds = UNKN0WN/ gb = AF |
| 40H2 | 66 | 2605 | M37197 | Hs.184760 | 1.00E−177 | 4 | CCAAT-box-binding factor (CBF) mRNA, complete cds/c |
| 514E4 | 29 | 519 | NM_000984 | Hs.184776 | 0 | 3 | ribosomal protein L23a (RPL23A), mRNA/cds = (2 |
| 589A7 | 736 | 983 | AK025533 | Hs.184793 | 1.00E−138 | 1 | cDNA: FLJ21880 fis, clone HEP02743/cds = UNKNOW |
| 142G5 | 1918 | 2157 | AL049782 | Hs.184938 | 8.00E−83 | 3 | Novel human gene mapping to chomosome 13/ cds = UNKNOWN/gb = A |
| 462G9 | 178 | 398 | AI085568 | Hs.185062 | 1.00E−76 | 1 | oy68b05.x1 cDNA, 3' end/clone = IMAGE: 1670961 |
| 470C12 | 81 | 333 | T98171 | Hs.185675 | 1.00E−105 | 1 | ye56c12.s1 cDNA, 3' end/clone = IMAGE: 121750/ |
| 463F2 | 3175 | 3359 | NM_014686 | Hs.186840 | 1.00E−72 | 1 | KIAA0355 gene product (KIAA0355), mRNA/cds = ( |
| 461E4 | 907 | 1118 | NM_018519 | Hs.186874 | 4.00E−91 | 1 | hypothetical protein PRO2266 (PRO2266), mRNA |
| 155A1 | 53 | 379 | AI619501 | Hs.187362 | 1.00E−109 | 1 | ty50c09.x1 cDNA, 3' end/clone = IMAGE: 2282512 |
| 461C9 | 2948 | 3458 | NM_014504 | Hs.187660 | 0 | 1 | putative Rab5 GDP/GTP exchange factor homologu |
| 470F2 | 5 | 331 | BE646499 | Hs.187872 | 1.00E−156 | 1 | 7e87h02.x1 cDNA, 3' end/clone = IMAGE: 3292179 |
| 68D12 | 590 | 740 | AW963239 | Hs.187908 | 4.00E−66 | 1 | EST375312/gb = AW963239/gi = 8153075/ug = |
| 75H12 | 2012 | 2585 | AL110269 | Hs.187991 | 0 | 1 | cDNA DKFZp564A122 (from clone DKFZp564A1 |
| 167G4 | 1474 | 1958 | NM_015626 | Hs.187991 | 0 | 1 | DKFZPS64A122 protein (DKFZP564A122), mRNA/c |
| 137G3 | 54 | 197 | AI625368 | Hs.188365 | 2.00E−34 | 46 | ts37c10.x1 cDNA, 3' end/clone = IMAGE: 2230770 |
| 464C12 | 183 | 404 | AA432364 | Hs.188777 | 7.00E−94 | 1 | zw76a09.s1 cDNA, 3' end/clone = IMAGE: 782104/ |
| 467E9 | 29 | 183 | AA576947 | Hs.188886 | 1.00E−63 | 1 | nm82b04.s1 cDNA, 3' end/clone = IMAGE: 1074703 |
| 467B4 | 349 | 459 | AI392805 | Hs.189031 | 2.00E−49 | 1 | tg04h03.x1 cDNA, 3' end/clone = IMAGE: 2107829 |
| 461E2 | 242 | 473 | BE674964 | Hs.190065 | 1.00E−109 | 1 | 7f11b09.x1 cDNA, 3' end/clone = IMAGE: 3294329 |
| 466F4 | 58 | 295 | BG326781 | Hs.190219 | 1.00E−132 | 1 | 602425659F1 cDNA, 5' end/clone = IMAGE: 4563471 |
| 465H4 | 111 | 558 | AA582958 | Hs.190229 | 0 | 1 | nn80d08.s1 cDNA, 3' end/clone = IMAGE: 1090191 |
| 470F9 | 26 | 529 | AI763206 | Hs.190453 | 0 | 1 | wh95e09.x1 cDNA, 3' end/clone = IMAGE: 2388520 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 66H12 | 1 | 3459 | D00099 | Hs.190703 | 0 | 5 | for Na, K-ATPase alpha-subunit, complete |
| 472E1 | 338 | 540 | AW294083 | Hs.190904 | 2.00E−46 | 1 | UI-H-BI2-ahg-b-05-0-UI.s1 cDNA, 3' end/clon |
| 522G10 | 433 | 970 | NM_003757 | Hs.192023 | 0 | 2 | eukaryotic translation initiation factor 3, |
| 54GB | 29 | 410 | AW838827 | Hs.192123 | 0 | 1 | CM1-LT0059-280100-108-e02/gb = AW838827 |
| 465G4 | 261 | 515 | BF224348 | Hs.192463 | 1.00E−104 | 1 | 7q86c05.x1 cDNA/clone = IMAGE/gb = BF224348/g |
| 468F9 | 392 | 487 | AI524039 | Hs.192524 | 2.00E−36 | 1 | tg99h02.x1 cDNA, 3' end/clone = IMAGE: 2116947 |
| 466C6 | 111 | 392 | AW972048 | Hs.192534 | 1.00E−153 | 1 | EST384032 cDNA/gb = AW972048/gi = 8161789/ug = |
| 184F12 | 1 | 677 | AF090927 | Hs.192705 | 0 | 1 | clone HQ0457 PRO0457 mRNA, complete cds/cds = ( |
| 464C11 | 1 | 65 | BE298181 | Hs.192755 | 3.00E−23 | 1 | 601118566F1 cDNA, 5' end/clone = IMAGE: 3028193 |
| 465H3 | 108 | 706 | BG036938 | Hs.192965 | 0 | 1 | 602287708F1 cDNA, 5' end/clone = IMAGE: 4375153 |
| 169F9 | 4138 | 4890 | D87454 | Hs.192966 | 0 | 1 | KIAA0265 gene, partial cds/cds = (0,1205)/gb |
| 118H10 | 1104 | 1858 | AK024263 | Hs.193063 | 1.00E−132 | 2 | cDNA FLJ14201 fis, clone NT2RP3002955/cds = UNK |
| 472F3 | 28 | 405 | BF062295 | Hs.193237 | 0 | 1 | 7k76b11.x1 cDNA, 3' end/clone = IMAGE: 3481293 |
| 40A5 | 1933 | 2611 | X12830 | Hs.193400 | 0 | 1 | interleukin-6 (IL-6) receptor/cds = (437,184 |
| 63B5 | 327 | 582 | AW959162 | Hs.193669 | 1.00E−103 | 1 | EST371232/gb = AW959162/gi = 8148846/ug = |
| 52G10 | 803 | 1173 | M57627 | Hs.193717 | 0 | 1 | interleukin 10 (IL10) mRNA, complete cds/cds = (30,566 |
| 469F5 | 2088 | 2438 | AL110204 | Hs.193784 | 1.00E−179 | 1 | mRNA; cDNA DKFZp586K1922 (from clone DKFZp586K |
| 598H7 | 1428 | 1715 | NM_014828 | Hs.194035 | 1.00E−119 | 1 | KIAA0737 gene product (KIAA0737), mRNA/cds = ( |
| 462B6 | 103 | 546 | BE618004 | Hs.194362 | 1.00E−165 | 1 | 601462354F1 cDNA, 5' end/clone = IMAGE: 3865861 |
| 472F12 | 1177 | 1667 | AB036737 | Hs.194369 | 0 | 2 | mRNA for RERE, complete cds/cds = (636,5336)/g |
| 182E10 | 11785 | 13486 | U82828 | Hs.194382 | 0 | 5 | ataxia telangiectasia (ATM) gene, complete cd |
| 458F4 | 258 | 408 | NM_022739 | Hs.194477 | 2.00E−62 | 1 | E3 ubiquitin ligase SMURF2 (SMURF2), mRNA/cd |
| 583D2 | 1425 | 1732 | NM_014232 | Hs.194534 | 1.00E−136 | 1 | vesicle-associated membrane protein 2 (synapt |
| 38H8 | 1198 | 1620 | U89387 | Hs.194638 | 0 | 1 | RNA polymerase II subunit hsRPB4 gene, complete cds/ |
| 122H10 | 5292 | 5481 | NM_023005 | Hs.194688 | 4.00E−80 | 1 | bromodomain adjacent to zinc finger domain, 1B |
| 186G9 | 1 | 1908 | AL136945 | Hs.194718 | 0 | 2 | mRNA; cDNA DKFZp586O012 (from clone DKFZp586O0 |
| 113F3 | 1852 | 2375 | NM_000634 | Hs.194778 | 0 | 1 | interleukin 8 receptor, alpha (IL8RA), mRNA/ |
| 106A3 | 35 | 404 | U11870 | Hs.194778 | 0 | 1 | interleukin-8 receptor type A (IL8RBA) gene, promote |
| 473B8 | 1001 | 1314 | AF319438 | Hs.194976 | 1.00E−172 | 1 | SH2 domain-containing phosphatase anchor pro |
| 57F9 | 442 | 1934 | Y14039 | Hs.195175 | 0 | 27 | mRNA for CASH alpha protein/cds = (481,1923)/g |
| 49E5 | 2314 | 2512 | NM_018666 | Hs.195292 | 2.00E−37 | 1 | putative tumor antigen (SAGE), mRNA/cds = (167, |
| 473B10 | 406 | 532 | BE671815 | Hs.195374 | 1.00E−54 | 1 | 7a47c12.x1 cDNA, 3' end/clone = IMAGE: 3221878 |
| 595B5 | 59 | 311 | AI653766 | Hs.195378 | 6.00E−46 | 1 | ty01b06.x1 cDNA, 3' end/clone = IMAGE: 2277779 |
| 60G4 | 42 | 1554 | D13642 | Hs.195614 | 0 | 2 | KIAA0017 gene, complete cds/cds = (136,1335) |
| 473B9 | 739 | 927 | AF241534 | Hs.196015 | 2.00E−73 | 1 | hydatidiform mole associated and imprinted (H |
| 99C10 | 1075 | 1424 | NM_000294 | Hs.196177 | 1.00E−115 | 1 | phosphorylase kinase, gamma 2 (testis) (PHKG2 |
| 45H9 | 956 | 1405 | AF283645 | Hs.196270 | 0 | 1 | folate transporter/carrier mRNA, complete cd |
| 54F9 | 2567 | 2954 | U04636 | Hs.196384 | 0 | 1 | cyclooxygenase-2 (hCox-2) gene, complete cds/cds = (1 |
| 38F12 | 401 | 606 | AI984074 | Hs.196398 | 1.00E−104 | 1 | wz56c02.x1 cDNA, 3' end/clone = IMAGE: 2562050 |
| 157G1 | 403 | 551 | AJ006835 | Hs.196769 | 7.00E−77 | 2 | RNA transcript from U17 small nucleolar RNA ho |
| 163F4 | 1 | 402 | AI650871 | Hs.197028 | 0 | 1 | wa95f03.x1 cDNA, 3'end/clone = IMAGE: 2303933 |
| 160B3 | 408 | 476 | AI832038 | Hs.197091 | 5.00E−27 | 1 | wj99e02.x1 3'end/clone = IMAGE: 2410970 |
| 105E8 | 1299 | 3674 | AB020657 | Hs.197298 | 0 | 6 | for KIAA0850 protein, complete cds/cds = ( |
| 178G12 | 2097 | 3593 | AF205218 | Hs.197298 | 0 | 8 | NS1-binding protein-like protein mRNA, compl |
| 585F1 | 284 | 1711 | NM_001469 | Hs.197345 | 0 | 4 | thyroid autoantigen 70 kD (Ku antigen) (G22P1) |
| 39C10 | 545 | 1984 | Z83840 | Hs.197345 | 0 | 2 | DNA sequence from clone CTA-216E10 on chromosome 22 C |
| 58E12 | 2162 | 3013 | NM_001530 | Hs.197540 | 0 | 2 | hypoxia-inducible factor 1, alpha subunit (ba |
| 125G11 | 3673 | 4059 | D29805 | Hs.198248 | 0 | 1 | mRNA for beta-1,4-galactosyltransferase, complete |
| 41H10 | 6 | 821 | M33906 | Hs.198253 | 1.00E−156 | 2 | MHC class II HLA-DQA1 mRNA, complete cds/cds = (43,810) |
| 186A11 | 551 | 1031 | NM_004544 | Hs.198271 | 0 | 2 | NADH dehydrogenase (ubiquinone) 1 alpha subco |
| 126D8 | 993 | 1381 | NM_021105 | Hs.198282 | 0 | 1 | phospholipid scramblase 1 (PLSCR1), mRNA/cds |
| 174C12 | 4824 | 5257 | NM_003070 | Hs.198296 | 0 | 1 | SWI/SNF related, matrix associated, actin dep |
| 109C6 | 128 | 833 | X04327 | Hs.198365 | 0 | 1 | erythrocyte 2,3-bisphosphoglycerate mutase mRNA EC |
| 64B12 | 4383 | 5289 | NM_000189 | Hs.198427 | 0 | 2 | hexokinase 2 (HK2), mRNA/cds = (1490,4243)/gd |
| 70B4 | 3267 | 5289 | Z46376 | Hs.198427 | 0 | 4 | HK2 mRNA for hexokinase II/cds = (1490,4243)/gb = Z |
| 478H6 | 186 | 475 | AI978581 | Hs.198694 | 1.00E−129 | 1 | wq72d08.x1 cDNA, 3' end/clone = IMAGE: 2476815 |
| 587G1 | 767 | 1143 | NM_006837 | Hs.198767 | 1.00E−170 | 1 | COP9 (constitutive photomorphogenic, Arabido |
| 465E11 | 373 | 554 | BE621611 | Hs.198802 | 2.00E−77 | 1 | 601493754T1 cDNA, 3' end/clone = IMAGE: 3895836 |
| 123B3 | 310 | 3608 | AB011108 | Hs.198891 | 0 | 3 | mRNA for KIAA0536 protein, partial cds/cds = (0, |
| 157H3 | 3457 | 5268 | D50929 | Hs.198899 | 0 | 2 | KIAA0139 gene, complete cds/cds = (128,4276) |
| 477H1 | 35 | 592 | NM_002229 | Hs.198951 | 0 | 1 | jun B proto-oncogene (JUNB), mRNA/cds = (253,12 |
| 53C5 | 979 | 1296 | X51345 | Hs.198951 | 1.00E−160 | 1 | jun-B mRNA for JUN-B protein/cds = (253,1296)/gb = X513 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 54H8 | 350 | 501 | AW450874 | Hs.199014 | 5.00E−81 | 1 | UI-H-BI3-all-a-11-0-UI.s1 cDNA, 3' end/clon |
| 520E12 | 3506 | 3878 | L04731 | Hs.199160 | 0 | 1 | translocation T(4:11) of ALL-1 gene to chromoso |
| 57F4 | 5941 | 6266 | NM_006267 | Hs.199179 | 1.00E−158 | 1 | RAN binding protein 2 (RANBP2), mRNA/cds = (127, |
| 50B10 | 5 | 3645 | D86984 | Hs.199243 | 0 | 2 | KIAA0231 gene, partial cds/cds = (0,1430)/gb |
| 68E12 | 1757 | 2052 | L25124 | Hs.199248 | 1.00E−156 | 2 | prostaglandin E2 receptor mRNA, complete cds/ |
| 484H3 | 1879 | 1958 | NM_000958 | Hs.199248 | 3.00E−33 | 1 | prostaglandin E receptor 4 (subtype EP4) (PTGE |
| 466G6 | 368 | 3287 | NM_013233 | Hs.199263 | 0 | 2 | Ste-20 related kinase (SPAK), mRNA/cds = (173,1 |
| 464B9 | 633 | 1068 | AF015041 | Hs.199291 | 0 | 1 | NUMB-R protein (NUMB-R) mRNA, complete cds/c |
| 522F9 | 2 | 116 | AI669591 | Hs.200442 | 5.00E−59 | 1 | tw34b09.x1 cDNA, 3' end/clone = IMAGE: 2261561 |
| 60F11 | 4945 | 5114 | AB040942 | Hs.201500 | 7.00E−92 | 1 | for KIAA1509 protein, partial cds/cds = (0 |
| 72D12 | 819 | 1293 | AF104398 | Hs.201673 | 0 | 1 | comichon mRNA, complete cds/cds = (56,490)/g |
| 105G5 | 1629 | 2130 | AF091263 | Hs.201675 | 0 | 1 | RNA binding motif protein 5 (RBM5) mRNA, comple |
| 116G3 | 1637 | 2854 | NM_005778 | Hs.201675 | 0 | 2 | RNA binding motif protein 5 (RBM5), mRNA/cds = ( |
| 40A10 | 254 | 431 | AI693179 | Hs.201789 | 5.00E−85 | 1 | wd68d12.x1 cDNA, 3' end/clone = IMAGE: 2336759 |
| 473D4 | 421 | 547 | BE551203 | Hs.201792 | 3.00E−49 | 1 | 7b55h12.x1 cDNA, 3' end/clone = IMAGE: 3232199 |
| 472D8 | 313 | 623 | AW390251 | Hs.202402 | 1.00E−123 | 1 | CM4-ST0182-051099-021-b06 cDNA/gb = AW390251 |
| 66H5 | 176 | 482 | AI271437 | Hs.203041 | 1.00E−173 | 1 | qi19c05.x1 cDNA, 3' end/clone = IMAGE: 1856936 |
| 594C2 | 35 | 368 | AW131782 | Hs.203606 | 1.00E−147 | 2 | xf34e08.x1 cDNA, 3' end/clone = IMAGE: 2619974 |
| 138B12 | 101 | 420 | AW194379 | Hs.203755 | 1.00E−93 | 3 | xm08h07.x1 3' end/clone = IMAGE: 2683645 |
| 473D3 | 1 | 234 | AI538474 | Hs.203784 | 1.00E−117 | 1 | td06h08.x1 cDNA, 3' end/clone = IMAGE: 2074911 |
| 471A5 | 113 | 442 | AI393908 | Hs.203829 | 1.00E−153 | 1 | tg05f10.x1 cDNA, 3' end/clone = IMAGE: 2107915 |
| 40A4 | 1621 | 2037 | AF004230 | Hs.204040 | 0 | 1 | monocyte/macrophage Ig-related receptor MIR |
| 463H1 | 7 | 319 | AW977671 | Hs.204214 | 1.00E−161 | 1 | EST389900 cDNA/gb = AW977671/gi = 8169049/ug = |
| 478E7 | 25 | 434 | AI762023 | Hs.204610 | 0 | 2 | wh89f04.x1 cDNA, 3' end/clone = IMAGE: 2387935 |
| 55E11 | 324 | 469 | AI741246 | Hs.204656 | 100E−58 | 12 | wg26g09.x1 cDNA, 3' end/clone = IMAGE: 2366272 |
| 478G10 | 345 | 476 | AI760901 | Hs.204703 | 9.00E−34 | 1 | wi09h06.x1 cDNA, 3' end/clone = IMAGE: 2389787 |
| 470E11 | 374 | 507 | AI762741 | Hs.204707 | 2.00E−49 | 1 | wh93h02.x1 cDNA, 3' end/clone = IMAGE: 2388339 |
| 478F5 | 179 | 437 | AI086035 | Hs.204873 | 1.00E−110 | 1 | oy70h04.x1 cDNA, 3' end/clone = IMAGE: 1671223 |
| 464G4 | 33 | 320 | AI749444 | Hs.204929 | 5.00E−50 | 1 | at24c03.x1 cDNA, 3' end/clone = IMAGE: 2356036 |
| 472D2 | 88 | 198 | AI760018 | Hs.205071 | 4.00E−54 | 1 | wh83b02.x1 cDNA, 3' end/clone = IMAGE: 2387307 |
| 470D9 | 5 | 422 | AW976641 | Hs.205079 | 0 | 1 | EST388750 cDNA/gb = AW976641/gi = 8167872/ug = |
| 470D4 | 122 | 500 | AA885473 | Hs.205175 | 0 | 1 | am10c12.s1 cDNA, 3' end/clone = IMAGE: 1466422 |
| 473C5 | 285 | 525 | BF679831 | Hs.205319 | 2.00E−96 | 1 | 602154415F1 cDNA, 5' end/clone = IMAGE: 4295595 |
| 470E7 | 295 | 521 | AI762557 | Hs.205327 | 9.00E−95 | 2 | wh92f07.x1 cDNA, 3' end/clone = IMAGE: 2388229 |
| 478F11 | 11 | 447 | AI761141 | Hs.205452 | 0 | 3 | wh97g08.x1 cDNA, 3' end/clone = IMAGE: 2388734 |
| 459A12 | 111 | 323 | N72600 | Hs.205555 | 9.00E−96 | 1 | za46f08.s1 cDNA, 3' end/clone = IMAGE: 295623/ |
| 470F4 | 214 | 481 | AW977820 | Hs.205675 | 1.00E−131 | 1 | EST389824 cDNA/gb = AW977820/gi = 8168971/ug = |
| 102G3 | 1 | 249 | BF680988 | Hs.205696 | 2.00E−78 | 1 | 602156272F1 cDNA, 5' end/clone = IMAGE: 4297216 |
| 472B2 | 312 | 700 | BF794256 | Hs.206761 | 0 | 1 | 602255454F1 cDNA, 5' end/clone = IMAGE: 4338949 |
| 470C1 | 1113 | 1643 | AK024118 | Hs.206868 | 0 | 1 | cDNA FLJ14056 fis, clone HEMBB1000335/cds = UNK |
| 469H7 | 1076 | 1215 | U15177 | Hs.206984 | 3.00E−69 | 1 | cosmid CRI-JC2015 at D10S289 in 10sp13/ cds = (0,1214) |
| 61F9 | 5 | 181 | AW340421 | Hs.207995 | 4.00E−94 | 1 | hc96h02.x1 cDNA, 3' end/clone = IMAGE: 2907891 |
| 473C2 | 239 | 551 | BF439675 | Hs.208854 | 1.00E−151 | 1 | nab69e11.x1 cDNA/clone = IMAGE/gb = BF439675/ |
| 62G11 | 159 | 292 | BE781611 | Hs.208985 | 1.00E−60 | 1 | 601467463F1 cDNA, 5' end/clone = IMAGE: 3870902 |
| 472E2 | 258 | 554 | AI343473 | Hs.209203 | 1.00E−135 | 1 | tb97a08.x1 cDNA, 3' end/clone = IMAGE: 2062262 |
| 471C10 | 148 | 498 | AI768880 | Hs.209511 | 0 | 1 | wh71e04.x1 cDNA, 3' end/clone = IMAGE: 2386206 |
| 470G9 | 416 | 561 | AI798144 | Hs.209609 | 4.00E−63 | 1 | wh81g12.x1 cDNA, 3' end/clone = IMAGE: 2387206 |
| 478C10 | 120 | 447 | AI809310 | Hs.210385 | 1.00E−158 | 2 | wh75h08.x1 cDNA, 3' end/clone = IMAGE: 2386623 |
| 476B7 | 64 | 341 | AI075288 | Hs.210727 | 1.00E−151 | 2 | oy69h10.x1 cDNA, 3' end/clone = IMAGE: 1671139 |
| 477G4 | 915 | 1541 | AB040919 | Hs.210958 | 0 | 1 | mRNA for KIAA1486 protein, partial cds/cds = (1 |
| 468C2 | 215 | 498 | AI832182 | Hs.210995 | 1.00E−145 | 1 | td13h11.x1 cDNA, 3' end/clone = IMAGE: 2075589 |
| 472D11 | 1 | 300 | AI860120 | Hs.211024 | 1.00E−126 | 1 | wh39e01.x1 cDNA, 3' end/clone = IMAGE: 2383128 |
| 470D3 | 30 | 317 | AW362304 | Hs.211194 | 1.00E−137 | 1 | CM3-CT0275-031199-031-a08 cDNA/gb = AW362304 |
| 179F6 | 105 | 551 | AI823649 | Hs.211535 | 0 | 1 | wi85g03.x1 3' end/clone = IMAGE: 2400148 |
| 477G12 | 2439 | 4050 | NM_020993 | Hs.211563 | 0 | 4 | B-cell CLL/lymphoma 7A (BCL7A), mRNA/cds = (953 |
| 39A11 | 5178 | 5792 | L10717 | Hs.211576 | 0 | 2 | T cell-specific tyrosine kinase mRNA, complete |
| 187B9 | 5365 | 5790 | NM_005546 | Hs.211576 | 0 | 1 | IL2-inducible T-cell kinase (ITK), mRNA/cds = |
| 152C2 | 3965 | 4297 | Z22551 | Hs.211577 | 1.00E−174 | 1 | kinectin gene/cds = (69,4139)/gb = Z22551/gi = 296 |
| 120A2 | 2556 | 2917 | NM_005955 | Hs.211581 | 0 | 1 | metal-regulatory transcription factor 1 (MTF |
| 147A2 | 2915 | 4407 | M59465 | Hs.211600 | 0 | 6 | tumor necrosis factor alpha inducible protein A20 mRN |
| 583B12 | 2404 | 3981 | NM_006290 | Hs.211600 | 0 | 11 | tumor necrosis factor, alpha-induced protein |
| 589F3 | 1905 | 2274 | AF090693 | Hs.211610 | 0 | 1 | apoptosis-related RNA binding protein (NAPOR- |
| 470G11 | 277 | 462 | AI862623 | Hs.211744 | 5.00E−99 | 1 | wh99h10.x1 cDNA, 3' end/clone = IMAGE: 2388931 |
| 473F2 | 195 | 423 | BE675092 | Hs.211828 | 2.00E−95 | 1 | 7f02d07.x1 cDNA, 3' end/clone = IMAGE: 3293485 |
| 517D2 | 1059 | 1366 | BC000747 | Hs.211973 | 1.00E−162 | 2 | Similar to homolog of Yeast RRP4 (ribosomal RN |
| 109D9 | 391 | 533 | AI922921 | Hs.212553 | 2.00E−68 | 1 | wn81c05.x1 cDNA, 3' end/clone = IMAGE: 2452232 |
| 494H12 | 172 | 549 | AI912585 | Hs.213385 | 0 | 3 | we11d07.x1 cDNA, 3' end/clone = IMAGE: 2340781 |
| 596G11 | 4740 | 5687 | AB007916 | Hs.214646 | 0 | 8 | mRNA for KIAA0447 protein, partial cds/cds = (2 |
| 104C12 | 843 | 1787 | AL031282 | Hs.215595 | 0 | 2 | DNA sequence from clone 283E3 on chromosome 1p36.21–36 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 124F8 | 1391 | 2913 | NM_002074 | Hs.215595 | 0 | 4 | guanine nucleotide binding protein (G protein) |
| 157E8 | 1264 | 1627 | AK001548 | Hs.215766 | 0 | 4 | FLJ10686 fis, clone NT2RP3000252, highly |
| 519G3 | 1729 | 2094 | NM_012341 | Hs.215766 | 0 | 1 | GTP-binding protein (NGB), mRNA/cds = (23,1924 |
| 473E7 | 2278 | 2472 | AB022663 | Hs.215857 | 3.00E−52 | 1 | HFB30 mRNA, complete cds/cds = (236,1660)/gb = |
| 104F7 | 4 | 1324 | D00017 | Hs.217493 | 0 | 3 | for lipocortin II, complete cds/cds = (49,1 |
| 58G2 | 11 | 1324 | NM_004039 | Hs.217493 | 0 | 7 | annexin A2 (ANXA2), mRNA/cds = (49,1068)/gb = N |
| 467D4 | 27 | 443 | AI392814 | Hs.221014 | 1.00E−180 | 1 | tg10a02.x1 cDNA, 3' end/clone = IMAGE: 2108330 |
| 463B1 | 69 | 457 | AV686223 | Hs.221642 | 0 | 1 | AV686223 cDNA, 5' end/clone = GKCGXH11/clone_ |
| 464D10 | 295 | 552 | BF058398 | Hs.221695 | 1.00E−115 | 1 | 7k30d01.x1 cDNA, 3' end/clone = IMAGE: 3476785 |
| 466C12 | 1 | 427 | AI540165 | Hs.222186 | 0 | 1 | td10d05.x1 cDNA, 3' end/clone = IMAGE: 2075241 |
| 125H10 | 2596 | 2917 | AB046830 | Hs.222746 | 0 | 1 | mRNA for KIAA1610 protein, partial cds/cds = (0 |
| 473C4 | 1 | 193 | BF435098 | Hs.222833 | 9.00E−72 | 1 | 7p05g01.x1 cDNA, 3' end/clone = IMAGE: 3645097 |
| 37B4 | 18 | 371 | AW389509 | Hs.223747 | 1.00E−147 | 1 | CM3-ST0163-051099-019-b11/gb = AW389509 |
| 470H7 | 106 | 357 | AI766706 | Hs.223935 | 1.00E−116 | 1 | wi02g11.x1 cDNA, 3' end/clone = IMAGE: 2389124 |
| 472D12 | 1 | 370 | AL133721 | Hs.224680 | 0 | 1 | DKFZp761H09121_r1 cDNA, 5' end/clone = DKFZp76 |
| 124E4 | 53 | 208 | AI874107 | Hs.224760 | 7.00E−50 | 3 | wm49b01.x1 cDNA, 3' end/clone = IMAGE: 2439241 |
| 477G3 | 146 | 412 | AI400714 | Hs.225567 | 1.00E−141 | 1 | tg93g12.x1 cDNA, 3' end/clone = IMAGE: 2116390 |
| 112F12 | 2313 | 2799 | AL163279 | Hs.225674 | 0 | 1 | chromosome 21 segment HS21C079/cds = (0,6888) |
| 118D12 | 6187 | 6775 | NM_015384 | Hs.225767 | 0 | 1 | IDN3 protein (IDN3), mRNA/cds = (706,7182)/gb |
| 109B7 | 2208 | 3315 | AF119417 | Hs.225939 | 0 | 2 | nonfunctional GM3 synthase mRNA, alternativel |
| 125A8 | 2877 | 3381 | NM_006999 | Hs.225951 | 0 | 1 | topoisomerase-related function protein 4-1 |
| 129C8 | 5510 | 5893 | AF012108 | Hs.225977 | 0 | 1 | Amplified in Breast Cancer (AIB1) mRNA, comple |
| 39G12 | 4498 | 4859 | NM_014977 | Hs.227133 | 1.00E−93 | 2 | KIAA0670 protein/acinus (KIAA0670), mRNA/cd |
| 153D10 | 1 | 286 | AF000145 | Hs.227400 | 1.00E−139 | 2 | germinal center kinase related protein kinase |
| 464B12 | 901 | 1425 | AL050131 | Hs.227429 | 0 | 1 | mRNA; cDNA DKFZp586I111 (from clone DKFZp586I1 |
| 459D9 | 3828 | 4314 | NM_004841 | Hs.227806 | 0 | 1 | ras GTPase activating protein-like (NGAP), mR |
| 135E9 | 135 | 773 | NM_004049 | Hs.227817 | 0 | 1 | BCL2-related protein A1 (BCL2A1), mRNA/cds = ( |
| 59F10 | 123 | 808 | Y09397 | Hs.227817 | 0 | 12 | GRS protein/cds = (102,629)/gb = Y09397/ |
| 516H4 | 1901 | 2462 | NM_014287 | Hs.227823 | 0 | 1 | pM5 protein (PM5), mRNA/cds = (0,3668)/gb = NM_0 |
| 107C12 | 2776 | 3390 | Y15906 | Hs.227913 | 0 | 1 | for XAGL protein/cds = (132,1646)/gb = Y159 |
| 152C7 | 171 | 1390 | AF052155 | Hs.227949 | 0 | 2 | clone 24761 mRNA sequence/cds = UNKNOWN/gb = AF |
| 522G8 | 108 | 293 | AI917348 | Hs.228486 | 2.00E−70 | 1 | ts83d10.x1 cDNA, 3' end/clone = IMAGE: 2237875 |
| 66C7 | 304 | 445 | AI094726 | Hs.228795 | 1.00E−26 | 1 | qa08f05.x1 cDNA, 3' end/clone = IMAGE: 1686177 |
| 585D1 | 51 | 294 | AI199388 | Hs.228817 | 5.00E−73 | 1 | qs75e05.x1 cDNA, 3' end/clone = IMAGE: 1943936 |
| 468E9 | 113 | 324 | AI523873 | Hs.228926 | 7.00E−77 | 2 | tg97c12.x1 cDNA, 3' end/clone = IMAGE: 2116726 |
| 466F1 | 44 | 139 | AI380491 | Hs.229374 | 3.00E−39 | 2 | tf95b10.x1 cDNA, 3' end/clone = IMAGE: 2107003 |
| 182F1 | 40 | 465 | AI354231 | Hs.229385 | 1.00E−138 | 4 | qv12c04.x1 cDNA, 3' end/clone = IMAGE: 1981350 |
| 465C1 | 237 | 318 | AW812896 | Hs.229868 | 3.00E−38 | 1 | RC3-ST0186-250200-018-a11 cDNA/gb = AW812896 |
| 178H7 | 42 | 353 | AI581732 | Hs.229918 | 1.00E−68 | 5 | ar74f03.x1 cDNA, 3' end/clone = IMAGE: 2128349 |
| 72H6 | 48 | 534 | AI818777 | Hs.229990 | 1.00E−85 | 3 | wl11f10.x1 cDNA, 3' end/clone = IMAGE: 2424619 |
| 181E9 | 52 | 279 | AI827451 | Hs.229993 | 1.00E−66 | 1 | wl17d11.x1 cDNA, 3' end/clone = IMAGE: 2425173 |
| 38H1 | 225 | 311 | AI579979 | Hs.230430 | 1.00E−25 | 1 | tq45a01.x1 cDNA, 3' end/clone = IMAGE: 2211720 |
| 489G11 | 66 | 369 | AI818596 | Hs.230492 | 1.00E−112 | 5 | wk74d04.x1 cDNA, 3' end/clone = IMAGE: 2421127 |
| 118D6 | 40 | 161 | AI025427 | Hs.230752 | 6.00E−37 | 1 | ow27g06.s1 cDNA, 3' end/clone = IMAGE: 1648090 |
| 462H6 | 305 | 437 | AI087055 | Hs.230805 | 3.00E−67 | 1 | oy70c09.x1 cDNA, 3' end/clone = IMAGE: 1671184 |
| 107C11 | 93 | 240 | AI796419 | Hs.230939 | 1.00E−40 | 1 | wj17f02.x1 cDNA, 3' end/clone = IMAGE: 2403099 |
| 591A1 | 65 | 316 | AA767883 | Hs.231154 | 7.00E−59 | 4 | oa30h07.s1 cDNA, 3' end/clone = IMAGE: 1306525 |
| 471B3 | 177 | 519 | BE407125 | Hs.231510 | 1.00E−166 | 1 | 601301818F1 cDNA, 5' end/clone = IMAGE: 3636412 |
| 64G11 | 609 | 950 | AL542592 | Hs.231816 | 1.00E−166 | 1 | AL542592 cDNA/clone = CS0DE012YA05-(5-prime) |
| 108G1 | 1 | 210 | AW006867 | Hs.231987 | 1.00E−109 | 1 | ws15d07.x1 cDNA, 3' end/clone = IMAGE: 2497261 |
| 115F3 | 44 | 185 | AW016002 | Hs.232000 | 7.00E−75 | 2 | UI-H-BI0p-abh-h-06-0-UI.s1 cDNA, 3' end/clo |
| 138A6 | 4771 | 5194 | D15050 | Hs.232068 | 0 | 1 | transcription factor AREB6, complete cds/cd |
| 472A6 | 311 | 497 | BF195579 | Hs.232257 | 1.00E−78 | 1 | 7n85c03.x1 cDNA, 3' end/clone = IMAGE: 3571205 |
| 111A7 | 285 | 463 | AW026667 | Hs.233261 | 1.00E−41 | 1 | wv15d09.x1 cDNA, 3' end/clone = IMAGE: 2529617 |
| 67G8 | 292 | 560 | BE719483 | Hs.233383 | 4.00E−94 | 3 | MR1-HT0858-020800-001-c06/gb = BE719483 |
| 123B11 | 180 | 351 | AW006045 | Hs.233560 | 5.00E−82 | 1 | wz81b09.x1 cDNA, 3' end/clone = IMAGE: 2565209 |
| 472E3 | 1 | 319 | AW027530 | Hs.233564 | 1.00E−180 | 1 | wv74c06.x1 cDNA, 3' end/clone-IMAGE: 2535274 |
| 36F11 | 943 | 1896 | Z85996 | Hs.233750 | 0 | 6 | DNA sequence from PAC 431A14 on chromosome 6p21. Conta |
| 184G6 | 49 | 491 | BF694761 | Hs.233936 | 0 | 9 | 602080851F2 cDNA, 5' end/clone = IMAGE: 4245133 |
| 599C7 | 12 | 540 | NM_006471 | Hs.233936 | 0 | 55 | myosin, light polypeptide, regulatory, non-s |
| 156B4 | 405 | 774 | AF054185 | Hs.233952 | 1.00E−164 | 1 | proteasome subunit HSPC complete cds/c |
| 595G5 | 85 | 315 | NM_002792 | Hs.233952 | 1.00E−126 | 1 | proteasome (prosome, macropain) subunit, alp |
| 67F5 | 108 | 556 | AK000654 | Hs.234149 | 0 | 1 | FLJ20647 fis, clone KAT02147/cds = (90,836 |
| 591B6 | 1 | 555 | NM_017918 | Hs.234149 | 0 | 6 | hypothetical protein FLJ20647 (FLJ20647), mR |
| 111B7 | 1887 | 2217 | AK023204 | Hs.234265 | 1.00E−120 | 1 | cDNA FLJ13142 fis, clone NT2RP3003212, modera |
| 72F6 | 314 | 2581 | AL035071 | Hs.234279 | 0 | 2 | DNA sequence from clone 1085F17 on chromosome 20q11.1 |
| 514H4 | 2105 | 2523 | NM_012325 | Hs.234279 | 0 | 1 | microtubule-associated protein, RP/EB family |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 599A10 | 1 | 1163 | NM_002300 | Hs.234489 | 0 | 30 | lactate dehydrogenase B (LDHB), mRNA/cds = (84 |
| 163A8 | 470 | 1153 | X13794 | Hs.234489 | 0 | 4 | lactate dehydrogenase B gene exon 1 and (EC 1.1.1. |
| 125E5 | 31 | 465 | NM_000978 | Hs.234518 | 1.00E−117 | 2 | ribosomal protein L23 (RPL23), mRNA/cds = (25,4 |
| 471B1 | 1499 | 2033 | L05148 | Hs.234569 | 0 | 1 | protein tyrosine kinase related mRNA sequence/ cds = UN |
| 466D7 | 1050 | 1402 | NM_013451 | Hs.234680 | 0 | 1 | fer-1 (C.elegans)-like 3 (myoferlin) (FER1L3) |
| 108B11 | 407 | 742 | X14008 | Hs.234734 | 0 | 1 | lysozyme gene (EC 3.2.1.17)/cds = (82,474)/ gb = X14008 |
| 476A12 | 3 | 440 | AI076222 | Hs.235042 | 0 | 2 | oy65b09.x1 cDNA, 3' end/clone = IMAGE: 1670681 |
| 464H7 | 994 | 2425 | AL157426 | Hs.235390 | 1.00E−22 | 1 | mRNA; cDNA DKFZp761B101 (from clone DKFZp761B1 |
| 472F2 | 2203 | 2431 | AK024137 | Hs.235498 | 7.00E−97 | 1 | cDNA FLJ14075 fis, clone HEMBB1001905, weakly |
| 63C7 | 1159 | 1751 | AK000260 | Hs.235712 | 0 | 1 | FLJ20253 fis, clone COLF6895/cds = UNKNOWN |
| 73C8 | 39 | 485 | AI379474 | Hs.235823 | 0 | 1 | tc57g08.x1 cDNA, 3' end/clone = IMAGE: 2068766 |
| 590H8 | 182 | 449 | AA020845 | Hs.235883 | 1.00E−145 | 3 | ze64a07.r1 cDNA, 5' end/clone = IMAGE: 363732/ |
| 182H3 | 468 | 2009 | NM_001535 | Hs.235887 | 1.00E−119 | 5 | HMT1 (hnRNP methyltransferase, S. cerevisiae) |
| 119B12 | 253 | 596 | NM_003075 | Hs.236030 | 0 | 1 | SWI/SNF related, matrix associated, actin dep |
| 461C5 | 654 | 1112 | AK026410 | Hs.236449 | 0 | 1 | cDNA: FLJ22757 fis, clone KAIA0803/cds = (92,24 |
| 182G3 | 514 | 2817 | AK023223 | Hs.236494 | 0 | 2 | FLJ13161 fis, clone NT2RP3003589, highly |
| 469G7 | 857 | 1336 | AK026359 | Hs.236744 | 0 | 1 | cDNA: FLJ22706 fis, clone HSI13163/cds = UNKNOW |
| 592A9 | 1522 | 1888 | NM_020135 | Hs.236828 | 0 | 1 | putative helicase RUVBL (LOC56897), mRNA/cds |
| 177A1 | 1260 | 1704 | AK001514 | Hs.236844 | 1.00E−170 | 1 | FLJ10652 fis, clone NT2RP2005886/cds = (50 |
| 594G2 | 916 | 1537 | NM_018169 | Hs.236844 | 0 | 2 | hypothetical protein FLJ10652 (FLJ10652), mR |
| 98D10 | 1881 | 1964 | NM_006947 | Hs.237825 | 9.00E−36 | 1 | signal recognition particle 72 kD (SRP72), mRN |
| 72C7 | 36 | 1214 | M29696 | Hs.237868 | 0 | 2 | interleukin-7 receptor (IL-7) mRNA, complete cds/cd |
| 591B10 | 577 | 1658 | NM_002185 | Hs.237868 | 0 | 9 | interleukin 7 receptor (IL7R), mRNA/cds = (22,1 |
| 109G2 | 16 | 405 | AF116682 | Hs.238205 | 0 | 1 | PRO2013 mRNA, complete cds/cds = (135,380)/gb |
| 41E1 | 2163 | 2733 | U60805 | Hs.238648 | 0 | 1 | oncostatin-M specific receptor beta subunit (OSMRB) |
| 599C11 | 508 | 1734 | AK026110 | Hs.238707 | 0 | 5 | cDNA: FLJ22457 fis, clone HRC09925/cds = (56,14 |
| 143E8 | 2 | 595 | AV700542 | Hs.238730 | 1.00E−177 | 6 | AV700542 cDNA, 3' end/clone = GKCAFD05/clone_ |
| 596C11 | 77 | 658 | AW955090 | Hs.238954 | 0 | 5 | EST367160 cDNA/gb = AW955090/gi = 8144773/ug = |
| 169C7 | 1371 | 1634 | AY004255 | Hs.238990 | 1.00E−148 | 1 | cdk inhibitor p27KIP1 mRNA, complete cds/cds = |
| 173C1 | 1599 | 1859 | BC001971 | Hs.238990 | 1.00E−146 | 1 | Similar to cyclin-dependent kinase inhibitor |
| 458B5 | 1539 | 1809 | AL136828 | Hs.238996 | 1.00E−131 | 1 | mRNA; cDNA DKFZp434K0427 (from clone DKFZp434K |
| 591H9 | 6104 | 6559 | AL157902 | Hs.239114 | 0 | 1 | DNA sequence from clone RP4-675C20 on chromosome 1p13 |
| 512G4 | 231 | 2376 | NM_005746 | Hs.239138 | 0 | 61 | pre-B-cell colony-enhancing factor (PBEF), m |
| 53D11 | 935 | 2053 | U02020 | Hs.239138 | 0 | 15 | pre-B cell enhancing factor (PBEF) mRNA, complete cds |
| 38B7 | 2187 | 2263 | AK025021 | Hs.239189 | 1.00E−36 | 1 | FLJ21368 fis, clone COL03056, highly sim |
| 458E10 | 90 | 622 | NM_016533 | Hs.239208 | 0 | 1 | ninjurin 2 (NINJ2), mRNA/cds = (56,484)/gb = NM |
| 184G10 | 1608 | 2056 | AK026535 | Hs.239307 | 0 | 1 | FLJ22882 fis, clone KAT03587, highly sim |
| 194D9 | 1544 | 1683 | NM_003680 | Hs.239307 | 4.00E−57 | 1 | tyrosyl-tRNA synthetase (YARS), mRNA/cds = (0, |
| 110C7 | 450 | 1216 | AF246221 | Hs.239625 | 0 | 4 | transmembrane protein BRI mRNA, complete cds |
| 599G9 | 446 | 1205 | NM_021999 | Hs.239625 | 0 | 13 | integral membrane protein 2B (ITM2B), mRNA/cd |
| 515E4 | 1404 | 1671 | NM_014515 | Hs.239720 | 1.00E−132 | 1 | CCR4-NOT transcription complex, subunit 2 (C |
| 115H10 | 1124 | 2079 | BC000105 | Hs.239760 | 0 | 2 | Similar to CG14740 gene product, clone MGC: 25 |
| 466E3 | 605 | 923 | NM_005301 | Hs.239891 | 1.00E−164 | 2 | G protein-coupled receptor 35 (GPR35), mRNA/ |
| 52B5 | 993 | 1243 | AJ223075 | Hs.239894 | 1.00E−106 | 1 | for TRIP protein/cds = (178,2532)/gb = AJ22 |
| 171E10 | 88 | 399 | AW002624 | Hs.240077 | 1.00E−145 | 1 | wu60d10.x1 cDNA, 3' end/clone = IMAGE: 990854/ |
| 75C5 | 325 | 1604 | AK027191 | Hs.240443 | 0 | 8 | FLJ23538 fis, clone LNG08010, highly sim |
| 597D3 | 1134 | 1792 | BC001255 | Hs.240770 | 0 | 1 | nuclear cap binding protein subunit 2, 20 kD, |
| 98A11 | 596 | 6834 | NM_005385 | Hs.241493 | 0 | 10 | natural killer-tumor recognition sequence (N |
| 98C10 | 1580 | 2204 | AK027187 | Hs.241507 | 0 | 40 | cDNA: FLJ23534 fis, clone LNG06974, highly sim |
| 463E8 | 324 | 846 | AF047002 | Hs.241520 | 0 | 1 | transcriptional coactivator ALY mRNA, partia |
| 514G6 | 802 | 1238 | NM_012392 | Hs.241531 | 0 | 3 | peflin (PEF), mRNA/cds = (12,866)/gb = NM_01239 |
| 177G4 | 1375 | 1887 | AF099149 | Hs.241558 | 0 | 1 | TRIAD1 type I mRNA, complete cds/cds = (144,1625 |
| 110E4 | 1320 | 1937 | AK021704 | Hs.241567 | 0 | 1 | FLJ11642 fis, clone HEMBA 1004356, highly |
| 513B12 | 700 | 1447 | NM_016839 | Hs.241567 | 0 | 3 | RNA binding motif, single stranded interacting |
| 500G10 | 910 | 1249 | NM_000594 | Hs.241570 | 0 | 1 | tumor necrosis factor (TNF superfamily, membe |
| 514B6 | 735 | 1032 | NM_018630 | Hs.241578 | 1.00E−155 | 1 | hypothetical protein PRO2577 (PRO2577), mRNA |
| 590H9 | 61 | 251 | NM_016200 | Hs.241578 | 1.00E−104 | 1 | U6 snRNA-associated Sm-like protein LSm8 (LOC |
| 50A6 | 200 | 311 | AK026704 | Hs.242868 | 3.00E−57 | 3 | FLJ23051 fis, clone LNG02642/cds = UNKNOW |
| 104C10 | 199 | 353 | AA424812 | Hs.243029 | 2.00E−74 | 1 | zw04b02.s1 cDNA, 3' end/clone = IMAGE: 768267/ |
| 72G4 | 182 | 415 | AW081232 | Hs.243321 | 1.00E−99 | 4 | xc22e08.x1 cDNA, 3' end/clone = IMAGE: 2585030 |
| 521D12 | 32 | 287 | AW102836 | Hs.243457 | 6.00E−96 | 1 | xd38h12.x1 cDNA, 3' end/clone = IMAGE: 2596103 |
| 102F3 | 79 | 157 | W45562 | Hs.243720 | 4.00E−26 | 1 | zc26e07.s1 cDNA, 3' end/clone = IMAGE: 323460/ |
| 56D6 | 193 | 454 | M97856 | Hs.243886 | 1.00E−122 | 1 | histone-binding protein mRNA, complete cds/c |
| 595D8 | 25 | 495 | NM_002482 | Hs.243886 | 0 | 1 | nuclear autoantigenic sperm protein (histone- |
| 46G5 | 2137 | 2661 | AK000745 | Hs.243901 | 0 | 1 | cDNA FLJ20738 fis, clone HEP08257/ |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 477D4 | 141 | 250 | AI394001 | Hs.244666 | 4.00E−51 | 1 | cds = UNKNOWN<br>tg06d04.x1 cDNA, 3' end/clone = IMAGE: 2107975 |
| 139B7 | 50 | 235 | AW078847 | Hs.244816 | 4.00E−32 | 2 | xb18g07.x1 cDNA, 3' end/clone = IMAGE: 2576700 |
| 472C4 | 74 | 464 | AW139918 | Hs.245138 | 0 | 1 | UI-H-BI1-aee-d-05-0-UI.s1 cDNA, 3' end/clon |
| 459F7 | 45 | 229 | AW080951 | Hs.245616 | 7.00E−58 | 1 | xc28c10.x1 cDNA, 3' end/clone = IMAGE: 2585586 |
| 100A6 | 41 | 1795 | L22009 | Hs.245710 | 1.00E−143 | 3 | hnRNP H mRNA, complete cds/cds = (72,1421)/<br>gb = L22009 |
| 592G8 | 41 | 1798 | NM_005520 | Hs.245710 | 0 | 6 | heterogeneous nuclear ribonucleoprotein H1 |
| 71G4 | 382 | 583 | AL136607 | Hs.245798 | 1.00E−104 | 1 | mRNA; cDNA DKFZp564I0422 (from clone DKFZp564 |
| 118B9 | 4495 | 5528 | AK024391 | Hs.246112 | 0 | 4 | cDNA FLJ14329 fis, clone PLACE4000259, highly |
| 471E5 | 148 | 464 | AI568725 | Hs.246299 | 1.00E−177 | 1 | th15a01.x1 cDNA, 3' end/clone = IMAGE: 2118312 |
| 464D11 | 26 | 526 | N28843 | Hs.246358 | 0 | 1 | yx59d10.r1 cDNA, 5' end/clone = IMAGE: 266035/ |
| 40H7 | 550 | 1108 | S57235 | Hs.246381 | 0 | 1 | CD68 = 110 kda transmembrane glycoprotein [human, promonocy |
| 471E12 | 152 | 507 | AW117189 | Hs.246494 | 1.00E−149 | 1 | xd83f08.x1 cDNA, 3' end/clone = IMAGE: 2604231 |
| 479C1 | 47 | 345 | AV739961 | Hs.246796 | 1.00E−140 | 1 | AV739961 cDNA, 5' end/clone = CBFBRA10/clone_ |
| 472C9 | 43 | 400 | BF796642 | Hs.246818 | 0 | 1 | 602259846F1 cDNA, 5' end/clone = IMAGE: 4343171 |
| 47F11 | 2 | 227 | AB015856 | Hs.247433 | 1.00E−123 | 1 | for ATF6, complete cds/cds = (68,2080)/gb |
| 179H9 | 12 | 379 | AL031313 | Hs.247783 | 1.00E−111 | 1 | DNA sequence from clone 581F12 on chromosome Xq21. Co |
| 167A9 | 5 | 352 | Z00013 | Hs.247792 | 1.00E−163 | 5 | H. sapiens germilne gene for the leader peptide and variable |
| 72B8 | 402 | 672 | L15006 | Hs.247824 | 1.00E−139 | 2 | Ig superfamily CTLA-4 mRNA, complete cds/cds = |
| 488H10 | 135 | 672 | NM_005214 | Hs.247824 | 1.00E−146 | 5 | cytotoxic T-lymphocyte-associated protein 4 |
| 188G8 | 1 | 255 | NM_002991 | Hs.247838 | 1.00E−135 | 1 | small inducible cytokine subfamily A (Cys-Cys |
| 153D11 | 401 | 720 | AL049545 | Hs.247877 | 1.00E−133 | 2 | DNA sequence from clone 263J7 on chromosome 6q14.3–15 |
| 44D2 | 42 | 448 | AL035604 | Hs.247894 | 1.00E−133 | 1 | DNA sequence from clone 38C16 on chromosome 6q22.33–2 |
| 180B7 | 10 | 271 | L21961 | Hs.247947 | 4.00E−72 | 1 | Ig rearranged lambda-chain mRNA, subgroup VL3, V-J re |
| 110B11 | 311 | 803 | U08626 | Hs.247984 | 0 | 1 | glutamine synthetase pseudogene/cds = (0,899)/gb = U |
| 74G5 | 361 | 965 | X14798 | Hs.248109 | 0 | 1 | DNA for c-ets-1 proto-oncogene/cds = (278,1603)/gb = |
| 60H10 | 214 | 527 | AW150084 | Hs.248657 | 1.00E−99 | 3 | xg36f03.x1 cDNA, 3' end/clone = IMAGE: 2629661 |
| 64E2 | 329 | 536 | BF512500 | Hs.248689 | 1.00E−112 | 1 | UI-H-BI3-alw-h-10-0-UI.s1 cDNA, 3' end/clon |
| 470C6 | 278 | 470 | AI832183 | Hs.249031 | 1.00E−103 | 1 | wh80g09.x1 cDNA, 3' end/clone = IMAGE: 2387104 |
| 146A9 | 1145 | 1422 | S63912 | Hs.249247 | 1.00E−113 | 1 | D10S102 = FBRNP [human, fetal brain, mRNA, 3043 nt]/cds = (30, |
| 519E8 | 37 | 628 | NM_002136 | Hs.249495 | 0 | 1 | heterogeneous nuclear ribonucleoprotein A1 |
| 458C7 | 2232 | 2520 | NM_000964 | Hs.250505 | 1.00E−163 | 1 | retinoic acid receptor, alpha (RARA), mRNA/cd |
| 476A8 | 1060 | 1601 | AF308285 | Hs.250528 | 0 | 1 | serologically defined breast cancer antigen N |
| 123D7 | 436 | 2077 | AL157499 | Hs.250535 | 1.00E−153 | 3 | mRNA; cDNA DKFZp434N2412 (from clone DKFZp434 |
| 477A10 | 285 | 370 | AW291304 | Hs.250600 | 2.00E−34 | 1 | UI-H-BI2-agg-b-11-0-UI.s1 cDNA, 3' end/clon |
| 172G12 | 726 | 1598 | AF182420 | Hs.250620 | 0 | 6 | MDS019 (MDS019) mRNA, complete cds/cds = (231,1 |
| 167E11 | 11633 | 13714 | NM_016252 | Hs.250646 | 1.00E−180 | 2 | baculoviral IAP repeat-containing 6 (BIRC6), |
| 591E4 | 198 | 714 | NM_002823 | Hs.250655 | 4.00E−99 | 3 | prothymosin, alpha (gene sequence 28) (PTMA), |
| 40D9 | 2289 | 3010 | M95585 | Hs.250692 | 0 | 1 | hepatic leukemia factor (HLF) mRNA, complete cds/cds |
| 110D9 | 2336 | 3259 | NM_003144 | Hs.250773 | 0 | 3 | signal sequence receptor, alpha (translocon-a |
| 166A3 | 1 | 302 | AF103458 | Hs.250806 | 6.00E−93 | 2 | isolate donor N clone N168K immunoglobulin kap |
| 110C12 | 629 | 1228 | M35416 | Hs.250811 | 0 | 1 | GTP-binding protein (RALB) mRNA, complete cds/cds = (1 |
| 458D12 | 1136 | 1714 | AY007158 | Hs.250820 | 0 | 1 | clone CDABP0113 mRNA sequence/cds = UNKNOWN/g |
| 177C5 | 658 | 823 | J02621 | Hs.251064 | 3.00E−32 | 1 | non-histone chromosomal protein HMG-14 mRNA, complet |
| 126A2 | 658 | 1009 | NM_004965 | Hs.251064 | 0 | 3 | high-mobility group (nonhistone chromosomal) |
| 523G1 | 1 | 337 | AE000660 | Hs.251465 | 1.00E−178 | 2 | T-cell receptor alpha delta locus from bases 5 |
| 40G1 | 4 | 781 | X72308 | Hs.251526 | 0 | 3 | for monocyte chemotactic protein-3 (MCP- |
| 188G7 | 1 | 1030 | NM_002789 | Hs.251531 | 0 | 3 | proteasome (prosome, macropain) subunit, alp |
| 61E12 | 578 | 2275 | NM_006537 | Hs.251636 | 0 | 2 | ubiquitin specific protease 3 (USP3), mRNA/cd |
| 38B10 | 995 | 1211 | AK026594 | Hs.251653 | 1.00E−107 | 1 | FLJ22941 fis, clone KAT08078, highly sim |
| 70C3 | 2022 | 2405 | X52142 | Hs.251871 | 0 | 1 | CTP synthetase (EC 6.3.4.2)/cds = (75,1850)/ |
| 177E9 | 49 | 406 | S80990 | Hs.252136 | 1.00E−125 | 2 | ficolin [human, uterus, mRNA, 1736 nt]/<br>cds = (532,1512)/gb |
| 50F8 | 1841 | 2048 | AK026712 | Hs.252259 | 1.00E−114 | 15 | FLJ23059 fis, clone LNG03912/cds = (41,16 |
| 585E12 | 16 | 194 | AI383340 | Hs.252300 | 1.00E−63 | 1 | tc76g05.x1 cDNA, 3' end/clone = IMAGE: 2070584 |
| 181E12 | 22 | 99 | BE963374 | Hs.252338 | 4.00E−30 | 1 | 601657137R1 cDNA, 3' end/clone = IMAGE: 3866193 |
| 477H4 | 290 | 451 | AI524022 | Hs.252359 | 8.00E−87 | 1 | tg99f02.x1 cDNA, 3' end/clone = IMAGE: 2116923 |
| 188G11 | 95 | 700 | NM_007104 | Hs.252574 | 0 | 2 | ribosomal protein L10a (RPL10A), mRNA/cds = (1 |
| 471H9 | 1 | 285 | AV706014 | Hs.252580 | 1.00E−145 | 1 | AV706014 cDNA, 5' end/clone = ADBAOB12/clone_ |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 134F9 | 1358 | 1464 | AL359626 | Hs.252588 | 5.00E−50 | 1 | mRNA; cDNA DKFZp564F172 (from clone DKFZp564F1 |
| 597B10 | 13 | 279 | NM_000981 | Hs.252723 | 1.00E−149 | 28 | ribosomal protein L19 (RPL19), mRNA/cds = (28,6 |
| 120D7 | 962 | 1674 | NM_006054 | Hs.252831 | 0 | 5 | reticulon 3 (RTN3), mRNA/cds = (124,834)/gb = N |
| 593B10 | 102 | 467 | AW191929 | Hs.252989 | 7.00E−93 | 1 | x177c10.x1 cDNA, 3' end/clone = IMAGE: 2680722 |
| 482C11 | 32 | 122 | AW195119 | Hs.253151 | 3.00E−33 | 1 | xn66b07.x1 cDNA, 3' end/clone = IMAGE: 2699413 |
| 472C6 | 34 | 279 | AW204029 | Hs.253384 | 1.00E−137 | 1 | UI-H-BI1-aen-d-02-0-UI.s1 cDNA, 3' end/clon |
| 472D4 | 27 | 440 | AW205624 | Hs.253502 | 0 | 1 | UI-H-BI1-afr-e-01-0-UI.s1 cDNA, 3' end/clon |
| 472D1 | 120 | 362 | BF750565 | Hs.253550 | 1.00E−133 | 1 | RC1-BN0410-261000-014-f11 cDNA/gb = BF750565 |
| 480F11 | 367 | 558 | AW237483 | Hs.253820 | 1.00E−105 | 1 | xm72e01.x1 cDNA, 3' end/clone = IMAGE: 2689752 |
| 472B5 | 35 | 363 | AI432340 | Hs.254006 | 1.00E−169 | 1 | tg54e06.x1 cDNA, 3' end/clone = IMAGE: 2112610 |
| 75E5 | 1 | 904 | M14328 | Hs.254105 | 0 | 5 | alpha enolase mRNA, complete cds/cds = (94,1398)/gb = |
| 592A12 | 1 | 1100 | NM_001428 | Hs.254105 | 0 | 5 | enolase 1, (alpha) (EN01), mRNA/cds = (94,1398) |
| 472D10 | 183 | 414 | AI364936 | Hs.255100 | 1.00E−126 | 1 | qz23c12.x1 cDNA, 3' end/clone = IMAGE: 2027734 |
| 479H9 | 43 | 184 | AW292772 | Hs.255119 | 2.00E−70 | 1 | UI-H-BW0-aij-d-03-0-UI.s1 cDNA, 3' end/clon |
| 480A2 | 18 | 523 | AW293267 | Hs.255178 | 0 | 1 | UI-H-BW0-aii-e-10-0-UI.s1 cDNA, 3' end/clon |
| 480B7 | 16 | 298 | AW293895 | Hs.255249 | 1.00E−116 | 1 | UI-H-BW0-ain-f-10-0-UI.s1 cDNA, 3' end/clon |
| 479H11 | 23 | 202 | AW293955 | Hs.255255 | 3.00E−79 | 1 | UI-H-BW0-aik-d-05-0-UI.s1 cDNA, 3' end/clon |
| 480A4 | 415 | 598 | AW294681 | Hs.255336 | 5.00E−66 | 1 | UI-H-BW0-ail-g-10-0-UI.s1 cDNA, 3' end/clon |
| 480A7 | 223 | 427 | AW294695 | Hs.255339 | 1.00E−103 | 1 | UI-H-BW0-aim-a-02-0-UI.s1 cDNA, 3' end/clon |
| 480A8 | 26 | 338 | BF514247 | Hs.255340 | 1.00E−167 | 1 | UI-H-BW1-ani-h-09-0-UI.s1 cDNA, 3' end/clon |
| 480C12 | 239 | 483 | AW295088 | Hs.255389 | 1.00E−124 | 1 | UI-H-BW0-ait-d-09-0-UI.s1 cDNA, 3' end/clon |
| 480F9 | 1 | 423 | BF531016 | Hs.255390 | 0 | 1 | 602072345F1 cDNA, 5' end/clone = IMAGE: 4215251 |
| 480B3 | 68 | 377 | AW295446 | Hs.255446 | 1.00E−161 | 1 | UI-H-BW0-aip-c-03-0-UI.s1 cDNA, 3' end/clon |
| 460H5 | 44 | 427 | AA455707 | Hs.255452 | 1.00E−161 | 1 | aa22d09.r1 cDNA, 5' end/clone = IMAGE: 814001/ |
| 480B12 | 132 | 212 | AW295664 | Hs.255454 | 7.00E−39 | 1 | UI-H-BW0-aip-g-12-0-UI.s1 cDNA, 3' end/clon |
| 472E7 | 163 | 489 | AI439645 | Hs.255490 | 1.00E−166 | 1 | tc91e08.x1 cDNA, 3' end/clone = IMAGE: 2073542 |
| 480D12 | 84 | 258 | AW296005 | Hs.255492 | 8.00E−90 | 1 | UI-H-BW0-aiu-b-01-0-UI.s1 cDNA, 3' end/clon |
| 480F4 | 34 | 464 | AW296063 | Hs.255501 | 0 | 1 | UI-H-BW0-aiu-g-08-0-UI.s1 cDNA, 3' end/clon |
| 480D5 | 18 | 404 | AW296490 | Hs.255554 | 0 | 2 | UI-H-BW0-aiq-f-08-0-UI.s1 cDNA, 3' end/clon |
| 480E1 | 95 | 379 | AW296532 | Hs.255559 | 1.00E−101 | 1 | UI-H-BW0-aiv-b-07-0-UI.s1 cDNA, 3' end/clon |
| 480E5 | 17 | 326 | AW296545 | Hs.255560 | 1.00E−128 | 1 | UI-H-BW0-aiv-c-11-0-UI.s1 cDNA, 3' end/clon |
| 480F2 | 20 | 330 | AW296730 | Hs.255573 | 1.00E−160 | 1 | UI-H-BW0-aix-f-12-0-UI.s1 cDNA, 3' end/clon |
| 480G7 | 38 | 479 | AW296797 | Hs.255579 | 0 | 1 | UI-H-BW0-ajb-e-07-0-UI.s1 cDNA, 3' end/clon |
| 480C9 | 19 | 274 | AW297339 | Hs.255637 | 1.00E−117 | 1 | UI-H-BW0-air-c-03-0-UI.s1 cDNA, 3' end/clon |
| 480C4 | 70 | 191 | AW297400 | Hs.255647 | 1.00E−49 | 1 | UI-H-BW0-ais-a-05-0-UI.s1 cDNA, 3' end/clon |
| 480G5 | 17 | 242 | AW297522 | Hs.255661 | 2.00E−87 | 1 | UI-H-BW0-aja-e-02-0-UI.s1 cDNA, 3' end/clon |
| 480F10 | 230 | 560 | AW294654 | Hs.255687 | 0 | 1 | UI-H-BW0-ail-d-10-0-UI.s1 cDNA, 3' end/clon |
| 480G9 | 47 | 582 | AW297813 | Hs.255695 | 0 | 1 | UI-H-BW0-aiy-g-09-0-UI.s1 cDNA, 3' end/clon |
| 480G10 | 31 | 453 | AW297827 | Hs.255697 | 0 | 1 | UI-H-BW0-aiy-h-11-0-UI.s1 cDNA, 3' end/clon |
| 482G6 | 16 | 242 | AW339651 | Hs.255927 | 3.00E−78 | 1 | he15g04.x1 cDNA, 3' end/clone = IMAGE: 2919126 |
| 469B11 | 4 | 221 | AW341086 | Hs.256031 | 1.00E−99 | 1 | xz92h04.x1 cDNA, 3' end/clone = IMAGE: 2871703 |
| 140E7 | 2870 | 3589 | M32315 | Hs.256278 | 1.00E−84 | 2 | tumor necrosis factor receptor mRNA, complete cds/cd |
| 189H12 | 2839 | 3294 | NM_001066 | Hs.256278 | 0 | 2 | tumor necrosis factor receptor superfamily, m |
| 99H11 | 83 | 589 | NM_005620 | Hs.256290 | 0 | 4 | S100 calcium-binding protein A11 (calgizzarin |
| 58C7 | 1778 | 2264 | AJ271747 | Hs.256583 | 0 | 1 | partial mRNA for double stranded RNA binding nu |
| 482F4 | 373 | 628 | AV719442 | Hs.256959 | 1.00E−124 | 1 | AV719442 cDNA, 5' end/clone = GLCBNA01/clone_ |
| 482F5 | 8 | 377 | AW440866 | Hs.256961 | 1.00E−179 | 1 | he05f02.x1 cDNA, 3' end/clone = IMAGE: 2918139 |
| 482F8 | 191 | 315 | AW440974 | Hs.256971 | 2.00E−62 | 1 | he06e12.x1 cDNA, 3' end/clone = IMAGE: 2918254 |
| 479E7 | 136 | 567 | AW444482 | Hs.256979 | 0 | 2 | UI-H-BI3-akb-e-05-0-UI.s1 cDNA, 3' end/clon |
| 471H5 | 3 | 432 | AI438957 | Hs.257066 | 0 | 1 | tc89b05.x1 cDNA, 3' end/clone = IMAGE: 2073297 |
| 472G3 | 233 | 617 | AW450350 | Hs.257283 | 0 | 1 | UI-H-BI3-akn-c-01-0-UI.s1 cDNA, 3' end/clon |
| 472G11 | 112 | 338 | AI809475 | Hs.257466 | 1.00E−101 | 1 | wh76d06.x1 cDNA, 3' end/clone = IMAGE: 2386667 |
| 479F7 | 22 | 421 | AW452467 | Hs.257572 | 0 | 1 | UI-H-BI3-als-e-09-0-UI.s1 cDNA, 3' end/clon |
| 479G9 | 95 | 304 | AW452513 | Hs.257579 | 1.00E−81 | 1 | UI-H-BW1-ame-b-03-0-UI.s1 cDNA, 3' end/clon |
| 479F11 | 16 | 329 | AW453021 | Hs.257640 | 1.00E−163 | 1 | UI-H-BW1-ama-c-02-0-UI.s1 cDNA, 3' end/clon |
| 479G4 | 45 | 441 | AW453044 | Hs.257646 | 0 | 1 | UI-H-BW1-ama-e-01-0-UI.s1 cDNA, 3' end/clon |
| 482F9 | 11 | 256 | AW467193 | Hs.257667 | 1.00E−108 | 1 | he07a04.x1 cDNA, 3' end/clone = IMAGE: 2918286 |
| 482G2 | 9 | 271 | AW467400 | Hs.257680 | 1.00E−112 | 1 | he10f11.x1 cDNA, 3' end/clone = IMAGE: 2918637 |
| 482G8 | 108 | 428 | AW467437 | Hs.257682 | 1.00E−177 | 1 | he17d05.x1 cDNA, 3' end/clone = IMAGE: 2919273 |
| 482G12 | 1 | 417 | AW467501 | Hs.257687 | 0 | 1 | he19e06.x1 cDNA, 3' end/clone = IMAGE: 2919490 |
| 482H4 | 39 | 143 | AW467746 | Hs.257695 | 3.00E−51 | 1 | he23d05.x1 cDNA, 3' end/clone = IMAGE: 2919849 |
| 482H6 | 1 | 116 | AW467863 | Hs.257705 | 2.00E−59 | 1 | he27c04.x1 cDNA, 3' end/clone = IMAGE: 2920230 |
| 482H7 | 1 | 321 | AW467864 | Hs.257706 | 1.00E−156 | 1 | he27c05.x1 cDNA, 3' end/clone = IMAGE: 2920232 |
| 482H9 | 1 | 112 | AW467992 | Hs.257709 | 1.00E−47 | 1 | he30b01.x1 cDNA, 3' end/clone = IMAGE: 2920489 |
| 483A2 | 20 | 429 | AW468207 | Hs.257716 | 0 | 1 | he34a12.x1 cDNA, 3' end/clone = IMAGE: 2920894 |
| 483A9 | 11 | 373 | AW468431 | Hs.257727 | 0 | 1 | he37h11.x1 cDNA, 3' end/clone = IMAGE: 2921253 |
| 483B2 | 2 | 241 | AW468621 | Hs.257743 | 1.00E−119 | 1 | he42e03.x1 cDNA, 3' end/clone = IMAGE: 2921692 |
| 75B1 | 157 | 246 | BE531180 | Hs.258494 | 5.00E−44 | 1 | 601278313F1 cDNA, 5' end/clone = IMAGE: 3610443 |
| 585F6 | 2200 | 4106 | AL136549 | Hs.258503 | 0 | 8 | mRNA; cDNA DKFZp761I12121 (from clone |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| | | | | | | | DKFZP761 |
| 169E2 | 5186 | 5415 | U20489 | Hs.258609 | 1.00E−119 | 2 | glomerular epithelial protein 1 (GLEPP1) comple |
| 127A5 | 2142 | 2477 | AB037790 | Hs.258730 | 1.00E−177 | 1 | mRNA for KIAA1369 protein, partial cds/cds = (0 |
| 171B12 | 4202 | 4314 | Y10129 | Hs.258742 | 4.00E−45 | 2 | mybpc3 gene/cds = (33,3857)/gb = Y10129/gi = 20583 |
| 75B7 | 531 | 682 | L14542 | Hs.258850 | 3.00E−81 | 1 | lectin-like type II integral membrane protein (NKG2-E |
| 471G5 | 344 | 473 | AI144328 | Hs.259084 | 3.00E−61 | 1 | oy84g04.x1 cDNA, 3' end/clone = IMAGE: 1672566 |
| 479B7 | 73 | 307 | AF161364 | Hs.259683 | 1.00E−123 | 1 | HSPC101 mRNA, partial cds/cds = (0,556)/gb = AF |
| 146B11 | 1942 | 2174 | AL136842 | Hs.260024 | 8.00E−92 | 1 | DKFZp434A0530 (from clone DKFZp434A |
| 584A1 | 1085 | 1470 | AL022398 | Hs.261373 | 1.00E−166 | 1 | DNA sequence from PAC 434O14 on chromosome 1q32 |
| 148B1 | 119 | 817 | X60656 | Hs.261802 | 0 | 2 | elongation factor 1-beta/cds = (95,772) |
| 60G3 | 203 | 3170 | NM_001634 | Hs.262476 | 0 | 15 | S-adenosylmethionine decarboxylase 1 (AMD1) |
| 462E7 | 292 | 374 | AW300868 | Hs.262789 | 8.00E−40 | 1 | xk07d09.x1 cDNA, 3' end/clone = IMAGE: 2666033 |
| 56F11 | 33 | 234 | BF243724 | Hs.263414 | 4.00E−82 | 1 | 601877832F1 cDNA, 5' end/clone = IMAGE: 4106359 |
| 119C5 | 2414 | 2664 | NM_002108 | Hs.263435 | 1.00E−137 | 1 | histidine ammonia-lyase (HAL), mRNA/cds(297 |
| 105A4 | 3225 | 3775 | AK025774 | Hs.264190 | 0 | 3 | FLJ22121 fis, clone HEP18876, highly sim |
| 469H1 | 369 | 576 | AI380111 | Hs.264298 | 1.00E−103 | 1 | tf98a11.x1 cDNA, 3' end/clone = IMAGE: 2107292 |
| 181A3 | 2434 | 2768 | NM_002535 | Hs.264981 | 1.00E−148 | 2 | 2'-5'oligoadenylate synthetase 2 (OAS2), tra |
| 41B7 | 3209 | 3885 | M59911 | Hs.265829 | 0 | 1 | integrin alpha-3 chain mRNA, complete cds/ cds = (73,32 |
| 75F9 | 264 | 452 | AW150944 | Hs.265838 | 2.00E−96 | 1 | xg42e09.x1 cDNA, 3' end/clone = IMAGE: 2630248 |
| 99C3 | 2684 | 3155 | AK000680 | Hs.266175 | 0 | 2 | cDNA FLJ20673 fis, clone KAIA4464/cds = (104,14 |
| 598E12 | 2417 | 2894 | AK026669 | Hs.266940 | 0 | 2 | cDNA: FLJ23016 fis, clone LNG00874/cds = UNKNOW |
| 468B6 | 863 | 1515 | NM_016569 | Hs.267182 | 0 | 1 | TBX3-iso protein (TBX3-iso), mRNA/cds = (116,1 |
| 115E11 | 1234 | 1713 | AF271994 | Hs.267288 | 0 | 1 | dopamine responsive protein DRG-1 mRNA, compl |
| 114A4 | 31 | 382 | NM_024095 | Hs.267400 | 1.00E−179 | 1 | hypothetical protein MGC5540 (MGC5540), mRNA |
| 166C7 | 1315 | 1919 | AK001749 | Hs.267604 | 0 | 2 | FLJ10887 fis, clone NT2RP4002018, weakly |
| 56A8 | 564 | 3624 | AB033054 | Hs.267690 | 0 | 3 | for KIAA1228 protein, partial cds/cds = (0 |
| 70B10 | 229 | 2138 | AK001471 | Hs.268012 | 0 | 3 | FLJ10609 fis, clone NT2RP2005276, highly |
| 178D10 | 1831 | 2796 | NM_012255 | Hs.268555 | 0 | 2 | 5'-3'exoribonuclease 2 (XRN2), mRNA/cds = (68, |
| 168B9 | 451 | 881 | AF068235 | Hs.268763 | 0 | 1 | barrier-to-autointegration factor mRNA, com |
| 465F2 | 91 | 433 | AA613224 | Hs.270264 | 0 | 1 | no19d06.s1 cDNA, 3' end/clone = IMAGE: 1101131 |
| 469E2 | 302 | 422 | BE857296 | Hs.270293 | 1.00E−57 | 1 | 7g27b01.x1 cDNA, 3' end/clone = IMAGE: 3307657 |
| 465D10 | 284 | 405 | AI270476 | Hs.270341 | 4.00E−51 | 1 | qu88e12.x1 cDNA, 3' end/clone = IMAGE: 1979182 |
| 473F10 | 831 | 1096 | AK021517 | Hs.270557 | 1.00E−140 | 1 | cDNA FLJ11455 fis, clone HEMBA1001497/cds = UNK |
| 193A10 | 458 | 563 | AI818951 | Hs.270614 | 5.00E−31 | 1 | wj89e12.x1 cDNA, 3' end/clone = IMAGE: 2410030 |
| 458E11 | 44 | 264 | W03955 | Hs.270717 | 1.00E−118 | 1 | za62d04.r1 cDNA, 5'end/clone = IMAGE: 297127/ |
| 163C12 | 280 | 954 | M30704 | Hs.270833 | 1.00E−168 | 2 | amphiregulin (AR) mRNA, complete cds, clones lambda-A |
| 196F4 | 208 | 567 | NM_001657 | Hs.270833 | 1.00E−158 | 1 | amphiregulin (schwannoma-derived growth fac |
| 464G2 | 378 | 529 | AW172850 | Hs.270999 | 4.00E−77 | 1 | xj04f07.x1 cDNA, 3' end/clone = IMAGE: 2656251 |
| 464F5 | 131 | 476 | AW572930 | Hs.271264 | 0 | 1 | hf17f07.x1 cDNA, 3' end/clone = IMAGE: 2932165 |
| 41G6 | 458 | 880 | Y16645 | Hs.271387 | 0 | 1 | for monocyte chemotactic protein-2/cds = |
| 464F2 | 139 | 220 | AW975086 | Hs.271420 | 2.00E−34 | 1 | EST387192 cDNA/gb = AW975086/gi = 8166291/ug = |
| 178E10 | 961 | 1452 | AK021715 | Hs.271541 | 0 | 1 | cDNA FLJ11653 fis, clone HEMBA1004538/cds = UNK |
| 129E1 | 73 | 441 | NM_016049 | Hs.271614 | 1.00E−136 | 1 | CGI-112 protein (LOC51016), mRNA/cds = (158,78 |
| 40C9 | 4195 | 4949 | X17033 | Hs.271986 | 0 | 1 | integrin alpha-2 subunit/cds = (48,3593)/gb |
| 108E1 | 917 | 1331 | NM_006811 | Hs.272168 | 0 | 2 | tumor differentially expressed 1 (TDE1), mRNA |
| 155H10 | 232 | 715 | AL021395 | Hs.272279 | 1.00E−164 | 1 | DNA sequence from clone RP1-269M15 on chromosome 20q1 |
| 159D3 | 38 | 238 | AL034343 | Hs.272295 | 1.00E−106 | 4 | DNA sequence from clone RP1-108C2 on chromosome 6p12. |
| 477C3 | 744 | 1166 | AL133015 | Hs.272307 | 0 | 2 | mRNA; cDNA DKFZp434O2417 (from clone DKFZp434O |
| 173D12 | 228 | 594 | AL121934 | Hs.272340 | 1.00E−140 | 5 | DNA sequence from clone RP11-209A2 on chromosome 6. C |
| 472D9 | 27 | 418 | NM_016135 | Hs.272398 | 0 | 1 | transcription factor ets (TEL2), mRNA/cds = (7 |
| 465F9 | 1885 | 2345 | NM_013351 | Hs.272409 | 0 | 1 | T-box 21 (TBX21), mRNA/cds = (211,1818)/gb = NM |
| 41E11 | 1 | 277 | NM_004167 | Hs.272493 | 1.00E−113 | 1 | small inducible cytokine subfamily A (Cys-Cys |
| 462E11 | 8 | 526 | NM_001503 | Hs.272529 | 0 | 1 | glycosylphosphatidylinositol specific phos |
| 104C6 | 210 | 327 | AE000659 | Hs.272550 | 5.00E−61 | 1 | T-cell receptor alpha delta locus from bases 2 |
| 596A3 | 411 | 1208 | NM_013392 | Hs.272736 | 0 | 5 | nuclear receptor binding protein (NRBP), mRNA |
| 75C2 | 1892 | 2188 | AK000316 | Hs.272793 | 1.00E−165 | 1 | FLJ20309 fis, clone HEP07296/cds = (41,127 |
| 58C6 | 1 | 956 | NM_006009 | Hs.272897 | 0 | 2 | Tubulin, alpha, brain-specific (TUBA3), mRNA |
| 190H8 | 3246 | 3771 | AK024471 | Hs.273230 | 1.00E−165 | 2 | mRNA for FLJ00064 protein, partial cds/cds = (0 |
| 590E11 | 1512 | 1860 | NM_014230 | Hs.273307 | 1.00E−168 | 4 | signal recognition particle 68 kD (SRP68), mRN |
| 588H2 | 696 | 1454 | NM_000516 | Hs.273385 | 0 | 3 | guanine nucleotide binding protein (G protein) |
| 165E9 | 3186 | 3695 | NM_014871 | Hs.273397 | 0 | 1 | KIAA0710 gene product (KIAA0710), mRNA/cds = ( |
| 462A6 | 394 | 496 | AA527312 | Hs.273775 | 2.00E−42 | 1 | ng36a08.s1 cDNA, 3' end/clone = IMAGE: 936854/ |
| 587F1 | 1763 | 1978 | AL050353 | Hs.274170 | 1.00E−112 | 1 | mRNA; cDNA DKFZp564C0482 (from clone DKFZp564C |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 177E5 | 1448 | 1876 | AK000765 | Hs.274248 | 0 | 1 | FLJ20758 fis, clone HEP01508/cds = (464,13 |
| 59E7 | 1 | 301 | AF151049 | Hs.274344 | 1.00E−159 | 3 | HSPC215 mRNA, complete cds/cds = (92,451)/gb = |
| 174A6 | 931 | 1352 | NM_004301 | Hs.274350 | 0 | 1 | BAF53 (BAF53A), mRNA/cds = (136,1425)/gb = NM_0 |
| 99E2 | 718 | 1391 | NM_018477 | Hs.274369 | 0 | 4 | uncharacterized hypothalamus protein HARP11 |
| 117F6 | 3046 | 3478 | AB037844 | Hs.274396 | 0 | 2 | mRNA for KIAA1423 protein, partial cds/cds = (0 |
| 52F3 | 1724 | 2342 | NM_005346 | Hs.274402 | 1.00 E−149 | 48 | heat shock 70 kD protein 1 (HSPA1B), mRNA/cds = ( |
| 516B1 | 719 | 1026 | NM_018975 | Hs.274428 | 1.00E−161 | 2 | TRF2-interacting telomeric RAP1 protein (RAP |
| 104A1 | 1943 | 2396 | AK002127 | Hs.274439 | 0 | 1 | FLJ11265 fis, clone PLACE1009158/cds = (30 |
| 137D6 | 1697 | 1817 | NM_001403 | Hs.274466 | 8.00E−49 | 1 | eukaryotic translation elongation factor 1 a |
| 108D11 | 321 | 646 | X16863 | Hs.274467 | 1.00E−160 | 1 | Fc-gamma RIII-1 cDNA for Fc-gamma receptor III-1 (CD |
| 107F1 | 567 | 895 | AF283771 | Hs.274472 | 1.00E−168 | 1 | clone TCBAP0774 mRNA sequence/cds = UNKNOWN/g |
| 517B9 | 4 | 480 | NM_002128 | Hs.274472 | 0 | 3 | high-mobility group (nonhistone chromosomal) |
| 514C8 | 254 | 539 | M12888 | Hs.274474 | 1.00E−144 | 2 | T-cell receptor germline beta-chain gene C-region C- |
| 460G5 | 602 | 775 | M12679 | Hs.274485 | 3.00E−94 | 1 | Cw1 antigen mRNA, complete cds/cds = (0,617)/ gb = M1267 |
| 463G7 | 163 | 744 | D90145 | Hs.274535 | 0 | 4 | LD78 beta gene/cds = (86,367)/gb = D90145/ gi = 219907/ |
| 472E10 | 277 | 391 | AI393960 | Hs.274851 | 6.00E−59 | 1 | tg11d04.x1 cDNA, 3' end/clone = IMAGE: 2108455 |
| 115A11 | 156 | 446 | NM_014624 | Hs.275243 | 1.00E−157 | 8 | S100 calcium-binding protein A6 (calcyclin) ( |
| 102C6 | 23 | 448 | AA610514 | Hs.275611 | 1.00E−161 | 1 | np93h02.s1/clone = 1133907/gb = AA6 |
| 160E3 | 24 | 304 | AA757952 | Hs.275773 | 1.00E−74 | 3 | zg49e07.s1 3' end/clone = IMAGE: 396708/ |
| 500B8 | 26 | 536 | NM_022551 | Hs.275865 | 0 | 3 | ribosomal protein S18 (RPS18), mRNA/cds = (46,5 |
| 522D9 | 184 | 593 | NM_001959 | Hs.275959 | 0 | 1 | eukaryotic translation elongation factor 1 b |
| 151H4 | 1 | 196 | AA984890 | Hs.276063 | 5.00E−58 | 1 | am62e06.s1 cDNA, 3' end/clone = IMAGE: 1576642 |
| 476B10 | 362 | 615 | BF510670 | Hs.276341 | 1.00E−116 | 1 | UI-H-BI4-aof-b-08-0-UI.s1 cDNA, 3' end/clon |
| 144F10 | 73 | 279 | AI318342 | Hs.276662 | 8.00E−57 | 1 | ta73c09.x1 3' end/clone = IMAGE: 2049712 |
| 593G1 | 17 | 88 | BE747210 | Hs.276718 | 2.00E−26 | 1 | 601580926F1 cDNA, 5' end/clone = IMAGE: 3929430 |
| 473E3 | 205 | 488 | AI380791 | Hs.276766 | 1.00E−144 | 1 | tg04b12.x1 cDNA, 3' end/clone = IMAGE: 2107775 |
| 598A2 | 72 | 427 | NM_001803 | Hs.276770 | 0 | 19 | CDW52 antigen (CAMPATH-1 antigen) (CDW52), mR |
| 170H2 | 83 | 432 | X62466 | Hs.276770 | 0 | 1 | CAMPATH-1 (CDw52) antigen/cds = (33,218) |
| 464F7 | 2 | 454 | AI492640 | Hs.276903 | 0 | 2 | qz18a06.x1 cDNA, 3' end/clone = IMAGE: 2021842 |
| 464E5 | 102 | 191 | AI493726 | Hs.276907 | 3.00E−44 | 2 | qz12f08.x1 cDNA, 3' end/clone = IMAGE: 2021319 |
| 50B5 | 42 | 308 | AI581383 | Hs.276988 | 5.00E−77 | 1 | to71c02.x1 cDNA, 3' end/clone = IMAGE: 2183714 |
| 468C6 | 40 | 279 | AI740667 | Hs.277201 | 1.00E−64 | 1 | wg07b07.x1 cDNA, 3' end/clone = IMAGE: 2364373 |
| 111D12 | 1 | 562 | AI749435 | Hs.277224 | 1.00E−118 | 9 | at24b04.x1 cDNA, 3' end/clone = IMAGE: 2356015 |
| 459B4 | 176 | 367 | AI811065 | Hs.277293 | 2.00E−38 | 1 | tr03f05.x1 cDNA, 3' end/clone = IMAGE: 2217249 |
| 477H3 | 6227 | 6584 | NM_013449 | Hs.277401 | 1.00E−132 | 1 | bromodomain adjacent to zinc finger domain, 2A |
| 54A8 | 34 | 301 | AW050975 | Hs.277672 | 3.00E−48 | 1 | wz25f04.x1 cDNA, 3' end/clone = IMAGE: 2559103 |
| 459E4 | 1532 | 2061 | NM_006389 | Hs.277704 | 0 | 1 | oxygen regulated protein (150 kD) (ORP150), mR |
| 109B6 | 3281 | 3721 | U65785 | Hs.277704 | 0 | 1 | 150 kDa oxygen-regulated protein ORP150 mRNA, complet |
| 524H7 | 2979 | 3350 | NM_005899 | Hs.277721 | 0 | 1 | membrane component, chromosome 17, surface ma |
| 472F10 | 425 | 556 | AW082714 | Hs.277738 | 5.00E−69 | 1 | xb61f07.x1 cDNA, 3' end/clone = IMAGE: 2580805 |
| 176D1 | 113 | 269 | AW262728 | Hs.277994 | 6.00E−32 | 1 | xq94a12.x1 cDNA, 3' end/clone = IMAGE: 2758270 |
| 464H4 | 2138 | 3563 | NM_016733 | Hs.278027 | 0 | 9 | LIM domain kinase 2 (LIMK2), transcript varian |
| 145C9 | 533 | 1446 | D13316 | Hs.278238 | 0 | 3 | transcription factor, E4TF1-47, complete cds |
| 161C3 | 339 | 560 | NM_002041 | Hs.278238 | 1.00E−123 | 1 | GA-binding protein transcription factor, bet |
| 74C9 | 345 | 1048 | AK026632 | Hs.278242 | 0 | 3 | FLJ22979 fis, clone KAT11379, highly sim |
| 59E2 | 255 | 782 | L24804 | Hs.278270 | 0 | 2 | (p23) mRNA, complete cds/cds = (232,714)/ gb = L24804/ |
| 521H10 | 8 | 461 | AI720536 | Hs.278302 | 1.00E−114 | 4 | as83c02.x1 cDNA, 3' end/clone = IMAGE: 2335298 |
| 118C6 | 830 | 1104 | NM_001995 | Hs.278333 | 1.00E−148 | 1 | fatty-acid-Coenzyme A ligase, long-chain 1 ( |
| 104E9 | 248 | 417 | AF151054 | Hs.278429 | 2.00E−78 | 1 | HSPC220 mRNA, complete cds/cds = (288,818)/gb |
| 594F10 | 379 | 1760 | NM_016520 | Hs.278429 | 0 | 4 | hepatocellular carcinoma-associated antigen |
| 126D11 | 7374 | 7716 | NM_006289 | Hs.278559 | 0 | 1 | talin (TLN), mRNA/cds = (126,7751)/gb = NM_0062 |
| 589E6 | 3078 | 5778 | NM_003105 | Hs.278571 | 0 | 3 | sortilin-related receptor, L(DLR class) A re |
| 102C10 | 669 | 1180 | D14041 | Hs.278573 | 0 | 1 | for H-2K binding factor-2, complete cds/ |
| 526H8 | 167 | 4709 | NM_015874 | Hs.278573 | 0 | 5 | H-2K binding factor-2 (LOC51580), mRNA/cds = ( |
| 120A12 | 732 | 1305 | AB029031 | Hs.278586 | 0 | 1 | mRNA for KIAA1108 protein, partial cds/cds = (0 |
| 126F4 | 3138 | 3515 | AF035737 | Hs.278589 | 0 | 2 | general transcription factor 2-I (GTF2I) mRNA |
| 40A7 | 3179 | 3864 | U24578 | Hs.278625 | 0 | 1 | RP1 and complement C4B precursor (C4B) genes, partial |
| 50C4 | 4401 | 4581 | AB002334 | Hs.278671 | 2.00E−60 | 1 | KIAA0336 gene, complete cds/cds = (253,5004) |
| 106E12 | 104 | 1222 | D50525 | Hs.278693 | 0 | 11 | TI-227H/cds = UNKNOWN/gb = D50525/gi = 1167502 |
| 467E10 | 168 | 542 | BE973840 | Hs.278704 | 1.00E−145 | 1 | 601680647F1 cDNA, 5' end/clone = IMAGE: 3951154 |
| 75F2 | 1121 | 1772 | J04755 | Hs.278718 | 0 | 37 | ferritin H processed pseudogene, complete cds/ cds = UN |
| 170E12 | 204 | 843 | AL121735 | Hs.278736 | 0 | 2 | Isoform of human GTP-binding protein G25K/ cds = (104,679)/ |
| 103F4 | 589 | 926 | NM_019597 | Hs.278857 | 0 | 1 | heterogeneous nuclear ribonucleoprotein H2 |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 37F8 | 3 | 519 | U01923 | Hs.278857 | 0 | 1 | BTK region clone ftp-3 mRNA/cds = UNKNOWN/gb = U01923/ |
| 66B11 | 2195 | 2512 | AB029027 | Hs.279039 | 1.00E−172 | 1 | for KIAA1104 protein, complete cds/cds = ( |
| 171G3 | 219 | 815 | AK027258 | Hs.279040 | 0 | 2 | FLJ23605 fis, clone LNG15982, highly sim |
| 172E12 | 18 | 95 | NM_014065 | Hs.279040 | 4.00E−27 | 2 | HT001 protein (HT001), mRNA/cds = (241,1203)/ |
| 596A12 | 1 | 225 | BE220869 | Hs.279231 | 2.00E−78 | 1 | hu01g02.x1 cDNA, 3' end/clone = IMAGE: 3165362 |
| 61H2 | 20 | 220 | BE279328 | Hs.279429 | 2.00E−32 | 3 | 601157666F1 cDNA, 5' end/clone = IMAGE: 3504328 |
| 458E12 | 1835 | 2473 | NM_014160 | Hs.279474 | 0 | 1 | HSPC070 protein (HSPC070), mRNA/cds(331,158 |
| 110F3 | 983 | 1614 | NM_016160 | Hs.279518 | 0 | 1 | amyloid precursor protein homolog HSD-2 (LOC5 |
| 37E5 | 39 | 732 | AK001403 | Hs.279521 | 0 | 1 | FLJ10541 fis, clone NT2RP2001381/cds = (3 |
| 66D6 | 6 | 463 | BE502919 | Hs.279522 | 0 | 1 | hz81b08.x1 cDNA, 3' end/clone = IMAGE: 3214359 |
| 123A11 | 411 | 903 | NM_013237 | Hs.279529 | 0 | 2 | px19-like protein (PX19), mRNA/cds = (176,835) |
| 185A10 | 809 | 1324 | NM_002817 | Hs.279554 | 0 | 1 | proteasome (prosome, macropain) 26S subunit, |
| 472H9 | 88 | 543 | AL582047 | Hs.279555 | 0 | 1 | AL582047 cDNA/clone = CS0DL003YD01-(3-prime) |
| 41A2 | 1 | 326 | AK000575 | Hs.279581 | 1.00E−162 | 1 | FLJ20568 fis, clone REC00775/cds = (6,422) |
| 135F4 | 648 | 935 | NM_016283 | Hs.279586 | 1.00E−110 | 1 | adrenal gland protein AD-004 (LOC51578), mRNA |
| 69D9 | 841 | 935 | D16217 | Hs.279607 | 9.00E−40 | 1 | calpastatin, complete cds/cds = (162,2288)/ |
| 116B6 | 938 | 1562 | NM_001750 | Hs.279607 | 0 | 1 | calpastatin (CAST), mRNA/cds = (66,1358)/gb = |
| 473F4 | 6847 | 7401 | NM_007329 | Hs.279611 | 0 | 1 | deleted in malignant brain tumors 1 (DMBT1), tr |
| 123C7 | 2488 | 2684 | NM_021644 | Hs.279681 | 1.00E−105 | 1 | heterogeneous nuclear ribonucleoprotein H3 |
| 586E2 | 357 | 633 | NM_014169 | Hs.279761 | 3.00E−97 | 1 | HSPC134 protein (HSPC134), mRNA/cds = (45,716) |
| 464D6 | 383 | 524 | NM_016154 | Hs.279771 | 1.00E−33 | 1 | ras-related GTP-binding protein 4b (RAB4B), m |
| 99G9 | 1375 | 1835 | NM_013388 | Hs.279784 | 0 | 1 | prolactin regulatory element binding (PREB), |
| 590F4 | 1045 | 1540 | NM_003883 | Hs.279789 | 0 | 2 | histone deacetylase 3 (HDAC3), mRNA/cds = (55,1 |
| 163E1 | 59 | 564 | NM_015932 | Hs.279813 | 0 | 3 | hypothetical protein (HSPC014), mRNA/cds = (8 |
| 525G5 | 3914 | 4160 | NM_014819 | Hs.279849 | 1.00E−138 | 1 | KIAA0438 gene product (KIAA0438), mRNA/cds = ( |
| 598A10 | 9 | 821 | NM_003295 | Hs.279860 | 0 | 19 | tumor protein, translationally-controlled 1 |
| 526C8 | 734 | 1166 | NM_016007 | Hs.279867 | 0 | 1 | CGI-59 protein (LOC51625), mRNA/cds = (2,1153) |
| 183G12 | 758 | 1093 | NM_017774 | Hs.279893 | 0 | 1 | hypothetical protein FLJ20342 (FLJ20342), mR |
| 36B3 | 247 | 611 | AK025623 | Hs.279901 | 0 | 1 | FLJ21970 fis, clone HEP05733, highly sim |
| 592G3 | 479 | 1052 | NM_016146 | Hs.279901 | 0 | 4 | PTD009 protein (PTD009), mRNA/cds = (257,916) |
| 38F5 | 811 | 1256 | AF151875 | Hs.279918 | 0 | 4 | CGI-117 protein mRNA, complete cds/cds = (456,9 |
| 161E3 | 542 | 862 | NM_016391 | Hs.279918 | 1.00E−151 | 1 | hypothetical protein (HSPC111), mRNA/cds = (6 |
| 584F11 | 10 | 212 | NM_014248 | Hs.279919 | 1.00E−112 | 2 | ring-box 1 (RBX1), mRNA/cds = (6,332)/gb = NM_0 |
| 588H7 | 400 | 1155 | NM_003404 | Hs.279920 | 0 | 12 | tyrosine 3-monooxygenase/tryptophan 5-monoo |
| 169C8 | 400 | 1155 | X57346 | Hs.279920 | 1.00E−131 | 2 | HS1 protein/cds = (372,1112)/gb = X57346 |
| 147A1 | 209 | 1978 | AK025927 | Hs.279921 | 0 | 8 | FLJ22274 fis, clone HRC03616, highly sim |
| 591H11 | 48 | 1810 | NM_016127 | Hs.279921 | 1.00E−176 | 33 | HSPC035 protein (LOC51669), mRNA/cds = (16,103 |
| 69D1 | 727 | 1776 | NM_014366 | Hs.279923 | 0 | 3 | putative nucleotide binding protein, estradio |
| 52C6 | 303 | 1151 | V00522 | Hs.279930 | 0 | 2 | encoding major histocompatibility complex gene |
| 158C11 | 2483 | 2785 | D84224 | Hs.279946 | 1.00E−166 | 2 | methionyl tRNA synthetase, complete c |
| 194E7 | 1525 | 1767 | NM_004990 | Hs.279946 | 1.00E−125 | 1 | methionine- tRNA synthetase (MARS), mRNA/cds |
| 62E5 | 215 | 701 | U93243 | Hs.279948 | 0 | 1 | Ubc6p homolog mRNA, complete cds/cds = (27,983) |
| 145G3 | 1 | 1882 | AK024090 | Hs.281434 | 1.00E−147 | 5 | FLJ14028 fis, clone HEMBA1003838/cds = UN |
| 473A6 | 1 | 310 | BE552131 | Hs.282091 | 1.00E−158 | 1 | hw29b05.x1 cDNA, 3' end/clone = IMAGE: 3184305 |
| 52C12 | 1 | 455 | R67739 | Hs.282410 | 0 | 1 | yi28c06.r1 cDNA, 5' end/clone = IMAGE: 140554/ |
| 112A3 | 5072 | 5274 | NM_006165 | Hs.282441 | 3.00E−83 | 1 | nuclear factor related to kappa B binding prote |
| 61H3 | 443 | 577 | AV648638 | Hs.282867 | 2.00E−68 | 4 | AV648638 cDNA, 3' end/clone = GLCBLE12/clone_ |
| 37D3 | 38 | 766 | AF287008 | Hs.283022 | 0 | 5 | triggering receptor expressed on monocytes 1 |
| 125C5 | 32 | 748 | NM_018643 | Hs.283022 | 0 | 13 | triggering receptor expressed on myeloid cell |
| 41B1 | 597 | 1084 | NM_018636 | Hs.283106 | 0 | 2 | hypothetical protein PRO2987 (PRO2987), mRNA |
| 111E9 | 1111 | 1405 | AB037802 | Hs.283109 | 1.00E−152 | 1 | mRNA for KIAA1381 protein, partial cds/cds = (0 |
| 169D7 | 5 | 175 | BE672733 | Hs.283216 | 2.00E−37 | 1 | 7b75g07.x1 3' end/clone = IMAGE: 3234108 |
| 74G11 | 47 | 384 | BE676472 | Hs.283267 | 1.00E−151 | 1 | 7f30c05.x1 cDNA, 3' end/clone = IMAGE: 3296168 |
| 191A5 | 256 | 890 | NM_018507 | Hs.283330 | 0 | 3 | hypothetical protein PRO1843 (PRO1843), mRNA |
| 465B7 | 114 | 638 | AW979262 | Hs.283410 | 0 | 2 | EST391372 cDNA/gb = AW979262/gi = 8170550/ug = |
| 143E1 | 1970 | 2258 | NM_020217 | Hs.283611 | 1.00E−110 | 1 | hypothetical protein DKFZp547I014 (DKFZp547I |
| 54E9 | 385 | 739 | AF116620 | Hs.283630 | 0 | 3 | PRO1068 mRNA, complete cds/cds = UNKNOWN/gb = A |
| 462D10 | 63 | 279 | NM_007220 | Hs.283646 | 1.00E−119 | 1 | carbonic anhydrase VB, mitochondrial (CA5B), |
| 518B11 | 359 | 690 | NM_016056 | Hs.283670 | 1.00E−167 | 2 | CGI-119 protein (LOC51643), mRNA/cds = (0,776) |
| 36H5 | 1 | 226 | BE778549 | Hs.283674 | 8.00E−85 | 1 | 601466063F1 cDNA, 5' end/clone = IMAGE: 3869391 |
| 126H10 | 907 | 1431 | NM_017801 | Hs.283685 | 0 | 1 | hypothetical protein FLJ20396 (FLJ20396), mR |
| 69B1 | 2288 | 3232 | AF103803 | Hs.283690 | 0 | 6 | clone H41 unknown mRNA/cds = (323,1099)/gb = AF |
| 98B1 | 162 | 489 | NM_018476 | Hs.283719 | 1.00E−110 | 1 | uncharacterized hypothalamus protein HBEX2 |
| 39C3 | 997 | 3088 | NM_020151 | Hs.283722 | 0 | 2 | GTT1 protein (GTT1), mRNA/cds = (553,1440)/gb |
| 592E4 | 13 | 2219 | NM_020357 | Hs.283728 | 0 | 2 | PEST-containing nuclear protein (pcnp), mRNA |
| 142F11 | 138 | 371 | AF173296 | Hs.283740 | 1.00E−130 | 1 | e(y)2 homolog mRNA, complete cds/cds = (216,521 |
| 592F3 | 480 | 858 | NM_013234 | Hs.283781 | 0 | 2 | muscle specific gene (M9), mRNA/cds = (171,827) |
| 159E5 | 3 | 281 | AL121916 | Hs.283838 | 1.00E−113 | 6 | DNA sequence from clone RP1-189G13 on chromosome 20. |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 142H10 | 517 | 892 | AL121585 | Hs.283864 | 9.00E−70 | 2 | DNA sequence from clone RP11-504H3 on chromosome 20 C |
| 166D3 | 1 | 227 | X72475 | Hs.283972 | 6.00E−70 | 1 | for rearranged lg kappa light chain variable |
| 134E8 | 980 | 1302 | NM_014110 | Hs.284136 | 0 | 47 | PRO2047 protein (PRO2047), mRNA/cds = (798,968 |
| 596C5 | 30 | 705 | NM_006134 | Hs.284142 | 0 | 2 | chromosome 21 open reading frame 4 (C21ORF4), m |
| 74A4 | 1944 | 2157 | AL359585 | Hs.284158 | 1.00E−110 | 3 | cDNA DKFZp762B195 (from clone DKFZp762B1 |
| 159A4 | 159 | 1414 | AF165521 | Hs.284162 | 0 | 4 | ribosomal protein L30 isolog (L30) mRNA, compl |
| 597F9 | 836 | 1000 | NM_016304 | Hs.284162 | 1.00E−88 | 1 | 60S ribosomal protein L30 isolog (LOC51187), m |
| 462D2 | 655 | 1306 | NM_016301 | Hs.284164 | 0 | 1 | protein x 0004 (LOC51184), mRNA/cds = (31,885) |
| 458C6 | 720 | 910 | AP001753 | Hs.284189 | 1.00E−102 | 1 | genomic DNA, chromosome 21q, section 97/105/ |
| 165D5 | 1482 | 2302 | AB040120 | Hs.284205 | 0 | 2 | mRNA for BCG induced integral membrane protein |
| 180C12 | 309 | 602 | BF381953 | Hs.284235 | 1.00E−148 | 2 | 601816251F1 cDNA, 5' end/clone = IMAGE: 4050061 |
| 67D9 | 27 | 2026 | AK024969 | Hs.284249 | 0 | 10 | FLJ21316 fis, clone COL02253, highly sim |
| 39D1 | 307 | 2899 | U90552 | Hs.284283 | 0 | 5 | butyrophilin (BTF5) mRNA, complete cds/ cds = (359,190 |
| 147C8 | 391 | 556 | AF161451 | Hs.284295 | 2.00E−58 | 1 | HSPC333 mRNA, partial cds/cds = (0,443)/gb = AF |
| 192C12 | 333 | 484 | AV700210 | Hs.284605 | 5.00E−57 | 1 | AV700210 cDNA, 3' end/clone = GKBALC03/clone_ |
| 49G11 | 380 | 523 | AV700636 | Hs.284674 | 4.00E−33 | 1 | AV700636 cDNA, 3' end/clone = GKBAGH12/clone_ |
| 115C11 | 375 | 1001 | AK023291 | Hs.285017 | 0 | 1 | cDNA FLJ13229 fis, clone OVARC1000106/cds = (15 |
| 458H8 | 1544 | 2233 | AK023459 | Hs.285107 | 0 | 1 | cDNA FLJ13397 fis, clone PLACE1001351/cds = (22 |
| 70F4 | 11 | 605 | AV700298 | Hs.285173 | 0 | 4 | AV700298 cDNA, 3' end/clone = GKCBVGO5/clone_ |
| 66C6 | 684 | 1415 | NM_001300 | Hs.285313 | 0 | 5 | core promoter element binding protein (COPEB), |
| 169F2 | 4 | 460 | BF684382 | Hs.285555 | 0 | 2 | 602141836F1 5' end/clone = IMAGE: 4302776 |
| 171F12 | 646 | 839 | X58529 | Hs.285823 | 6.00E−99 | 2 | rearranged immunoglobulin mRNA for mu heavy chain enh |
| 142F10 | 1438 | 1728 | AK025788 | Hs.285833 | 1.00E−152 | 1 | FLJ22135 fis, clone HEP20858/cds = UNKNOW |
| 171H2 | 1 | 2500 | AL050376 | Hs.285853 | 5.00E−21 | 1 | mRNA; cDNA DKFZp586J101 (from clone DKFZp586J1 |
| 40C5 | 786 | 1163 | AK026603 | Hs.286124 | 0 | 2 | FLJ22950 fis, clone KAT09618, highly sim |
| 458D9 | 55 | 684 | NM_016041 | Hs.286131 | 0 | 1 | CGI-101 protein (LOC51009), mRNA/cds = (6,635) |
| 458D1 | 1 | 310 | AK025886 | Hs.286194 | 1.00E−151 | 1 | cDNA: FLJ22233 fis, clone HRC02016/cds = (35,12 |
| 515C10 | 817 | 1136 | AK021791 | Hs.286212 | 1.00E−138 | 1 | cDNA FLJ11729 fis, clone HEMBA1005394, modera |
| 71C7 | 285 | 2441 | AK026933 | Hs.286236 | 0 | 7 | cDNA: FLJ23280 fis, clone HEP07194/cds = (468,1 |
| 184B9 | 372 | 612 | BE965319 | Hs.286754 | 3.00E−66 | 2 | 601659229R1 cDNA, 3' end/clone = IMAGE: 3895783 |
| 586C12 | 18 | 381 | NM_000996 | Hs.287361 | 0 | 3 | ribosomal protein L35a (RPL35A), mRNA/cds = (6 |
| 36C6 | 152 | 685 | AJ277247 | Hs.287369 | 0 | 37 | for interleukin 21 (IL-21 gene)/cds = (71, |
| 513H8 | 17 | 690 | NM_020525 | Hs.287369 | 0 | 510 | interleukin 22 (IL22), mRNA/cds = (71,610)/gb |
| 586G2 | 3978 | 4107 | NM_021621 | Hs.287387 | 3.00E−68 | 1 | caspase recruitment domain protein 7 (CARD7) |
| 99D12 | 2330 | 2851 | NM_015906 | Hs.287414 | 0 | 1 | transcriptional intermediary factor 1 gamma ( |
| 182A2 | 284 | 576 | AK024331 | Hs.287631 | 1.00E−156 | 1 | cDNA FLJ14269 fis, clone PLACE1003864/cds = UN |
| 465A11 | 2226 | 2321 | AK024372 | Hs.287634 | 1.00E−42 | 1 | cDNA FLJ14310 fis, clone PLACE3000271/cds = (40 |
| 190A11 | 679 | 1126 | AK026769 | Hs.287725 | 0 | 1 | cDNA: FLJ23116 fis, clone LNG07945, highly sim |
| 75E2 | 479 | 837 | AL390738 | Hs.287788 | 1.00E−146 | 3 | DNA sequence from clone RP11-438F9 on chromosome 13 C |
| 59B7 | 488 | 1071 | AK022537 | Hs.287863 | 0 | 1 | FLJ12475 fis, clone NT2RM1000962/cds = (16 |
| 460E8 | 1611 | 1979 | AK024092 | Hs.287864 | 0 | 1 | cDNA FLJ14030 fis, clone HEMBA1004086/cds = UNK |
| 465F11 | 5714 | 6271 | NM_006312 | Hs.287994 | 0 | 1 | nuclear receptor co-repressor 2 (NCOR2), mRNA |
| 150E12 | 2041 | 2720 | AK026834 | Hs.287995 | 0 | 3 | FLJ23181 fis, clone LNG11094/cds = UNKNOW |
| 52D9 | 703 | 1482 | AB016247 | Hs.288031 | 0 | 1 | for sterol-C5-desaturase, complete cds |
| 37F4 | 1091 | 1655 | AK025375 | Hs.288061 | 1.00E−141 | 20 | FLJ21722 fis, clone COLF0522, highly sim |
| 188G5 | 1081 | 1753 | NM_001101 | Hs.288061 | 0 | 69 | actin, beta (ACTB), mRNA/cds = (73,1200)/gb = N |
| 171C12 | 2103 | 2426 | AB046857 | Hs.288140 | 1.00E−158 | 1 | KIAA1637 protein, partial cds/cds = (0 |
| 104E8 | 1354 | 1790 | AK023078 | Hs.288141 | 0 | 1 | FLJ13016 fis, clone NT2RP3000624, modera |
| 181A4 | 1890 | 2507 | AK022030 | Hs.288178 | 0 | 2 | cDNA FLJ11968 fis, clone HEMBB1001133/cds = UNK |
| 129A1 | 3522 | 3748 | J04144 | Hs.288204 | 1.00E−125 | 1 | angiotensin I-converting enzyme mRNA, complete cds/ |
| 598D12 | 1464 | 1947 | AK025643 | Hs.288224 | 0 | 3 | cDNA: FLJ21990 fis, clone HEP06386/cds = (22,49 |
| 52E6 | 920 | 1388 | AK023402 | Hs.288416 | 0 | 2 | FLJ13340 fis, clone OVARC1001942, weakly |
| 165E3 | 303 | 640 | NM_020666 | Hs.288417 | 0 | 1 | protein serine threonine kinase Clk4 (CLK4), |
| 53D3 | 1 | 153 | AK022280 | Hs.288435 | 6.00E−76 | 1 | FLJ12218 fis, clone MAMMA1001075, modera |
| 586C2 | 223 | 448 | BF110312 | Hs.288443 | 1.00E−63 | 3 | 7n36d08.x1 cDNA, 3' end/clone = IMAGE: 3566654 |
| 521F12 | 1922 | 2248 | AK026923 | Hs.288455 | 0 | 1 | cDNA: FLJ23270 fis, clone COL10309, highly sim |
| 120A11 | 825 | 1855 | AK026078 | Hs.288555 | 0 | 2 | cDNA: FLJ22425 fis, clone HRC08686/ cds = UNKNOW |
| 129D11 | 1723 | 1984 | AK023470 | Hs.288673 | 1.00E−143 | 2 | FLJ13408 fis, clone PLACE1001672, weakly |
| 109B12 | 1686 | 2086 | AK025215 | Hs.288708 | 1.00E−121 | 8 | FLJ21562 fis, clone COL06420/cds = (238,2 |
| 178F11 | 387 | 558 | NM_005402 | Hs.288757 | 3.00E−93 | 1 | v-ral simian leukemia viral oncogene homolog |
| 58F8 | 1262 | 1604 | AK022735 | Hs.288836 | 0 | 1 | cDNA FLJ12673 fis, clone NT2RM4002344/cds = (2, |
| 163E11 | 360 | 1687 | AK024094 | Hs.288856 | 1.00E−25 | 2 | FLJ14032 fis, clone HEMBA1004353, highly |
| 105B4 | 741 | 1243 | AK025092 | Hs.288872 | 0 | 1 | FLJ21439 fis, clone COL04352/cds = (206,1 |
| 106D10 | 1598 | 2291 | AB014515 | Hs.288891 | 0 | 3 | for KIAA0615 protein, complete cds/cds = ( |
| 460F8 | 154 | 2487 | NM_021818 | Hs.288906 | 1.00E−150 | 2 | WW Domain-Containing Gene (WW45), mRNA/cds = ( |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 48A6 | 560 | 1258 | NM_017644 | Hs.288922 | 0 | 1 | hypothetical protein FLJ20059 (FLJ20059), mR |
| 168B10 | 1271 | 1747 | AK023320 | Hs.288929 | 0 | 1 | FLJ13258 fis, clone OVARC1000862, modera |
| 114E2 | 2395 | 2849 | AK023256 | Hs.288932 | 0 | 1 | cDNA FLJ13194 fis, clone NT2RP3004378, weakly |
| 586F9 | 368 | 730 | AK026363 | Hs.288936 | 1.00E−162 | 4 | cDNA: FLJ22710 fis, clone HSI13340/cds = UNKNOW |
| 180B4 | 831 | 959 | NM_000344 | Hs.288986 | 1.00E−32 | 1 | survival of motor neuron 1, telomeric (SMN1), |
| 149A12 | 10 | 1958 | AK025467 | Hs.289008 | 0 | 5 | FLJ21814 fis, clone HEP01068/cds = UNKNOW |
| 117B5 | 5160 | 5611 | NM_012231 | Hs.289024 | 1.00E−141 | 1 | PR domain containing 2, with ZNF domain (PRDM2) |
| 469A5 | 3132 | 3365 | AK024456 | Hs.289034 | 1.00E−106 | 1 | mRNA for FLJ00048 protein, partial cds/cds = (2 |
| 461F6 | 396 | 473 | AK024197 | Hs.289037 | 7.00E−37 | 1 | cDNA FLJ14135 fis, clone MAMMA1002728/cds = UN |
| 176G11 | 1049 | 1811 | AK024669 | Hs.289069 | 0 | 4 | cDNA: FLJ21016 fis, clone CAE05735/cds = (90,11 |
| 473A5 | 1343 | 1937 | NM_013326 | Hs.289080 | 0 | 1 | colon cancer-associated protein Mic1 (MIC1), |
| 591G2 | 14 | 2259 | NM_005348 | Hs.289088 | 0 | 14 | heat shock 90 kD protein 1, alpha (HSPCA), mRNA |
| 70D3 | 21 | 2912 | X15183 | Hs.289088 | 0 | 17 | 90-kDa heat-shock protein/cds = (60,2258)/g |
| 37E8 | 780 | 1509 | AK026033 | Hs.289092 | 0 | 5 | FLJ22380 fis, clone HRC07453, highly sim |
| 74B10 | 408 | 791 | X00453 | Hs.289095 | 1.00E−153 | 2 | gene fragment for DX alpha-chain signal peptide, |
| 518B5 | 870 | 1128 | NM_005313 | Hs.289101 | 1.00E−119 | 1 | glucose regulated protein, 58 kD (GRP58), mRNA |
| 472A3 | 116 | 304 | X83300 | Hs.289103 | 4.00E−84 | 1 | H. sapiens SMA4 mRNA/cds = (66,488)/gb = X83300/gi = 603028/ |
| 112G6 | 1703 | 2550 | NM_001166 | Hs.289107 | 0 | 5 | baculoviral IAP repeat-containing 2 (BIRC2), |
| 37F11 | 1996 | 2580 | U37547 | Hs.289107 | 0 | 2 | IAP homolog B (MIHB) mRNA, complete cds/cds = (1159,301 |
| 169A12 | 371 | 588 | X57812 | Hs.289110 | 2.00E−84 | 1 | rearranged immunoglobulin lambda light chain/c |
| 472D6 | 2102 | 2424 | AF294900 | Hs.289118 | 1.00E−121 | 1 | beta, beta-carotene 15, 15'-dioxygenase (BCD |
| 151D1 | 2214 | 2294 | AK025846 | Hs.289721 | 1.00E−38 | 2 | FLJ22193 fis, clone HRC01108/cds = UNKNOW |
| 40A8 | 160 | 346 | AI761924 | Hs.289834 | 2.00E−94 | 1 | wg68h03.x1 cDNA, 3' end/clone = IMAGE: 2370293 |
| 468D5 | 42 | 105 | AA719103 | Hs.290535 | 5.00E−29 | 1 | zh33d10.s1 cDNA, 3' end/clone = IMAGE: 413875/ |
| 515B6 | 7 | 249 | AA837754 | Hs.291129 | 2.00E−61 | 1 | oe10d02.s1 cDNA/clone = IMAGE: 1385475/gb = AA |
| 594C9 | 16 | 319 | NM_005745 | Hs.291904 | 1.00E−150 | 1 | accessory proteins BAP31/BAP29 (DXS1357E), m |
| 476C10 | 180 | 311 | AI184710 | Hs.292276 | 8.00E−62 | 1 | qd64a01.x1 cDNA, 3' end/clone = IMAGE: 1734216 |
| 466G5 | 65 | 431 | AA461604 | Hs.292451 | 0 | 1 | zx51d08.r1 cDNA, 5' end/clone = IMAGE: 795759/ |
| 331F12 | 142 | 314 | BF310166 | Hs.292457 | 3.00E−85 | 1 | 601894826F1 cDNA, 5' end/clone = IMAGE: 4124119 |
| 590D6 | 1 | 406 | BG339050 | Hs.292457 | 0 | 2 | 602436875F1 cDNA, 5' end/clone = IMAGE: 4554643 |
| 150G5 | 160 | 431 | AI440234 | Hs.292490 | 6.00E−66 | 1 | ti99h12.x1 cDNA, 3' end/clone = IMAGE: 2140199 |
| 594F8 | 319 | 447 | AA761571 | Hs.292519 | 1.00E−57 | 1 | nz23d06.s1 cDNA, 3' end/clone = IMAGE: 1288619 |
| 122E2 | 91 | 307 | AI582954 | Hs.292553 | 4.00E−47 | 1 | tr98e07.x1 cDNA, 3' end/clone = IMAGE: 2227140 |
| 41E5 | 363 | 463 | D59502 | Hs.292590 | 3.00E−48 | 1 | HUM041H11A cDNA, 3' end/clone = GEN-041H11/cl |
| 99B8 | 215 | 378 | AI672433 | Hs.292615 | 6.00E−62 | 4 | wa03b05.x1 cDNA, 3' end/clone = IMAGE: 2296977 |
| 72C6 | 198 | 484 | AA719537 | Hs.292877 | 1.00E−112 | 3 | zh40g12.s1 cDNA, 3' end/clone = IMAGE: 414598/ |
| 157H5 | 49 | 447 | AI962127 | Hs.292901 | 1.00E−126 | 1 | wx77f07.x1 3' end/clone = IMAGE: 2549701 |
| 115C2 | 2052 | 2613 | NM_006310 | Hs.293007 | 0 | 1 | aminopeptidase puromycin sensitive (NPEPPS), |
| 463F3 | 14 | 445 | AW629485 | Hs.293352 | 0 | 2 | hi59b07.x1 cDNA, 3' end/clone = IMAGE: 2976565 |
| 193H8 | 94 | 333 | AI263141 | Hs.293444 | 7.00E−58 | 1 | qw90c01.x1 cDNA, 3' end/clone = IMAGE: 1998336 |
| 170G9 | 46 | 713 | AI452611 | Hs.293473 | 9.00E−21 | 1 | tj27g07.x1 cDNA, 3' end/clone = IMAGE: 2142780 |
| 100F9 | 554 | 666 | BE905040 | Hs.293515 | 2.00E−43 | 1 | 601496859F1 cDNA, 5' end/clone = IMAGE: 3898767 |
| 588G9 | 153 | 507 | BF794089 | Hs.293658 | 1.00E−143 | 1 | 602255649F1 cDNA, 5' end/clone = IMAGE: 4338732 |
| 142G8 | 2 | 231 | AV701332 | Hs.293689 | 1.00E−79 | 1 | AV701332 cDNA, 5' end/clone = ADAABD03/clone_ |
| 137A4 | 1 | 557 | BF029654 | Hs.293777 | 0 | 1 | 601765621F1 cDNA, 5' end/clone = IMAGE: 3997900 |
| 478C6 | 442 | 622 | BE748123 | Hs.293842 | 3.00E−63 | 1 | 601571679F1 cDNA, 5' end/clone = IMAGE: 3838675 |
| 100E7 | 198 | 488 | BE748663 | Hs.293842 | 1.00E−145 | 1 | 601571679T1 cDNA, 3' end/clone = IMAGE: 3838675 |
| 110B4 | 246 | 469 | NM_016398 | Hs.293905 | 1.00E−122 | 1 | hypothetical protein (HSPC131), mRNA/cds = (1 |
| 466D2 | 198 | 543 | AW972477 | Hs.294083 | 1.00E−180 | 1 | EST384568 cDNA/gb = AW972477/gi = 8162323/ug = |
| 100C10 | 1 | 398 | AW963235 | Hs.294092 | 0 | 2 | EST375308/gb = AW963235/gi = 8153071/ug = |
| 118F10 | 418 | 552 | BF245076 | Hs.294110 | 1.00E−48 | 1 | 601863910F1 cDNA, 5' end/clone = IMAGE: 4082235 |
| 596H2 | 1150 | 2308 | BC002450 | Hs.294135 | 0 | 20 | ribosomal protein L4, clone MGC: 776, mRNA, co |
| 596B4 | 139 | 414 | BE621121 | Hs.294309 | 7.00E−73 | 3 | 601493943F1 cDNA, 5' end/clone = IMAGE: 3896051 |
| 114D4 | 600 | 738 | BE961923 | Hs.294348 | 8.00E−33 | 1 | 601655335R1 cDNA, 3' end/clone = IMAGE: 3845768 |
| 66D11 | 185 | 625 | BE963811 | Hs.294578 | 1.00E−127 | 6 | 601657462R1 cDNA, 3' end/clone = IMAGE: 3875846 |
| 53E11 | 433 | 701 | BE964149 | Hs.294612 | 5.00E−81 | 1 | 601657833R1 cDNA, 3' end/clone = IMAGE: 3875984 |
| 179A11 | 442 | 776 | BF313856 | Hs.294754 | 9.00E−79 | 1 | 601902261F1 5' end/clone = IMAGE: 4134998 |
| 102B9 | 146 | 347 | H71236 | Hs.295055 | 7.00E−90 | 2 | ys12f10.s1 cDNA, 3' end/clone = IMAGE: 214603/ |
| 110F4 | 136 | 358 | H80108 | Hs.295107 | 1.00E−118 | 1 | yu09f02.s1 cDNA, 3' end/clone = IMAGE: 233307/ |
| 593F2 | 78 | 381 | AF212224 | Hs.295231 | 1.00E−172 | 3 | CLK4 mRNA, complete cds/cds = (153,1514)/gb = A |
| 50G9 | 355 | 415 | AI052431 | Hs.295451 | 1.00E−26 | 2 | oz07e08.x1 cDNA, 3' end/clone = IMAGE: 1674662 |
| 102E4 | 99 | 413 | AI560651 | Hs.295682 | 1.00E−146 | 8 | tq60f01.x1 cDNA, 3' end/clone = IMAGE: 2213209 |
| 486F7 | 263 | 489 | BF572855 | Hs.295806 | 1.00E−100 | 1 | 602079424F2 cDNA, 5' end/clone = IMAGE: 4254172 |
| 39C1 | 2054 | 2315 | AL050141 | Hs.295833 | 1.00E−144 | 6 | cDNA DKFZp586O031 (from clone DKFZp586O0 |
| 192D3 | 48 | 551 | AW081320 | Hs.295945 | 1.00E−158 | 4 | xc30f12.x1 cDNA, 3' end/clone = IMAGE: 2585807 |
| 102B7 | 753 | 850 | AL117536 | Hs.295969 | 5.00E−39 | 1 | cDNA DKFZp434G012 (from clone DKFZp434G0 |
| 168D1 | 73 | 1193 | AL360190 | Hs.295978 | 1.00E−134 | 3 | mRNA full length insert cDNA clone EUROIMAGE 74 |
| 47D6 | 103 | 331 | AW150085 | Hs.295997 | 3.00E−79 | 8 | xg36f04.x1 cDNA, 3' end/clone = IMAGE: 2629663 |
| 151H9 | 197 | 507 | AW264291 | Hs.296057 | 1.00E−113 | 1 | xq97g08.x1 cDNA, 3' end/clone = IMAGE: 2758622 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 56A1 | 1034 | 1220 | AJ012504 | Hs.296151 | 3.00E−74 | 1 | activated in tumor suppression, clone TSA |
| 525D12 | 42 | 545 | AI922889 | Hs.296159 | 1.00E−148 | 42 | wn64g11.x1 cDNA, 3' end/clone = IMAGE: 2450276 |
| 72C12 | 280 | 545 | AW166001 | Hs.296159 | 1.00E−84 | 10 | xf43e11.x1 cDNA, 3' end/clone = IMAGE: 2620844 |
| 99B1 | 21 | 286 | BE259480 | Hs.296183 | 4.00E−81 | 3 | 601106571F1 cDNA, 5' end/clone = IMAGE: 3342929 |
| 143F5 | 18 | 178 | BE962588 | Hs.296183 | 1.00E−55 | 1 | 601655929R1 cDNA, 3' end/clone = IMAGE: 3855823 |
| 110A10 | 2115 | 2237 | AL096752 | Hs.296243 | 1.00E−61 | 1 | cDNA DKFZp434A012 (from clone DKFZp434A0 |
| 170G1 | 16 | 304 | BE964134 | Hs.296246 | 4.00E−96 | 1 | 601657818R1 CDNA, 3' end/clone = IMAGE: 3876028 |
| 597G5 | 168 | 1564 | NM_014456 | Hs.296251 | 0 | 18 | programmed cell death 4 (PDCD4), mRNA/cds = (84 |
| 184A12 | 686 | 1564 | U96628 | Hs.296251 | 0 | 2 | nuclear antigen H731-like protein mRNA, compl |
| 479H10 | 247 | 540 | NM_002072 | Hs.296261 | 1.00E−117 | 1 | guanine nucleotide binding protein (G protein |
| 179H11 | 48 | 250 | BF315059 | Hs.296266 | 3.00E−56 | 1 | 601899090F1 5' end/clone = IMAGE: 4128334 |
| 182E9 | 1576 | 2251 | AK023460 | Hs.296275 | 0 | 2 | FLJ13398 fis, clone PLACE1001377, highly |
| 459B11 | 305 | 545 | BF340402 | Hs.296317 | 1.00E−79 | 1 | 602036746F1 cDNA, 5' end/clone = IMAGE: 4184602 |
| 459B12 | 349 | 721 | AK001838 | Hs.296323 | 0 | 1 | cDNA FLJ10976 fis, clone PLACE1001399/cds = UN |
| 179F8 | 1 | 756 | BF342246 | Hs.296333 | 0 | 2 | 602013019F1 5' end/clone = IMAGE: 4148741 |
| 171D1 | 12 | 330 | AV693913 | Hs.296339 | 1.00E−100 | 1 | AV693913 cDNA, 5' end/clone = GKCDVG04/clone_ |
| 39B9 | 1 | 297 | AB046771 | Hs.296350 | 1.00E−167 | 1 | for KIAA1551 protein, partial cds/cds = (0 |
| 36H12 | 547 | 1089 | M96995 | Hs.296381 | 0 | 2 | epidermal growth factor receptor-binding pro |
| 459F1 | 867 | 1020 | NM_014499 | Hs.296433 | 4.00E−76 | 1 | putative purinergic receptor (P2Y10), mRNA/c |
| 584A11 | 615 | 1287 | NM_006392 | Hs.296585 | 0 | 4 | nucleolar protein (KKE/D repeat) (NOP56), mRN |
| 593F7 | 209 | 752 | NM_005678 | Hs.296948 | 0 | 2 | SNRPN upstream reading frame (SNURF), transcr |
| 174F7 | 493 | 681 | BE253125 | Hs.297095 | 2.00E−60 | 5 | 601116648F1 cDNA, 5' end/clone = IMAGE: 3357178 |
| 123H9 | 132 | 413 | BE965554 | Hs.297190 | 9.00E−88 | 1 | 601659486R1 cDNA, 3' end/clone = IMAGE: 3896204 |
| 123D6 | 1105 | 1595 | AF113676 | Hs.297681 | 0 | 1 | clone FLB2803 PRO0684 mRNA, complete cds/cds = |
| 71C6 | 1076 | 1630 | NM_003380 | Hs.297753 | 0 | 2 | vimentin (VIM), mRNA/cds = (122,1522)/gb = NM_0 |
| 586G5 | 1179 | 1452 | NM_001908 | Hs.297939 | 1.00E−142 | 1 | cathepsin B (CTSB), mRNA/cds = (177,1196)/gb = |
| 521E7 | 1 | 220 | NM_001022 | Hs.298262 | 1.00E−119 | 4 | ribosomal protein S19 (RPS19), mRNA/cds = (22,4 |
| 466H7 | 9 | 339 | AW614181 | Hs.298654 | 1.00E−153 | 1 | hg77d03.x1 cDNA, 3' end/clone = IMAGE.2951621 |
| 464A4 | 675 | 1232 | BC001077 | Hs.299214 | 0 | 1 | clone IMAGE: 2822295, mRNA, partial cds/cds = |
| 466F3 | 49 | 337 | AA132448 | Hs.299416 | 1.00E−141 | 1 | zo20a03.s1 cDNA, 3' end/clone = IMAGE: 587404/ |
| 589B10 | 123 | 339 | AW073707 | Hs.295581 | 1.00E−55 | 30 | xb01h03.x1 cDNA, 3' end/clone = IMAGE: 2575061 |
| 521H4 | 3 | 371 | NM_001000 | Hs.300141 | 1.00E−125 | 4 | ribosomal protein L39 (RPL39), mRNA/cds = (37,1 |
| 599F12 | 36 | 328 | AW243795 | Hs.300220 | 2.00E−67 | 1 | xo56f02.x1 cDNA, 3' end/clone = IMAGE: 2707995 |
| 479A6 | 173 | 356 | AW262077 | Hs.300229 | 3.00E−64 | 1 | xq61e07.x1 cDNA, 3' end/clone = IMAGE: 2755140 |
| 111C8 | 806 | 1350 | NM_018579 | Hs.300496 | 1.00E−147 | 6 | mitochondrial solute carrier (LOC51312), mRN |
| 459D8 | 1 | 679 | NM_014478 | Hs.300684 | 0 | 1 | calcitonin gene-related peptide-receptor co |
| 522C5 | 98 | 1360 | NM_001154 | Hs.300711 | 0 | 10 | annexin A5 (ANXA5), mRNA/cds = (192,1154)/gb = |
| 596B7 | 407 | 750 | NM_003130 | Hs.300741 | 2.00E−83 | 1 | sorcin (SRI), mRNA/cds = (12,608)/gb = NM_00313 |
| 191A3 | 210 | 440 | AA788623 | Hs.301104 | 4.00E−34 | 9 | ah29f09.s1 cDNA, 3' end/clone = 1240265/clone |
| 123E1 | 15 | 267 | BE963194 | Hs.301110 | 1.00E−60 | 11 | 601656811R1 cDNA, 3' end/clone = IMAGE: 3865731 |
| 116F11 | 346 | 650 | NM_014029 | Hs.301175 | 2.00E−71 | 2 | HSPC022 protein (HSPC022), mRNA/cds = (18,623) |
| 58D4 | 489 | 611 | AW863111 | Hs.301183 | 8.00E−50 | 1 | MR3-SN0009-010400-101-f02 cDNA/gb = AW863111 |
| 122D8 | 3644 | 4034 | AB037808 | Hs.301434 | 0 | 1 | mRNA for KIAA1387 protein, partial cds/cds = (0 |
| 520F11 | 276 | 553 | BE886472 | Hs.301486 | 1.00E−111 | 1 | 601509688F1 cDNA, 5' end/clone = IMAGE: 3911301 |
| 512E5 | 71 | 687 | NM_001011 | Hs.301547 | 0 | 8 | ribosomal protein S7 (RPS7), mRNA/cds = (81,665 |
| 463F9 | 168 | 689 | AV702152 | Hs.301570 | 0 | 1 | AV702152 cDNA, 5' end/clone = ADBBFH05/clone_ |
| 117A12 | 2239 | 2395 | NM_007167 | Hs.301637 | 5.00E−78 | 1 | zinc finger protein 258 (ZNF258), mRNA/cds = (9 |
| 190A6 | 12942 | 13156 | AF155238 | Hs.301698 | 1.00E−114 | 1 | BAC 180i23 chromosome 8 map 8q24.3 beta-galacto |
| 594F12 | 1409 | 1841 | NM_005442 | Hs.301704 | 0 | 1 | eomesodermin (*Xenopus laevis*) homolog (EOMES) |
| 116G12 | 5477 | 5571 | AB033081 | Hs.301721 | 6.00E−47 | 1 | mRNA for KIAA1255 protein, partial cds/cds = (0 |
| 123C4 | 23 | 579 | BE260041 | Hs.301809 | 1.00E−129 | 4 | 601150579F1 cDNA, 5' end/clone = IMAGE: 3503419 |
| 192E12 | 1458 | 1854 | NM_007145 | Hs.301819 | 0 | 1 | zinc finger protein 146 (ZNF146), mRNA/cds = (8 |
| 590G8 | 1100 | 1307 | AF132197 | Hs.301824 | 3.00E−57 | 1 | PRO1331 mRNA, complete cds/cds = (422,616)/gb |
| 482E5 | 1764 | 2139 | NM_001295 | Hs.301921 | 0 | 1 | chemokine (C-C motif) receptor 1 (CCR1), mRNA |
| 583C5 | 4283 | 4684 | NM_014415 | Hs.301956 | 0 | 1 | zinc finger protein (ZNF-U69274), mRNA/cds = ( |
| 173G11 | 645 | 839 | X58529 | Hs.302063 | 1.00E−104 | 4 | rearranged immunoglobulin mRNA for mu heavy chain enh |
| 597D11 | 30 | 369 | AL137162 | Hs.302114 | 1.00E−150 | 5 | DNA sequence from clone RP5-843L14 on chromosome 20. |
| 191G9 | 182 | 353 | AC004079 | Hs.302183 | 9.00E−60 | 1 | PAC clone RP1-167F23 from 7p15/cds = (0,569)/g |
| 473D2 | 102 | 333 | BF477640 | Hs.302447 | 1.00E−126 | 1 | 7r01c05.x1 cDNA/clone = IMAGE/gb = BF477640/g |
| 479A9 | 18 | 267 | BE964028 | Hs.302585 | 7.00E−79 | 1 | 601657601R1 cDNA, 3' end/clone = IMAGE: 3875617 |
| 180A5 | 894 | 1325 | NM_018295 | Hs.302981 | 0 | 2 | hypothetical protein FLJ11000 (FLJ11000), mR |
| 593H6 | 950 | 1151 | X00437 | Hs.303157 | 1.00E−104 | 1 | mRNA for T-cell specific protein/cds = (37,975)/gb = XC |
| 51G12 | 274 | 533 | BG054649 | Hs.303214 | 1.00E−138 | 4 | 7o45b01.x1 cDNA, 3' end/clone = IMAGE: 3576912 |
| 189D8 | 785 | 1024 | NM_002138 | Hs.303627 | 1.00E−133 | 2 | heterogeneous nuclear ribonucleoprotein D ( |
| 99B11 | 1 | 529 | NM_002982 | Hs.303649 | 0 | 51 | small inducible cytokine A2 (monocyte chemota |
| 461E1 | 397 | 496 | AI472078 | Hs.303662 | 2.00E−28 | 1 | tj85h03.x1 cDNA, 3' end/clone = IMAGE: 2148341 |
| 103A1 | 359 | 687 | AF130085 | Hs.304177 | 1.00E−151 | 1 | clone FLB8503 PRO2286 mRNA, complete cds/cds |
| 180B11 | 52 | 240 | AI824522 | Hs.304477 | 4.00E−57 | 1 | tx71d03.x1 cDNA, 3' end/clone = lMAGE: 2275013 |
| 519A10 | 1 | 104 | AI880542 | Hs.304620 | 3.00E−26 | 1 | at80h05.x1 cDNA, 3' end/clone = IMAGE: 2378361 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 479F6 | 331 | 582 | AA873734 | Hs.304886 | 1.00E−131 | 1 | oh55h07.s1 cDNA, 3' end/clone = IMAGE: 1470589 |
| 176G3 | 61 | 324 | AI904802 | Hs.304919 | 2.00E−74 | 1 | IL-BT067-190199-037 cDNA/gb = AI904802/gi = 6 |
| 471G6 | 169 | 397 | AW592876 | Hs.304925 | 1.00E−122 | 1 | hg04d05.x1 cDNA, 3' end/clone = IMAGE: 2944617 |
| 119D11 | 3 | 348 | AL049282 | Hs.306030 | 1.00E−179 | 1 | mRNA; cDNA DKFZp564M113 (from clone DKFZp564M1 |
| 112F7 | 2398 | 3008 | U80743 | Hs.306094 | 0 | 1 | CAGH32 mRNA, partial cds/cds = (0,1671)/gb = U80 |
| 460C1 | 243 | 533 | NM_001353 | Hs.306098 | 5.00E−71 | 1 | aldo-keto reductase family 1, member C1 (dihy |
| 126A4 | 469 | 543 | L08048 | Hs.306192 | 2.00E−28 | 1 | non-histone chromosomal protein (HMG-1) retropseudo |
| 119F3 | 2113 | 2237 | AL096752 | Hs.306327 | 3.00E−60 | 1 | mRNA; cDNA DKFZp434A012 (from clone DKFZp434A0 |
| 467F8 | 1860 | 2406 | AL390039 | Hs.307106 | 0 | 1 | DNA sequence from clone RP13-383K5 on chromosome Xq22 |
| 192B12 | 1 | 454 | X72475 | Hs.307183 | 0 | 6 | H. sapiens mRNA for rearranged Ig kappa light chain variable |
| 116H11 | 60 | 402 | AF067519 | Hs.307357 | 1.00E−160 | 1 | PITSLRE protein kinase beta SV1 isoform (CDC2L |
| 472D3 | 150 | 478 | AW975895 | Hs.307486 | 1.00E−124 | 1 | EST388004 cDNA/gb = AW975895/gi = 8167117/ug = |
| 458B4 | 87 | 354 | AW206977 | Hs.307542 | 1.00E−143 | 1 | UI-H-BI1-afs-h-11-0-UI.s1 cDNA, 3' end/clon |
| 463A11 | 181 | 397 | AI057025 | Hs.307879 | 1.00E−69 | 1 | oy75a12.x1 cDNA, 3' end/clone = IMAGE: 1671646 |
| 479C6 | 138 | 403 | BE264564 | Hs.308154 | 1.00E−144 | 1 | 601192330F1 cDNA, 5' end/clone = IMAGE: 3536383 |
| 468G10 | 118 | 446 | AI361642 | Hs.309028 | 0 | 1 | qy86d04.x1 cDNA, 3' end/clone = IMAGE: 2018887 |
| 461G12 | 64 | 466 | AI379735 | Hs.309117 | 7.00E−25 | 1 | tc41c11.x1 cDNA, 3' end/clone = IMAGE: 2067188 |
| 466H8 | 15 | 487 | AI380278 | Hs.309120 | 0 | 1 | tf99f08.x1 cDNA, 3' end/clone = IMAGE: 2107431 |
| 477C8 | 28 | 187 | AI380449 | Hs.309122 | 7.00E−84 | 1 | tg02f12.x1 cDNA, 3' end/clone = IMAGE: 2107631 |
| 477C9 | 47 | 537 | AI380687 | Hs.309127 | 0 | 1 | tg03e04.x1 cDNA, 3' end/clone = IMAGE: 2107710 |
| 465F4 | 68 | 631 | AI440337 | Hs.309279 | 0 | 1 | tc88b03.x1 cDNA, 3' end/clone = IMAGE: 2073197 |
| 465G6 | 313 | 404 | AI475653 | Hs.309347 | 9.00E−31 | 1 | tc93b04.x1 cDNA, 3' end/clone = IMAGE: 2073679 |
| 465E7 | 1 | 340 | AI475827 | Hs.309349 | 1.00E−171 | 2 | tc87a05.x1 cDNA, 3' end/clone = IMAGE: 2073104 |
| 517G11 | 62 | 516 | AI707809 | Hs.309433 | 1.00E−115 | 2 | as28g09.x1 cDNA, 3' end/clone = IMAGE: 2318560 |
| 468D11 | 290 | 497 | AI523766 | Hs.309484 | 1.00E−103 | 1 | tg94f07.x1 cDNA, 3' end/clone = IMAGE: 2116453 |
| 186F5 | 77 | 418 | AI569898 | Hs.309629 | 1.00E−81 | 1 | tr57c12.x1 cDNA, 3' end/clone = IMAGE: 2222422 |
| 116A12 | 8 | 158 | AI735206 | Hs.310333 | 2.00E−43 | 1 | at07f03.x1 cDNA, 3' end/clone = IMAGE: 2354429 |
| 126G12 | 35 | 170 | AI866194 | Hs.310948 | 1.00E−54 | 1 | wl27a04.x1 cDNA, 3' end/clone = IMAGE: 2426092 |
| 172G8 | 86 | 227 | AI926251 | Hs.311137 | 3.00E−44 | 1 | wo41h05.x1 cDNA, 3' end/clone = IMAGE: 2457945 |
| 477D8 | 1 | 115 | AI968387 | Hs.311448 | 4.00E−42 | 2 | wu02e08.x1 cDNA, 3' end/clone = IMAGE: 2515814 |
| 462F10 | 13 | 220 | AW043857 | Hs.311783 | 1.00E−107 | 1 | wy81g04.x1 cDNA, 3' end/clone = IMAGE: 2554998 |
| 185A9 | 46 | 423 | AW130007 | Hs.312182 | 1.00E−130 | 2 | xf26f10.x1 cDNA, 3' end/clone = IMAGE: 2619211 |
| 515F6 | 34 | 181 | AW148618 | Hs.312412 | 3.00E−58 | 2 | xe99f02.x1 cDNA, 3' end/clone = IMAGE: 2616699 |
| 583E12 | 5945 | 6393 | AL133572 | Hs.312840 | 0 | 1 | mRNA; cDNA DKFZp434I0535 (from clone DKFZp434I |
| 471D5 | 306 | 411 | AW298430 | Hs.313413 | 1.00E−46 | 1 | UI-H-BW0-ajI-c-09-0-UI.s1 cDNA, 3' end/clon |
| 482F7 | 1 | 449 | AW440965 | Hs.313578 | 0 | 1 | he06d07.x1 cDNA, 3' end/clone = IMAGE: 2918221 |
| 473B3 | 179 | 463 | BG150461 | Hs.313610 | 1.00E−135 | 1 | 7k01d08.x1 cDNA, 3' end/clone = IMAGE: 3443006 |
| 479E9 | 138 | 434 | AW450835 | Hs.313715 | 1.00E−127 | 1 | UI-H-BI3-alf-f-06-0-UI.s1 cDNA, 3' end/clon |
| 71B9 | 344 | 577 | AI733018 | Hs.313929 | 1.00E−115 | 1 | oh60h01.x5 cDNA, 3' end/clone = IMAGE: 1471441 |
| 479B6 | 217 | 443 | AW629176 | Hs.314085 | 2.00E−70 | 1 | hi52a04.x1 cDNA, 3' end/clone = IMAGE: 2975886 |
| 191F11 | 55 | 123 | BE255377 | Hs.314898 | 1.00E−26 | 1 | 601115405F1 cDNA, 5' end/clone = IMAGE: 3355872 |
| 522F11 | 14 | 204 | BE962883 | Hs.314941 | 9.00E−83 | 3 | 601656423R1 cDNA, 3' end/clone = IMAGE: 3856325 |
| 195F12 | 120 | 363 | BE351010 | Hs.315050 | 2.00E−77 | 1 | ht22g04.x1 cDNA, 3' end/clone = IMAGE: 3147510 |
| 173A5 | 429 | 824 | BE410105 | Hs.315263 | 1.00E−133 | 1 | 601302278F1 cDNA, 5' end/clone = IMAGE: 3637002 |
| 481B2 | 1063 | 1283 | NM_006255 | Hs.315366 | 3.00E−72 | 1 | protein kinase C, eta (PRKCH), mRNA/cds = (166,2 |
| 459G1 | 1428 | 1700 | NM_006850 | Hs.315463 | 1.00E−124 | 1 | suppression of tumorigenicity 16 (melanoma di |
| 113H4 | 22 | 359 | BE901218 | Hs.315633 | 1.00E−127 | 2 | 601676034F1 cDNA, 5' end/clone = IMAGE: 3958617 |
| 583B7 | 510 | 754 | BE963666 | Hs.316047 | 2.00E−55 | 2 | 601656685R1 cDNA, 3' end/clone = IMAGE: 3865820 |
| 466E10 | 488 | 644 | AV729160 | Hs.316771 | 1.00E−54 | 1 | AV729160 cDNA, 5' end/clone = HTCCAB04/clone_ |
| 597A6 | 50 | 249 | AV710763 | Hs.316785 | 4.00E−31 | 2 | AV710763 cDNA, 5' end/clone = CuAAJH09/clone_ |
| 123C3 | 41 | 529 | BF183507 | Hs.318215 | 1.00E−158 | 1 | 601809991R1 cDNA, 3' end/clone = IMAGE: 4040470 |
| 193E12 | 15 | 2274 | NM_006074 | Hs.318501 | 0 | 7 | stimulated trans-acting factor (50 kDa) (STAF |
| 165D8 | 727 | 1344 | BC002867 | Hs.318693 | 0 | 1 | clone IMAGE: 3940519, mRNA, partial cds/cds = |
| 49F8 | 520 | 1094 | M16942 | Hs.318720 | 0 | 1 | MHC class II HLA-DRw53-associated glycoprotein beta- |
| 172E10 | 310 | 944 | NM_016018 | Hs.318725 | 0 | 1 | CGI-72 protein (LOC51105), mRNA/cds = (69,1400 |
| 585B1 | 51 | 296 | BF696330 | Hs.318782 | 6.00E−90 | 4 | 602125273F1 cDNA, 5' end/clone = IMAGE: 4281906 |
| 45E12 | 208 | 737 | NM_000636 | Hs.318885 | 0 | 7 | superoxide dismutase 2, mitochondrial (SOD2) |
| 460G2 | 409 | 663 | BG106948 | Hs.318893 | 5.00E−96 | 1 | 602291361F1 cDNA, 5' end/clone = IMAGE: 4386159 |
| 480C1 | 155 | 325 | BF889206 | Hs.319926 | 4.00E−74 | 1 | RC6-TN0073-041200-013-H02 cDNA/gb = BF889206 |
| 178F1 | 1 | 387 | BG112503 | Hs.320972 | 1.00E−133 | 3 | 602282105F1 cDNA, 5' end/clone = IMAGE: 4369633 |
| 176G4 | 1092 | 1339 | AL110236 | Hs.321022 | 1.00E−136 | 1 | mRNA; cDNA DKFZp566P1124 (from clone DKFZp566P |
| 461H6 | 1701 | 2239 | NM_024101 | Hs.321130 | 0 | 1 | hypothetical protein MGC2771 (MGC2771), mRNA |
| 513F2 | 605 | 1614 | AK001111 | Hs.321245 | 0 | 2 | cDNA FLJ10249 fis, clone HEMBB1000725, highly |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 525B4 | 9 | 251 | BE871962 | Hs.321262 | 6.00E−98 | 15 | 601448005F1 cDNA, 5' end/clone = IMAGE: 3852001 |
| 467A4 | 1974 | 2223 | AK026270 | Hs.321454 | 6.00E−87 | 1 | cDNA: FLJ22617 fis, clone HSI05379, highly sim |
| 589F10 | 39 | 276 | BF970928 | Hs.321477 | 5.00E−77 | 1 | 602270204F1 cDNA, 5' end/clone = IMAGE: 4358425 |
| 125A7 | 1102 | 1584 | BC000627 | Hs.321677 | 0 | 1 | Signal transducer and activator of transcript |
| 597H3 | 2786 | 2920 | AL136542 | Hs.322456 | 4.00E−46 | 2 | mRNA; cDNA DKFZp761D0211 (from clone DKFZp761D |
| 465E2 | 40 | 107 | BE747224 | Hs.322643 | 7.00E−22 | 1 | 601580941F1 cDNA, 5' end/clone = IMAGE: 3929386 |
| 515A12 | 1 | 698 | AL050376 | Hs.322645 | 0 | 2 | mRNA; cDNA DKFZp586J101 (from clone DKFZp586J1 |
| 589H11 | 26 | 265 | BG283132 | Hs.322653 | 4.00E−79 | 6 | 602406784F1 cDNA, 5' end/clone = IMAGE: 4518957 |
| 586E5 | 1939 | 2162 | AK025200 | Hs.322680 | 1.00E−120 | 3 | cDNA: FLJ21547 fis, clone COL06206/cds = UNKNOW |
| 595A2 | 1 | 306 | BG311130 | Hs.322804 | 2.00E−70 | 1 | ia55a08.y1 cDNA, 5' end/clone_end = 5'/gb = BG3 |
| 459H11 | 742 | 951 | BC002746 | Hs.322824 | 1.00E−111 | 1 | Similar to dodecenoyl-Coenzyme A delta isome |
| 64C3 | 655 | 887 | NM_020368 | Hs.322901 | 1.00E−112 | 1 | disrupter of silencing 10 (SAS10), mRNA/cds = ( |
| 591B8 | 3626 | 4574 | D80006 | Hs.322903 | 0 | 3 | mRNA for KIAA0184 gene, partial cds/cds = (0,2591)/gb |
| 458C3 | 5106 | 5198 | NM_003035 | Hs.323032 | 3.00E−43 | 1 | TAL1 (SCL) interrupting locus (SIL), mRNA/cds |
| 526B7 | 2132 | 2750 | NM_024334 | Hs.323193 | 0 | 2 | hypothetical protein MGC3222 (MGC3222), mRNA |
| 167F4 | 467 | 731 | NM_014953 | Hs.323346 | 1.00E−136 | 2 | KIAA1008 protein (KIAA1008), mRNA/cds = (93,28 |
| 194B8 | 1913 | 3596 | AB051480 | Hs.323463 | 0 | 9 | mRNA for KIAA1693 protein, partial cds/cds = (0 |
| 478H9 | 75 | 564 | BF700502 | Hs.323662 | 0 | 1 | 602128860F1 cDNA, 5' end/clone = IMAGE: 4285502 |
| 119B1 | 1598 | 2284 | NM_014664 | Hs.323712 | 0 | 2 | KIAA0615 gene product (KIAA0615), mRNA/cds = ( |
| 167H2 | 1410 | 3683 | AB046771 | Hs.323822 | 0 | 4 | mRNA for KIAA1551 protein, partial cds/cds = (0 |
| 595C12 | 1 | 528 | NM_021998 | Hs.323950 | 0 | 6 | zinc finger protein 6 (CMPX1) (ZNF6), mRNA/cd |
| 462F1 | 1 | 356 | AK026836 | Hs.324060 | 1.00E−176 | 1 | cDNA: FLJ23183 fis, clone LNG11477/cds = (226,7 |
| 122D10 | 217 | 424 | AK026091 | Hs.324187 | 2.00E−83 | 1 | cDNA: FLJ22438 fis, clone HRC09232, highly sim |
| 525B2 | 1028 | 3282 | AL136739 | Hs.324275 | 0 | 2 | mRNA; cDNA DKFZp434D2111 (from clone DKFZp434D |
| 459B6 | 3 | 482 | BF668584 | Hs.324342 | 0 | 1 | 602123634F1 cDNA, 5' end/clone = IMAGE: 4280408 |
| 583D10 | 232 | 466 | NM_021104 | Hs.324406 | 1.00E−130 | 2 | ribosomal protein L41 (RPL41), mRNA/cds = (83,1 |
| 118F8 | 2262 | 2819 | NM_016824 | Hs.324470 | 0 | 1 | adducin 3 (gamma) (ADD3), transcript variant 1 |
| 461A5 | 46 | 391 | AW968541 | Hs.324481 | 1.00E−111 | 1 | EST380617 cDNA/gb = AW968541/gi = 8158382/ug = |
| 467F11 | 927 | 1189 | NM_000817 | Hs.324784 | 1.00E−147 | 1 | glutamate decarboxylase 1 (brain, 67 kD) (GAD1 |
| 103C1 | 1686 | 1771 | AK024863 | Hs.325093 | 9.00E−42 | 1 | cDNA: FLJ21210 fis, clone COL00479/cds = UNKNOW |
| 521E11 | 4276 | 4689 | AB028990 | Hs.325530 | 0 | 1 | mRNA for KIAA1067 protein, partial cds/cds = (0 |
| 480A9 | 112 | 333 | AA760848 | Hs.325874 | 1.00E−108 | 1 | nz14f06.s1 cDNA, 3' end/clone = IMAGE: 1287779 |
| 71G8 | 2619 | 2868 | NM_001964 | Hs.326035 | 1.00E−116 | 1 | early growth response 1 (EGR1), mRNA/cds = (270, |
| 593D6 | 742 | 3372 | NM_004735 | Hs.326159 | 0 | 4 | leucine rich repeat (in FLII) interacting prot |
| 463G9 | 42 | 608 | AW975482 | Hs.326165 | 0 | 1 | EST387591 cDNA/gb = AW975482/gi = 8166696/ug = |
| 526B12 | 2380 | 2639 | U83857 | Hs.326247 | 1.00E−143 | 2 | Aac11 (aac11) mRNA, complete cds/cds = (77,1663)/ gb = |
| 36A1 | 63 | 338 | AA010282 | NA | 1.00E−116 | 1 | zi08h07.r1 Soares_fetal_liver_spleen_1NFLS_S1 cDNA |
| 459D10 | 67 | 164 | AA044450 | NA | 3.00E−47 | 1 | zk55a02.r1 Soares_pregnant_uterus_NbHPU cDNA clone |
| 469E6 | 1 | 216 | AA069335 | NA | 1.00E−104 | 1 | zf74e10.r1 Soares_pineal_gland_N3HPG cDNA clone |
| 463B2 | 4 | 205 | AA077131 | NA | 4.00E−88 | 1 | Brain cDNA Library cDNA clone 7B08E10 |
| 68H9 | 17 | 383 | AA101212 | NA | 0 | 1 | endothelial cell 937223 cDNA clone IMAGE: 549605 3' |
| 458F3 | 120 | 498 | AA115345 | NA | 0 | 1 | zl09f11.r1 Soares_pregnant_uterus_NbHPU cDNA clone |
| 459E6 | 36 | 532 | AA122297 | NA | 0 | 1 | zk97a11.r1 Soares_pregnant_uterus_NbHPU cDNA clone |
| 462C5 | 1 | 122 | AA136584 | NA | 2.00E−59 | 1 | fetal retina 937202 cDNA clone IMAGE: 565899 3' |
| 594A1 | 60 | 412 | AA149078 | NA | 0 | 1 | zl45e09.r1 Soares_pregnant_uterus_NbHPU cDNA clone |
| 515A9 | 329 | 449 | AA182528 | NA | 2.00E−46 | 1 | NT2 neuronal precursor 937230 cDNA clone |
| 75H4 | 7 | 371 | AA187234 | NA | 1.00E−119 | 1 | endothelial cell 937223 cDNA clone IMAGE: 624540 3' |
| 73F10 | 1 | 544 | AA210786 | NA | 0 | 1 | cDNA clone IMAGE: 682976 5' |
| 525D8 | 1 | 119 | AA214691 | NA | 6.00E−60 | 1 | Express cDNA library cDNA 5' |
| 37H4 | 250 | 401 | AA243144 | NA | 3.00E−48 | 1 | cDNA clone IMAGE: 685113 5' |
| 463B10 | 145 | 408 | AA250809 | NA | 1.00E−123 | 1 | cDNA clone IMAGE: 684374 5' |
| 464E10 | 1 | 303 | AA251184 | NA | 1.00E−119 | 1 | cDNA clone IMAGE: 684046 5' |
| 477H8 | 1 | 123 | AA252909 | NA | 4.00E−58 | 3 | cDNA clone IMAGE: 669292 5' |
| 465C3 | 1 | 279 | AA258979 | NA | 1.00E−129 | 1 | cDNA clone IMAGE: 687151 5' |
| 588G6 | 275 | 529 | AA280051 | NA | 2.00E−94 | 1 | cDNA clone IMAGE: 705062 5' |
| 465E9 | 74 | 429 | AA282774 | NA | 0 | 1 | cDNA clone IMAGE: 713136 5' |
| 459E7 | 49 | 466 | AA283061 | NA | 0 | 1 | cDNA clone IMAGE: 713078 5' |
| 164B4 | 41 | 329 | AA284232 | NA | 1.00E−148 | 2 | zc39c01.T7 Soares_senescent_fibroblasts_NbHSF cDNA |
| 461G8 | 289 | 532 | AA290921 | NA | 1.00E−123 | 1 | cDNA clone IMAGE: 700335 5' |
| 470G7 | 29 | 441 | AA290993 | NA | 0 | 1 | cDNA clone IMAGE: 700425 5' |
| 500A12 | 1 | 519 | AA307854 | NA | 1.00E−174 | 1 | (HCC) cell line cDNA 5' end similar to |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 471F4 | 9 | 326 | AA309188 | NA | 1.00E−153 | 1 | cDNA |
| 194B6 | 134 | 467 | AA312681 | NA | 1.00E−163 | 1 | cDNA 5' end |
| 69F3 | 5 | 321 | AA314369 | NA | 1.00E−176 | 1 | (HCC) cell line II cDNA 5' end similar |
| 67G10 | 1 | 171 | AA319163 | NA | 3.00E−64 | 2 | cDNA 5' end |
| 99A5 | 1 | 287 | AA322158 | NA | 1.00E−136 | 1 | cDNA 5' end similar to similar to tropomyosin |
| 171B1 | 13 | 310 | AA332553 | NA | 1.00E−135 | 1 | cDNA 5' end |
| 485D11 | 46 | 210 | AA360634 | NA | 2.00E−75 | 1 | cDNA 5' end |
| 462G2 | 1 | 183 | AA377352 | NA | 4.00E−89 | 2 | cDNA 5' end |
| 523A8 | 1 | 407 | AA397592 | NA | 0 | 1 | cDNA clone IMAGE: 728546 5' |
| 171G10 | 1 | 409 | AA401648 | NA | 0 | 2 | cDNA clone IMAGE: 726936 5' |
| 100F5 | 42 | 172 | AA402069 | NA | 4.00E−60 | 1 | cDNA clone IMAGE: 727161 5' |
| 459H7 | 48 | 375 | AA412436 | NA | 1.00E−163 | 1 | cDNA clone IMAGE: 731446 5' |
| 102A8 | 25 | 120 | AA418765 | NA | 1.00E−46 | 1 | cDNA clone IMAGE: 767795 5' |
| 73A3 | 1 | 424 | AA426506 | NA | 0 | 1 | cDNA clone IMAGE: 768117 5' |
| 72E10 | 1 | 442 | AA427653 | NA | 0 | 11 | tumor NbHOT cDNA clone IMAGE: 770045 5' |
| 72A1 | 1 | 261 | AA429783 | NA | 1.00E−142 | 1 | zw57b01.r1 Soares_total_fetus_Nb2HF8_9w cDNA clone |
| 460D12 | 126 | 388 | AA431959 | NA | 1.00E−93 | 1 | cDNA clone IMAGE: 782188 3' |
| 450B11 | 1 | 437 | AA454987 | NA | 0 | 1 | cDNA clone IMAGE: 811916 5' |
| 518A8 | 1 | 329 | AA457757 | NA | 1.00E−177 | 1 | fetal retina 937202 cDNA clone IMAGE: 838756 5' |
| 460F7 | 47 | 490 | AA460876 | NA | 0 | 1 | zx69d04.r1 Soares_total_fetus_Nb2HF8_9w cDNA clone |
| 118H12 | 1 | 304 | AA476568 | NA | 1.00E−163 | 1 | zx02f11.r1 Soares_total_fetus_Nb2HF8_9w cDNA clone |
| 40F11 | 1 | 533 | AA479163 | NA | 0 | 1 | cDNA clone IMAGE: 754246 5' similar to gb: X15606 |
| 470F3 | 76 | 356 | AA482019 | NA | 1.00E−142 | 1 | cDNA clone IMAGE: 746046 3' |
| 466C2 | 1 | 354 | AA490796 | NA | 1.00E−148 | 1 | cDNA clone IMAGE: 82101 5' |
| 464A9 | 228 | 364 | AA496483 | NA | 7.00E−71 | 1 | tumor NbHOT cDNA clone IMAGE: 755690 5' similar to |
| 123D11 | 99 | 297 | AA501725 | NA | 1.00E−103 | 1 | cDNA clone IMAGE: 929806 similar to contains Alu |
| 119G10 | 128 | 374 | AA501934 | NA | 1.00E−134 | 1 | cDNA clone IMAGE: 956346 |
| 166A11 | 19 | 140 | AA516406 | NA | 1.00E−48 | 1 | cDNA clone IMAGE: 923858 3' |
| 36G1 | 5 | 480 | AA524720 | NA | 0 | 1 | cDNA clone IMAGE: 937468 3' |
| 109H9 | 37 | 286 | AA573427 | NA | 1.00E−130 | 2 | cDNA clone IMAGE: 1028913 3' |
| 477B2 | 8 | 273 | AA579400 | NA | 1.00E−143 | 1 | cDNA clone IMAGE: 915561 similar to contains Alu |
| 178C10 | 1 | 354 | AA588755 | NA | 1.00E−177 | 1 | cDNA clone IMAGE: 1084243 3' |
| 486G7 | 35 | 99 | AA613460 | NA | 6.00E−28 | 1 | cDNA clone IMAGE: 1144571 similar to contains |
| 472E9 | 27 | 389 | AA628833 | NA | 1.00E−119 | 1 | af37g04.s1 Soares_total_fetus_Nb2HF8_9w cDNA clone |
| 100C3 | 122 | 505 | AA639796 | NA | 0 | 1 | cDNA clone IMAGE: 1159029 3' |
| 518A7 | 39 | 226 | AA665359 | NA | 4.00E−83 | 1 | cDNA clone IMAGE: 1205697 similar to |
| 473D9 | 377 | 446 | AA683244 | NA | 1.00E−30 | 1 | schizo brain S11 cDNA clone IMAGE: 971252 3' |
| 523D7 | 80 | 502 | AA701667 | NA | 1.00E−158 | 1 | zi43g09.s1 Soares_fetal_liver_spleen_1NFLS_S1 cDNA |
| 472B1 | 37 | 130 | AA744774 | NA | 1.00E−35 | 1 | cDNA clone IMAGE: 1283731 3' |
| 98C9 | 10 | 254 | AA748714 | NA | 1.00E−111 | 1 | cDNA clone IMAGE: 1270595 3' |
| 196D7 | 3 | 442 | AA806222 | NA | 0 | 1 | cDNA clone IMAGE: 1409989 3' |
| 118A8 | 10 | 381 | AA806766 | NA | 0 | 1 | cDNA clone IMAGE: 1338727 3' |
| 98B3 | 56 | 159 | AA826572 | NA | 7.00E−47 | 1 | cDNA clone IMAGE: 1416447 3' |
| 154D9 | 38 | 405 | AA846378 | NA | 1.00E−164 | 1 | cDNA clone IMAGE: 1394232 3' |
| 459C2 | 1 | 491 | AA909983 | NA | 0 | 2 | Soares_NFL_T_GBC_S1 cDNA clone IMAGE: 1523142 3' |
| 486A7 | 1 | 176 | AA916990 | NA | 1.00E−72 | 1 | Soares_NFL_T_GBC_S1 cDNA clone IMAGE: 1527333 3' |
| 460D2 | 78 | 537 | AA923567 | NA | 0 | 1 | cDNA clone IMAGE: 1536231 3' |
| 105F4 | 86 | 390 | AA974839 | NA | 4.00E−94 | 1 | cDNA clone IMAGE: 1567639 3' |
| 461H7 | 295 | 383 | AA974991 | NA | 2.00E−30 | 1 | Soares_NFL_T_GBC_S1 cDNA clone IMAGE: 1560953 3' |
| 162B1 | 398 | 470 | AA976045 | NA | 9.00E−28 | 1 | cDNA clone IMAGE: 1558392 3' |
| 53D8 | 1 | 422 | AA984245 | NA | 1.00E−162 | 1 | schizo brain S11 cDNA clone IMAGE: 1629672 3' |
| 524A5 | 3568 | 4037 | AB020681 | NA | 0 | 1 | mRNA for KIAA0874 protein, partial cds Length = 4440 |
| 174H3 | 81 | 271 | AB021288 | NA | 1.00E−101 | 1 | mRNA for beta 2-microglobulin, complete cds Length = 925 |
| 115A2 | 1920 | 2309 | AB034747 | NA | 0 | 4 | SIMPLE mRNA for small integral membrane protein of lysosome/late endos |
| 39G7 | 1578 | 1920 | AB040875 | NA | 1.00E−135 | 3 | hxCT mRNA for cystine/glutamate exchanger, complete cds Length = 2000 |
| 149H2 | 430 | 713 | AB044971 | NA | 1.00E−158 | 1 | mRNA for nucleolar phosphoprotein Nopp34, complete cds Length = 1005 |
| 458F6 | 780 | 1235 | AB045118 | NA | 0 | 1 | FRAT2 mRNA, complete cds Length = 2164 |
| 459D12 | 2694 | 3564 | AB045278 | NA | 0 | 2 | beta3GnT5 mRNA for beta1,3-N-acetylglucosaminyltransferase 5, complete |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 103H7 | 1294 | 1933 | AB049881 | NA | 1.00E−139 | 1 | similar to Macaca fascicularis brain cDNA, clone: QnpA 18828 Length = 2517 |
| 102E11 | 1142 | 1772 | AB050511 | NA | 0 | 1 | similar to Macaca fascicularis brain cDNA, clone: QnpA-18828 Length = 2518 |
| 460C3 | 798 | 930 | AB050514 | NA | 9.00E−54 | 1 | similar to Macaca fascicularis brain cDNA, clone: QnpA-18828 Length = 2519 |
| 480A10 | 4649 | 5183 | AB058677 | NA | 0 | 1 | mRNA for MEGF11 protein (KIAA1781), complete cds Length = 5702 |
| 142G10 | 2251 | 2430 | AB060884 | NA | 6.00E−44 | 1 | similar to Macaca fascicularis brain cDNA clone: QtrA-13024, full insert sequence |
| 494G5 | 1585 | 1998 | AF005213 | NA | 0 | 1 | ankyrin 1 (ANK1) mRNA, complete cds Length = 2651 |
| 154C6 | 520 | 826 | AF005775 | NA | 1.00E−150 | 3 | caspase-like apoptosis regulatory protein 2 (clarp) mRNA, alternativel |
| 186B6 | 772 | 1248 | AF039575 | NA | 0 | 1 | heterogeneous nuclear ribonucleoprotein D0B mRNA partial cds |
| 471A4 | 395 | 611 | AF061944 | NA | 6.00E−84 | 1 | kinase deficient protein KDP mRNA, partial cds Length = 2653 |
| 37G5 | 277 | 525 | AF067529 | NA | 1.00E−129 | 1 | PITSLRE protein kinase beta SV18 isoform (CDC2L2) mRNA, partial cds |
| 479D1 | 1270 | 1570 | AF070635 | NA | 1.00E−144 | 1 | clone 24818 mRNA sequence Length = 1643 |
| 491E2 | 38 | 226 | AF086214 | NA | 9.00E−74 | 1 | full length insert cDNA clone ZD64D04 Length = 691 |
| 517C2 | 230 | 465 | AF086431 | NA | 1.00E−113 | 1 | full length insert cDNA clone ZD79H10 Length = 530 |
| 593C6 | 1 | 359 | AF113210 | NA | 0 | 5 | MSTP030 mRNA, complete cds Length = 1024 |
| 191A8 | 135 | 1169 | AF113213 | NA | 0 | 3 | MSTP033 mRNA, complete cds Length = 1281 |
| 144E9 | 799 | 943 | AF116679 | NA | 9.00E−29 | 1 | PRO2003 mRNA, complete cds Length = 1222 |
| 106E3 | 583 | 1187 | AF116702 | NA | 0 | 2 | PRO2446 mRNA, complete cds Length = 1356 |
| 72F8 | 878 | 1205 | AF130094 | NA | 1.00E−175 | 1 | clone FLC0165 mRNA sequence Length = 1548 |
| 458G9 | 730 | 1463 | AF157116 | NA | 0 | 1 | clone 274512, mRNA sequence Length = 2172 |
| 139F11 | 18 | 229 | AF161430 | NA | 1.00E−115 | 1 | HSPC312 mRNA, partial cds Length = 360 |
| 149H10 | 406 | 621 | AF161455 | NA | 3.00E−95 | 2 | HSPC337 mRNA, partial cds Length = 1033 |
| 68A9 | 19 | 243 | AF173954 | NA | 2.00E−27 | 1 | Cloning vector pGEM-URA3, complete sequence Length = 4350 |
| 165B7 | 65 | 418 | AF202092 | NA | 0 | 1 | PC3-96 mRNA, complete cds Length = 1068 |
| 52H1 | 361 | 594 | AF212226 | NA | 1.00E−34 | 1 | RPL24 mRNA, complete cds Length = 1474 |
| 162H8 | 52 | 404 | AF212233 | NA | 1.00E−179 | 1 | microsomal signal peptidase subunit mRNA, complete cds Length = 794 |
| 54E10 | 680 | 1316 | AF212241 | NA | 0 | 3 | CDA02 mRNA, complete cds Length = 2179 |
| 117D8 | 2052 | 2482 | AF248648 | NA | 0 | 3 | RNA-binding protein BRUNOL2 mRNA, complete cds Length = 2615 |
| 75E3 | 326 | 662 | AF249845 | NA | 0 | 2 | isolate Siddi 10 hypervariable region 1, mitochondrial sequence |
| 459G12 | 791 | 1267 | AF260237 | NA | 0 | 1 | hairy/enhancer of split 6 (HES6) mRNA, complete cds Length = 1286 |
| 177F6 | 1968 | 2423 | AF267856 | NA | 0 | 1 | HT033 mRNA, complete cds Length = 2972 |
| 115G8 | 996 | 1399 | AF267863 | NA | 0 | 1 | DC43 mRNA, complete cds Length = 2493 |
| 501H3 | 426 | 1152 | AF279437 | NA | 0 | 107 | interleukin 22 (IL22) mRNA, complete cds Length = 1167 |
| 174B4 | 900 | 1332 | AF283771 | NA | 0 | 2 | clone TCBAP0774 mRNA sequence Length = 1814 |
| 126C7 | 454 | 843 | AF332864 | NA | 1.00E−116 | 2 | similar to Mus Ras association domain family 3 protein (Rassf3) mRNA |
| 105A9 | 232 | 624 | AF333025 | NA | 1.00E−140 | 1 | prokineticin 2 precursor (PROK2) mRNA, complete cds Length = 1406 |
| 186F1 | 4543 | 5058 | AF347010 | NA | 0 | 3 | mitochondrion, complete genome Length = 16570 |
| 590B12 | 4684 | 5053 | AF347013 | NA | 0 | 1 | mitochondrion, complete genome Length = 16566 |
| 517H7 | 4669 | 5058 | AF347015 | NA | 0 | 1 | mitochondrion, complete genome Length = 16571 |
| 596E9 | 220 | 295 | AI027844 | NA | 3.00E−34 | 1 | cDNA clone IMAGE: 1671612 3' |
| 599B3 | 608 | 609 | AI039890 | NA | 1.00E−45 | 1 | ox97d11.x1 Soares_senescent_fibroblasts_NbHSF cDNA |
| 189H9 | 22 | 524 | AI041828 | NA | 0 | 1 | oy34b08.x1 Soares_parathyroid_tumor_NbHPA cDNA clone |
| 471F6 | 63 | 526 | AI084224 | NA | 0 | 1 | cDNA clone IMAGE: 1671418 3' |
| 142E9 | 6 | 372 | AI091533 | NA | 1.00E−179 | 1 | oo23d05.x1 Soares_NSF_F8_9W_OT_PA_P_S1 cDNA clone |
| 72D2 | 65 | 529 | AI131018 | NA | 0 | 6 | qb82e07.x1 Soares_fetal_heart_NbHH19W cDNA clone |
| 468F6 | 9 | 428 | AI223400 | NA | 0 | 1 | cDNA clone IMAGE: 1838447 3' similar to TR: O15383 |
| 185H1 | 94 | 199 | AI267714 | NA | 5.00E−50 | 1 | SB pool 1 cDNA clone IMAGE: 2038526 |
| 166A9 | 1 | 480 | AI275205 | NA | 0 | 1 | cDNA clone IMAGE: 1990616 3' |
| 499F2 | 4 | 395 | AI281442 | NA | 0 | 2 | cDNA clone IMAGE: 1967452 3' |
| 517H5 | 155 | 457 | AI298509 | NA | 1.00E−158 | 1 | cDNA clone IMAGE: 1896546 3' |
| 144F7 | 24 | 364 | AI299573 | NA | 0 | 1 | cDNA clone IMAGE: 1900105 3' |
| 519E9 | 52 | 408 | AI352690 | NA | 1.00E−180 | 1 | cDNA clone IMAGE: 1946884 3' |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 466F9 | 172 | 440 | AI361839 | NA | 1.00E−109 | 1 | cDNA clone IMAGE: 2022012 3' |
| 144C9 | 118 | 373 | AI362793 | NA | 7.00E−63 | 1 | cDNA clone IMAGE: 2018948 3' similar to gb: M60854 |
| 464B11 | 19 | 455 | AI363001 | NA | 0 | 1 | cDNA clone IMAGE: 2018452 3' similar to contains |
| 127B6 | 40 | 257 | AI370412 | NA | 6.00E−96 | 1 | cDNA clone IMAGE: 1987587 3' |
| 166C4 | 58 | 271 | AI371227 | NA | 1.00E−62 | 1 | cDNA clone IMAGE: 1987633 3' similar to |
| 467G7 | 1 | 450 | AI380016 | NA | 0 | 1 | cDNA clone IMAGE: 2109169 3' similar to |
| 466C5 | 316 | 497 | AI380390 | NA | 8.00E−44 | 1 | cDNA clone IMAGE: 2107088 3' |
| 466B5 | 200 | 477 | AI381586 | NA | 1.00E−126 | 1 | cDNA clone IMAGE: 2074796 3' |
| 458G10 | 347 | 444 | AI384128 | NA | 2.00E−40 | 1 | cDNA clone IMAGE: 2088819 3' similar to contains |
| 467A8 | 415 | 522 | AI391500 | NA | 1.00E−41 | 1 | cDNA clone IMAGE: 2107686 3' |
| 477D1 | 14 | 269 | AI392705 | NA | 1.00E−137 | 2 | cDNA clone IMAGE: 2109581 3' |
| 467B11 | 1 | 293 | AI393970 | NA | 1.00E−122 | 1 | cDNA clone IMAGE: 2107950 3' |
| 522D3 | 250 | 526 | AI419082 | NA | 1.00E−127 | 1 | cDNA clone IMAGE: 2103029 3' |
| 149A11 | 25 | 313 | AI440491 | NA | 1.00E−132 | 1 | cDNA clone IMAGE: 2073277 3' |
| 471C1 | 77 | 215 | AI458739 | NA | 1.00E−50 | 1 | cDNA clone IMAGE: 2149471 3' similar to gb: S85655 |
| 116E10 | 162 | 503 | AI469584 | NA | 1.00E−171 | 1 | cDNA clone IMAGE: 2156522 3' |
| 472C8 | 1 | 369 | AI498316 | NA | 0 | 1 | cDNA clone IMAGE: 2160886 3' similar to TR: Q62717 |
| 468E8 | 2 | 451 | AI523854 | NA | 3.00E−92 | 1 | cDNA clone IMAGE: 2116683 3' |
| 477B5 | 23 | 295 | AI524624 | NA | 2.00E−86 | 1 | cDNA clone IMAGE: 2075323 3' |
| 193H3 | 368 | 489 | AI525644 | NA | 4.00E−34 | 1 | cDNA 5' |
| 66F1 | 277 | 436 | AI571519 | NA | 7.00E−84 | 2 | cDNA clone IMAGE: 2225079 3' similar to gb: J03909 |
| 171A11 | 225 | 429 | AI581199 | NA | 1.00E−101 | 3 | cDNA clone IMAGE: 2154787 3' similar to |
| 116F2 | 337 | 429 | AI597917 | NA | 4.00E−42 | 1 | cDNA clone IMAGE: 2258495 3' similar to contains |
| 461G10 | 9 | 398 | AI627495 | NA | 1.00E−179 | 1 | cDNA clone IMAGE: 2285386 3' |
| 594D11 | 206 | 434 | AI628930 | NA | 1.00E−110 | 1 | cDNA clone IMAGE: 2281541 3' similar to |
| 489H9 | 1 | 507 | AI633798 | NA | 0 | 4 | cDNA clone IMAGE: 2242115 3' |
| 171G7 | 212 | 431 | AI634972 | NA | 1.00E−103 | 1 | cDNA clone IMAGE: 2284157 3' |
| 165C12 | 270 | 581 | AI651212 | NA | 1.00E−175 | 1 | cDNA clone IMAGE: 2304186 3' |
| 64B3 | 1 | 529 | AI678099 | NA | 0 | 1 | Soares_NFL_T_GBC_S1 cDNA clone IMAGE: 2330166 3' |
| 134H3 | 186 | 289 | AI684022 | NA | 1.00E−34 | 1 | cDNA clone IMAGE: 2267411 3' |
| 110B8 | 169 | 496 | AI688560 | NA | 1.00E−132 | 1 | Soares_NFL_T_GBC_S1 cDNA clone IMAGE: 2330535 3' |
| 459F2 | 160 | 542 | AI697756 | NA | 0 | 1 | cDNA clone IMAGE: 2341330 3' |
| 481F11 | 21 | 340 | AI700738 | NA | 1.00E−167 | 1 | cDNA clone IMAGE: 2343628 3' |
| 488C5 | 37 | 533 | AI701165 | NA | 0 | 4 | cDNA clone IMAGE: 2340734 3' |
| 104D9 | 116 | 241 | AI709236 | NA | 4.00E−60 | 1 | HPLRB6 cDNA clone IMAGE: 2353865 3' similar to |
| 112E1 | 18 | 576 | AI742850 | NA | 0 | 1 | wg47a05.x1 Soares_NSF_F8_9W_OT_PA_P_S1 cDNA clone |
| 113H12 | 5 | 140 | AI748827 | NA | 1.00E−63 | 1 | HPLRB6 cDNA clone IMAGE: 2356401 3' |
| 458B8 | 150 | 474 | AI760353 | NA | 0 | 1 | cDNA clone IMAGE: 2387703 3' |
| 461H11 | 334 | 578 | AI762870 | NA | 1.00E−111 | 1 | cDNA clone IMAGE: 2397996 3' |
| 458D10 | 1 | 465 | AI765153 | NA | 0 | 1 | cDNA clone IMAGE: 2393531 3' |
| 38B5 | 2 | 295 | AI766963 | NA | 1.00E−140 | 1 | cDNA clone IMAGE: 2400693 3' |
| 471A2 | 320 | 394 | AI796317 | NA | 2.00E−31 | 1 | cDNA clone IMAGE: 2384100 3' |
| 74D10 | 15 | 377 | AI802547 | NA | 1.00E−124 | 2 | cDNA clone IMAGE: 2186739 3'similar to TR: O15510 |
| 482C9 | 117 | 409 | AI803065 | NA | 1.00E−164 | 1 | tj47a07.x1 Soares_NSF_F8_9W_OT_PA_P_S1 cDNA clone |
| 480C5 | 177 | 517 | AI807278 | NA | 0 | 1 | Soares_NFL_T_GBC_S1 cDNA clone IMAGE: 2357909 3' |
| 175B12 | 228 | 513 | AI817153 | NA | 1.00E−132 | 1 | cDNA clone IMAGE: 2413005 3' |
| 66E10 | 14 | 268 | AI858771 | NA | 1.00E−119 | 1 | cDNA clone IMAGE: 2429769 3' |
| 470H6 | 65 | 500 | AI880607 | NA | 0 | 1 | HPLRB6 cDNA clone IMAGE: 2355013 3' |
| 181D12 | 7 | 512 | AI884548 | NA | 0 | 1 | cDNA clone IMAGE: 2437818 3'similar to gb: L06797 |
| 468H6 | 52 | 528 | AI884671 | NA | 0 | 1 | cDNA clone IMAGE: 2431488 3' |
| 597C9 | 284 | 383 | AI904071 | NA | 1.00E−48 | 1 | cDNA |
| 467C2 | 206 | 351 | AI917642 | NA | 2.00E−59 | 1 | cDNA clone IMAGE: 2392330 3' |
| 459D1 | 25 | 575 | AI948513 | NA | 0 | 1 | cDNA clone IMAGE: 2470532 3' |
| 166E11 | 152 | 280 | AI954499 | NA | 4.00E−54 | 1 | cDNA clone IMAGE: 2550263 3' |
| 493D7 | 2032 | 2171 | AJ001235 | NA | 4.00E−29 | 1 | similar to Papio hamadryas ERV-9 like LTR insertion Length = 2240 |
| 116B1 | 1169 | 1744 | AJ009771 | NA | 0 | 1 | mRNA for putative RING finger protein, partial Length = 3038 |
| 137B9 | 296 | 407 | AJ271637 | NA | 4.00E−32 | 1 | similar to Elaeis guineensis microsatellite DNA, clone mEgCIR0219 |
| 483E6 | 4250 | 4492 | AJ278191 | NA | 1.00E−95 | 1 | similar to Mus musculus mRNA for putative mc7 protein (mc7 gene) |
| 144A8 | 988 | 1152 | AK001163 | NA | 1.00E−75 | 1 | cDNA FLJ10301 fis, clone NT2RM2000032 Length = 1298 |
| 525C11 | 49 | 496 | AK001451 | NA | 0 | 1 | cDNA FLJ10589 fis, clone NT2RP2004389 |
| 177D9 | 707 | 980 | AK004265 | NA | 7.00E−76 | 1 | similar to Mus 18 days embryo cDNA, RIKEN full-length enriched library, |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 111E10 | 777 | 1121 | AK004400 | NA | 1.00E−112 | 1 | similar to Mus 18 days embryo cDNA, RIKEN full-length enriched library, |
| 458G4 | 650 | 1259 | AK008020 | NA | 8.00E−86 | 1 | similar to Mus adult male small intestine cDNA, RIKEN full-length enrich |
| 47G7 | 31 | 328 | AK009988 | NA | 1.00E−111 | 1 | similar to Mus adult male tongue cDNA, RIKEN full-length enriched librar |
| 69G7 | 1801 | 1987 | AK012426 | NA | 5.00E−68 | 3 | similar to Mus 11 days embryo cDNA, RIKEN full-length enriched library, |
| 62C10 | 1092 | 1267 | AK013164 | NA | 6.00E−46 | 2 | similar to Mus 10, 11 days embryo cDNA, RIKEN full-length enriched libra |
| 46D9 | 3243 | 3564 | AK014408 | NA | 1.00E−104 | 1 | similar to Mus 12 days embryo embryonic body below diaphragm region |
| 1078C11 | 2069 | 2326 | AK016683 | NA | 9.00E−83 | 1 | similar to Mus adult male testis cDNA, RIKEN full-length enriched librar |
| 102C12 | 698 | 1339 | AK018758 | NA | 0 | 1 | similar to Mus adult male liver cDNA, RIKEN full-length enriched library |
| 585B3 | 1278 | 1873 | AK021925 | NA | 0 | 1 | cDNA FLJ11863 fis, clone HEMBA1006926 Length = 2029 |
| 46F3 | 1377 | 2006 | AK022057 | NA | 0 | 1 | cDNA FLJ11995 fis, clone HEMBB1001443, highly similar to Rattus norveg |
| 73E7 | 344 | 1112 | AK023512 | NA | 0 | 9 | cDNA FLJ13450 fis, clone PLACE1003027, highly similar to *Homo sapiens* |
| 465B12 | 681 | 1338 | AK024202 | NA | 0 | 1 | cDNA FLJ14140 fis, clone MAMMA1002858, highly similar to Rat cMG1 |
| 142D12 | 254 | 358 | AK024740 | NA | 9.00E−27 | 1 | cDNA: FLJ21087 fis, clone CAS03323 Length = 826 |
| 472F7 | 1330 | 1623 | AK024764 | NA | 1.00E−164 | 1 | cDNA: FLJ21111 fis, clone CAS05384, highly similar to AF144700 Homo sa |
| 521A3 | 26 | 195 | AK024976 | NA | 2.00E−90 | 1 | cDNA: FLJ21323 fis, clone COL02374 Length = 1348 |
| 465D1 | 2091 | 2255 | AK025769 | NA | 1.00E−74 | 1 | cDNA: FLJ22116 fis, clone HEP18520 Length = 2271 |
| 595E9 | 16 | 546 | AK026264 | NA | 0 | 1 | cDNA: FLJ22611 fis, clone HSI04961 Length = 1426 |
| 103E1 | 1353 | 1866 | AK026334 | NA | 1.00E−126 | 1 | cDNA: FLJ22681 fis, clone HSI10693 Length = 1903 |
| 524F3 | 1635 | 1742 | AK026443 | NA | 9.00E−51 | 2 | cDNA: FLJ22790 fis, clone KAIA2176, highly similar to HUMPMCA |
| 196H10 | 938 | 1286 | AK026819 | NA | 6.00E−82 | 1 | cDNA: FLJ23166 fis, clone LNG09880 Length = 1941 |
| 172F7 | 349 | 738 | AK027258 | NA | 0 | 1 | cDNA: FLJ23605 fis, clone LNG15982, highly similar to AF113539 Homo sa |
| 187B10 | 1583 | 2142 | AK027260 | NA | 1.00E−129 | 1 | cDNA: FLJ23607 fis, clone LNG16050 Length = 2560 |
| 190F11 | 76 | 636 | AL042081 | NA | 0 | 1 | (synonym: htes3) cDNA clone DKFZp434P171 3' |
| 525A9 | 1 | 653 | AL042370 | NA | 0 | 1 | (synonym: htes3) cDNA clone DKFZp434A1821 5' |
| 464G8 | 59 | 686 | AL042376 | NA | 0 | 1 | (synonym: htes3) cDNA clone DKFZp434A2421 5' |
| 172B12 | 380 | 624 | AL047171 | NA | 1.00E−131 | 1 | (synonym: hute1) cDNA clone DKFZp586F2018 5' |
| 193F3 | 915 | 1309 | AL049305 | NA | 1.00E−133 | 1 | mRNA; cDNA DKFZp564A186 (from clone DKFZp564A186) Length = 1669 |
| 111H8 | 102 | 660 | AL049356 | NA | 1.00E−146 | 1 | mRNA; cDNA DKFZp566E233 (from clone DKFZp566E233) Length = 808 |
| 526E6 | 118 | 551 | AL049932 | NA | 1.00E−147 | 2 | mRNA; cDNA DKFZp564H2416 (from clone DKFZp564H2416) Length = 1865 |
| 37C8 | 707 | 996 | AL050218 | NA | 1.00E−156 | 1 | mRNA; cDNA DKFZp586I0923 (from clone DKFZp586I0923) Length = 1282 |
| 72A9 | 1235 | 1391 | AL110164 | NA | 2.00E−70 | 1 | mRNA; cDNA DKFZp586I0324 (from clone DKFZp586I0324) Length = 1705 |
| 107C8 | 1042 | 1398 | AL117644 | NA | 0 | 2 | mRNA; cDNA DKFZp434M095 (from clone DKFZp434M095) Length = 1455 |
| 62E7 | 1 | 475 | AL120453 | NA | 1.00E−117 | 1 | (synonym: hamy2) cDNA clone DKFZp761I208 5' |
| 492A7 | 77 | 390 | AL121406 | NA | 1.00E−101 | 1 | (synonym: hmel2) cDNA clone DKFZp762G117 5' |
| 598B1 | 443 | 812 | AL133879 | NA | 1.00E−172 | 1 | (synonym: hamy2) cDNA clone DKFZp761J0114 5' |
| 458C10 | 47 | 351 | AL133913 | NA | 5.00E−76 | 1 | (synonym: hamy2) cDNA clone DKFZp761M2014 5' |
| 98E7 | 922 | 2284 | AL136558 | NA | 0 | 6 | mRNA; cDNA DKFZp761B1514 (from clone DKFZp761B1514) Length = 3453 |
| 157F6 | 3511 | 3847 | AL136797 | NA | 0 | 1 | mRNA; cDNA DKFZp434N031 (from clone DKFZp434N031); complete cds |
| 68B4 | 1009 | 1595 | AL136932 | NA | 0 | 1 | mRNA; cDNA DKFZp586H1322 (from clone DKFZp586H1322); complete cds |
| 458B6 | 278 | 955 | AL137601 | NA | 0 | 1 | mRNA; cDNA DKFZp434E0811 (from clone DKFZp434E0811); partial cds |
| 172C9 | 1866 | 2423 | AL137608 | NA | 0 | 1 | mRNA; cDNA DKFZp434J1111 (from clone DKFZp434J1111); partial cds |
| 72G1 | 194 | 474 | AL138429 | NA | 1.00E−151 | 1 | (synonym: htes3) cDNA clone DKFZp434E0629 3' |
| 463H12 | 12 | 356 | AL513780 | NA | 1.00E−124 | 1 | cDNA clone CL0BA003ZF07 5 prime |
| 181B6 | 43 | 638 | AL520535 | NA | 0 | 1 | cDNA clone CS0DB006YD20 3 prime |
| 69B6 | 352 | 858 | AL520892 | NA | 0 | 1 | cDNA clone CS0DB002YG16 5 prime |
| 182A5 | 119 | 617 | AL521097 | NA | 0 | 1 | cDNA clone CS0DB001YA13 3 prime |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 458E9 | 3 | 865 | AL528020 | NA | 0 | 2 | cDNA clone CS0DC028YO09 3 prime |
| 485C11 | 1 | 431 | AL532303 | NA | 0 | 1 | cDNA clone CS0DM014YJ04 5 prime |
| 196G3 | 78 | 698 | AL532406 | NA | 0 | 1 | cDNA clone CS0DM014YL03 5 prime |
| 105H4 | 154 | 486 | AL533737 | NA | 1.00E−156 | 1 | cDNA clone CS0DF002YH09 5 prime |
| 594G1 | 337 | 756 | AL534564 | NA | 0 | 1 | cDNA clone CS0DF004YI09 5 prime |
| 524A9 | 403 | 906 | AL540260 | NA | 0 | 1 | cDNA clone CS0DF032YF03 3 prime |
| 118H5 | 433 | 532 | AL540399 | NA | 4.00E−39 | 1 | cDNA clone CS0DE001YM08 5 prime |
| 124C2 | 270 | 815 | AL543900 | NA | 0 | 1 | cDNA clone CS0DI005YK13 3 prime |
| 471D3 | 216 | 403 | AL550229 | NA | 9.00E−49 | 1 | cDNA clone CS0DI039YD11 5 prime |
| 191F2 | 324 | 844 | AL554506 | NA | 0 | 1 | cDNA clone CS0DI083YJ17 5 prime |
| 166F6 | 64 | 576 | AL556016 | NA | 0 | 1 | cDNA clone CS0DK010YH04 5 prime |
| 467G9 | 61 | 401 | AL556919 | NA | 1.00E−138 | 1 | cDNA clone CS0DK012YI02 5 prime |
| 37D7 | 149 | 685 | AL559029 | NA | 0 | 1 | cDNA clone CS0DJ010YJ11 5 prime |
| 590B3 | 76 | 287 | AL559422 | NA | 1.00E−111 | 2 | cDNA clone CS0DJ013YN07 5 prime |
| 181H2 | 168 | 780 | AL559555 | NA | 0 | 1 | cDNA clone CS0DJ013YP21 5 prime |
| 589E3 | 28 | 447 | AL561074 | NA | 0 | 1 | cDNA clone CS0DL001YN01 5 prime |
| 487F9 | 326 | 739 | AL561892 | NA | 1.00E−149 | 1 | cDNA clone CS0DB006YL04 3 prime |
| 68F10 | 12 | 658 | AL562895 | NA | 0 | 1 | cDNA clone CS0DC021YO20 3 prime |
| 157D7 | 2 | 108 | AL565736 | NA | 1.00E−28 | 1 | cDNA clone CS0DF007YC06 3 prime |
| 177B1 | 231 | 505 | AL567986 | NA | 1.00E−128 | 1 | cDNA clone CS0DF036YI04 3 prime |
| 512E3 | 627 | 815 | AL575666 | NA | 1.00E−94 | 1 | cDNA clone CS0DI069YD02 3 prime |
| 112E10 | 193 | 623 | AL575755 | NA | 0 | 1 | cDNA clone CS0DI070YG17 3 prime |
| 70H7 | 197 | 757 | AL576149 | NA | 0 | 1 | cDNA clone CS0DI072YK21 3 prime |
| 37F1 | 275 | 411 | AL577970 | NA | 1.00E−43 | 1 | cDNA clone CS0DK008YK22 3 prime |
| 65D4 | 278 | 828 | AL578975 | NA | 0 | 1 | cDNA clone CS0DK012YN01 3 prime |
| 182G2 | 70 | 684 | AL579745 | NA | 0 | 1 | cDNA clone CS0DJ003YG20 5 prime |
| 194F9 | 450 | 669 | AL582354 | NA | 3.00E−94 | 1 | cDNA clone CS0DL006YH05 3 prime |
| 184F2 | 27 | 501 | AL583322 | NA | 2.00E−37 | 1 | cDNA clone CS0DL012YI10 5 prime |
| 40A3 | 432 | 638 | AL583391 | NA | 4.00E−83 | 1 | cDNA clone CS0DL012YA12 3 prime |
| 53G7 | 6 | 462 | AU117298 | NA | 0 | 1 | sapiens cDNA clone HEMBA1001091 5' |
| 37G7 | 218 | 706 | AU118159 | NA | 0 | 1 | sapiens cDNA clone HEMBA1002998 5' |
| 180F9 | 174 | 698 | AU120731 | NA | 0 | 1 | sapiens cDNA clone HEMBB1001298 5' |
| 191F1 | 298 | 608 | AU135154 | NA | 1.00E−137 | 1 | sapiens cDNA clone PLACE1001348 5' |
| 466G7 | 11 | 125 | AU158636 | NA | 1.00E−53 | 1 | sapiens cDNA clone PLACE4000063 3' |
| 67F9 | 1 | 453 | AV648670 | NA | 0 | 2 | cDNA clone GLCBLH08 3' |
| 155D6 | 97 | 337 | AV650434 | NA | 1.00E−104 | 1 | cDNA clone GLCCEG06 3' |
| 596H6 | 1 | 397 | AV651615 | NA | 0 | 1 | cDNA clone GLCCRF09 3' |
| 99D5 | 41 | 232 | AV653169 | NA | 6.00E−78 | 1 | cDNA clone GLCDIB01 3' |
| 331C10 | 33 | 365 | AV654188 | NA | 1.00E−103 | 6 | cDNA clone GLCDTC01 3' |
| 121A12 | 70 | 188 | AV659358 | NA | 3.00E−47 | 1 | cDNA clone GLCFWC05 3' |
| 460G9 | 69 | 476 | AV687530 | NA | 0 | 1 | cDNA clone GKCATH08 5' |
| 470F5 | 1 | 174 | AV689330 | NA | 2.00E−50 | 1 | cDNA clone GKCDJE03 5' |
| 109E8 | 71 | 471 | AV705900 | NA | 0 | 1 | cDNA clone ADBBFE11 5' |
| 166C9 | 121 | 226 | AV709955 | NA | 2.00E−26 | 1 | cDNA clone ADCABF08 5' |
| 117F1 | 69 | 582 | AV710415 | NA | 0 | 1 | cDNA clone CuAAND10 5' |
| 523C9 | 41 | 536 | AV716565 | NA | 0 | 6 | cDNA clone DCBCAF01 5' |
| 103D7 | 1 | 164 | AV716644 | NA | 3.00E−77 | 2 | cDNA clone DCBAUG10 5' |
| 195F11 | 232 | 459 | AV716791 | NA | 1.00E−113 | 2 | cDNA clone DCBAZC04 5' |
| 63C4 | 208 | 421 | AV719659 | NA | 1.00E−101 | 1 | cDNA clone GLCGRA09 5' |
| 496C4 | 156 | 563 | AV719938 | NA | 0 | 1 | cDNA clone GLCFUC08 5' |
| 479A1 | 120 | 469 | AV720984 | NA | 1.00E−162 | 1 | cDNA clone HTBBIC02 5' |
| 499D6 | 70 | 406 | AV721008 | NA | 1.00E−112 | 4 | cDNA clone HTBBHG03 5' |
| 461C8 | 182 | 676 | AV723437 | NA | 0 | 1 | cDNA clone HTBBUE10 5' |
| 585G1 | 173 | 552 | AV724531 | NA | 0 | 1 | cDNA clone HTBARD04 5' |
| 113B8 | 1 | 149 | AV724559 | NA | 3.00E−40 | 1 | cDNA clone HTBCFB08 5' |
| 111H4 | 497 | 498 | AV724665 | NA | 0 | 1 | cDNA clone HTBAYG03 5' |
| 458F5 | 1 | 534 | AV730135 | NA | 0 | 1 | cDNA clone HTFAHA06 5' |
| 589F6 | 21 | 226 | AV735258 | NA | 6.00E−70 | 1 | cDNA clone cdAAIF03 5' |
| 172C8 | 209 | 426 | AV738173 | NA | 9.00E−98 | 1 | cDNA clone CBMAHC04 5' |
| 464G3 | 43 | 498 | AV743635 | NA | 0 | 1 | cDNA clone CBLBAC03 5' |
| 72D4 | 43 | 384 | AV745692 | NA | 1.00E−178 | 2 | cDNA clone NPAACB06 5' |
| 592G12 | 175 | 571 | AV749844 | NA | 1.00E−176 | 1 | cDNA clone NPCBVG08 5' |
| 169F6 | 110 | 250 | AV755117 | NA | 3.00E−28 | 1 | cDNA cloneTPAABA12 5' |
| 99H3 | 200 | 513 | AV755367 | NA | 1.00E−131 | 2 | cDNA clone BMFAIB02 5' |
| 595G9 | 399 | 549 | AV756188 | NA | 2.00E−31 | 1 | cDNA clone BMFABD08 5' |
| 595A12 | 8 | 572 | AW002985 | NA | 0 | 2 | cDNA clone IMAGE: 2475831 3' |
| 586B7 | 184 | 330 | AW004905 | NA | 8.00E−50 | 1 | cDNA clone IMAGE: 2565317 3' similar to |
| 591D6 | 15 | 436 | AW021037 | NA | 0 | 1 | Cochlea cDNA clone IMAGE: 2483601 5' |
| 188F1 | 135 | 476 | AW021551 | NA | 0 | 1 | Cochlea cDNA clone IMAGE: 2484414 5' |
| 467E8 | 73 | 474 | AW027160 | NA | 1.00E−162 | 1 | Soares__thymus__NHFTh cDNA clone IMAGE: 2512983 3' similar to |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 472G2 | 11 | 110 | AW064187 | NA | 9.00E−38 | 1 | CD4 intrathymic T-cell cDNA library cDNA 3' |
| 598F3 | 43 | 453 | AW071894 | NA | 0 | 1 | cDNA clone IMAGE: 2501169 3' |
| 181C7 | 10 | 96 | AW131768 | NA | 8.00E−41 | 1 | cDNA clone IMAGE: 2619947 3' |
| 181D1 | 69 | 216 | AW134512 | NA | 2.00E−77 | 1 | UI-H-BI1-abv-e-05-0-UI.s1 NCI_CGAP_Sub3 cDNA clone IMAGE: 2713065 3' |
| 472B10 | 339 | 458 | AW136717 | NA | 4.00E−54 | 1 | UI-H-BI1-adm-a-03-0-UI.s1 NCI_CGAP_Sub3 cDNA clone IMAGE: 2717092 3' |
| 166B9 | 240 | 408 | AW137104 | NA | 6.00E−88 | 1 | UI-H-BI1-acp-e-02-0-UI.s1 NCI_CGAP_Sub3 cDNA clone IMAGE: 2714979 3' |
| 188C1 | 323 | 461 | AW137149 | NA | 2.00E−72 | 1 | UI-H-BI1-acq-a-05-0-UI.s1 NCI_CGAP_Sub3 cDNA clone IMAGE: 2715152 3' |
| 65B2 | 106 | 298 | AW148765 | NA | 7.00E−75 | 1 | cDNA clone IMAGE: 2616915 3' |
| 524C3 | 234 | 429 | AW151854 | NA | 1.00E−76 | 2 | cDNA clone IMAGE: 2623546 3' similar to |
| 479A8 | 6 | 327 | AW161820 | NA | 1.00E−151 | 1 | brain 00004 cDNA clone IMAGE: 2781653 3' |
| 585E10 | 7 | 391 | AW166442 | NA | 0 | 1 | Soares_NHCe_cervix cDNA clone IMAGE: 269740 3' |
| 482C6 | 9 | 329 | AW188398 | NA | 1.00E−133 | 1 | cDNA clone IMAGE: 2665252 3' |
| 522G11 | 39 | 516 | AW248322 | NA | 0 | 1 | cDNA clone IMAGE: 2820662 5' |
| 473D5 | 283 | 416 | AW274156 | NA | 4.00E−69 | 1 | Soares_NFL_T_GBC_S1 cDNA clone IMAGE: 2814367 3' |
| 71C12 | 20 | 530 | AW293159 | NA | 0 | 2 | UI-H-BW0-aii-b-08-0-UI.s1 NCI_CGAP_Sub6 cDNA clone IMAGE: 2729414 3' |
| 472H11 | 205 | 501 | AW293424 | NA | 1.00E−151 | 1 | UI-H-BI2-ahm-a-12-0-UI.s1 NCI_CGAP_Sub4 cDNA clone IMAGE: 2727094 3' |
| 465H11 | 17 | 124 | AW293426 | NA | 1.00E−48 | 1 | UI-H-BI2-ahm-b-02-0-UI.s1 NCI_CGAP_Sub4 cDNA clone IMAGE: 2727122 3' |
| 461H8 | 19 | 452 | AW295965 | NA | 0 | 1 | UI-H-BI2-ahh-f-07-0-UI.s1 NCI_CGAP_Sub4 cDNA clone IMAGE: 2726917 3' |
| 464B7 | 250 | 551 | AW300500 | NA | 3.00E−95 | 1 | cDNA clone IMAGE: 2774602 3' |
| 465C7 | 1 | 322 | AW338115 | NA | 0 | 1 | cDNA clone IMAGE: 2833029 3' |
| 466H5 | 10 | 523 | AW341449 | NA | 0 | 1 | Soares_NFL_T_GBC_S1 cDNA clone IMAGE: 2909026 3' similar to |
| 461D9 | 12 | 325 | AW379049 | NA | 1.00E−134 | 1 | HT0230 cDNA |
| 186E8 | 51 | 277 | AW380881 | NA | 1.00E−103 | 1 | HT0283 cDNA |
| 180D4 | 260 | 348 | AW384988 | NA | 2.00E−30 | 1 | HT0427 cDNA |
| 472C1 | 13 | 404 | AW390233 | NA | 1.00E−122 | 1 | ST0181 cDNA |
| 462G12 | 236 | 321 | AW402007 | NA | 3.00E−40 | 1 | UI-HF-BK0-aao-g-02-0-UI.r1 NIH_MGC_36 cDNA clone IMAGE: 3054530 5' |
| 177H2 | 18 | 338 | AW405863 | NA | 9.00E−52 | 1 | UI-HF-BL0-acf-e-06-0-UI.r1 NIH_MGC_37 cDNA clone IMAGE: 3059026 5' |
| 140G10 | 6 | 308 | AW440517 | NA | 1.00E−152 | 1 | cDNA clone IMAGE: 2890615 3' |
| 482A10 | 1 | 231 | AW440869 | NA | 1.00E−114 | 1 | cDNA clone IMAGE: 2918151 3' similar to contains |
| 40B2 | 18 | 353 | AW444632 | NA | 4.00E−45 | 1 | UI-H-BI3-ajw-b-11-0-UI.s1 NCI_CGAP_Sub5 cDNA clone IMAGE: 2733260 3' |
| 61C2 | 21 | 392 | AW444812 | NA | 0 | 1 | UI-H-BI3-ajy-d-11-0-UI.s1 NCI_CGAP_Sub5 cDNA clone IMAGE: 2733380 3' |
| 461H10 | 151 | 248 | AW449610 | NA | 8.00E−48 | 1 | UI-H-BI3-aku-g-11-0-UI.s1 NCI_CGAP_Sub5 cDNA clone IMAGE: 2735804 3' |
| 479E10 | 9 | 425 | AW451293 | NA | 0 | 1 | UI-H-BI3-alh-f-06-0-UI.s1 NCI_CGAP_Sub5 cDNA clone IMAGE: 2736899 3' |
| 489G6 | 16 | 303 | AW452023 | NA | 1.00E−125 | 1 | UI-H-BI3-alm-f-06-0-UI.s1 NCI_CGAP_Sub5 cDNA clone IMAGE: 2737306 3' |
| 463H8 | 99 | 289 | AW452096 | NA | 1.00E−103 | 1 | UI-H-BI3-alo-d-02-0-UI.s1 NCI_CGAP_Sub5 cDNA clone IMAGE: 3068186 3' |
| 459B8 | 71 | 535 | AW499658 | NA | 0 | 1 | UI-HF-BR0p-ajj-c-07-0-UI.r1 NIH_MGC_52 cDNA clone IMAGE: 3074677 5' |
| 37A2 | 128 | 395 | AW499828 | NA | 1.00E9−110 | I | UI-HF-BN0-ake-c-06-0-UI.rl NIH_MGC_50 cDNA clone IMAGE: 3076619 5' |
| 112E5 | 88 | 557 | AW499829 | NA | 0 | 1 | UI-HF-BN0-ake-c-07-0-UI.r1 NIH_MGC_50 cDNA clone IMAGE: 3076621 5' |
| 523F5 | 435 | 517 | AW500534 | NA | 4.00E−36 | 1 | UI-HF-BN0-akj-d-04-0-UI.r1 NIH_MGC_50 cDNA clone IMAGE: 3077406 5' |
| 476E10 | 152 | 450 | AW501528 | NA | 1.00E−129 | 1 | UI-HF-BP0p-ajf-c-02-0-UI.r1 NIH_MGC_51 cDNA clone IMAGE: 3073923 5' |
| 67D10 | 36 | 413 | AW504212 | NA | 0 | 1 | UI-HF-BN0-alp-a-11-0-UI.r1 NIH_MGC_50 cDNA clone IMAGE: 3080348 5' |
| 100E10 | 29 | 364 | AW504293 | NA | 1.00E−159 | 1 | UI-HF-BN0-alg-b-10-0-UI.r1 NIH_MGC_50 cDNA clone IMAGE: 3079267 5' |
| 484D12 | 35 | 353 | AW510795 | NA | 1.00E−167 | 1 | Soares_NFL_T_GBC_S1 cDNA clone IMAGE: 2911933 3' similar to |
| 480B2 | 109 | 446 | AW572538 | NA | 1.00E−162 | 1 | cDNA clone IMAGE: 2832030 3' |
| 465D2 | 272 | 464 | AW573211 | NA | 2.00E−49 | 1 | Soares_NFL_T_GBC_S1 cDNA clone |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 47G6 | 125 | 126 | AW614193 | NA | 1.00E−51 | 1 | IMAGE: 2933767 3' similar to cDNA clone IMAGE: 2951662 3' |
| 499D7 | 1 | 341 | AW630825 | NA | 0 | 2 | cDNA clone IMAGE: 2969854 5' |
| 62H5 | 10 | 423 | AW651682 | NA | 0 | 2 | cDNA clone IMAGE: 2901099 5' |
| 104A7 | 3 | 461 | AW778854 | NA | 0 | 1 | cDNA clone IMAGE: 3037337 3' |
| 484H1 | 9 | 453 | AW780057 | NA | 0 | 1 | cDNA clone IMAGE: 3036046 3' |
| 491E8 | 18 | 348 | AW792856 | NA | 1.00E−164 | 2 | UM0001 cDNA |
| 65D11 | 64 | 648 | AW810442 | NA | 0 | 3 | ST0125 cDNA |
| 596F6 | 49 | 623 | AW813133 | NA | 0 | 1 | ST0189 cDNA |
| 518H1 | 131 | 386 | AW819894 | NA | 1.00E−133 | 1 | ST0294 cDNA |
| 115A7 | 1 | 315 | AW836389 | NA | 1.00E−169 | 3 | LT0030 cDNA |
| 486D9 | 32 | 237 | AW837717 | NA | 1.00E−65 | 1 | LT0042 cDNA |
| 477B12 | 84 | 253 | AW837808 | NA | 4.00E−67 | 1 | LT0042 cDNA |
| 121A11 | 253 | 444 | AW842489 | NA | 1.00E−98 | 1 | CN0032 cDNA |
| 472E6 | 132 | 447 | AW846856 | NA | 1.00E−149 | 1 | CT0195 cDNA |
| 164F9 | 1 | 462 | AW856490 | NA | 0 | 1 | CT0290 cDNA |
| 103C4 | 23 | 366 | AW859565 | NA | 0 | 1 | CT0355 cDNA |
| 129D3 | 81 | 295 | AW866426 | NA | 1.00E−108 | 1 | SN0024 cDNA |
| 501F9 | 88 | 421 | AW873028 | NA | 1.00E−170 | 3 | cDNA clone IMAGE: 3120038 3' |
| 98G4 | 1 | 294 | AW873326 | NA | 1.00E−107 | 1 | cDNA clone IMAGE: 3009400 3' |
| 72D5 | 55 | 648 | AW886511 | NA | 0 | 1 | OT0083 cDNA |
| 460A5 | 101 | 294 | AW891344 | NA | 1.00E−102 | 1 | NT0079 cDNA |
| 459E9 | 196 | 260 | AW945538 | NA | 8.00E−28 | 1 | EN0024 cDNA |
| 479H5 | 17 | 224 | AW948395 | NA | 1.00E−102 | 1 | FN0040 cDNA |
| 165E7 | 2 | 599 | AW949461 | NA | 0 | 1 | MAGA cDNA |
| 123G9 | 104 | 715 | AW954112 | NA | 0 | 2 | MAGC cDNA |
| 183F3 | 84 | 503 | AW954476 | NA | 1.00E−159 | 1 | MAGC cDNA |
| 196C6 | 8 | 189 | AW954580 | NA | 5.00E−98 | 1 | MAGC cDNA |
| 515H10 | 1 | 512 | AW955265 | NA | 0 | 1 | MAGC cDNA |
| 41E8 | 16 | 671 | AW957139 | NA | 1.00E−145 | 2 | MAGD cDNA |
| 66A7 | 335 | 503 | AW958538 | NA | 4.00E−85 | 1 | MAGE cDNA |
| 465G8 | 169 | 615 | AW960484 | NA | 0 | 1 | MAGF cDNA |
| 519E6 | 44 | 290 | AW960593 | NA | 1.00E−134 | 1 | MAGF cDNA |
| 594F4 | 306 | 571 | AW963171 | NA | 1.00E−112 | 1 | MAGH cDNA |
| 155B2 | 30 | 673 | AW964218 | NA | 0 | 3 | MAGH cDNA |
| 173B5 | 1 | 553 | AW965078 | NA | 0 | 1 | MAGI cDNA |
| 176A6 | 7 | 312 | AW965490 | NA | 1.00E−136 | 1 | MAGI cDNA |
| 498H9 | 1 | 456 | AW965987 | NA | 0 | 2 | MAGI cDNA |
| 517D11 | 105 | 484 | AW966098 | NA | 0 | 2 | MAGI cDNA |
| 166H7 | 63 | 559 | AW967388 | NA | 0 | 1 | MAGJ cDNA |
| 462C8 | 69 | 212 | AW967948 | NA | 2.00E−72 | 1 | MAGJ cDNA |
| 189C5 | 8 | 566 | AW968561 | NA | 0 | 1 | MAGJ cDNA |
| 459C3 | 129 | 587 | AW969359 | NA | 0 | 2 | MAGK cDNA |
| 174C1 | 155 | 527 | AW969546 | NA | 1.00E−170 | 1 | MAGK cDNA |
| 191F6 | 158 | 543 | AW973953 | NA | 1.00E−152 | 2 | MAGM cDNA |
| 461G9 | 311 | 437 | AW974749 | NA | 7.00E−47 | 1 | MAGN cDNA |
| 104D1 | 182 | 594 | AW993791 | NA | 0 | 1 | BN0034 cDNA |
| 188F5 | 734 | 1292 | AY007110 | NA | 0 | 4 | clone TCCCTA00084 mRNA sequence Length = 1656 |
| 48D7 | 692 | 1169 | AY029066 | NA | 1.00E−76 | 4 | Humanin (HN1) mRNA, complete cds Length = 1567 |
| 55B8 | 1802 | 2045 | BC000141 | NA | 3.00E−96 | 1 | Similar to myelocytomatosis oncogene, clone MGC: 5183, mRNA |
| 37A8 | 34 | 301 | BC000374 | NA | 1.00E−101 | 1 | ribosomal protein L18, clone MGC: 8373, mRNA, complete cds |
| 178E5 | 20 | 551 | BC000408 | NA | 5.00E−53 | 1 | acetyl-Coenzyme A acetyltransferase 2 (acetoacetyl Coenzyme A thiolase |
| 596G2 | 27 | 263 | BC000449 | NA | 3.00E−43 | 2 | Similar to ubiquitin C, clone MGC: 8448, mRNA, complete cds |
| 179A3 | 693 | 1002 | BC000514 | NA | 1.00E−160 | 3 | ribosomal protein L13a, clone MGC: 8547, mRNA, complete cds |
| 158F10 | 169 | 522 | BC000523 | NA | 1.00E−157 | 1 | Similar to ribosomal protein S24, clone MGC: 8595, mRNA, complete cds |
| 515G5 | 34 | 270 | BC000530 | NA | 7.00E−38 | 1 | ribosomal protein L19, clone MGC: 8653, mRNA, complete cds |
| 39B6 | 286 | 1073 | BC000590 | NA | 0 | 9 | actin related protein 2/3 complex, subunit 2 (34 kD), clone MGC: 1416, |
| 169A4 | 929 | 1314 | BC000672 | NA | 0 | 1 | guanine nucleotide binding protein (G protein), beta polypeptide 2-lik |
| 166H4 | 1350 | 1745 | BC000771 | NA | 1.00E−169 | 8 | Similar to tropomyosin 4, clone MGC: 3261, mRNA, complete cds |
| 331F9 | 482 | 949 | BC000967 | NA | 0 | 1 | clone IMAGE: 3449287, mRNA, partial cds Length = 2156 |
| 526C6 | 633 | 829 | BC001169 | NA | 1.00E−100 | 1 | Similar to esterase 10, clone MGC: 1873, mRNA, |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 135G12 | 1598 | 1766 | BC001303 | NA | 6.00E−42 | 1 | complete cds<br>Similar to splicing factor, arginine/serine-rich 2 (SC-35), clone MGC: |
| 491C6 | 613 | 714 | BC001385 | NA | 3.00E−34 | 1 | Similar to leucine rich repeat (in FLII) interacting protein 1, clone |
| 108D10 | 234 | 641 | BC001399 | NA | 2.00E−79 | 1 | ferritin, heavy polypeptide 1, clone MGC: 1749, mRNA, complete cds |
| 196H5 | 1387 | 1899 | BC001412 | NA | 6.00E−55 | 4 | eukaryotic translation elongation factor 1 alpha 1, clone MGC: 1332, mR |
| 460F5 | 973 | 1350 | BC001413 | NA | 0 | 1 | clone IMAGE: 3140866, mRNA Length = 1634 |
| 520C5 | 348 | 472 | BC001632 | NA | 5.00E−34 | 1 | Similar to NADH dehydrogenase (ubiquinone) flavoprotein 2 (24 kD), clon |
| 520D10 | 1729 | 2205 | BC001637 | NA | 0 | 2 | ATP synthase, H+ transporting, mitochondrial F1 complex, alpha subunit |
| 524A1 | 564 | 922 | BC001660 | NA | 1.00E−94 | 2 | ribonuclease 6 precursor, clone MGC: 1360, mRNA, complete cds |
| 121E7 | 275 | 381 | BC001697 | NA | 2.00E−26 | 1 | Similar to ribosomal protein S15a, clone MGC: 2466, mRNA, complete cds |
| 109D1 | 2441 | 2835 | BC001798 | NA | 1.00E−123 | 1 | clone MGC: 3157, mRNA, complete cds Length = 3041 |
| 180D9 | 741 | 921 | BC001819 | NA | 5.00E−85 | 2 | ribonuclease 6 precursor, clone MGC: 3554, mRNA, complete cds |
| 72H5 | 1264 | 2808 | BC001854 | NA | 0 | 8 | methionine adenosyltransferase II, alpha, clone MGC: 4537, mRNA, comple |
| 167H8 | 1099 | 1436 | BC002409 | NA | 1.00E−49 | 1 | actin, beta, clone MGC: 8647, mRNA, complete cds Length = 1858 |
| 53H1 | 2398 | 2513 | BC002538 | NA | 3.00E−41 | 1 | serine (or cysteine) proteinase inhibitor, clade B (ovalbumin), member |
| 125B3 | 246 | 585 | BC002711 | NA | 1.00E−40 | 1 | cell division cycle 42 (GTP-binding protein, 25 kD), clone MGC: 3497, mR |
| 331H8 | 201 | 557 | BC002837 | NA | 0 | 1 | clone MGC: 4175, mRNA, complete cds Length = 1092 |
| 150C4 | 1699 | 2040 | BC002845 | NA | 8.00E−29 | 1 | eukaryotic translation elongation factor 1 alpha 1, clone MGC: 3711, mR |
| 70D7 | 345 | 850 | BC002900 | NA | 0 | 1 | Similar to proteasome (prosome, macropain) subunit, alpha type, 2, clo |
| 476B5 | 1431 | 1761 | BC002929 | NA | 1.00E−141 | 1 | clone IMAGE: 3954899, mRNA, partial cds Length = 2467 |
| 38D7 | 200 | 688 | BC002971 | NA | 0 | 2 | clone IMAGE: 3543711, mRNA, partial cds Length = 1934 |
| 74A11 | 652 | 1724 | BC003063 | NA | 0 | 5 | Similar to likely ortholog of yeast ARV1, clone IMAGE: 3506392, mRNA |
| 105H12 | 1148 | 1370 | BC003090 | NA | 1.00E−105 | 1 | COP9 homolog, clone MGC: 1297, mRNA, complete cds Length = 1637 |
| 50F4 | 8 | 301 | BC003137 | NA | 1.00E−115 | 1 | ribosomal protein S3, clone MGC: 3657, mRNA, complete cds |
| 175G9 | 93 | 216 | BC003352 | NA | 1.00E−33 | 1 | tumor protein, translationally-controlled 1, clone MGC: 5308, mRNA, com |
| 587E9 | 72 | 554 | BC003358 | NA | 4.00E−60 | 2 | ribosomal protein L10, clone MGC: 5189, mRNA, complete cds |
| 71F8 | 491 | 911 | BC003406 | NA | 0 | 1 | cytidine monophosphate-N-acetylneuraminic acid hydroxylase (CMP-N-acet |
| 512E11 | 308 | 372 | BC003563 | NA | 2.00E−27 | 1 | guanine nucleotide binding protein (G protein), gamma 5, clone MGC: 196 |
| 118B11 | 76 | 343 | BC003577 | NA | 1.00E−111 | 1 | clone IMAGE: 3544292, mRNA, partial cds Length = 826 |
| 107E3 | 9 | 634 | BC003697 | NA | 0 | 1 | clone MGC: 5564, mRNA, complete cds Length = 2145 |
| 128D4 | 1408 | 1550 | BC004186 | NA | 1.00E−34 | 1 | guanine nucleotide binding protein, beta 1, clone MGC: 2819, mRNA, comp |
| 58H6 | 554 | 859 | BC004245 | NA | 1.00E−171 | 2 | ferritin, light polypeptide, clone MGC: 10465, mRNA, complete cds |
| 481D8 | 134 | 460 | BC004258 | NA | 6.00E−73 | 1 | hypothetical protein PRO1741, clone MGC: 10753, mRNA, complete cds |
| 520F6 | 160 | 1400 | BC004317 | NA | 0 | 3 | clone MGC: 10924, mRNA, complete cds Length = 1837 |
| 489G7 | 511 | 787 | BC004458 | NA | 2.00E−60 | 1 | enolase 1, (alpha), clone MGC: 4315, mRNA, complete cds |
| 115B8 | 1162 | 1640 | BC004521 | NA | 0 | 2 | ATP synthase, H+ transporting, mitochondrial F1 complex, alpha subunit |
| 118A2 | 1126 | 1369 | BC004805 | NA | 4.00E−38 | 1 | similar to *Mus musculus*, clone IMAGE: 3584831, mRNA Length = 1910 |
| 73D2 | 1174 | 1751 | BC004872 | NA | 0 | 1 | clone MGC: 11034, mRNA, complete cds Length = 2471 |
| 522E3 | 681 | 993 | BC004900 | NA | 1.00E−175 | 10 | ribosomal protein L13a, clone IMAGE: 3545758, mRNA, partial cds |
| 55G12 | 1 | 232 | BC004928 | NA | 3.00E−68 | 1 | clone MGC: 10493, mRNA, complete cds Length = 2567 |
| 520C2 | 3 | 139 | BC004994 | NA | 1.00E−31 | 1 | myosin regulatory light chain, clone MGC: 4405, mRNA, complete cds |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 460H4 | 1577 | 1923 | BC005101 | NA | 0 | 1 | clone IMAGE: 3618561, mRNA Length = 2113 |
| 154F12 | 122 | 283 | BC005128 | NA | 2.00E−46 | 1 | ribosomal protein L7a, clone MGC: 10607, mRNA, complete cds |
| 592C8 | 647 | 925 | BC005187 | NA | 2.00E−32 | 1 | Similar to hypothetical protein, clone MGC: 12182, mRNA, complete cds |
| 591D1 | 726 | 837 | BC005361 | NA | 5.00E−31 | 1 | proteasome (prosome, macropain) subunit, alpha type, 4, clone MGC: 1246 |
| 458A7 | 1307 | 1568 | BC005816 | NA | 4.00E−98 | 1 | Similar to deltex (Drosophila) homolog 1, clone IMAGE: 3688330, mRNA, p |
| 122C6 | 263 | 378 | BC005928 | NA | 1.00E−29 | 1 | S100 calcium-binding protein A8 (calgranulin A), clone MGC: 14536, mRNA |
| 47H11 | 273 | 854 | BC006008 | NA | 0 | 1 | clone IMAGE: 4285740, mRNA Length = 1040 |
| 598E1 | 850 | 1226 | BC006176 | NA | 0 | 2 | clone IMAGE: 4054156, mRNA, partial cds Length = 1423 |
| 175A1 | 570 | 887 | BC006282 | NA | 1.00E−161 | 1 | Similar to RIKEN cDNA 1110020N13 gene, clone MGC: 10540 |
| 150H12 | 543 | 1098 | BC006464 | NA | 0 | 1 | calmodulin 2 (phosphorylase kinase, delta), clone MGC: 2168 |
| 583E5 | 980 | 1246 | BC006849 | NA | 1.00E−127 | 1 | Similar to RIKEN cDNA 2410044K02 gene, clone MGC: 5469 |
| 41H7 | 619 | 1308 | BC007004 | NA | 0 | 2 | Similar to oxysterol-binding protein-related protein 1, clone IMAGE: 40 |
| 56C12 | 13 | 187 | BC007063 | NA | 6.00E−27 | 1 | peroxiredoxin 1, clone MGC: 12514, mRNA, complete cds Length = 973 |
| 183C11 | 2986 | 3328 | BC007203 | NA | 1.00E−169 | 1 | hypothetical protein MGC10823, clone MGC: 12957, mRNA, complete cds |
| 109H10 | 1343 | 1627 | BC007277 | NA | 1.00E−156 | 1 | Similar to RIKEN cDNA 0610039P13 gene, clone MGC: 15619, mRNA |
| 588E11 | 423 | 1324 | BC007299 | NA | 0 | 3 | Similar to ATP synthase, H+ transporting, mitochondrial F1 complex, al |
| 164F12 | 72 | 336 | BE002854 | NA | 1.00E−147 | 1 | BN0090 cDNA |
| 106A12 | 22 | 608 | BE005703 | NA | 0 | 1 | BN0120 cDNA |
| 472E11 | 168 | 297 | BE044364 | NA | 1.00E−66 | 1 | Soares_NFL_T_GBC_S1 cDNA clone IMAGE: 3040218 3' |
| 458H11 | 2 | 510 | BE049439 | NA | 0 | 1 | cDNA clone IMAGE: 2834924 3' |
| 46F7 | 18 | 527 | BE061115 | NA | 0 | 1 | BT0041 cDNA |
| 105A8 | 1 | 166 | BE085539 | NA | 3.00E−74 | 1 | BT0669 cDNA |
| 467F5 | 27 | 247 | BE086076 | NA | 1.00E−115 | 1 | BT0672 cDNA |
| 469B6 | 5 | 188 | BE091932 | NA | 6.00E−87 | 1 | BT0733 cDNA |
| 66D7 | 18 | 568 | BE160822 | NA | 0 | 1 | HT0422 cDNA |
| 593F8 | 110 | 451 | BE163106 | NA | 1.00E−165 | 1 | HT0457 cDNA |
| 468B10 | 1 | 461 | BE168334 | NA | 0 | 1 | HT0514 cDNA |
| 192E1 | 1 | 602 | BE176373 | NA | 0 | 1 | HT0585 cDNA |
| 109A9 | 100 | 377 | BE177661 | NA | 1.00E−129 | 1 | HT0598 cDNA |
| 468B9 | 27 | 145 | BE178880 | NA | 3.00E−31 | 1 | HT0609 cDNA |
| 526E11 | 6 | 222 | BE217848 | NA | 1.00E−118 | 3 | cDNA clone IMAGE: 3174941 3' |
| 115H2 | 226 | 227 | BE218938 | NA | 2.00E−97 | 1 | cDNA clone IMAGE: 3176478 3' |
| 126B3 | 1 | 509 | BE222301 | NA | 1.00E−151 | 1 | cDNA clone IMAGE: 3166180 3' |
| 195F2 | 123 | 470 | BE222392 | NA | 4.00E−91 | 1 | cDNA clone IMAGE: 3166335 3' |
| 170F7 | 1 | 375 | BE242649 | NA | 0 | 1 | acute myelogenous leukemia cell (FAB M1) Baylor-HGSC |
| 459F10 | 35 | 432 | BE247056 | NA | 5.00E−84 | 1 | cell acute lymphoblastic leukemia Baylor-HGSC project = TCBA |
| 491G11 | 269 | 516 | BE253336 | NA | 1.00E−116 | 1 | cDNA clone IMAGE: 3357826 5' |
| 471H10 | 140 | 202 | BE254064 | NA | 2.00E−26 | 1 | cDNA clone IMAGE: 3354554 5' |
| 521H9 | 22 | 605 | BE292793 | NA | 0 | 2 | cDNA clone IMAGE: 2987838 5' |
| 472A9 | 33 | 436 | BE297329 | NA | 0 | 1 | cDNA clone IMAGE: 3532809 5' |
| 99E10 | 59 | 423 | BE328818 | NA | 0 | 1 | cDNA clone IMAGE: 3181355 3' |
| 192C3 | 4 | 335 | BE348809 | NA | 0 | 1 | cDNA clone IMAGE: 3152438 3' |
| 140G6 | 206 | 405 | BE348955 | NA | 3.00E−85 | 1 | cDNA clone IMAGE: 3144625 3' |
| 483D12 | 1 | 534 | BE349148 | NA | 1.00E−160 | 1 | cDNA clone IMAGE: 3150275 3' |
| 491H12 | 1 | 526 | BE379820 | NA | 0 | 1 | cDNA clone IMAGE: 3510960 5' |
| 481D5 | 212 | 333 | BE464239 | NA | 3.00E−45 | 1 | cDNA clone IMAGE: 3194693 3' |
| 469H8 | 31 | 179 | BE466500 | NA | 2.00E−71 | 1 | cDNA clone IMAGE: 3195395 3' |
| 56D11 | 72 | 353 | BE467470 | NA | 1.00E−113 | 1 | cDNA clone IMAGE: 3212950 3' |
| 471D10 | 1 | 249 | BE502246 | NA | 1.00E−119 | 2 | cDNA clone IMAGE: 3197344 3' |
| 471C2 | 255 | 486 | BE502992 | NA | 1.00E−128 | 1 | cDNA clone IMAGE: 3214462 3' |
| 56A2 | 291 | 669 | BE538333 | NA | 1.00E−164 | 1 | cDNA clone IMAGE: 3454710 5' |
| 191F12 | 488 | 587 | BE547584 | NA | 9.00E−28 | 1 | cDNA clone IMAGE: 3461312 5' |
| 525F3 | 5 | 236 | BE550944 | NA | 1.00E−125 | 1 | cDNA clone IMAGE: 3233200 3' |
| 473B7 | 46 | 228 | BE551867 | NA | 4.00E−86 | 1 | cDNA clone IMAGE: 3195555 3' |
| 467C6 | 48 | 404 | BE569141 | NA | 1.00E−162 | 1 | cDNA clone IMAGE: 3681180 5' |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 110D3 | 193 | 473 | BE613237 | NA | 1.00E−157 | 2 | cDNA clone IMAGE: 3856357 3' |
| 140F9 | 20 | 344 | BE614297 | NA | 1.00E−84 | 1 | cDNA clone IMAGE: 3906037 3' |
| 473B12 | 63 | 216 | BE645630 | NA | 3.00E−51 | 1 | cDNA clone IMAGE: 3288143 3' similar to contains |
| 460C2 | 156 | 594 | BE646470 | NA | 0 | 1 | cDNA clone IMAGE: 3292133 3' |
| 172E5 | 329 | 491 | BE670804 | NA | 7.00E−72 | 8 | cDNA clone IMAGE: 3285031 3' similar to gb: J04130 |
| 469D4 | 50 | 553 | BE674685 | NA | 0 | 1 | cDNA clone IMAGE: 3292800 3' similar to TR: O60688 |
| 171F2 | 10 | 280 | BE676054 | NA | 1.00E−96 | 1 | cDNA clone IMAGE: 3295273 3' |
| 102E12 | 102 | 357 | BE737348 | NA | 2.00E−93 | 1 | cDNA clone IMAGE: 3640772 5' |
| 121C11 | 198 | 488 | BE748663 | NA | 1.00E−150 | 1 | cDNA clone IMAGE: 3838675 3' |
| 126D1 | 208 | 449 | BE763412 | NA | 1.00E−122 | 1 | NT0036 cDNA |
| 172H5 | 52 | 581 | BE768647 | NA | 0 | 1 | FT0010 cDNA |
| 176F12 | 178 | 646 | BE792125 | NA | 0 | 1 | cDNA clone IMAGE: 3936215 5' |
| 71A6 | 16 | 437 | BE825187 | NA | 0 | 1 | CN0028 cDNA |
| 115F11 | 14 | 132 | BE858152 | NA | 4.00E−60 | 1 | cDNA clone IMAGE: 3306735 3' |
| 61A11 | 1 | 448 | BE872245 | NA | 0 | 1 | cDNA clone IMAGE: 3850435 5' |
| 171B8 | 155 | 377 | BE875145 | NA | 8.00E−88 | 1 | cDNA clone IMAGE: 3891244 5' |
| 108A6 | 370 | 539 | BE876375 | NA | 7.00E−72 | 2 | cDNA clone IMAGE: 3889033 5' |
| 166B1 | 1 | 472 | BE877115 | NA | 1.00E−153 | 1 | cDNA clone IMAGE: 3887598 5' |
| 63D11 | 208 | 496 | BE878973 | NA | 1.00E−141 | 1 | cDNA clone IMAGE: 3895002 5' |
| 525C3 | 208 | 400 | BE879482 | NA | 7.00E−88 | 1 | cDNA clone IMAGE: 3894277 5' |
| 526F7 | 335 | 603 | BE881113 | NA | 1.00E−126 | 1 | cDNA clone IMAGE: 3894306 5' |
| 152G12 | 122 | 659 | BE881351 | NA | 0 | 2 | cDNA clone IMAGE: 3892808 5' |
| 589H4 | 118 | 510 | BE882335 | NA | 0 | 2 | cDNA clone IMAGE: 3907044 5' |
| 51B12 | 199 | 631 | BE884898 | NA | 3.00E−56 | 1 | cDNA clone IMAGE: 3908551 5' |
| 114C1 | 286 | 530 | BE887646 | NA | 1.00E−121 | 1 | cDNA clone IMAGE: 3913468 5' |
| 120H2 | 282 | 706 | BE888744 | NA | 0 | 1 | cDNA clone IMAGE: 3915133 5' |
| 107D11 | 172 | 497 | BE891242 | NA | 0 | 1 | cDNA clone IMAGE: 3917201 5' |
| 513G4 | 263 | 662 | BE891269 | NA | 0 | 1 | cDNA clone IMAGE: 3917064 5' |
| 166B8 | 7 | 453 | BE891928 | NA | 0 | 1 | cDNA clone IMAGE: 3920185 5' |
| 185G9 | 23 | 390 | BE894437 | NA | 1.00E−145 | 1 | cDNA clone IMAGE: 3918224 5' |
| 189A8 | 211 | 485 | BE896691 | NA | 1.00E−82 | 1 | cDNA clone IMAGE: 3925062 5' |
| 598A7 | 78 | 301 | BE897669 | NA | 1.00E−83 | 1 | cDNA clone IMAGE: 3923346 5' |
| 191D9 | 189 | 575 | BE899595 | NA | 0 | 3 | cDNA clone IMAGE: 3952215 5' |
| 331F2 | 109 | 287 | BF001438 | NA | 3.00E−96 | 2 | cDNA clone IMAGE: 3313517 3' |
| 192C9 | 57 | 419 | BF033741 | NA | 0 | 1 | cDNA clone IMAGE: 3857635 5' |
| 117H4 | 73 | 454 | BF056055 | NA | 0 | 1 | cDNA clone IMAGE: 3443950 3' similar to contains |
| 104B10 | 6 | 412 | BF058599 | NA | 1.00E−177 | 1 | cDNA clone IMAGE: 3477311 3' |
| 331A12 | 13 | 164 | BF059133 | NA | 1.00E−72 | 1 | cDNA clone IMAGE: 3480249 3' |
| 40H1 | 81 | 507 | BF060725 | NA | 0 | 1 | 7j59h07.x1 Soares_NSF_F8_9W_OT_PA_P_S1 cDNA clone |
| 464F1 | 1 | 510 | BF061421 | NA | 0 | 1 | 7j52c11.x1 Soares_NSF_F8_9W_OT_PA_P_S1 cDNA clone |
| 71E11 | 1 | 441 | BF105172 | NA | 0 | 1 | cDNA clone IMAGE: 4042560 5' |
| 129D7 | 92 | 561 | BF116224 | NA | 0 | 2 | cDNA clone IMAGE: 3570793 3' |
| 145E10 | 83 | 624 | BF131060 | NA | 0 | 1 | cDNA done IMAGE: 4051731 5' |
| 113B6 | 105 | 410 | BF194880 | NA | 1.00E−157 | 1 | cDNA clone IMAGE: 3643600 3' |
| 157E9 | 102 | 308 | BF197153 | NA | 1.00E−108 | 2 | cDNA clone IMAGE: 3561933 3' |
| 127H8 | 1 | 173 | BF197762 | NA | 3.00E−92 | 1 | cDNA clone IMAGE: 3653139 3' |
| 462D1 | 29 | 177 | BF221780 | NA | 7.00E−78 | 1 | cDNA clone IMAGE: 3578603 3' |
| 472B8 | 7 | 229 | BF306204 | NA | 9.00E−70 | 1 | cDNA clone IMAGE: 4138980 5' |
| 62A3 | 187 | 612 | BF309911 | NA | 1.00E−162 | 1 | cDNA clone IMAGE: 4138171 5' |
| 476G4 | 316 | 487 | BF330908 | NA | 5.00E−66 | 1 | BT0333 cDNA |
| 524D1 | 86 | 258 | BF339088 | NA | 8.00E−88 | 1 | cDNA clone IMAGE: 4182956 5' |
| 58G4 | 13 | 606 | BF341359 | NA | 0 | 2 | cDNA clone IMAGE: 4149195 5' |
| 480E7 | 68 | 288 | BF357523 | NA | 4.00E−97 | 1 | HT0945 cDNA |
| 116C9 | 8 | 170 | BF364413 | NA | 2.00E−81 | 1 | NN1068 cDNA |
| 168F4 | 11 | 595 | BF369763 | NA | 0 | 1 | GN0120 cDNA |
| 495F1 | 1 | 318 | BF373638 | NA | 1.00E−108 | 2 | FT0176 cDNA |
| 98E1 | 81 | 499 | BF377518 | NA | 0 | 2 | TN0115 cDNA |
| 169C5 | 17 | 500 | BF380732 | NA | 0 | 1 | UT0073 cDNA |
| 464E11 | 12 | 272 | BF432643 | NA | 1.00E−129 | 1 | cDNA clone IMAGE: 3406531 3' |
| 183G2 | 119 | 548 | BF433058 | NA | 1.00E−112 | 1 | cDNA clone IMAGE: 3565500 3' |
| 473F9 | 21 | 411 | BF433353 | NA | 0 | 1 | cDNA clone IMAGE: 3703678 3' |
| 117C9 | 179 | 462 | BF433657 | NA | 2.00E−99 | 1 | cDNA clone IMAGE: 3702965 3' similar to contains |
| 514A3 | 170 | 245 | BF435621 | NA | 2.00E−34 | 2 | Lupski_sciatic_nerve cDNA clone IMAGE: 3394901 3' similar to |
| 459G8 | 78 | 417 | BF445405 | NA | 1.00E−179 | 1 | cDNA clone IMAGE: 3699337 3' |
| 483D10 | 12 | 474 | BF447885 | NA | 0 | 1 | cDNA clone IMAGE: 3706147 3' |
| 519H12 | 319 | 394 | BF449068 | NA | 3.00E−27 | 1 | cDNA clone IMAGE: 3579069 3' |
| 584H11 | 78 | 487 | BF475501 | NA | 7.00E−50 | 1 | Lupski_sciatic_nerve cDNA clone IMAGE: 3396242 3' |
| 471G8 | 214 | 400 | BF478238 | NA | 9.00E−61 | 1 | cDNA clone IMAGE: 3700476 3' similar to contains |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 109F10 | 20 | 329 | BF507849 | NA | 1.00E−172 | 1 | UI-H-BI4-apv-h-02-0-UI.s1 NCI_CGAP_Sub8 cDNA clone IMAGE: 3088755 3' |
| 173E10 | 147 | 231 | BE510393 | NA | 1.00E−39 | 1 | UI-H-BI4-aon-h-07-0-UI.s1 NCI_CGAP_Sub8 cDNA clone IMAGE: 3085669 3' |
| 464D1 | 32 | 460 | BF513602 | NA | 1.00E−106 | 1 | UI-H-BW1-amt-a-11-0-UI.s1 NCI_CGAP_Sub7 cDNA clone IMAGE: 3070773 3' |
| 118D9 | 106 | 248 | BF514341 | NA | 4.00E−46 | 1 | UI-H-BW1-and-h-10-0-UI.s1 NCI_CGAP_Sub7 cDNA clone IMAGE: 3082218 3' |
| 462E3 | 29 | 197 | BF515538 | NA | 1.00E−87 | 1 | UI-H-BW1-anq-b-09-0-UI.s1 NCI_CGAP_Sub7 cDNA clone IMAGE: 3083081 3' |
| 459C7 | 70 | 661 | BF525720 | NA | 0 | 1 | cDNA clone IMAGE: 4212877 5' |
| 462F8 | 151 | 684 | BF526421 | NA | 0 | 1 | cDNA clone IMAGE: 4213536 5' |
| 174H6 | 1 | 367 | BF530382 | NA | 0 | 1 | cDNA clone IMAGE: 4214327 5' |
| 477C5 | 183 | 689 | BF569545 | NA | 0 | 1 | cDNA clone IMAGE: 4310435 5' |
| 46C3 | 2 | 626 | BF571362 | NA | 0 | 1 | cDNA clone IMAGE: 4252059 5' |
| 465B1 | 350 | 508 | BF591040 | NA | 3.00E−39 | 1 | cDNA clone IMAGE: 3319177 3' |
| 477G7 | 6 | 127 | BF592138 | NA | 2.00E−57 | 1 | cDNA clone IMAGE: 3573334 3' |
| 180B2 | 53 | 264 | BF593930 | NA | 1.00E−114 | 1 | nab48e03.x1 Soares_NSF_F8_9W_OT_PA_P_S1 cDNA clone |
| 185F12 | 139 | 578 | BF663116 | NA | 0 | 1 | cDNA clone IMAGE: 4308392 5' |
| 471F9 | 77 | 590 | BF667621 | NA | 0 | 1 | cDNA clone IMAGE: 4278888 5' |
| 41D10 | 16 | 664 | BF668050 | NA | 0 | 2 | cDNA clone IMAGE: 4279827 5' |
| 491G6 | 87 | 275 | BF670567 | NA | 1.00E−97 | 1 | cDNA clone IMAGE: 4290961 5' |
| 112B4 | 17 | 303 | BF671020 | NA | 1.00E−120 | 1 | cDNA clone IMAGE: 4292143 5' |
| 194H6 | 6 | 196 | BF678298 | NA | 1.00E−100 | 1 | cDNA clone IMAGE: 4248916 5' |
| 514H9 | 96 | 179 | BF691178 | NA | 2.00E−32 | 1 | cDNA clone IMAGE: 4332544 5' |
| 99H1 | 146 | 327 | BF691895 | NA | 2.00E−69 | 1 | cDNA clone IMAGE: 4333460 5' |
| 465E12 | 29 | 681 | BF725383 | NA | 0 | 1 | cDNA (Un-normalized, unamplified): BX cDNA clone |
| 69B10 | 17 | 96 | BF726114 | NA | 3.00E−37 | 1 | cDNA (Un-normalized, unamplified): BY cDNA clone |
| 151H10 | 18 | 366 | BF732404 | NA | 0 | 1 | cDNA clone IMAGE: 3434918 3' |
| 124D2 | 36 | 378 | BF736784 | NA | 1.00E−179 | 1 | KT0018 cDNA |
| 463H5 | 30 | 152 | BF740663 | NA | 3.00E−56 | 1 | HB0031 cDNA |
| 469D2 | 164 | 398 | BF744387 | NA | 6.00E−74 | 1 | BT0636 cDNA |
| 72E1 | 17 | 128 | BF749089 | NA | 1.00E−44 | 3 | BN0386 cDNA |
| 98C3 | 9 | 515 | BF758480 | NA | 0 | 1 | CT0539 cDNA |
| 46E11 | 26 | 162 | BF773126 | NA | 5.00E−57 | 1 | IT0048 cDNA |
| 124C8 | 32 | 257 | BF773393 | NA | 1.00E−115 | 1 | IT0039 cDNA |
| 166G8 | 312 | 549 | BF797348 | NA | 1.00E−108 | 1 | cDNA clone IMAGE: 4340490 5' |
| 146D8 | 222 | 288 | BF805164 | NA | 5.00E−29 | 1 | CI0173 cDNA |
| 49G4 | 99 | 460 | BF813798 | NA | 0 | 5 | CI0084 cDNA |
| 469F8 | 31 | 455 | BF816700 | NA | 4.00E−88 | 1 | CI0128 cDNA |
| 98C1 | 37 | 375 | BF818594 | NA | 1.00E−163 | 1 | CI0184 cDNA |
| 62C9 | 166 | 359 | BF821451 | NA | 3.00E−28 | 1 | RT0038 cDNA |
| 51F8 | 28 | 367 | BF827734 | NA | 1.00E−175 | 1 | HN0025 cDNA |
| 56F7 | 15 | 429 | BF845167 | NA | 9.00E−84 | 1 | HT1035 cDNA |
| 476D11 | 1 | 303 | BF869167 | NA | 1.00E−165 | 2 | ET0119 cDNA |
| 476H4 | 12 | 262 | BF875575 | NA | 1.00E−131 | 2 | ET0100 cDNA |
| 68D6 | 242 | 452 | BF877979 | NA | 3.00E−98 | 1 | ET0109 cDNA |
| 37C10 | 1 | 381 | BF897042 | NA | 0 | 3 | MT0179 cDNA |
| 465B3 | 63 | 193 | BF898285 | NA | 5.00E−60 | 1 | MT0229 cDNA |
| 331C7 | 274 | 485 | BF899464 | NA | 3.00E−83 | 1 | MT0211 cDNA |
| 72D8 | 50 | 334 | BF904425 | NA | 1.00E−152 | 1 | MT0245 cDNA |
| 159F6 | 333 | 417 | BF906114 | NA | 2.00E−35 | 1 | MT0267 cDNA |
| 108H5 | 6 | 409 | BF926187 | NA | 0 | 1 | NT0193 cDNA |
| 71F9 | 192 | 286 | BF928644 | NA | 1.00E−43 | 1 | NT0216 cDNA |
| 481D4 | 27 | 334 | BF938959 | NA | 1.00E−102 | 1 | cDNA clone IMAGE: 3706689 3' |
| 189B11 | 69 | 183 | BF939014 | NA | 4.00E−29 | 1 | cDNA clone IMAGE: 3706658 3' |
| 115G2 | 85 | 399 | BF940103 | NA | 1.00E−177 | 1 | cDNA clone IMAGE: 3439383 3' |
| 463B3 | 304 | 449 | BF940291 | NA | 8.00E−62 | 1 | cDNA clone IMAGE: 3577096 3' |
| 122G1 | 8 | 339 | BF950968 | NA | 1.00E−170 | 1 | NN1186 cDNA |
| 470B4 | 251 | 320 | BF962743 | NA | 2.00E−28 | 1 | NN0045 cDNA |
| 516D5 | 39 | 208 | BF962934 | NA | 5.00E−69 | 1 | NN0045 cDNA |
| 593G10 | 242 | 597 | BF965068 | NA | 1.00E−177 | 2 | cDNA clone IMAGE: 4356776 5' |
| 101A1 | 6 | 356 | BF965438 | NA | 1.00E−132 | 1 | cDNA clone IMAGE: 4356453 5' |
| 477F3 | 25 | 653 | BF965960 | NA | 0 | 1 | cDNA clone IMAGE: 4365102 5' |
| 588E4 | 67 | 562 | BF966028 | NA | 1.00E−134 | 1 | cDNA clone IMAGE: 4364887 5' |
| 467F10 | 11 | 282 | BF966049 | NA | 1.00E−122 | 1 | cDNA clone IMAGE: 4364941 5' |
| 59E12 | 81 | 355 | BF966269 | NA | 1.00E−144 | 1 | cDNA clone IMAGE: 4375212 5' |
| 480E11 | 416 | 755 | BF968628 | NA | 8.00E−41 | 1 | cDNA clone IMAGE: 4359351 5' |
| 37H8 | 200 | 500 | BF968963 | NA | 1.00E−148 | 1 | cDNA clone IMAGE: 4358390 5' |
| 98H5 | 396 | 397 | BF969990 | NA | 1.00E−133 | 1 | cDNA clone IMAGE: 4360614 5' |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 597C3 | 15 | 571 | BF971075 | NA | 0 | 1 | cDNA clone IMAGE: 4358911 5' |
| 101F1 | 188 | 305 | BF971984 | NA | 6.00E−42 | 1 | cDNA clone IMAGE: 4329095 5' |
| 464H5 | 246 | 602 | BF980139 | NA | 0 | 1 | cDNA clone IMAGE: 4373963 3' |
| 63B6 | 130 | 597 | BF981080 | NA | 0 | 1 | cDNA clone IMAGE: 4401411 5' |
| 167A3 | 223 | 418 | BF981263 | NA | 1.00E−101 | 1 | cDNA clone IMAGE: 4400757 5' |
| 512C12 | 1 | 494 | BF981634 | NA | 0 | 1 | cDNA clone IMAGE: 4397101 5' |
| 187H7 | 26 | 433 | BF997765 | NA | 1.00E−180 | 2 | GN0127 cDNA |
| 458E4 | 54 | 242 | BG006820 | NA | 3.00E−62 | 1 | GN0227 cDNA |
| 106A7 | 1 | 604 | BG024761 | NA | 0 | 1 | cDNA clone IMAGE: 4363858 5' |
| 459H6 | 1 | 524 | BG026279 | NA | 0 | 1 | cDNA clone IMAGE: 4386607 5' |
| 460B9 | 264 | 512 | BG028577 | NA | 1.00E−105 | 1 | cDNA clone IMAGE: 4387518 5' |
| 49E9 | 100 | 537 | BG033909 | NA | 0 | 1 | cDNA clone IMAGE: 4402729 5' |
| 54C10 | 1 | 582 | BG033953 | NA | 0 | 2 | cDNA clone IMAGE: 4402647 5' |
| 182B3 | 1 | 489 | BG034799 | NA | 0 | 1 | cDNA clone IMAGE: 4413514 5' |
| 166F8 | 13 | 586 | BG036101 | NA | 0 | 1 | cDNA clone IMAGE: 4414135 5' |
| 104A12 | 56 | 240 | BG054966 | NA | 1.00E−100 | 1 | cDNA clone IMAGE: 3441756 3' |
| 171H10 | 4 | 269 | BG056668 | NA | 3.00E−85 | 1 | cDNA clone IMAGE: 4169714 3' |
| 146G11 | 13 | 522 | BG057282 | NA | 0 | 5 | cDNA clone IMAGE: 4140477 3' similar to contains |
| 472A11 | 69 | 358 | BG057892 | NA | 1.00E−145 | 1 | 7f76e08.x1 Lupski_dorsal_root_ganglion cDNA clone |
| 513B4 | 2 | 418 | BG058599 | NA | 0 | 1 | cDNA clone IMAGE: 4141266 3' |
| 134B4 | 201 | 519 | BG058739 | NA | 1.00E−75 | 4 | cDNA clone IMAGE: 4140551 3' |
| 163E7 | 83 | 327 | BG110599 | NA | 1.00E−126 | 1 | cDNA clone IMAGE: 4368492 5' |
| 118A7 | 180 | 577 | BG110835 | NA | 0 | 1 | cDNA clone IMAGE: 4366502 5' |
| 37F12 | 38 | 649 | BG111212 | NA | 0 | 5 | cDNA clone IMAGE: 4369233 5' |
| 464A10 | 57 | 673 | BG111773 | NA | 0 | 1 | cDNA clone IMAGE: 4372861 5' |
| 464A7 | 56 | 411 | BG118529 | NA | 1.00E−167 | 1 | cDNA clone IMAGE: 4443519 5' |
| 458D8 | 186 | 715 | BG121288 | NA | 0 | 1 | cDNA clone IMAGE: 4450407 5' |
| 166H12 | 25 | 339 | BG149747 | NA | 1.00E−177 | 1 | cDNA clone IMAGE: 3367325 3' |
| 51H4 | 4 | 224 | BG149986 | NA | 1.00E−121 | 1 | cDNA clone IMAGE: 3406766 3' |
| 75G3 | 70 | 280 | BG150273 | NA | 1.00E−115 | 4 | cDNA clone IMAGE: 3442930 3' |
| 500F10 | 18 | 677 | BG163237 | NA | 0 | 3 | cDNA clone IMAGE: 4446802 5' |
| 519E4 | 39 | 575 | BG164898 | NA | 0 | 3 | cDNA clone IMAGE: 4453661 5' |
| 119E5 | 21 | 276 | BG165998 | NA | 1.00E−120 | 1 | cDNA clone IMAGE: 4456017 5' |
| 519B8 | 29 | 214 | BG166279 | NA | 5.00E−86 | 1 | cDNA clone IMAGE: 4455496 5' |
| 103B8 | 377 | 499 | BG170647 | NA | 1.00E−45 | 1 | cDNA clone IMAGE: 4426826 5' |
| 470F8 | 184 | 307 | BG180098 | NA | 4.00E−63 | 1 | cDNA clone IMAGE: 4430875 5' |
| 585C4 | 4 | 98 | BG230563 | NA | 5.00E−46 | 1 | cDNA clone IMAGE: 4143330 3' similar to contains |
| 48G7 | 2 | 298 | BG231557 | NA | 1.00E−119 | 1 | cDNA clone IMAGE: 4142471 3' |
| 73C4 | 188 | 430 | BG231805 | NA | 1.00E−130 | 1 | cDNA clone IMAGE: 4142814 3' |
| 148H4 | 2 | 525 | BG231961 | NA | 1.00E−133 | 12 | cDNA clone IMAGE: 4143104 3' |
| 484B5 | 364 | 533 | BG235942 | NA | 5.00E−81 | 1 | cDNA clone IMAGE: 4141389 3' |
| 137B5 | 97 | 523 | BG236015 | NA | 6.00E−87 | 1 | cDNA clone IMAGE: 4141365 3' |
| 489B11 | 12 | 294 | BG236084 | NA | 4.00E−75 | 2 | cDNA clone IMAGE: 4141856 3' similar to |
| 45H2 | 1 | 492 | BG249224 | NA | 1.00E−139 | 1 | cDNA clone IMAGE: 4470038 5' |
| 172F1 | 1 | 562 | BG254117 | NA | 0 | 1 | cDNA clone IMAGE: 4475233 5' |
| 588F3 | 66 | 202 | BG254292 | NA | 9.00E−43 | 1 | cDNA clone IMAGE: 4477042 5' |
| 583B5 | 8 | 183 | BG272304 | NA | 7.00E−45 | 1 | cDNA clone IMAGE: 4257371 |
| 73A4 | 119 | 311 | BG282346 | NA | 3.00E−42 | 1 | cDNA clone IMAGE: 4545131 5' |
| 586A2 | 99 | 511 | BG283706 | NA | 1.00E−160 | 1 | cDNA clone IMAGE: 4519866 5' |
| 152F12 | 1 | 676 | BG286649 | NA | 0 | 5 | cDNA clone IMAGE: 4499224 5' |
| 479A12 | 228 | 601 | BG286817 | NA | 1.00E−142 | 1 | cDNA clone IMAGE: 4500259 5' |
| 99B4 | 1 | 449 | BG288308 | NA | 0 | 2 | cDNA clone IMAGE: 4512706 5' |
| 584G2 | 54 | 468 | BG288554 | NA | 0 | 1 | cDNA clone IMAGE: 4517068 5' |
| 464E2 | 244 | 549 | BG289048 | NA | 1.00E−159 | 2 | cDNA clone IMAGE: 4512868 5' |
| 113H1 | 149 | 436 | BG289347 | NA | 1.00E−161 | 1 | cDNA clone IMAGE: 4516241 5' |
| 39G6 | 1 | 503 | BG290577 | NA | 0 | 1 | cDNA clone IMAGE: 4517986 5' |
| 48D8 | 38 | 440 | BG291970 | NA | 0 | 1 | cDNA clone IMAGE: 4517457 5' |
| 60E7 | 1 | 398 | BG319445 | NA | 0 | 4 | Keratinocyte Subtraction Library-Downregulated Transcripts Homo |
| 168C2 | 3 | 221 | BG319498 | NA | 1.00E−111 | 2 | Keratinocyte Subtraction Library-Downregulated Transcripts Homo |
| 461B12 | 1 | 393 | BG387694 | NA | 0 | 2 | cDNA clone IMAGE: 4521084 5' |
| 174G11 | 3 | 542 | BG391695 | NA | 0 | 1 | cDNA clone IMAGE: 4537243 5' |
| 597A4 | 164 | 612 | BG396292 | NA | 0 | 2 | cDNA clone IMAGE: 4581548 5' |
| 190B10 | 469 | 667 | BG397564 | NA | 3.00E−62 | 2 | cDNA clone IMAGE: 4564968 5' |
| 593C3 | 35 | 461 | BG403635 | NA | 0 | 1 | cDNA clone IMAGE: 4526364 5' |
| 57H10 | 121 | 495 | BG413494 | NA | 0 | 1 | 7j54e06.x1 Soares_NSF_F8_9W_OT_PA_P_S1 cDNA clone |
| 155G11 | 119 | 347 | BG424974 | NA | 3.00E−52 | 1 | cDNA clone IMAGE: 4591378 5' |
| 45G3 | 17 | 332 | BG427404 | NA | 1.00E−159 | 1 | cDNA clone IMAGE: 4612518 5' |
| 185C9 | 16 | 185 | BG432194 | NA | 3.00E−62 | 1 | cDNA clone IMAGE: 4610035 5' |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 331D4 | 60 | 386 | BG434865 | NA | 1.00E−179 | 1 | cDNA clone IMAGE: 4605025 5' |
| 464H12 | 97 | 295 | BG438232 | NA | 1.00E−105 | 1 | cDNA clone IMAGE: 4622433 5' |
| 521F2 | 280 | 534 | BG468330 | NA | 1.00E−111 | 1 | cDNA clone IMAGE: 4644153 5' |
| 56F6 | 167 | 582 | BG473228 | NA | 0 | 2 | cDNA clone IMAGE: 4646938 5' |
| 61G3 | 8 | 185 | BG473813 | NA | 2.00E−95 | 1 | cDNA clone IMAGE: 4647416 5' |
| 119E9 | 7 | 377 | BG482798 | NA | 1.00E−178 | 3 | cDNA clone IMAGE: 4616253 5' |
| 125F8 | 47 | 318 | BG489375 | NA | 1.00E−149 | 1 | cDNA clone IMAGE: 4636634 5' |
| 73H3 | 55 | 154 | BG493253 | NA | 5.00E−49 | 1 | cDNA clone IMAGE: 4672787 5' |
| 111H9 | 79 | 754 | BG497765 | NA | 0 | 1 | cDNA clone IMAGE: 4665582 5' |
| 171A10 | 74 | 476 | BG501063 | NA | 0 | 1 | cDNA clone IMAGE: 4668643 5' |
| 471G1 | 65 | 197 | BG501895 | NA | 1.00E−63 | 1 | cDNA clone IMAGE: 4654344 5' |
| 111E1 | 16 | 181 | BG503693 | NA | 4.00E−85 | 2 | cDNA clone IMAGE: 4657381 5' |
| 121B6 | 77 | 553 | BG505271 | NA | 0 | 2 | cDNA clone IMAGE: 4664028 5' |
| 599F2 | 379 | 484 | BG505379 | NA | 3.00E−45 | 1 | cDNA clone IMAGE: 4657121 5' |
| 105C1 | 208 | 646 | BG505961 | NA | 0 | 1 | cDNA clone IMAGE: 4072795 5' |
| 521E10 | 23 | 440 | BG506168 | NA | 0 | 4 | cDNA clone IMAGE: 4072226 5' |
| 119A5 | 188 | 596 | BG506472 | NA | 1.00E−103 | 1 | cDNA clone IMAGE: 4070820 5' |
| 479D7 | 34 | 308 | BG527060 | NA | 1.00E−121 | 1 | cDNA clone IMAGE: 4685209 5' |
| 71H3 | 27 | 542 | BG527658 | NA | 0 | 1 | cDNA clone IMAGE: 4685854 5' |
| 186A7 | 2 | 336 | BG531486 | NA | 5.00E−96 | 1 | cDNA clone IMAGE: 4699409 5' |
| 187H11 | 186 | 662 | BG532345 | NA | 0 | 1 | cDNA clone IMAGE: 4699954 5' |
| 64G4 | 166 | 650 | BG532470 | NA | 0 | 1 | cDNA clone IMAGE: 4699923 5' |
| 486E6 | 224 | 561 | BG533994 | NA | 1.00E−168 | 5 | cDNA clone IMAGE: 4663102 5' |
| 116F9 | 188 | 392 | BG536394 | NA | 7.00E−67 | 1 | cDNA clone IMAGE: 4689645 5' |
| 75C7 | 1 | 452 | BG536641 | NA | 0 | 2 | cDNA clone IMAGE: 4691078 5' |
| 175D10 | 3 | 114 | BG537502 | NA | 2.00E−49 | 1 | cDNA clone IMAGE: 4690780 5' |
| 599E1 | 356 | 659 | BG538731 | NA | 1.00E−111 | 1 | cDNA clone IMAGE: 4691392 5' |
| 191H9 | 80 | 631 | BG541679 | NA | 0 | 1 | cDNA clone IMAGE: 4695805 5' |
| 466A4 | 1 | 408 | BG542394 | NA | 0 | 1 | cDNA clone IMAGE: 4696046 5' |
| 67G12 | 29 | 698 | BG547561 | NA | 0 | 3 | cDNA clone IMAGE: 4703738 5' |
| 467B6 | 60 | 234 | BG547627 | NA | 3.00E−93 | 2 | cDNA clone IMAGE: 4703608 5' |
| 488F8 | 2041 | 2132 | D10495 | NA | 9.00E−31 | 1 | mRNA for protein kinase C delta-type, complete cds Length = 2163 |
| 525B6 | 21 | 222 | D17042 | NA | 1.00E−100 | 2 | HepG2 partial cDNA, clone hmd3f07m5 Length = 222 |
| 471E4 | 2287 | 2877 | D17391 | NA | 0 | 2 | mRNA for alpha 4(IV) collagen, C-terminal Length = 3558 |
| 134D8 | 561 | 694 | D28589 | NA | 2.00E−59 | 1 | mRNA (KIAA00167), partial sequence Length = 792 |
| 112D1 | 1614 | 2159 | D30036 | NA | 0 | 1 | mRNA for phosphatidylinositol transfer protein (PI-TPalpha), complete |
| 98H4 | 1 | 357 | F11941 | NA | 1.00E−180 | 1 | brain cDNA cDNA clone c-33f05 |
| 585G7 | 15 | 264 | F13765 | NA | 1.00E−136 | 1 | (1992) cDNA clone FII112 3' |
| 47D11 | 1 | 296 | F35665 | NA | 1.00E−146 | 1 | cDNA clone sH5-000005-0/E06 |
| 465F5 | 34 | 225 | H03298 | NA | 1.00E−70 | 1 | cDNA clone IMAGE: 151865 5' |
| 481A6 | 43 | 362 | H51796 | NA | 1.00E−123 | 1 | spleen 1NFLS cDNA clone IMAGE: 194250 5' |
| 100E3 | 116 | 205 | H56344 | NA | 1.00E−37 | 1 | spleen 1NFLS cDNA clone IMAGE: 203711 5' similar to |
| 464F9 | 10 | 398 | H57221 | NA | 5.00E−45 | 2 | spleen 1NFLS cDNA clone IMAGE: 204710 5' |
| 66C3 | 10 | 77 | H78395 | NA | 8.00E−28 | 1 | liver spleen 1NFLS cDNA clone IMAGE: 233597 3' |
| 105D11 | 63 | 365 | H81660 | NA | 1.00E−154 | 1 | 2NbHM cDNA clone IMAGE: 249138 5' |
| 60G10 | 1 | 189 | H86841 | NA | 1.00E−100 | 1 | cDNA clone IMAGE: 220310 5' similar to SP: S44265 |
| 470D6 | 1 | 314 | H92914 | NA | 1.00E−146 | 1 | Soares_pineal_gland_N3HPG cDNA clone IMAGE: 231988 3' |
| 483E5 | 839 | 944 | K02885 | NA | 1.00E−26 | 1 | T-cell receptor active beta-chain V-D-J-beta-1.2-C-beta-1 (TCRB) mRNA, |
| 516F5 | 1753 | 2047 | L11284 | NA | 1.00E−131 | 1 | Homo sapiens ERK activator kinase (MEK1) mRNA Length = 2222 |
| 525E11 | 105 | 738 | L40557 | NA | 1.00E−112 | 1 | perforin (PRF1) mRNA, 3' end Length = 818 |
| 74F1 | 661 | 826 | M11124 | NA | 5.00E−41 | 1 | MHC HLA DQ alpha-chain mRNA from DRw9 cell line Length = 835 |
| 121E3 | 1323 | 1870 | M12824 | NA | 0 | 4 | T-cell differentiation antigen Leu-2/T8 mRNA, partial cds Length = 197 |
| 66H2 | 713 | 1190 | M17783 | NA | 0 | 1 | glia-derived nexin (GDN) mRNA, 5' end Length = 1191 |
| 41A9 | 698 | 883 | M32577 | NA | 4.00E−28 | 1 | MHC HLA-DQ beta mRNA, complete cds Length = 1104 |
| 478D10 | 436 | 605 | M55674 | NA | 4.00E−33 | 1 | (clone M212) phosphoglycerate mutase 2 (muscle specific isozyme) (PGAM |
| 469B8 | 5 | 377 | N20190 | NA | 0 | 1 | 2NbHM cDNA clone IMAGE: 264340 3' |
| 109E4 | 21 | 449 | N23307 | NA | 0 | 2 | 2NbHM cDNA clone IMAGE: 267836 3' |
| 171D9 | 80 | 381 | N25486 | NA | 1.00E−147 | 1 | 2NbHM cDNA clone IMAGE: 264068 5' |
| 73H12 | 1 | 398 | N27575 | NA | 1.00E−144 | 2 | 2NbHM cDNA clone IMAGE: 264499 5' |
| 490A11 | 25 | 475 | N31700 | NA | 0 | 1 | 2NbHM cDNA clone IMAGE: 267025 5' |
| 599D6 | 185 | 483 | N34261 | NA | 1.00E−150 | 1 | 2NbHM cDNA clone IMAGE: 267967 5' |
| 188F3 | 112 | 357 | N36787 | NA | 1.00E−107 | 1 | 2NbHM cDNA clone IMAGE: 273145 3' |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 465B10 | 7 | 558 | N49836 | NA | 0 | 1 | yz08a11.s1 Soares_multiple_sclerosis_2NbHMSP cDNA |
| 40D4 | 199 | 575 | N58136 | NA | 1.00E−153 | 1 | spleen 1NFLS cDNA clone IMAGE: 247587 3' |
| 183E2 | 227 | 366 | N80578 | NA | 2.00E−53 | 1 | Soares_fetal_lung_NbHL19W cDNA clone IMAGE: 300873 3' similar to |
| 139G6 | 9 | 269 | N94511 | NA | 1.00E−125 | 1 | zb80g04.s1 Soares_senescent_fibroblasts_NbHSF cDNA |
| 126B8 | 1 | 256 | N99577 | NA | 1.00E−137 | 2 | spleen 1NFLS cDNA clone IMAGE: 295067 5' |
| 118A10 | 893 | 5056 | NC_001807 | NA | 0 | 7 | mitochondrion, complete genome Length = 16568 |
| 41B2 | 1 | 471 | NM_000873 | NA | 0 | 1 | intercellular adhesion molecule 2 (ICAM2), mRNA Length = 1035 |
| 62A8 | 1877 | 1958 | NM_000958 | NA | 1.00E−37 | 4 | prostaglandin E receptor 4 (subtype EP4) (PTGER4), mRNA |
| 179H10 | 53 | 265 | NM_000983 | NA | 1.00E−44 | 1 | ribosomal protein L22 (RPL22), mRNA Length = 602 |
| 331D3 | 71 | 343 | NM_001024 | NA | 1.00E−144 | 5 | ribosomal protein S21 (RPS21), mRNA Length = 343 |
| 41G10 | 3162 | 3565 | NM_001243 | NA | 3.00E−47 | 1 | tumor necrosis factor receptor superfamily, member 8 (TNFRSF8), mRNA |
| 591E9 | 1027 | 1483 | NM_002211 | NA | 0 | 2 | integrin, beta 1 (fibronectin receptor, beta polypeptide, antigen CD29 |
| 497C6 | 4946 | 5064 | NM_002460 | NA | 9.00E−36 | 2 | interferon regulatory factor 4 (IRF4), mRNA Length = 5065 |
| 597D8 | 1232 | 1461 | NM_005356 | NA | 2.00E−48 | 1 | lymphocyte-specific protein tyrosine kinase (LCK), mRNA Length = 2032 |
| 166G2 | 50 | 319 | NM_005745 | NA | 2.00E−90 | 1 | accessory proteins BAP31/BAP29 (DXS1357E), mRNA Length = 1314 |
| 468D2 | 3245 | 3480 | NM_011086 | NA | 8.00E−63 | 1 | similar to Mus phosphoinositide kinase, fyve-containing (Pikfyve), mRNA |
| 599A4 | 1335 | 1630 | NM_014644 | NA | 2.00E−69 | 1 | KIAA0477 gene product (KIAA0477), mRNA Length = 5676 |
| 69C2 | 818 | 1361 | NM_014905 | NA | 0 | 3 | glutaminase (GLS), mRNA Length = 4606 |
| 495C6 | 622 | 838 | NM_015435 | NA | 1.00E−104 | 1 | double ring-finger protein, Dorfin (DORFIN), mRNA Length = 1640 |
| 463D11 | 480 | 632 | NM_015995 | NA | 1.00E−77 | 1 | Kruppel-like factor 13 (KLF13), mRNA Length = 1079 |
| 49C10 | 817 | 964 | NM_019604 | NA | 3.00E−28 | 1 | class-I MHC-restricted T cell associated molecule (CRTAM), mRNA |
| 188E4 | 390 | 643 | NM_019997 | NA | 6.00E−79 | 1 | similar to Mus musculus cDNA sequence AB041581 (AB041581) |
| 103H2 | 1421 | 1662 | NM_021432 | NA | 3.00E−66 | 1 | similar to Mus RIKEN cDNA 1110020M21 gene (1110020M21Rik) |
| 465G11 | 1685 | 1761 | NM_021777 | NA | 1.00E−34 | 1 | a disintegrin and metalloproteinase domain 28 (ADAM28), transcirpt var |
| 166D8 | 1265 | 1951 | NM_022152 | NA | 0 | 1 | PP1201 protein (PP1201), mRNA Length = 2309 |
| 459G6 | 1 | 123 | NM_024567 | NA | 2.00E−36 | 1 | hypothetical protein (FLJ21616), mRNA Length = 1858 |
| 461G2 | 667 | 1182 | NM_025977 | NA | 1.00E−28 | 1 | similar to Mus RIKEN cDNA 2510048L02 gene (2510048L02Rik) |
| 62A5 | 759 | 1200 | NM_030780 | NA | 0 | 1 | folate transporter/carrier (LOC81034), mRNA Length = 2534 |
| 52C11 | 1277 | 1954 | NM_030788 | NA | 0 | 1 | DC-specific transmembrane protein (LOC81501), mRNA Length = 1974 |
| 108A7 | 910 | 3014 | NM_031419 | NA | 0 | 4 | molecule possessing ankyrin repeats induced by lipopolysaccharide |
| 74E11 | 47 | 464 | NM_031435 | NA | 0 | 1 | hypothetical protein DKFZp56410422 (DKFZP56410422), mRNA |
| 56B3 | 1518 | 1962 | NM_031453 | NA | 1.00E−176 | 1 | hypothetical protein MGC11034 (MGC11034), mRNA Length = 3301 |
| 46F2 | 118 | 663 | NM_031480 | NA | 1.00E−105 | 1 | hypothetical protein AD034 (AD034), mRNA Length = 2495 |
| 192B3 | 51 | 290 | R11456 | NA | 1.00E−105 | 1 | spleen 1NFLS cDNA clone IMAGE: 129880 5' similar to |
| 458B9 | 43 | 359 | R64054 | NA | 1.00E−159 | 1 | cDNA clone IMAGE: 139969 5' |
| 169F11 | 1 | 429 | R85137 | NA | 0 | 1 | brain N2b4HB55Y cDNA clone IMAGE: 180492 5' |
| 465B5 | 16 | 392 | R88126 | NA | 1.00E−164 | 1 | cDNA clone IMAGE: 186850 5' |
| 477F8 | 1 | 525 | T77017 | NA | 0 | 1 | 1NIB cDNA clone IMAGE: 23326 5' |
| 39G11 | 162 | 455 | T80378 | NA | 1.00E−145 | 1 | 1NIB cDNA clone IMAGE: 24693 5' |
| 107D7 | 1 | 371 | T80654 | NA | 0 | 1 | spleen 1NFLS cDNA clone IMAGE: 108950 5' |
| 465A1 | 6 | 314 | T85880 | NA | 1.00E−114 | 1 | spleen 1NFLS cDNA clone IMAGE: 112441 5' |
| 48D12 | 2300 | 2533 | U08015 | NA | 1.00E−128 | 1 | NF-ATc mRNA, complete cds Length = 2743 |
| 121F1 | 13 | 380 | U46388 | NA | 1.00E−150 | 1 | cell line Patu 8988t cDNA clone xs425 |
| 127B12 | 3 | 330 | U52054 | NA | 0 | 4 | S6 H-8 mRNA expressed in chromosome 6-suppressed melanoma cells |
| 487C2 | 4054 | 4187 | U52682 | NA | 2.00E−28 | 1 | lymphocyte specific interferon regulatory factor/interferon regulatory |
| 110B3 | 1404 | 2081 | U53530 | NA | 0 | 1 | cytoplasmic dynein 1 heavy chain mRNA, partial cds Length = 2694 |

TABLE 3A-continued

Candidate nucleotide sequences identified using differential cDNA hybridization analysis

| Example Clone | Offset on Acc Start | Offset on Acc End | Accession Number | UniGene | Signif | Number Clones | Genbank Description |
|---|---|---|---|---|---|---|---|
| 466C8 | 34 | 175 | U75805 | NA | 3.00E−47 | 1 | cDNA clone f46 |
| 148G12 | 1513 | 1639 | U87954 | NA | 1.00E−27 | 1 | erbB3 binding protein EBP1 mRNA, complete cds Length = 1648 |
| 70A4 | 564 | 1381 | U94359 | NA | 0 | 2 | glycogenin-2 like mRNA sequence Length = 4066 |
| 158E4 | 843 | 945 | U97075 | NA | 1.00E−33 | 1 | FLICE-like inhibitory protein short form mRNA, complete cds |
| 459A1 | 227 | 446 | W00466 | NA | 1.00E−60 | 1 | 2NbHM cDNA clone IMAGE: 291193 5' |
| 459A2 | 60 | 350 | W00491 | NA | 1.00E−126 | 1 | 2NbHM cDNA clone IMAGE: 291255 5' similar to |
| 459B1 | 76 | 551 | W02600 | NA | 0 | 1 | spleen 1NFLS cDNA clone IMAGE: 296099 5' |
| 166C10 | 10 | 415 | W16552 | NA | 0 | 1 | Soares_fetal_lung_NbHL19W cDNA clone IMAGE: 301703 5' |
| 471C6 | 3 | 383 | W19201 | NA | 1.00E−149 | 1 | Soares_fetal_lung _NbHL19W cDNA clone IMAGE: 303118 5' similar to |
| 520A8 | 75 | 382 | W19487 | NA | 1.00E−154 | 1 | zb36f09.r1 Soares_parathyroid_tumor_NbHPA cDNA clone |
| 459B7 | 57 | 158 | W25068 | NA | 9.00E−50 | 1 | Soares_fetal_lung _NbHL19W cDNA clone IMAGE: 308696 5' |
| 188D3 | 39 | 283 | W26193 | NA | 2.00E−91 | 1 | randomly primed sublibrary cDNA |
| 75B12 | 8 | 386 | W27656 | NA | 1.00E−166 | 1 | randomly primed sublibrary cDNA |
| 163F8 | 74 | 330 | W47229 | NA | 1.00E−117 | 1 | zc39c01.r1 Soares_senescent_fibroblasts_NbHSF cDNA |
| 478E6 | 2 | 322 | W56487 | NA | 3.00E−51 | 1 | zc59c07.r1 Soares_parathyroid _NbHPA cDNA clone |
| 73H4 | 76 | 297 | W72392 | NA | 1.00E−121 | 1 | Soares_fetal_heart_NbHH19W cDNA clone IMAGE: 345661 3' |
| 66D5 | 1 | 457 | W74397 | NA | 0 | 3 | Soares_fetal_heart_NbHH19W cDNA clone IMAGE: 345236 5' |
| 496D4 | 85 | 450 | W79598 | NA | 0 | 1 | Soares_fetal_heart_NbHH1 9W cDNA clone IMAGE: 347020 5' |
| 165D1 | 108 | 287 | W80882 | NA | 4.00E−94 | 1 | Soares_fetal_heart_NbHH19W cDNA clone IMAGE: 347240 5' |
| 463G1 | 5 | 406 | W86427 | NA | 0 | 1 | zh61c11.s1 Soares_fetal_liver spleen_1NFLS_S1 cDNA |
| 469G11 | 1276 | 1621 | X06180 | NA | 0 | 1 | mRNA for CD7 antigen (gp40) Length = 1656 |
| 113E11 | 126 | 885 | X65318 | NA | 0 | 1 | Cloning vector pGEMEX-2 Length = 3995 |
| 482E1 | 921 | 1168 | X79536 | NA | 1.00E−102 | 1 | mRNA for hnRNPcore protein A1 Length = 1198 |
| 123G8 | 408 | 848 | XM_002068 | NA | 8.00E−73 | 1 | glutamate-ammonia ligase (glutamine synthase) (GLUL), mRNA |
| 185E1 | 508 | 734 | XM_002158 | NA | 1.00E−27 | 1 | proteasome (prosome, macropain) subunit, alpha type, 5 (PSMA5), mRNA |
| 71A9 | 1131 | 1252 | XM_002269 | NA | 4.00E−29 | 1 | ARP3 (actin-related protein 3, yeast) homolog (ACTR3), mRNA |
| 49G7 | 1 | 257 | XM_003189 | NA | 1.00E−142 | 3 | similar to eukaryotic translation initiation factor 4A, isoform 2 (H. |
| 128B5 | 783 | 980 | XM_003304 | NA | 6.00E−41 | 1 | toll-like receptor 2 (TLR2), mRNA Length = 2600 |
| 185G10 | 853 | 1057 | XM_003507 | NA | 2.00E−26 | 1 | small inducible cytokine subfamily B (Cys-X-CyS), member 5 (epithelial |
| 41C9 | 588 | 1221 | XM_003593 | NA | 0 | 1 | CD38 antigen (p45) (CD38), mRNA Length = 1227 |
| 156C4 | 127 | 270 | XM_004020 | NA | 6.00E−71 | 1 | ribosomal protein S23 (RPS23), mRNA Length = 488 |
| 66E2 | 1344 | 1577 | XM_004500 | NA | 1.00E−46 | 1 | CD83 antigen (activated B lymphocytes, immunoglobulin superfamily) (CD |
| 61C6 | 474 | 987 | XM_004611 | NA | 2.00E−80 | 1 | Ras homolog enriched in brain 2 (RHEB2), mRNA Length = 987 |
| 184A7 | 971 | 1361 | XM_004720 | NA | 0 | 1 | hypothetical protein FLJ11000 (FLJ11000), mRNA Length = 1680 |
| 128E6 | 580 | 741 | XM_004839 | NA | 5.00E−38 | 1 | pre-B-cell colony-enhancing factor (PBEF), mRNA Length = 2377 |
| 55A11 | 1096 | 1305 | XM_005162 | NA | 1.00E−60 | 1 | GTP-binding protein overexpressed in skeletal muscle (GEM), mRNA |
| 519C4 | 1307 | 1441 | XM_005543 | NA | 1.00E−69 | 1 | aquaporin 3 (AQP3), mRNA Length = 1441 |
| 129F1 | 1854 | 2367 | XM_005693 | NA | 0 | 1 | inositol polyphosphate-5-phosphatase, 40 kD (INPP5A), mRNA |
| 522C10 | 700 | 916 | XM_005698 | NA | 7.00E−53 | 1 | programmed cell death 4 (PDCD4), mRNA Length = 1622 |
| 180G6 | 1884 | 2290 | XM_005799 | NA | 1.00E−166 | 1 | integrin, beta 1 (fibronectin receptor, beta polypeptide, antigen CD29 |
| 55F4 | 2573 | 2748 | XM_005883 | NA | 4.00E−73 | 1 | early growth response 2 (Krox-20 (Drosophila) homolog) (EGR2), mRNA |
| 492H7 | 976 | 1176 | XM_005980 | NA | 4.00E−33 | 1 | proteoglycan 1, secretory granule (PRG1), mRNA Length = 1176 |

TABLE 3A-continued

Candidate nucleotide sequences identified using differential cDNA hybridization analysis

| Example Clone | Offset on Acc Start | End | Accession Number | UniGene | Signif | Number Clones | Genbank Description |
|---|---|---|---|---|---|---|---|
| 476B4 | 1541 | 1918 | XM_006741 | NA | 0 | 1 | hypothetical protein FLJ10701 (FLJ10701), mRNA Length = 2299 |
| 493H5 | 145 | 379 | XM_006881 | NA | 2.00E−56 | 1 | interleukin 22 (IL22), mRNA Length = 676 |
| 499B4 | 11117 | 11410 | XM_007156 | NA | 3.00E−34 | 1 | spastic ataxia of Charlevoix-Saguenay (sacsin) (SACS), mRNA |
| 183D7 | 4270 | 4376 | XM_007189 | NA | 5.00E−37 | 1 | forkhead box O1A (rhabdomyosarcoma) (FOXO1A), mRNA Length = 5037 |
| 115B6 | 4151 | 4408 | XM_007606 | NA | 2.00E−50 | 2 | thrombospondin 1 (THBS1), mRNA Length = 5719 |
| 587B4 | 31 | 264 | XM_007650 | NA | 1.00E−114 | 3 | beta-2-microglobulin (B2M), mRNA Length = 918 |
| 598H5 | 206 | 300 | XM_008062 | NA | 1.00E−31 | 1 | ribosomal protein S15a (RPS15A), mRNA Length = 435 |
| 73E4 | 3252 | 3505 | XM_008082 | NA | 1.00E−119 | 1 | adaptor-related protein complex 1, gamma 1 subunit (AP1G1), mRNA |
| 64F7 | 186 | 334 | XM_008449 | NA | 1.00E−47 | 1 | small inducible cytokine A4 (homologous to mouse Mip-1b) (SCYA4) |
| 585E1 | 904 | 1020 | XM_009533 | NA | 1.00E−26 | 1 | CGI-06 protein (LOC51604), mRNA Length = 2146 |
| 75B8 | 710 | 1406 | XM_009574 | NA | 0 | 1 | nucleolar protein (KKE/D repeat) (NOP56), mRNA Length = 1910 |
| 467A5 | 210 | 620 | XM_009641 | NA | 0 | 1 | v-src avian sarcoma (Schmidt-Ruppin A-2) viral oncogene homolog (SRC), |
| 44A3 | 480 | 854 | XM_009917 | NA | 0 | 1 | splicing factor 3a, subunit 1, 120 kD (SF3A1), mRNA Length = 2614 |
| 114D12 | 2269 | 2491 | XM_009929 | NA | 7.00E−56 | 1 | LIM domain kinase 2 (LIMK2), mRNA Length = 3699 |
| 52F6 | 1 | 230 | XM_010593 | NA | 2.00E−36 | 1 | signaling lymphocytic activation molecule (SLAM), mRNA Length = 1791 |
| 185E5 | 1576 | 1695 | XM_010897 | NA | 3.00E−32 | 1 | neural precursor cell expressed, developmentally down-regulated 5 (NED |
| 106C3 | 1359 | 1824 | XM_011080 | NA | 0 | 1 | T cell activation, increased late expression (TACTILE), mRNA |
| 56H11 | 40 | 617 | XM_011082 | NA | 0 | 1 | interleukin 21 (IL21), mRNA Length = 617 |
| 53B2 | 2711 | 2839 | XM_011714 | NA | 3.00E−29 | 1 | neutral sphingomyelinase (N-SMase) activation associated factor (NSMAF |
| 47A3 | 896 | 1231 | XM_011865 | NA | 1.00E−55 | 1 | isopentenyl-diphosphate delta isomerase (IDI1), mRNA Length = 1835 |
| 159E9 | 17 | 178 | XM_011914 | NA | 1.00E−73 | 1 | ribosomal protein S24 (RPS24), mRNA Length = 515 |
| 39E6 | 339 | 535 | XM_012059 | NA | 1.00E−44 | 1 | hypothetical protein MDS025 (MDS025), mRNA Length = 1225 |
| 142F6 | 623 | 745 | XM_012328 | NA | 2.00E−40 | 1 | granzyme B (granzyme 2, cytotoxic T-lymphocyte-associated serine ester |
| 118D4 | 329 | 765 | XM_012649 | NA | 1.00E−114 | 1 | small inducible cytokine A7 (monocyte chemotactic protein 3) (SCYA7), |
| 168H9 | 2502 | 2616 | XM_015180 | NA | 2.00E−33 | 1 | apolipoprotein L, 6 (APOL6), mRNA Length = 2915 |
| 58D2 | 1582 | 1742 | XM_015921 | NA | 2.00E−30 | 1 | putative chemokine receptor; GTP-binding protein (HM74), mRNA |
| 466H9 | 86 | 440 | XM_016138 | NA | 2.00E−45 | 1 | hypothetical protein FLJ12439 (FLJ12439), mRNA Length = 1614 |
| 184G1 | 2651 | 3584 | XM_016481 | NA | 0 | 3 | hypothetical protein (DJ328E19.C1.1), mRNA Length = 3603 |
| 107G9 | 8199 | 8786 | XM_016721 | NA | 0 | 1 | zinc finger protein 106 (ZFP106), mRNA Length = 10462 |
| 39F11 | 2719 | 3671 | XM_016972 | NA | 0 | 2 | similar to hypothetical protein (*H. sapiens*) (LOC82646), mRNA |
| 159A7 | 19 | 561 | XM_018498 | NA | 1.00E−167 | 3 | ribosomal protein L5 (RPL5), mRNA Length = 984 |
| 459H2 | 2956 | 3450 | Y16414 | NA | 0 | 1 | mRNA for exportin (tRNA) Length = 3497 |

TABLE 3B

Identified Genomic Regions that code for novel human mRNA's

| Example Clone | Genome Start | End | Accession | Probability | Number Clones | Genbank Description |
|---|---|---|---|---|---|---|
| 172H5 | 12457 | 13616 | AC000015 | 0 | 2 | chromosome 4 clone B271E1 map 4q25, complete sequence L |
| 464A9 | 21144 | 21280 | AC000068 | 2.00E−70 | 1 | Chromosome 22q11.2 Cosmid Clone 102g9 In DGCR Region, c |
| 472B10 | 20340 | 20745 | AC000087 | 2.00E−67 | 1 | Chromosome 22q11.2 Cosmid Clone 83c5 In |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 103C4 | 93389 | 93611 | AC000119 | 0 | 5 | DGCR Region, co BAC clone RG104I04 from 7q21–7q22, complete sequence [H |
|  | 119111 | 119521 | AC000119 |  |  |  |
|  | 119522 | 119890 | AC000119 |  |  |  |
|  | 119989 | 121059 | AC000119 |  |  |  |
| 514A3 | 201218 | 201293 | AC000353 | 5.00E–34 | 2 | Chromosome 11q13 BAC Clone 18h3, complete sequence Leng |
| 524A9 | 24315 | 24820 | AC002073 | 0 | 3 | PAC clone RP3-515N1 from 22q11.2–q22, complete sequence |
|  | 24879 | 25274 | AC002073 |  |  |  |
| 458D10 | 28080 | 28625 | AC002297 | 0 | 1 | Genomic sequence from 9q34, complete sequence [Homo sap |
| 476D3 | 106080 | 106289 | AC002302 | 1.00E–86 | 1 | Chromosome 16 BAC clone CIT987-SKA-345G4-complete geno |
| 471D10 | 34638 | 34885 | AC002306 | 1.00E–118 | 2 | DNA from chromosome 19-cosmid R33799, genomic sequence, |
| 596F6 | 75526 | 76327 | AC002467 | 0 | 1 | BAC clone CTA-364P16 from 7q31, complete sequence [Homo |
| 473F3 | 74912 | 75540 | AC002549 | 0 | 2 | Xp22 BAC GS-377014 (Genome Systems BAC library) complet |
| 111E12 | 24581 | 24992 | AC003086 | 0 | 1 | BAC clone CTB-104F4 from 7q21–q22, complete sequence Le |
| 471E9 | 39706 | 40014 | AC003103 | 1.00E–151 | 1 | chromosome 17, clone HCIT268N12, complete sequence Leng |
| 526B9 | 39477 | 39615 | AC003695 | 3.00E–29 | 1 | chromosome 17, clone hRPC.859_O_20, complete sequence L |
| 331A3 | 47793 | 48492 | AC003976 | 1.00E–164 | 5 | chromosome 17, clone hCIT.91_J_4, complete sequence Len |
| 105C1 | 115642 | 116079 | AC004067 | 0 | 1 | chromosome 4 clone B366O24 map 4q25, complete sequence |
| 469H8 | 35828 | 35976 | AC004080 | 5.00E–71 | 1 | PAC clone RP1-170O19 from 7p15–p21, complete sequence L |
| 55F9 | 114263 | 114415 | AC004169 | 3.00E–46 | 1 | chromosome 4 clone C0236G06 map 4p16, complete sequence |
| 487F9 | 35319 | 35718 | AC004187 | 0 | 1 | clone UWGC: y17c131 from 6p21, complete sequence Length |
| 459H7 | 13409 | 13739 | AC004190 | 1.00E–166 | 1 | from UWGC: y18c282 from 6p21, complete sequence Length = |
| 464D1 | 28530 | 29042 | AC004221 | 1.00E–106 | 1 | DNA from chromosome 19, cosmid R29144 (LLNLR-252D12) an |
| 468A7 | 53111 | 53416 | AC004386 | 5.00E–80 | 2 | Homo Sapiens Chromosome X clone bWXD691, complete seque |
| 188F1 | 859 | 1200 | AC004520 | 0 | 1 | BAC clone CTB-119C2 from 7p15, complete sequence Length |
| 523F5 | 38269 | 38756 | AC004644 | 3.00E–38 | 1 | chromosome 16, cosmid clone 367E12 (LANL), complete seq |
| 142E4 | 113118 | 114014 | AC004686 | 0 | 14 | chromosome 17, clone hRPC.1073_F_15, complete sequence |
|  | 117050 | 117275 | AC004686 |  |  |  |
| 135F10 | 39469 | 39637 | AC004762 | 3.00E–75 | 1 | chromosome 20, P1 clone 28 (LBNL H134), complete sequen |
| 472C8 | 120427 | 120603 | AC004838 | 6.00E–92 | 1 | PAC clone RP4-589D8 from 7q31.1–q31.3, complete sequenc |
| 464F11 | 64853 | 65242 | AC004849 | 5.00E–59 | 2 | PAC clone RP4-659J6 from 7q33–q35, complete sequence Le |
| 460D2 | 54796 | 55320 | AC004854 | 0 | 1 | PAC clone RP4-673M15 from 7p13–p11.2, complete sequence |
| 513B4 | 94866 | 95147 | AC004858 | 2.00E–57 | 1 | PAC clone RP4-687K1 from 14, complete sequence Length = |
| 463C7 | 53959 | 54083 | AC004906 | 1.00E–44 | 1 | PAC clone RP5-852O24 from 7p22, complete sequence Lengt |
| 584D3 | 56155 | 56311 | AC004913 | 5.00E–36 | 1 | clone DJ0876A24, complete sequence Length = 98870 |
| 171B1 | 23796 | 24098 | AC004918 | 1.00E–145 | 1 | PAC clone RP5-894A10 from 7q32–q32, complete sequence L |
| 463B10 | 33758 | 34061 | AC004923 | 1.00E–135 | 1 | PAC clone RP5-901A4, complete sequence Length = 94851 |
| 101A1 | 50075 | 50425 | AC004997 | 1.00E–129 | 1 | PAC clone RP1-130H16 from 22q12.1-qter, complete sequen |
| 465G8 | 28181 | 28635 | AC005014 | 0 | 1 | BAC clone GS1-166A23 from 7p21, complete sequence Lengt |
| 470C3 | 93162 | 93469 | AC005068 | 1.00E–160 | 1 | BAC clone CTB-137N13 from 7, complete sequence Length = |
| 119E5 | 28806 | 29061 | AC005156 | 1.00E–119 | 1 | PAC clone RP5-1099C19 from 7q21–q22, complete sequence |

TABLE 3B-continued

Identified Genomic Regions that code for novel human mRNA's

| Example | Genome | | | | Number | |
|---|---|---|---|---|---|---|
| Clone | Start | End | Accession | Probability | Clones | Genbank Description |
| 98C3 | 24385 | 25049 | AC005192 | 0 | 1 | BAC clone CTB-163K11 from 7q31, complete sequence Lengt |
| 140G6 | 37679 | 37878 | AC005280 | 6.00E−85 | 1 | PAC clone RP1-240K6 from 14, complete sequence Length = |
| 476A10 | 12753 | 12826 | AC005306 | 8.00E−33 | 1 | chromosome 19, cosmid R27216 (LLNLR-232D4) and 3' overl |
| 331A12 | 34177 | 34328 | AC005391 | 2.00E−72 | 1 | chromosome 19, cosmid R29942, complete sequence Length |
| 111H11 | 85156 | 86081 | AC005488 | 0 | 2 | clone NH0313P13, complete sequence Length = 185737 |
| 472H11 | 22517 | 22813 | AC005531 | 1.00E−150 | 1 | PAC clone RP4-701O16 from 7q33–q36, complete sequence L |
| 139G6 | 96577 | 97117 | AC005540 | 0 | 3 | clone RP11-533I8, complete sequence Length = 133761 |
| | 116180 | 116836 | AC005540 | | | |
| 472F4 | 70951 | 71038 | AC005593 | 3.00E−41 | 1 | chromosome 5, P1 clone 1369f10 (LBNL H28), complete seq |
| 469D4 | 27949 | 28457 | AC005667 | 0 | 1 | chromosome 17, clone hRPK.329_E_11, complete sequence L |
| 463A7 | 127455 | 127799 | AC005740 | 1.00E−154 | 1 | chromosome 5p, BAC clone 50g21 (LBNL H154), complete se |
| 126B8 | 27782 | 28073 | AC005837 | 1.00E−160 | 2 | chromosome 17, clone hRPK.318_A_15, complete sequence L |
| 479D2 | 202167 | 202536 | AC005859 | 2.00E−46 | 1 | Xp22-83 BAC GSHB-324M7 (Genome Systems BAC Library) com |
| 39G6 | 62582 | 63099 | AC005920 | 0 | 1 | chromosome 17, clone hRPK.700_H_6, complete sequence Le |
| 63E1 | 39129 | 39250 | AC006006 | 3.00E−59 | 1 | PAC clone RP4-813F11 from 7q32–q34, complete sequence L |
| 461B11 | 140287 | 140770 | AC006010 | 1.00E−154 | 2 | clone DJ0935K16 |
| 119G10 | 81312 | 81740 | AC006033 | 0 | 1 | BAC clone RP11-121A8 from 7p14–p13, complete sequence L |
| 64A2 | 109063 | 109613 | AC006050 | 0 | 2 | chromosome 17, clone hRPK.268_F_2, complete sequence Le |
| 459B7 | 13630 | 14294 | AC006077 | 0 | 1 | chromosome 5, P1 clone 254f11 (LBNL H62), complete sequ |
| 37H4 | 58820 | 59068 | AC006111 | 1.00E−67 | 1 | chromosome 16 clone RP11-461A8, complete sequence Lengt |
| 512E3 | 39935 | 40123 | AC006139 | 3.00E−94 | 1 | clone UWGC: y55c068 from 6p21, complete sequence Length |
| 171H10 | 33704 | 33969 | AC006165 | 8.00E−78 | 1 | clone UWGC: y54c125 from 6p21, complete sequence Length |
| 72A1 | 106659 | 106958 | AC006207 | 1.00E−149 | 1 | 12p13.3 BAC RPCI3-488H23 (Roswell Park Cancer Institute |
| 195H12 | 38763 | 38930 | AC006323 | 2.00E−61 | 1 | clone RP5-1151M5, complete sequence Length = 86267 |
| 113B6 | 36330 | 36635 | AC006344 | 1.00E−157 | 1 | PAC clone RP4-726N20 from 7q32–q34, complete sequence L |
| 588G6 | 174012 | 174265 | AC006449 | 2.00E−93 | 1 | chromosome 17, clone hCIT.58_E_17, complete sequence Le |
| 463B2 | 65534 | 66031 | AC006483 | 0 | 1 | BAC clone CTB-161C1 from 7, complete sequence Length = |
| 115F11 | 71976 | 72094 | AC006511 | 8.00E−60 | 1 | 12p13.1 (17.1–21.3 cM) BAC RPCI11-69M1 (Roswell Park Ca |
| 187H11 | 34068 | 34544 | AC006536 | 0 | 1 | chromosome 14 clone BAC257P13 map 14q31, complete seque |
| 477E6 | 106567 | 106656 | AC007009 | 6.00E−30 | 1 | BAC clone RP11-560C1 from 7p22–p21, complete sequence L |
| 53E10 | 123408 | 123785 | AC007040 | 0 | 1 | BAC clone RP11-298H3 from 2, complete sequence Length = |
| 462C8 | 164080 | 164223 | AC007068 | 4.00E−72 | 2 | 12p BAC RPCI11-75L1 (Roswell Park Cancer Institute BAC |
| | 174303 | 174379 | AC007068 | | | |
| 478C7 | 27207 | 27305 | AC007097 | 4.00E−43 | 1 | BAC clone RP11-332E22 from 7q35–q36, complete sequence |
| 181A8 | 4600 | 4798 | AC007201 | 5.00E−59 | 2 | chromosome 19, cosmid R34383, complete sequence Length |
| 159F6 | 111852 | 112188 | AC007263 | 1.00E−151 | 1 | chromosome 14 clone RP11-79J20 containing gene for chec |
| 163F10 | 94927 | 95303 | AC007283 | 1.00E−126 | 2 | BAC clone RP11-536I18 from 2, complete sequence Length |
| 124G4 | 192082 | 192785 | AC007318 | 0 | 3 | clone RP11-420C9, complete sequence Length = 204230 |
| 331A5 | 117939 | 118047 | AC007383 | 3.00E−51 | 1 | BAC clone RP11-310K15 from 2, complete sequence Length |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 463C5 | 101528 | 101815 | AC007444 | 9.00E−41 | 1 | clone RP11-340F1 from 7p14–15, complete sequence Length |
| 485D5 | 94681 | 95267 | AC007458 | 1.00E−152 | 8 | 12q15 BAC RPCI11-444B24 (Roswell Park Cancer Institute |
|  | 95517 | 95826 | AC007458 |  |  |  |
|  | 95858 | 96487 | AC007458 |  |  |  |
|  | 96742 | 96838 | AC007458 |  |  |  |
|  | 187608 | 187732 | AC007458 |  |  |  |
| 181B6 | 95554 | 96149 | AC007488 | 0 | 2 | 3q27 BAC RPCI11-246B7 (Roswell Park Cancer Institute BA |
| 102E12 | 12533 | 12977 | AC007540 | 4.00E−93 | 1 | 12q24.1 BAC RPCI11-128P10 (Roswell Park Cancer Institut |
| 471C6 | 9877 | 10401 | AC007561 | 1.00E−160 | 1 | clone RP11-394E1, complete sequence Length = 106093 |
| 471C1 | 27629 | 27769 | AC007676 | 1.00E−27 | 1 | clone RP11-9B17, complete sequence Length = 152138 |
| 40D4 | 120766 | 121349 | AC007882 | 0 | 1 | BAC clone RP11-499D5 from 7p11.2–q11.2, complete sequen |
| 166C10 | 90374 | 90790 | AC007899 | 0 | 1 | BAC clone RP11-531C11 from 2, complete sequence Length |
| 492A7 | 11200 | 11376 | AC007911 | 7.00E−57 | 1 | chromosome 18, clone RP11-520K18, complete sequence Len |
| 459B3 | 65768 | 66232 | AC008009 | 0 | 2 | 3q26.2–27 BAC RPCI11-436A20 (Roswell Park Cancer Instit |
| 463F10 | 127622 | 127783 | AC008083 | 3.00E−85 | 1 | 12 BAC RP11-493L12 (Roswell Park Cancer Institute BAC L |
| 585C4 | 176255 | 176348 | AC008124 | 6.00E−38 | 1 | Chromosome 12q13-62.7-72 BAC RPCI11-352M15 (Roswell Par |
| 468E6 | 134033 | 134685 | AC008279 | 0 | 2 | BAC clone RP11-427F22 from 2, complete sequence Length |
| 112E9 | 37565 | 37926 | AC008408 | 0 | 4 | chromosome 5 clone CTC-278H1, complete sequence Length |
|  | 37996 | 38360 | AC008408 |  |  |  |
| 145C5 | 131866 | 132484 | AC008592 | 1.00E−141 | 8 | chromosome 5 clone CTC-576H9, complete sequence Length |
|  | 134190 | 134862 | AC008592 |  |  |  |
| 458D8 | 82521 | 83080 | AC008623 | 0 | 1 | chromosome 19 clone CTB-14D10, complete sequence Length |
| 584G2 | 44371 | 44929 | AC008723 | 0 | 2 | chromosome 5 clone CTB-95B16, complete sequence Length |
| 144F7 | 73662 | 74295 | AC008750 | 2.00E−54 | 2 | chromosome 19 clone CTD-2616J11, complete sequence Leng |
| 149G2 | 99171 | 99875 | AC008760 | 1.00E−121 | 6 | chromosome 19 clone CTD-3128G10, complete sequence Leng |
| 194H6 | 52930 | 53250 | AC008795 | 5.00E−89 | 2 | chromosome 5 clone CTD-2052F19, complete sequence Lengt |
|  | 57088 | 57263 | AC008795 |  |  |  |
| 117H9 | 101321 | 102169 | AC008860 | 0 | 11 | chromosome 5 clone CTD-2185A1, complete sequence Length |
|  | 102715 | 102980 | AC008860 |  |  |  |
|  | 103113 | 103402 | AC008860 |  |  |  |
| 155D6 | 34277 | 34517 | AC008982 | 1.00E−103 | 1 | chromosome 19 clone LLNLF-172E10, complete sequence Len |
| 458E4 | 33802 | 34039 | AC008985 | 8.00E−77 | 1 | chromosome 19 clone LLNLF-198H7, complete sequence Leng |
| 176A6 | 170428 | 170746 | AC009073 | 1.00E−138 | 1 | chromosome 16 clone RP11-31O11, complete sequence Lengt |
| 146D8 | 11633 | 11699 | AC009086 | 1.00E−28 | 1 | chromosome 16 clone RP11-368N21, complete sequence Leng |
| 458B8 | 176406 | 176888 | AC009120 | 0 | 1 | chromosome 16 clone RP11-484E3, complete sequence Lengt |
| 73C4 | 136885 | 137479 | AC009299 | 0 | 1 | BAC clone RP11-26B22 from 2, complete sequence Length = |
| 54F4 | 202039 | 202564 | AC009312 | 0 | 1 | clone RP11-425F6, complete sequence Length = 204834 |
| 480E2 | 143559 | 143986 | AC009313 | 0 | 1 | BAC clone RP11-440P12 from 2, complete sequence Length |
| 519E9 | 13492 | 13848 | AC009404 | 1.00E−178 | 1 | BAC clone RP11-28H22 from 2, complete sequence Length = |
| 129D12 | 81260 | 81769 | AC009466 | 1.00E−151 | 1 | chromosome 11, clone RP11-87N22, complete sequence Leng |
| 37E10 | 124522 | 125457 | AC009477 | 0 | 3 | BAC clone RP11-209H16 from 2, complete sequence Length |
| 129A12 | 6750 | 7331 | AC009506 | 0 | 1 | clone RP11-542H1, complete sequence Length = 191764 |
| 515H10 | 5494 | 5990 | AC009812 | 3.00E−69 | 4 | chromosome 3, clone RP11-48B3, complete sequence Length |
|  | 74019 | 74540 | AC009812 |  |  |  |
| 165D1 | 53879 | 54343 | AC009951 | 0 | 1 | clone RP11-107E5, complete sequence |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 53D8 | 30308 | 30860 | AC010132 | 1.00E−159 | 1 | Length = 159791 BAC clone RP11-111K18 from 7p11.2-p2, complete sequence |
| 487F11 | 16839 | 17267 | AC010480 | 1.00E−130 | 3 | chromosome 5 clone CTD-2315M5, complete sequence Length |
| 461G10 | 8988 | 9327 | AC010677 | 1.00E−163 | 1 | BAC clone CTD-2304L4 from 7, complete sequence Length = |
| 115H2 | 19073 | 19679 | AC010789 | 4.00E−97 | 2 | chromosome 10, clone RP11-190J1, complete sequence Leng |
| | 126247 | 126428 | AC010789 | | | |
| 168A9 | 78976 | 79540 | AC010877 | 0 | 2 | BAC clone RP11-218F6 from Y, complete sequence Length = |
| 468G6 | 98034 | 98744 | AC010878 | 1.00E−107 | 3 | clone RP11-230E20, complete sequence Length = 154115 |
| 477B12 | 167367 | 167895 | AC010913 | 0 | 1 | BAC clone RP11-44N22 from 2, complete sequence Length = |
| 192E1 | 10683 | 11328 | AC011245 | 0 | 1 | clone RP11-498O5, complete sequence Length = 56793 |
| 467C2 | 4521 | 4890 | AC011462 | 1.00E−178 | 1 | chromosome 19 clone CTC-435M10, complete sequence Lengt |
| 189F3 | 12090 | 12208 | AC011495 | 8.00E−60 | 1 | chromosome 19 clone CTB-33G10, complete sequence Length |
| 144C9 | 38166 | 38421 | AC011500 | 1.00E−62 | 1 | chromosome 19 clone CTB-60E11, complete sequence Length |
| 162E8 | 41387 | 41499 | AC012005 | 8.00E−30 | 1 | clone RP11-533E23, complete sequence Length = 189557 |
| 158G6 | 70285 | 70462 | AC012170 | 3.00E−95 | 1 | chromosome 15 clone RP11-562A8 map 15q21.1, complete se |
| 189B11 | 19127 | 19241 | AC013436 | 8.00E−29 | 3 | BAC clone RP11-105B9 from 7, complete sequence Length = |
| | 23196 | 23655 | AC013436 | | | |
| 98C9 | 178883 | 179326 | AC015651 | 1.00E−107 | 1 | chromosome 17, clone RP11-55A13, complete sequence Leng |
| 69F8 | 57839 | 58168 | AC015819 | 0 | 1 | chromosome 18, clone RP11-405M12, complete sequence Len |
| 47F9 | 3198 | 3826 | AC016395 | 0 | 1 | chromosome 10 clone RP11-153K11, complete sequence Leng |
| 480E3 | 39766 | 40155 | AC016623 | 2.00E−35 | 1 | chromosome 5 clone CTD-2345N17, complete sequence Lengt |
| 196G12 | 59552 | 60523 | AC016637 | 0 | 2 | chromosome 5 clone RP11-34J15, complete sequence Length |
| 518A8 | 61011 | 61433 | AC016751 | 0 | 1 | BAC clone RP11-504O20 from 2, complete sequence Length |
| 36C11 | 54765 | 54868 | AC017002 | 2.00E−30 | 2 | clone RP11-68E19, complete sequence Length = 205662 |
| 489H9 | 108513 | 109049 | AC017003 | 0 | 2 | clone RP11-78C11, complete sequence Length = 118385 |
| 479H6 | 142657 | 142930 | AC017020 | 8.00E−45 | 1 | BAC clone RP11-185K15 from Y, complete sequence Length |
| 483D10 | 99413 | 99875 | AC017101 | 0 | 1 | clone RP11-556A11, complete sequence Length = 195635 |
| 112B4 | 87464 | 88155 | AC018511 | 1.00E−129 | 2 | chromosome 10 clone RP11-77G23, complete sequence Lengt |
| | 117653 | 117940 | AC018511 | | | |
| 171F2 | 157933 | 158203 | AC018673 | 2.00E−96 | 1 | clone RP11-145A4, complete sequence Length = 187099 |
| 166H12 | 116351 | 116665 | AC018682 | 1.00E−177 | 1 | clone RP11-417F21, complete sequence Length = 181405 |
| 123F8 | 140561 | 141314 | AC018904 | 0 | 3 | chromosome 15 clone RP11-50C13 map 15q21.3, complete se |
| 116C9 | 191414 | 191866 | AC019206 | 0 | 1 | BAC clone RP11-401N16 from 2, complete sequence Length |
| 472E9 | 148765 | 149172 | AC020550 | 1.00E−140 | 1 | BAC clone RP11-198M19 from 2, complete sequence Length |
| 129D1 | 66284 | 67154 | AC020595 | 0 | 3 | BAC clone RP11-358M9 from 2, complete sequence Length = |
| 465H10 | 82476 | 83166 | AC020629 | 0 | 2 | 12q BAC RP11-76E16 (Roswell Park Cancer Institute BAC L |
| 182E2 | 83346 | 83465 | AC020716 | 1.00E−33 | 2 | clone RP11-449G13, complete sequence Length = 171805 |
| | 84373 | 84451 | AC020716 | | | |
| 37G8 | 35257 | 35957 | AC020750 | 0 | 1 | chromosome 3 clone RP11-105H19 map 3p, complete sequenc |
| 125F8 | 43854 | 44125 | AC022007 | 1.00E−149 | 1 | chromosome 3 clone RP11-481H17 map 3p, complete sequenc |
| 523A8 | 2991 | 3475 | AC022149 | 0 | 1 | chromosome 19 clone CTD-3093B17, complete sequence Leng |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 459E7 | 90726 | 91104 | AC022173 | 0 | 1 | chromosome 7 clone RP11-29B3, complete sequence Length |
| 469F8 | 53281 | 53724 | AC022336 | 6.00E−92 | 1 | 3 BAC RP11-71H17 (Roswell Park Cancer Institute BAC Lib |
| 463H5 | 75118 | 75256 | AC022382 | 5.00E−72 | 1 | chromosome 3 clone RP11-266J6 map 3p, complete sequence |
| 466G7 | 20276 | 20522 | AC023058 | 2.00E−53 | 2 | 3 BAC CTB-187G23 (CalTech BAC Library B) complete seque |
|  | 21327 | 21875 | AC023058 |  |  |  |
| 470B8 | 127894 | 128301 | AC024568 | 1.00E−169 | 1 | chromosome 5 clone CTD-2179L22, complete sequence Lengt |
| 473E11 | 21558 | 21818 | AC024939 | 1.00E−117 | 1 | 12 BAC RP11-485K18 (Roswell Park Cancer institute BAC L |
| 470E1 | 150190 | 150573 | AC025165 | 1.00E−171 | 1 | 12 BAC RP11-571M6 (Roswell Park Cancer Institute BAC Li |
| 480B5 | 107499 | 107766 | AC025253 | 9.00E−66 | 1 | 12 BAC RP11-499A10 (Roswell Park Cancer Institute BAC L |
| 583B5 | 27783 | 27958 | AC025257 | 1.00E−44 | 1 | 12 BAC RP11-56G10 (Roswell Park Cancer Institute BAC Li |
| 37H8 | 86118 | 86418 | AC026425 | 1.00E−148 | 1 | chromosome 5 clone CTD-2183D23, complete sequence Lengt |
| 166A9 | 119110 | 119797 | AC026794 | 0 | 1 | chromosome 5 clone CTD-2276B5, complete sequence Length |
| 103D4 | 105697 | 105794 | AC034240 | 5.00E−40 | 2 | chromosome 5 clone CTD-2335C11, complete sequence Lengt |
| 117H4 | 49581 | 49962 | AC053513 | 0 | 1 | clone RP11-359J14, complete sequence Length = 155958 |
| 459B8 | 64143 | 64709 | AC066580 | 0 | 1 | chromosome 3 clone RP11-109J15 map 3p, complete sequenc |
| 174D1 | 41807 | 42055 | AC067945 | 2.00E−69 | 2 | clone RP11-629B4, complete sequence Length = 162471 |
|  | 115078 | 115365 | AC067945 |  |  |  |
| 178F5 | 105048 | 105223 | AC068492 | 7.00E−37 | 1 | BAC clone RP11-809C23 from 2, complete sequence Length |
| 66E6 | 2116 | 2578 | AC068499 | 1.00E−135 | 2 | chromosome 19, cosmid R26574 (LLNL-R_225F10), complete |
| 178C12 | 15618 | 15959 | AC068789 | 0 | 1 | 12 BAC RP11-1049A21 (Roswell Park Cancer Institute BAC |
| 145F12 | 110468 | 110647 | AC069298 | 3.00E−89 | 4 | chromosome 3 clone RP11-56K23, complete sequence Length |
|  | 110779 | 111202 | AC069298 |  |  |  |
|  | 141211 | 141790 | AC069298 |  |  |  |
| 519F3 | 159763 | 160355 | AC069304 | 0 | 1 | BAC clone RP11-632K21 from 7, complete sequence Length |
| 464B11 | 52608 | 53051 | AC073347 | 0 | 1 | BAC clone RP11-775L16 from 7, complete sequence Length |
| 469E12 | 85540 | 85930 | AC073917 | 0 | 2 | 12q BAC RP11-415D21 (Roswell Park Cancer Institute BAC |
| 118C12 | 141407 | 141495 | AC083868 | 6.00E−70 | 3 | chromosome 7 clone RP11-148L5, complete sequence Length |
|  | 142293 | 142607 | AC083868 |  |  |  |
| 168G5 | 6632 | 7097 | AC087065 | 0 | 2 | chromosome 22q11 clone cos6, complete sequence Length = |
| 479G12 | 127024 | 127342 | AC090942 | 1.00E−119 | 1 | chromosome 3 clone RP11-220D14 map 3p, complete sequenc |
| 122G1 | 41957 | 42383 | AC091118 | 0 | 1 | chromosome 16 clone CTC-510K1, complete sequence Length |
| 479D7 | 153992 | 154141 | AF001549 | 6.00E−29 | 1 | Chromosome 16 BAC clone CIT987SK-A-270G1, complete sequ |
| 461H7 | 21977 | 22331 | AF015262 | 2.00E−69 | 1 | chromosome 21 clone Pac 255P7 map 21q-AML, complete seq |
| 463E9 | 27006 | 27615 | AF015725 | 0 | 1 | chromosome 21 clone cosmid clone D68F9 map 21q22.2, com |
| 480D9 | 15848 | 16252 | AF027207 | 1.00E−123 | 1 | chromosome 21 clone cosmid D13C2 map 21q22.2, complete |
| 465E9 | 296143 | 296800 | AF131216 | 0 | 1 | chromosome 8 map 8p23–p22 clones CTB-164D9, CTB-169o5, |
| 469D2 | 23811 | 24045 | AF161800 | 2.00E−78 | 1 | chromosome 8q21.2 BAC 189m5, complete sequence Length = |
| 37G7 | 200214 | 200755 | AJ003147 | 0 | 2 | complete genomic sequence between D16S3070 and D16S3275 |
|  | 201078 | 201309 | AJ003147 |  |  |  |
| 459A1 | 36969 | 37402 | AL008730 | 8.00E−82 | 2 | DNA sequence from PAC 487J7 on chromosome 6q21-22.1. Co |
| 480C8 | 37929 | 38457 | AL008733 | 0 | 1 | DNA sequence from clone RP1-163G9 on chromosome 1p36.2- |
| 462D9 | 36712 | 37037 | AL021878 | 0 | 2 | DNA sequence from clone RP1-257I20 on chromosome 22q13. |
|  | 40603 | 40772 | AL021878 |  |  |  |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 182H1 | 30506 | 30760 | AL022238 | 3.00E−96 | 2 | DNA sequence from clone RP5-1042K10 on chromosome 22q13 |
| 166F6 | 75035 | 75547 | AL022240 | 0 | 1 | DNA sequence from clone 328E19 on chromosome 1q12–21.2 |
| 165C12 | 179455 | 179766 | AL022329 | 1.00E−175 | 1 | DNA sequence from clone CTA-407F11 on chromosome 22q12 |
| 465A12 | 26329 | 26834 | AL022331 | 0 | 1 | DNA sequence from clone CTA-440B3 on chromosome 22q12.1 |
| 524D1 | 70719 | 70891 | AL022394 | 2.00E−87 | 1 | DNA sequence from clone RP3-511B24 on chromosome 20q11. |
| 53E3 | 129077 | 129538 | AL022396 | 0 | 1 | DNA sequence from PAC 380E11 on chromosome 6p22.3–p24. |
| 126D1 | 69809 | 70220 | AL031178 | 0 | 1 | DNA sequence from clone RP3-341E18 on chromosome 6p11.2 |
| 466A9 | 103757 | 104346 | AL031277 | 0 | 1 | DNA sequence from clone 1177E19 on chromosome 1p36.12–3 |
| 472E11 | 41594 | 41778 | AL031595 | 9.00E−97 | 1 | DNA sequence from clone RP4-671O14 on chromosome 22q13. |
| 462E8 | 72042 | 72629 | AL031672 | 0 | 1 | DNA sequence from clone RP4-691N24 on chromosome 20p11. |
| 478C2 | 29633 | 29708 | AL031708 | 9.00E−28 | 1 | DNA sequence from clone LA16-315G5 on chromosome 16, co |
| 53B1 | 30963 | 31311 | AL031729 | 1.00E−163 | 1 | DNA sequence from clone RP1-159A19 on chromosome 1p36.1 |
| 178B2 | 38674 | 38800 | AL033383 | 3.00E−27 | 1 | DNA sequence from clone RP5-1013A10 on chromosome 6p24. |
| 104A7 | 40604 | 41062 | AL033397 | 0 | 1 | DNA sequence from clone 27K12 on chromosome 6p11.2–12.3 |
| 190F11 | 77693 | 78285 | AL033519 | 0 | 1 | DNA sequence from clone RP3-340B19 on chromosome 6p21.2 |
| 121A11 | 15252 | 15679 | AL034344 | 9.00E−52 | 1 | DNA sequence from clone RP1-118B18 on chromosome 6p24.1 |
| 173B5 | 102500 | 102752 | AL034384 | 7.00E−58 | 1 | chromosome Xq28, cosmid clones 7H3, 14D7, C1230, 11E7, |
| 121A12 | 34566 | 34684 | AL034397 | 6.00E−47 | 1 | DNA sequence from clone 159A1 on chromosome Xq12–13.3. |
| 104B10 | 73639 | 74045 | AL034418 | 1.00E−176 | 1 | DNA sequence from clone RP5-1049G16 on chromosome 20q12 |
| 471F1 | 37083 | 37364 | AL034553 | 1.00E−150 | 1 | DNA sequence from clone RP5-914P20 on chromosome 20q13. |
| 463H8 | 97563 | 97753 | AL035405 | 1.00E−102 | 1 | DNA sequence from clone 21O18 on chromosome 1p35.1–36.2 |
| 472E6 | 20949 | 21271 | AL035413 | 1.00E−155 | 1 | DNA sequence from clone RP4-657E11 on chromosome 1p35.1 |
| 121F1 | 65029 | 65503 | AL035455 | 0 | 1 | DNA sequence from clone RP5-1018E9 on chromosome 20q13. |
| 465B1 | 37269 | 37445 | AL035530 | 2.00E−47 | 1 | DNA sequence from clone RP1-111C20 on chromosome 6q25.3 |
| 482C9 | 64837 | 65129 | AL035662 | 1.00E−163 | 1 | DNA sequence from clone RP4-599F21 on chromosome 20q12- |
| 166B9 | 39808 | 39976 | AL049715 | 1.00E−87 | 1 | DNA sequence from clone RP4-646P11 on chromosome 1, com |
| 591D6 | 65470 | 65892 | AL049795 | 0 | 1 | DNA sequence from clone RP4-622L5 on chromosome 1p34.2- |
| 72G1 | 82160 | 82440 | AL049829 | 1.00E−148 | 1 | chromosome 14 DNA sequence *** IN PROGRESS *** BAC R-12 |
| 112H3 | 2111 | 2535 | AL050330 | 0 | 2 | DNA sequence from clone RP1-3E1 on chromosome 6p21.23–2 |
| 479G5 | 18853 | 19244 | AL096712 | 1.00E−125 | 1 | DNA sequence from clone RP4-744I24 on chromosome 6p12.1 |
| 464C10 | 80145 | 80583 | AL096773 | 4.00E−85 | 1 | DNA sequence from clone 1000E10 on chromosome 1p12–13.3 |
| 123D11 | 34999 | 35510 | AL096808 | 1.00E−166 | 1 | genomic region containing hypervariable minisatellites |
| 129F10 | 1148 | 2507 | AL109616 | 0 | 95 | chromosome 21 Cosmid LLNLc116L1110, complete sequence L |
| 469B8 | 13155 | 13527 | AL109755 | 0 | 1 | DNA sequence from clone RP3-340H11 on chromosome 6q24.1 |
| 105F4 | 57995 | 58306 | AL109758 | 5.00E−98 | 1 | chromosome 14 DNA sequence *** IN PROGRESS *** BAC R-87 |
| 465H5 | 136248 | 136356 | AL109847 | 7.00E−29 | 1 | chromosome 14 DNA sequence BAC R-603H7 of library RPCI- |
| 60G8 | 84706 | 84959 | AL109914 | 1.00E−135 | 1 | DNA sequence from clone RP11-27F12 on |

TABLE 3B-continued

Identified Genomic Regions that code for novel human mRNA's

| Example Clone | Genome | | | Probability | Number Clones | Genbank Description |
|---|---|---|---|---|---|---|
| | Start | End | Accession | | | |
| 102A8 | 169378 | 169473 | AL109918 | 2.00E−34 | 1 | chromosome 6p22.3 DNA sequence from clone RP1-152L7 on chromosome 6p11.2- |
| 471D6 | 63862 | 64021 | AL117186 | 4.00E−80 | 1 | chromosome 14 DNA sequence *** IN PROGRESS *** BAC R-29 |
| 176E10 | 145991 | 146554 | AL117258 | 3.00E−63 | 1 | chromosome 14 DNA sequence BAC R-244E17 of library RPCI |
| 480E7 | 2975 | 3356 | AL117352 | 1.00E−153 | 1 | DNA sequence from clone RP5-876B10 on chromosome 1q42.1 |
| 110D3 | 48631 | 48886 | AL121573 | 3.00E−65 | 2 | DNA sequence from clone RP1-306F2 on chromosome 6p12.1- |
| 40B2 | 106788 | 107123 | AL121657 | 2.00E−42 | 1 | BAC sequence from the SPG4 candidate region at 2p21–2p2 |
| 52B9 | 56473 | 56690 | AL121899 | 1.00E−104 | 2 | DNA sequence from clone RP11-128M1 on chromosome 20. Co |
| 485A6 | 5475 | 7084 | AL121985 | 1.00E−138 | 7 | DNA sequence from clone RP11-404F10 on chromosome 1q23. |
| | 15867 | 16574 | AL121985 | | | |
| | 17098 | 17504 | AL121985 | | | |
| | 24037 | 24292 | AL121985 | | | |
| 40E4 | 54176 | 54528 | AL121998 | 1.00E−179 | 1 | DNA sequence from clone RP5-1103B4 on chromosome 1 Cont |
| 118H12 | 21398 | 21744 | AL132838 | 0 | 1 | chromosome 14 DNA sequence BAC R-85G20 of library RPCI- |
| 599F11 | 153822 | 154345 | AL133153 | 0 | 1 | chromosome 14 DNA sequence BAC R-895M11 of library RPCI |
| 478G8 | 115784 | 116115 | AL133243 | 1.00E−120 | 1 | BAC sequence from the SPG4 candidate region at 2p21–2p2 |
| 107H8 | 119760 | 120729 | AL133330 | 0 | 22 | DNA sequence from clone RP1-68D18 on chromosome 11p12-1 |
| | 121182 | 121863 | AL133330 | | | |
| | 122773 | 122940 | AL133330 | | | |
| | 143751 | 144379 | AL133330 | | | |
| | 146057 | 147016 | AL133330 | | | |
| | 159262 | 159639 | AL133330 | | | |
| 471E7 | 127891 | 128013 | AL133340 | 6.00E−46 | 1 | DNA sequence from clone RP11-204H22 on chromosome 20. C |
| 118H5 | 3922 | 4021 | AL133392 | 1.00E−38 | 2 | DNA sequence from clone CITF22-45C1 on chromosome 22 Co |
| | 4557 | 5184 | AL133392 | | | |
| 40A3 | 96202 | 96785 | AL133412 | 0 | 3 | DNA sequence from clone RP11-131A5 on chromosome 9q22.1 |
| | 97177 | 97568 | AL133412 | | | |
| 482A5 | 28668 | 29037 | AL133415 | 3.00E−34 | 4 | DNA sequence from clone RP11-124N14 on chromosome 10. C |
| | 51083 | 51210 | | | | |
| 54G9 | 54866 | 55153 | AL135783 | 1.00E−154 | 1 | DNA sequence from clone RP3-527F8 on chromosome Xq25–27 |
| 515C12 | 72222 | 72601 | AL135818 | 1.00E−146 | 2 | chromosome 14 DNA sequence BAC C-2547L24 of library Cal |
| 109A9 | 53171 | 53447 | AL136320 | 1.00E−137 | 1 | DNA sequence from clone RP3-323N1 on chromosome 10. Con |
| 476H10 | 127150 | 127680 | AL137017 | 0 | 1 | DNA sequence from clone RP11-120J1 on chromosome 9 Cont |
| 192C3 | 122511 | 122837 | AL137100 | 1.00E−117 | 1 | chromosome 14 DNA sequence BAC R-108M12 of library RPCl |
| 55G3 | 38923 | 39058 | AL137142 | 7.00E−44 | 2 | DNA sequence from clone RP11-173P16 on chromosome 13q12 |
| | 42456 | 42686 | AL137142 | | | |
| 466G2 | 24290 | 24402 | AL137144 | 9.00E−42 | 1 | DNA sequence from clone RP11-210E23 on chromosome 13q31 |
| 140F9 | 27354 | 27715 | AL137798 | 8.00E−82 | 1 | DNA sequence from clone RP5-1182A14 on chromosome 1 Con |
| 37A2 | 134590 | 134750 | AL137800 | 3.00E−69 | 1 | DNA sequence from clone RP1-127C7 on chromosome 1q25.1- |
| 493C2 | 734 | 1052 | AL138714 | 1.00E−157 | 1 | DNA sequence from clone RP11-121J7 on chromosome 13q32. |
| 468B9 | 1911 | 2509 | AL138717 | 9.00E−70 | 1 | DNA sequence from clone RP11-11D8 on chromosome 6 Conta |
| 194F9 | 46595 | 46814 | AL138755 | 6.00E−94 | 1 | DNA sequence from clone RP11-48M17 on chromosome 9p24.1 |
| 483D12 | 80220 | 80755 | AL138776 | 1.00E−157 | 1 | DNA sequence from clone RP11-20H6 on chromosome 1q25.1- |
| 464G9 | 14032 | 14659 | AL139020 | 0 | 1 | chromosome 14 DNA sequence BAC R-164H13 of library RPCI |
| 59G1 | 34476 | 34936 | AL139274 | 0 | 1 | DNA sequence from clone RP11-393I2 on chromosome 6, com |
| 129D3 | 65447 | 65661 | AL139289 | 1.00E−107 | 2 | DNA sequence from clone RP1-92O14 on chromosome 1p33–34 |
| | 66950 | 67158 | AL139289 | | | |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 464C2 | 55616 | 56289 | AL139328 | 0 | 1 | DNA sequence from clone RP11-84N7 on chromosome 13. Con |
| 57H10 | 155342 | 155810 | AL139330 | 0 | 2 | DNA sequence from clone RP11-266C7 on chromosome 6q25.2 |
| 470G6 | 44695 | 44978 | AL139399 | 1.00E−130 | 1 | DNA sequence from clone RP11-574A21 on chromosome Xq2l. |
| 476F5 | 42969 | 43159 | AL139801 | 5.00E−98 | 1 | DNA sequence from clone RP11-247M1 on chromosome 13, co |
| 107G11 | 139776 | 140378 | AL157402 | 0 | 2 | DNA sequence from clone RP11-553K8 on chromosome 1q31.2 |
| 172B12 | 136072 | 136492 | AL157768 | 1.00E−155 | 1 | DNA sequence from clone RP11-481A22 on chromosome 13 Co |
| 149A11 | 438 | 663 | AL157776 | 1.00E−123 | 1 | DNA sequence from clone RP11-68J15 on chromosome 6, com |
| 165E7 | 66361 | 67034 | AL157789 | 0 | 1 | chromosome 14 DNA sequence BAC R-880O3 of library RPCI- |
| 192B3 | 51907 | 52253 | AL157938 | 1.00E−176 | 1 | DNA sequence from clone RP11-544A12 on chromosome 9q34. |
| 50A11 | 5753 | 5886 | AL158136 | 1.00E−59 | 1 | DNA sequence from clone RP1-44N23 on chromosome 6 Conta |
| 472F9 | 84638 | 85232 | AL158159 | 0 | 1 | DNA sequence from clone RP11-498N2 on chromosome 9, com |
| 462G12 | 132520 | 132708 | AL160155 | 2.00E−95 | 1 | DNA sequence from clone RP11-461N23 on chromosome 13, c |
| 117H6 | 1976 | 2518 | AL160233 | 0 | 1 | chromosome 14 DNA sequence BAC C-2373J19 of library Cal |
| 460B9 | 207 | 739 | AL160408 | 1.00E−104 | 2 | DNA sequence from clone RP4-781K5 on chromosome 1q42.1- |
|  | 2023 | 2537 | AL160408 |  |  |  |
| 467F10 | 8461 | 8829 | AL161627 | 1.00E−122 | 1 | DNA sequence from clone RP11-287A8 on chromosome 9, com |
| 469A10 | 81966 | 82313 | AL161781 | 1.00E−175 | 1 | DNA sequence from clone RP11-297B17 on chromosome 9, co |
| 598H2 | 222231 | 222679 | AL162151 | 0 | 1 | chromosome 14 DNA sequence *** IN PROGRESS*** BAC C-31 |
| 466C5 | 147064 | 147687 | AL162578 | 0 | 1 | DNA sequence from clone RP11-2J18 on chromosome 6, comp |
| 467C9 | 216403 | 216544 | AL163303 | 3.00E−38 | 1 | chromosome 21 segment HS21C103 Length = 340000 |
| 462H9 | 63385 | 63502 | AL163853 | 6.00E−59 | 1 | chromosome 14 DNA sequence BAC R-248B10 of library RPCI |
| 464A10 | 63421 | 63807 | AL353744 | 2.00E−55 | 1 | clone RP13-100-A9 on chromosome X |
| 99E10 | 6789 | 7153 | AL353804 | 0 | 1 | DNA sequence from clone RP13-216E22 on chromosome Xq13. |
| 477D10 | 49708 | 50171 | AL354716 | 4.00E−96 | 1 | DNA sequence from clone RP11-86F4 on chromosome 6, comp |
| 518F10 | 3379 | 3602 | AL354891 | 2.00E−94 | 1 | DNA sequence from clone RP11-44I7 on chromosome 13, com |
| 464D8 | 122494 | 122702 | AL354977 | 1.00E−87 | 2 | DNA sequence from clone RP11-509J21 on chromosome 9, co |
| 459H6 | 109525 | 109864 | AL355520 | 1.00E−179 | 1 | DNA sequence from clone RP4-595C2 on chromosome 1q24.1- |
| 196C6 | 21603 | 21783 | AL355615 | 7.00E−96 | 2 | DNA sequence from clone RP11-33E24 on chromosome 6, com |
| 110B8 | 11907 | 12312 | AL355797 | 1.00E−145 | 1 | DNA sequence from clone RP1-9E2 on chromosome 6, comple |
| 180B2 | 142517 | 142726 | AL355871 | 1.00E−72 | 1 | DNA sequence from clone RP11-47K11 on chromosome 1, com |
| 464H5 | 50106 | 50463 | AL356276 | 0 | 2 | DNA sequence from clone RP11-367J7 on chromosome 1. Con |
| 105H4 | 32156 | 32236 | AL356379 | 2.00E−27 | 2 | DNA sequence from clone RP1-63P18 on chromosome 1. Cont |
|  | 32440 | 32804 | AL356379 |  |  |  |
| 113H1 | 22550 | 22837 | AL356481 | 1.00E−160 | 1 | DNA sequence from clone RP11-216B9 on chromosome 9, com |
| 170F7 | 46442 | 46855 | AL357374 | 0 | 1 | DNA sequence from clone RP11-353C18 on chromosome 20 Co |
| 522D3 | 113148 | 113424 | AL360182 | 1.00E−127 | 1 | DNA sequence from clone RP11-549L6 on chromosome 10, co |
| 36E9 | 38157 | 38346 | AL390196 | 4.00E−47 | 9 | clone RP11-60E24 on chromosome 6 |
| 587E3 | 15704 | 16062 | AL442128 | 1.00E−173 | 2 | DNA sequence from clone RP11-365P13 on chromosome 13, c |
| 468E8 | 52779 | 53344 | AL445201 | 1.00E−123 | 1 | DNA sequence from clone RP11-358L16 on chromosome 10, c |
| 39G11 | 106047 | 106169 | AL445687 | 2.00E−26 | 1 | clone RP11-567B20 on chromosome 1 |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 101F1 | 1538 | 1656 | AL449244 | 5.00E−44 | 2 | Novel human gene mapping to chomosome 22 Length = 2315 |
|  | 1676 | 2096 | AL449244 |  |  |  |
| 466D1 | 56761 | 56929 | AL450344 | 5.00E−85 | 1 | DNA sequence from clone RP11-136K14 on chromosome 6 Con |
| 142E9 | 116227 | 116568 | AL590763 | 0 | 8 | chromosome X sequence from 6 PACs 1 BAC and 1 cosmid, r |
|  | 116669 | 117358 | AL590763 |  |  |  |
|  | 154792 | 155165 | AL590763 |  |  |  |
| 459E9 | 26826 | 26890 | AP000471 | 2.00E−27 | 1 | genomic DNA, chromosome 21q22.3, clone:B2308H15 Length |
| 472C1 | 95646 | 96035 | AP000501 | 1.00E−101 | 1 | genomic DNA, chromosome 8p11.2, clone:91h23 to 9–41 Len |
| 464A7 | 7930 | 8285 | AP000526 | 1.00E−178 | 1 | genomic DNA, chromosome 22q11.2, Cat Eye Syndrome regio |
| 165E11 | 643 | 1244 | AP000554 | 1.00E−147 | 2 | genomic DNA, chromosome 22q11.2, BCRL2 region, clone:KB |
| 72D8 | 27091 | 27486 | AP000555 | 0 | 1 | genomic DNA, chromosome 22q11.2, BCRL2 region, clone:KB |
| 470B4 | 15634 | 15703 | AP001429 | 5.00E−28 | 1 | genomic DNA, chromosome 21q22.2, clone:T1212, LB7T-ERG |
| 59E12 | 59103 | 59520 | AP001574 | 1.00E−144 | 2 | genomic DNA, chromosome 8q23, clone: KB1991G8 Length = |
|  | 60671 | 61189 | AP001574 |  |  |  |
| 138G5 | 313261 | 313931 | AP001693 | 1.00E−31 | 27 | genomic DNA, chromosome 21q, section 37/105 Length = 34 |
|  | 315877 | 315967 | AP001693 |  |  |  |
|  | 319062 | 319564 | AP001693 |  |  |  |
|  | 319957 | 320293 | AP001693 |  |  |  |
|  | 320563 | 321212 | AP001693 |  |  |  |
|  | 328757 | 329184 | AP001693 |  |  |  |
| 158G11 | 107888 | 108375 | AP001721 | 0 | 1 | genomic DNA, chromosome 21q, section 65/105 Length = 34 |
| 462F9 | 330129 | 330645 | AP001728 | 1.00E−133 | 1 | genomic DNA, chromosome 21q, section 72/105 Length = 34 |
| 479A12 | 74529 | 74902 | AP002907 | 1.00E−141 | 1 | genomic DNA, chromosome 8q23, clone: KB431C1 Length = 9 |
| 470B2 | 123506 | 123689 | AP003117 | 4.00E−72 | 2 | genomic DNA, chromosome 8q23, clone: KB1958F4 Length = |
| 46D1 | 79174 | 79657 | AP003471 | 1.00E−164 | 2 | genomic DNA, chromosome 8q23, clone: KB1552D7 Length = |
|  | 83490 | 84099 | AP003471 |  |  |  |
| 496C4 | 745790 | 746197 | NT_004406 | 0 | 1 | chromosome 1 working draft sequence segment |
| 468E10 | 2015 | 2118 | NT_004452 | 2.00E−32 | 2 | chromosome 1 working draft sequence segment |
| 479H12 | 394087 | 394676 | NT_004480 | 0 | 1 | chromosome 1 working draft sequence segment |
| 472G2 | 268543 | 268642 | NT_004525 | 3.00E−42 | 1 | chromosome 1 working draft sequence segment |
| 477D9 | 231154 | 231469 | NT_004531 | 1.00E−177 | 1 | chromosome 1 working draft sequence segment |
| 460F7 | 786014 | 786511 | NT_004623 | 0 | 1 | chromosome 1 working draft sequence segment |
| 171F11 | 1E+06 | 1036701 | NT_004658 | 1.00E−26 | 1 | chromosome 1 working draft sequence segment |
| 184H1 | 2E+06 | 1770512 | NT_004698 | 0 | 4 | chromosome 1 working draft sequence segment |
|  | 2E+06 | 1822054 | NT_004698 |  |  |  |
|  | 2E+06 | 1832854 | NT_004698 |  |  |  |
| 514H9 | 289858 | 289941 | NT_004705 | 1.00E−29 | 1 | chromosome 1 working draft sequence segment |
| 463G1 | 175158 | 175615 | NT_004725 | 0 | 1 | chromosome 1 working draft sequence segment |
| 466C9 | 543567 | 544240 | NT_004753 | 0 | 1 | chromosome 1 working draft sequence segment |
| 496D7 | 2E+06 | 1515549 | NT_004754 | 0 | 1 | chromosome 1 working draft sequence segment |
| 583G8 | 733247 | 733667 | NT_004771 | 1.00E−128 | 1 | chromosome 1 working draft sequence segment |
| 124D2 | 107397 | 107739 | NT_004916 | 1.00E−178 | 1 | chromosome 1 working draft sequence segment |
| 479A8 | 285973 | 286345 | NT_005130 | 1.00E−165 | 1 | chromosome 2 working draft sequence segment |
| 165F7 | 1E+06 | 1435537 | NT_005151 | 1.00E−125 | 1 | chromosome 2 working draft sequence segment |
| 465F7 | 773772 | 774502 | NT_005166 | 0 | 2 | chromosome 2 working draft sequence segment |
| 73A3 | 80919 | 81448 | NT_005182 | 0 | 2 | chromosome 2 working draft sequence |

TABLE 3B-continued

Identified Genomic Regions that code for novel human mRNA's

| Example Clone | Genome Start | End | Accession | Probability | Number Clones | Genbank Description |
|---|---|---|---|---|---|---|
| | 81502 | 81742 | NT_005182 | | | segment |
| 124G7 | 2E+06 | 1859389 | NT_005204 | 1.00E−180 | 1 | chromosome 2 working draft sequence segment |
| 479G6 | 552674 | 553005 | NT_005229 | 1.00E−141 | 5 | chromosome 2 working draft sequence segment |
| | 1E+06 | 1122605 | NT_005229 | | | |
| 194C2 | 481052 | 481444 | NT_005230 | 1.00E−101 | 1 | chromosome 2 working draft sequence segment |
| 159F11 | 795978 | 796616 | NT_005275 | 0 | 1 | chromosome 2 working draft sequence segment |
| 472B1 | 1013 | 1410 | NT_005311 | 0 | 1 | chromosome 2 working draft sequence segment |
| 470G7 | 375182 | 375594 | NT_005399 | 0 | 1 | chromosome 2 working draft sequence segment |
| 100C3 | 803712 | 804094 | NT_005420 | 0 | 2 | chromosome 2 working draft sequence segment |
| | 970577 | 971108 | NT_005420 | | | |
| 98H4 | 2E+06 | 1829143 | NT_005423 | 0 | 1 | chromosome 2 working draft sequence segment |
| 105A10 | 1E+06 | 1144092 | NT_005435 | 1.00E−167 | 2 | chromosome 2 working draft sequence segment |
| 465C3 | 13444 | 13890 | NT_005471 | 0 | 1 | chromosome 2 working draft sequence segment |
| 112E5 | 3169 | 3793 | NT_005485 | 0 | 1 | chromosome 2 working draft sequence segment |
| 111H6 | 146878 | 146999 | NT_005499 | 2.00E−55 | 1 | chromosome 3 working draft sequence segment |
| 467G7 | 198880 | 199329 | NT_005505 | 0 | 1 | chromosome 3 working draft sequence segment |
| 182F12 | 140059 | 140193 | NT_005516 | 1.00E−144 | 3 | chromosome 3 working draft sequence segment |
| | 140754 | 141039 | NT_005516 | | | |
| 112B5 | 137689 | 138300 | NT_005529 | 0 | 4 | chromosome 3 working draft sequence segment |
| 64B3 | 55213 | 55793 | NT_005535 | 0 | 1 | chromosome 3 working draft sequence segment |
| 465E12 | 866776 | 867258 | NT_005769 | 0 | 2 | chromosome 3 working draft sequence segment |
| | 1E+06 | 1021292 | NT_005769 | | | |
| 470D5 | 1E+06 | 1395364 | NT_005795 | 1.00E−147 | 3 | chromosome 3 working draft sequence segment |
| | 2E+06 | 1749621 | NT_005795 | | | |
| 479G2 | 294179 | 294607 | NT_005910 | 0 | 1 | chromosome 3 working draft sequence segment |
| 112E1 | 392884 | 393490 | NT_005973 | 0 | 1 | chromosome 3 working draft sequence segment |
| 466H5 | 339511 | 340153 | NT_005985 | 0 | 2 | chromosome 3 working draft sequence segment |
| 189A8 | 22414 | 22869 | NT_005991 | 1.00E−110 | 1 | chromosome 3 working draft sequence segment |
| 45H8 | 1E+06 | 1012040 | NT_006098 | 1.00E−113 | 1 | chromosome 4 working draft sequence segment |
| 104D1 | 282259 | 282753 | NT_006102 | 0 | 2 | chromosome 4 working draft sequence segment |
| 459G8 | 367701 | 368248 | NT_006111 | 0 | 1 | chromosome 4 working draft sequence segment |
| 480E11 | 486179 | 486804 | NT_006114 | 0 | 1 | chromosome 4 working draft sequence segment |
| 115G2 | 4E+06 | 3514655 | NT_006204 | 1.00E−177 | 1 | chromosome 4 working draft sequence segment |
| 479G3 | 71744 | 72258 | NT_006258 | 0 | 1 | chromosome 4 working draft sequence segment |
| 461H11 | 378023 | 378482 | NT_006397 | 0 | 1 | chromosome 4 working draft sequence segment |
| 462F11 | 80360 | 81081 | NT_006410 | 0 | 1 | chromosome 4 working draft sequence segment |
| 463A5 | 2E+06 | 1609976 | NT_006489 | 1.00E−138 | 1 | chromosome 5 working draft sequence segment |
| 464C5 | 190095 | 190533 | NT_006611 | 0 | 2 | chromosome 5 working draft sequence segment |
| 109H9 | 89260 | 89769 | NT_006946 | 0 | 3 | chromosome 5 working draft sequence segment |
| 137B5 | 2E+06 | 1613357 | NT_006951 | 1.00E−86 | 4 | chromosome 5 working draft sequence segment |
| 73H4 | 992358 | 992685 | NT_007288 | 0 | 1 | chromosome 6 working draft sequence segment |
| 174H6 | 431672 | 432054 | NT_007308 | 0 | 1 | chromosome 6 working draft sequence segment |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 124C8 | 282413 | 283138 | NT_007951 | 0 | 1 | chromosome 7 working draft sequence segment |
| 174G11 | 829762 | 830370 | NT_007972 | 0 | 1 | chromosome 8 working draft sequence segment |
| 471H11 | 613132 | 613314 | NT_007978 | 9.00E−96 | 1 | chromosome 8 working draft sequence segment |
| 471G8 | 189279 | 189630 | NT_008012 | 1.00E−147 | 1 | chromosome 8 working draft sequence segment |
| 67C5 | 287017 | 287563 | NT_008037 | 0 | 2 | chromosome 8 working draft sequence segment |
| 479H4 | 90555 | 90944 | NT_008047 | 1.00E−174 | 1 | chromosome 8 working draft sequence segment |
| 100D7 | 64180 | 64371 | NT_008050 | 1.00E−134 | 6 | chromosome 8 working draft sequence segment |
| | 331150 | 331412 | NT_008050 | | | |
| 45B9 | 479878 | 480193 | NT_008060 | 1.00E−165 | 12 | chromosome 8 working draft sequence segment |
| | 489788 | 490607 | NT_008060 | | | |
| 169F11 | 291836 | 292284 | NT_008081 | 0 | 1 | chromosome 8 working draft sequence segment |
| 468H11 | 106661 | 106897 | NT_008128 | 1.00E−121 | 2 | chromosome 8 working draft sequence segment |
| | 110374 | 110691 | NT_008128 | | | |
| 470H6 | 520107 | 520754 | NT_008139 | 0 | 1 | chromosome 8 working draft sequence segment |
| 471F9 | 392744 | 393279 | NT_008157 | 0 | 1 | chromosome 8 working draft sequence segment |
| 469G8 | 433686 | 434156 | NT_008338 | 0 | 1 | chromosome 9 working draft sequence segment |
| 193E6 | 1E+06 | 1228306 | NT_008445 | 6.00E−56 | 1 | chromosome 9 working draft sequence segment |
| 480D2 | 90407 | 90990 | NT_008484 | 0 | 1 | chromosome 9 working draft sequence segment |
| 58G4 | 1E+06 | 1055972 | NT_008513 | 1.00E−139 | 1 | chromosome 9 working draft sequence segment |
| 490F10 | 669853 | 669980 | NT_008653 | 5.00E−39 | 2 | chromosome 10 working draft sequence segment |
| | 743459 | 744217 | NT_008653 | | | |
| 463B3 | 1E+06 | 1369815 | NT_008682 | 0 | 1 | chromosome 10 working draft sequence segment |
| 116E10 | 1E+06 | 1462064 | NT_008769 | 0 | 5 | chromosome 10 working draft sequence segment |
| | 2E+06 | 2026887 | NT_008769 | | | |
| | 2E+06 | 2027460 | NT_008769 | | | |
| | 2E+06 | 2028265 | NT_008769 | | | |
| 190A9 | 806672 | 807345 | NT_008774 | 0 | 4 | chromosome 10 working draft sequence segment |
| 473B7 | 75339 | 75524 | NT_008783 | 4.00E−72 | 2 | chromosome 10 working draft sequence segment |
| | 75869 | 76181 | NT_008783 | | | |
| 490A11 | 484304 | 484753 | NT_008921 | 0 | 1 | chromosome 10 working draft sequence segment |
| 585E10 | 328767 | 329151 | NT_008978 | 0 | 1 | chromosome 11 working draft sequence segment |
| 458B9 | 955258 | 955846 | NT_009073 | 0 | 1 | chromosome 11 working draft sequence segment |
| 471F4 | 288811 | 289312 | NT_009107 | 0 | 1 | chromosome 11 working draft sequence segment |
| 478H7 | 1E+06 | 1255050 | NT_009184 | 1.00E−92 | 1 | chromosome 11 working draft sequence segment |
| 109F10 | 1E+06 | 1136705 | NT_009314 | 1.00E−171 | 1 | chromosome 11 working draft sequence segment |
| 117F1 | 401530 | 402043 | NT_009334 | 0 | 2 | chromosome 11 working draft sequence segment |
| | 2E+06 | 1600694 | NT_009334 | | | |
| 467B6 | 3E+06 | 3011938 | NT_009338 | 5.00E−93 | 2 | chromosome 11 working draft sequence segment |
| 158H6 | 351515 | 351940 | NT_009438 | 0 | 2 | chromosome 12 working draft sequence segment |
| 471C2 | 977560 | 977791 | NT_009452 | 1.00E−127 | 1 | chromosome 12 working draft sequence segment |
| 182G2 | 21455 | 21913 | NT_009458 | 0 | 3 | chromosome 12 working draft sequence segment |
| | 167133 | 167630 | NT_009458 | | | |
| 462B12 | 518389 | 518876 | NT_009464 | 0 | 1 | chromosome 12 working draft sequence segment |
| 458A3 | 2E+06 | 1890445 | NT_009471 | 0 | 1 | chromosome 12 working draft sequence segment |
| 470D7 | 9540 | 10050 | NT_009540 | 0 | 1 | chromosome 12 working draft sequence segment |
| 525F3 | 163261 | 163590 | NT_009616 | 1.00E−125 | 1 | chromosome 12 working draft sequence |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 186E8 | 2E+06 | 1502030 | NT_009714 | 0 | 1 | chromosome 12 working draft sequence segment |
| 465G2 | 2E+06 | 1787964 | NT_009759 | 1.00E−130 | 2 | chromosome 12 working draft sequence segment |
| 476C1 | 321714 | 322118 | NT_009763 | 1.00E−170 | 1 | chromosome 12 working draft sequence segment |
| 476G8 | 2E+06 | 1609230 | NT_009770 | 6.00E−26 | 1 | chromosome 12 working draft sequence segment |
| 588E4 | 1E+06 | 1136791 | NT_010036 | 1.00E−134 | 1 | chromosome 14 working draft sequence segment |
| 479H5 | 2E+06 | 2151529 | NT_010062 | 0 | 1 | chromosome 14 working draft sequence segment |
| 178C10 | 6E+06 | 6026576 | NT_010113 | 0 | 1 | chromosome 14 working draft sequence segment |
| 192C9 | 5E+06 | 5344032 | NT_010194 | 0 | 1 | chromosome 15 working draft sequence segment |
| 119F12 | 3E+06 | 2680702 | NT_010204 | 1.00E−128 | 1 | chromosome 15 working draft sequence segment |
| 67G10 | 112609 | 112890 | NT_010222 | 1.00E−132 | 2 | chromosome 15 working draft sequence segment |
| 98C1 | 6684 | 7232 | NT_010237 | 0 | 1 | chromosome 15 working draft sequence segment |
| 458G10 | 478693 | 479052 | NT_010253 | 1.00E−120 | 1 | chromosome 15 working draft sequence segment |
| 459D1 | 2E+06 | 2123962 | NT_010289 | 0 | 1 | chromosome 15 working draft sequence segment |
| 110G1 | 303146 | 303706 | NT_010308 | 0 | 1 | chromosome 15 working draft sequence segment |
| 73A4 | 758542 | 758734 | NT_010310 | 6.00E−42 | 1 | chromosome 15 working draft sequence segment |
| 470F5 | 495497 | 496038 | NT_010360 | 0 | 1 | chromosome 15 working draft sequence segment |
| 469B6 | 1E+06 | 1095404 | NT_010419 | 1.00E−123 | 1 | chromosome 16 working draft sequence segment |
| 479E10 | 468259 | 468674 | NT_010432 | 0 | 1 | chromosome 16 working draft sequence segment |
| 100F5 | 177425 | 177795 | NT_010505 | 1.00E−169 | 1 | chromosome 16 working draft sequence segment |
| 462C5 | 22345 | 22727 | NT_010523 | 0 | 1 | chromosome 16 working draft sequence segment |
| 71H3 | 125549 | 125838 | NT_010530 | 5.00E−77 | 1 | chromosome 16 working draft sequence segment |
| 161E8 | 1E+06 | 1067677 | NT_010641 | 1.00E−123 | 1 | chromosome 17 working draft sequence segment |
| 464D9 | 120516 | 121079 | NT_010657 | 0 | 1 | chromosome 17 working draft sequence segment |
| 114G3 | 385825 | 386329 | NT_010672 | 1.00E−152 | 3 | chromosome 17 working draft sequence segment |
|  | 387069 | 387398 | NT_010672 |  |  |  |
|  | 424808 | 425286 | NT_010672 |  |  |  |
| 459E6 | 262663 | 263161 | NT_010757 | 0 | 1 | chromosome 17 working draft sequence segment |
| 134H3 | 583781 | 583868 | NT_010799 | 7.00E−32 | 1 | chromosome 17 working draft sequence segment |
| 467E5 | 1E+06 | 1376833 | NT_010808 | 0 | 1 | chromosome 17 working draft sequence segment |
| 462A11 | 436300 | 437040 | NT_010816 | 0 | 2 | chromosome 17 working draft sequence segment |
| 460C2 | 168998 | 169554 | NT_010833 | 0 | 1 | chromosome 17 working draft sequence segment |
| 467A8 | 480458 | 480865 | NT_010986 | 0 | 1 | chromosome 18 working draft sequence segment |
| 480F8 | 137902 | 138430 | NT_011029 | 0 | 1 | chromosome 18 working draft sequence segment |
| 470F8 | 472324 | 472740 | NT_011141 | 0 | 1 | chromosome 19 working draft sequence segment |
| 100E3 | 445588 | 445677 | NT_011145 | 2.00E−37 | 2 | chromosome 19 working draft sequence segment |
|  | 445757 | 446041 | NT_011145 |  |  |  |
| 104A12 | 169627 | 169811 | NT_011240 | 2.00E−99 | 1 | chromosome 19 working draft sequence segment |
| 69B10 | 358921 | 359000 | NT_011245 | 6.00E−37 | 1 | chromosome 19 working draft sequence segment |
| 465C7 | 243467 | 243788 | NT_011269 | 0 | 1 | chromosome 19 working draft sequence |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 464E7 | 1E+06 | 1182829 | NT_011597 | 1.00E-107 | 1 | segment chromosome X working draft sequence |
| 61A11 | 67055 | 67582 | NT_011724 | 0 | 1 | segment chromosome X working draft sequence |
| 140G10 | 761394 | 761693 | NT_015805 | 1.00E-138 | 3 | segment chromosome 2 working draft sequence |
|  | 761753 | 762151 | NT_015805 |  |  | segment |
| 486C4 | 503899 | 504524 | NT_016354 | 0 | 2 | chromosome 4 working draft sequence segment |
| 480G4 | 260275 | 260648 | NT_016355 | 0 | 1 | chromosome 4 working draft sequence segment |
| 461G8 | 276786 | 277233 | NT_016593 | 0 | 1 | chromosome 4 working draft sequence segment |
| 118D9 | 413201 | 413343 | NT_016968 | 7.00E-46 | 1 | chromosome 6 working draft sequence segment |
| 68C9 | 2E+06 | 2193260 | NT_017568 | 1.00E-169 | 1 | chromosome 9 working draft sequence segment |
| 470E5 | 526603 | 527148 | NT_017582 | 1.00E-131 | 2 | chromosome 9 working draft sequence segment |
| 127H8 | 248872 | 249411 | NT_019390 | 0 | 1 | chromosome 5 working draft sequence segment |
| 47G6 | 204946 | 205445 | NT_019447 | 0 | 1 | chromosome 7 working draft sequence segment |
| 467E8 | 210239 | 210638 | NT_021889 | 1.00E-170 | 1 | chromosome 1 working draft sequence segment |
| 480C6 | 210001 | 210545 | NT_021897 | 0 | 1 | chromosome 1 working draft sequence segment |
| 69H11 | 94439 | 94993 | NT_021903 | 1.00E-104 | 1 | chromosome 1 working draft sequence segment |
| 107D7 | 466791 | 467280 | NT_021918 | 0 | 1 | chromosome 1 working draft sequence segment |
| 471E11 | 418049 | 418124 | NT_021967 | 8.00E-32 | 1 | chromosome 1 working draft sequence segment |
| 468F11 | 370984 | 371480 | NT_022103 | 0 | 1 | chromosome 1 working draft sequence segment |
| 464H12 | 1E+06 | 1024449 | NT_022171 | 1.00E-155 | 1 | chromosome 2 working draft sequence segment |
| 462B11 | 242113 | 242753 | NT_022174 | 0 | 1 | chromosome 2 working draft sequence segment |
| 196D7 | 65778 | 66218 | NT_022315 | 0 | 5 | chromosome 2 working draft sequence segment |
|  | 66514 | 66886 | NT_022315 |  |  |  |
| 100E10 | 148157 | 148338 | NT_022358 | 4.00E-95 | 1 | chromosome 2 working draft sequence segment |
| 142F9 | 193054 | 193433 | NT_022457 | 0 | 6 | chromosome 3 working draft sequence segment |
|  | 240726 | 241196 | NT_022457 |  |  |  |
|  | 286545 | 287198 | NT_022457 |  |  |  |
| 595A12 | 40034 | 40650 | NT_022488 | 0 | 2 | chromosome 3 working draft sequence segment |
| 75A2 | 24792 | 25256 | NT_022555 | 1.00E-133 | 1 | chromosome 3 working draft sequence segment |
| 468G12 | 276616 | 277068 | NT_022751 | 0 | 1 | chromosome 4 working draft sequence segment |
| 471F6 | 403620 | 404200 | NT_022765 | 6.00E-89 | 1 | chromosome 4 working draft sequence segment |
| 463H12 | 197991 | 198185 | NT_022795 | 2.00E-88 | 1 | chromosome 4 working draft sequence segment |
| 473E4 | 408745 | 409322 | NT_022840 | 1.00E-123 | 2 | chromosome 4 working draft sequence segment |
| 461C8 | 544633 | 545127 | NT_022844 | 0 | 1 | chromosome 4 working draft sequence segment |
| 470G10 | 148269 | 148781 | NT_022855 | 0 | 1 | chromosome 4 working draft sequence segment |
| 480F3 | 471820 | 472173 | NT_023178 | 1.00E-138 | 1 | chromosome 5 working draft sequence segment |
| 176G2 | 98388 | 98683 | NT_023529 | 1.00E-153 | 1 | chromosome 7 working draft sequence segment |
| 71F2 | 62180 | 62604 | NT_023654 | 0 | 1 | chromosome 8 working draft sequence segment |
| 459F2 | 324390 | 324869 | NT_023660 | 0 | 1 | chromosome 8 working draft sequence segment |
| 124F9 | 275971 | 276413 | NT_023666 | 0 | 1 | chromosome 8 working draft sequence segment |
| 111H9 | 388593 | 389283 | NT_023676 | 0 | 1 | chromosome 8 working draft sequence |

TABLE 3B-continued

Identified Genomic Regions that code for novel human mRNA's

| Example Clone | Genome Start | End | Accession | Probability | Number Clones | Genbank Description |
|---|---|---|---|---|---|---|
| 460D12 | 527418 | 527528 | NT_023703 | 3.00E−43 | 1 | segment chromosome 8 working draft sequence segment |
| 129D7 | 104058 | 104672 | NT_023833 | 1.00E−170 | 1 | chromosome 8 working draft sequence segment |
| 183G2 | 183398 | 183840 | NT_023923 | 1.00E−112 | 1 | chromosome 9 working draft sequence segment |
| 478G6 | 41677 | 41996 | NT_023945 | 1.00E−137 | 1 | chromosome 9 working draft sequence segment |
| 163E7 | 1E+06 | 1455953 | NT_023959 | 1.00E−126 | 1 | chromosome 9 working draft sequence segment |
| 472G12 | 21182 | 21574 | NT_024016 | 0 | 1 | chromosome 9 working draft sequence segment |
| 466B7 | 471195 | 471690 | NT_024040 | 1.00E−138 | 1 | chromosome 10 working draft sequence segment |
| 459D2 | 315088 | 315482 | NT_024091 | 0 | 1 | chromosome 10 working draft sequence segment |
| 468B10 | 791272 | 792086 | NT_024101 | 0 | 2 | chromosome 10 working draft sequence segment |
| 175D1 | 270651 | 271264 | NT_024115 | 0 | 2 | chromosome 10 working draft sequence segment |
| 472D7 | 16139 | 16549 | NT_024223 | 0 | 1 | chromosome 11 working draft sequence segment |
| 476G3 | 71426 | 71803 | NT_024498 | 1.00E−144 | 1 | chromosome 13 working draft sequence segment |
| 138B6 | 2E+06 | 1638986 | NT_024680 | 0 | 2 | chromosome 15 working draft sequence segment |
| 466A4 | 308514 | 309137 | NT_024767 | 0 | 1 | chromosome 16 working draft sequence segment |
| 583D6 | 551386 | 551654 | NT_024781 | 1.00E−133 | 1 | chromosome 16 working draft sequence segment |
| 468F10 | 91355 | 92043 | NT_024815 | 1.00E−132 | 2 | chromosome 16 working draft sequence segment |
| 461D9 | 406470 | 406916 | NT_024897 | 0 | 2 | chromosome 17 working draft sequence segment |
|  | 440400 | 440720 | NT_024897 |  |  |  |
| 520A8 | 168514 | 168868 | NT_024997 | 0 | 1 | chromosome 18 working draft sequence segment |
| 128F5 | 113027 | 113221 | NT_025378 | 6.00E−82 | 1 | chromosome X working draft sequence segment |
| 467B11 | 519341 | 519633 | NT_025635 | 1.00E−113 | 1 | chromosome 1 working draft sequence segment |
| 464E11 | 8932 | 9161 | NT_025657 | 1.00E−126 | 1 | chromosome 2 working draft sequence segment |
| 188C1 | 1E+06 | 1221531 | NT_025823 | 4.00E−72 | 1 | chromosome 10 working draft sequence segment |
| 468B2 | 156035 | 156630 | NT_025900 | 1.00E−150 | 2 | chromosome 16 working draft sequence segment |
| 470F3 | 427484 | 428029 | NT_026379 | 0 | 2 | chromosome 10 working draft sequence segment |
| 36G1 | 483362 | 484059 | NT_026443 | 0 | 1 | chromosome 15 working draft sequence segment |
| 466B5 | 19929 | 20420 | NT_026455 | 1.00E−123 | 1 | chromosome 16 working draft sequence segment |
| 105A8 | 3431 | 3518 | U12202 | 6.00E−34 | 1 | ribosomal protein S24 (rps24) gene, complete cds Length |
| 175D10 | 18139 | 18285 | U18671 | 8.00E−45 | 2 | Stat2 gene, complete cds Length = 18648 |
| 116F9 | 68889 | 69093 | U85199 | 6.00E−69 | 1 | BAC956, complete sequence Length = 105232 |
| 598F3 | 22246 | 22656 | U91318 | 0 | 1 | chromosome 16 BAC clone CIT987SK-A-962B4, complete sequ |
| 471G1 | 1 | 109 | Z56926 | 9.00E−54 | 1 | CpG island DNA genomic Mse1 fragment, clone 153c6, forw |
| 516D5 | 1 | 143 | Z62429 | 4.00E−53 | 1 | CpG island DNA genomic Mse1 fragment, clone 69a1, forwa |
| 107D11 | 81 | 292 | Z63603 | 1.00E−104 | 1 | CpG island DNA genomic Mse1 fragment, clone 87h3, forwa |
| 481D4 | 12379 | 12686 | Z69304 | 1.00E−101 | 1 | DNA sequence from cosmid V311G7, between markers DXS366 |
| 461G6 | 23967 | 24497 | Z69715 | 1.00E−173 | 2 | DNA sequence from clone LL22NC03-74G7 on chromosome 22 |
| 465F5 | 15468 | 15659 | Z77852 | 3.00E−70 | 1 | DNA sequence from cosmid LUCA2 on chromosome 3p21.3 con |
| 459B2 | 26193 | 26772 | Z82248 | 0 | 2 | DNA sequence from clone LL22NC03-44A4 |

TABLE 3B-continued

Identified Genomic Regions that code for novel human mRNA's

| Example Clone | Genome Start | End | Accession | Probability | Number Clones | Genbank Description |
|---|---|---|---|---|---|---|
| | | | | | | on chromosome 22 |
| 478E5 | 49480 | 49615 | Z83847 | 6.00E−50 | 1 | DNA sequence from clone RP3-496C20 on chromosome 22 Con |
| 469E6 | 4705 | 5229 | Z83851 | 0 | 1 | DNA sequence from clone 989H11 on chromosome 22q13.1–13 |
| 517H5 | 128852 | 129155 | Z85986 | 1.00E−156 | 1 | DNA sequence from clone 108K11 on chromosome 6p21 Conta |
| 114C1 | 15995 | 16486 | Z93016 | 1.00E−121 | 3 | DNA sequence from clone RP1-211D12 on chromosome 20q12- |
| | 77940 | 78185 | Z93016 | | | |
| 118A8 | 117801 | 118272 | Z97989 | 0 | 2 | DNA sequence from PAC 66H14 on chromosome 6q21–22. Cont |
| | 132708 | 132773 | Z97989 | | | |

TABLE 3C

Table of novel human nucleotide sequences compared to assembled human sequences, depicting putative exon-intron structure

| Clone | Accession | Exon Clone Start | Stop | Genome Start | Stop | Exon Clone Start | Stop | Genome Start | Stop |
|---|---|---|---|---|---|---|---|---|---|
| 47D11 | NT_008060 | 90 | 407 | 480193 | 479876 | 406 | 586 | 478843 | 478662 |
| 53G7 | NT_008060 | 4 | 204 | 478642 | 478842 | 204 | 459 | 479917 | 480171 |
| 62C9 | NT_015169 | 29 | 224 | 220269 | 220464 | 321 | 384 | 220540 | 220603 |
| 62G9 | NT_006328 | 1 | 145 | 566357 | 566213 | 144 | 219 | 565724 | 565649 |
| 65B1 | NT_006098 | 243 | 454 | 2418134 | 2418345 | 303 | 462 | 2421648 | 2421807 |
| 65D10 | NT_025892 | 218 | 401 | 369301 | 369483 | 404 | 541 | 370290 | 370427 |
| 65D11 | NT_025892 | 98 | 241 | 367311 | 367453 | 240 | 425 | 369301 | 369486 |
| 65D12 | NT_025892 | 98 | 219 | 367333 | 367453 | 218 | 399 | 369301 | 369483 |
| 72D4 | NT_008060 | 1 | 198 | 478646 | 478843 | 197 | 489 | 479876 | 480168 |
| 73A7 | NT_008060 | 1 | 197 | 478646 | 478842 | 197 | 538 | 479917 | 480259 |
| 75B12 | NT_010265 | 1 | 171 | 309301 | 309471 | 169 | 267 | 315278 | 315376 |
| | NT_010265 | 587 | 658 | 319041 | 319112 | | | | |
| 100B5 | NT_006098 | 16 | 142 | 556012 | 556138 | 143 | 336 | 560579 | 560772 |
| 105B11 | NT_022315 | 2 | 226 | 66662 | 66886 | 429 | 491 | 89124 | 89186 |
| 170F9 | NT_010194 | 4 | 324 | 6405068 | 6405386 | 323 | 465 | 6407864 | 6408006 |
| 144F5 | NT_011595 | 1 | 280 | 125097 | 124818 | 345 | 491 | 120524 | 120378 |
| 166H7 | NT_009729 | 59 | 130 | 537939 | 537668 | 127 | 281 | 537177 | 537023 |
| | NT_009729 | 579 | 672 | 491513 | 491419 | | | | |
| 171A10 | NT_009151 | 2 | 244 | 6556227 | 6556469 | 245 | 396 | 6556693 | 6558846 |
| 98E1 | NT_006098 | 12 | 138 | 556012 | 556138 | 139 | 328 | 560579 | 560768 |
| 134B4 | NT_011512 | 3 | 251 | 12517461 | 12517709 | 252 | 338 | 12519881 | 12519967 |
| 172E5 | NT_009935 | 5 | 449 | 1427508 | 1427952 | 448 | 551 | 1434457 | 1434560 |
| 176F12 | NT_011520 | 48 | 309 | 6163505 | 6163766 | 308 | 409 | 6163866 | 6163967 |
| 51B9 | NT_021980 | 75 | 578 | 120596 | 121099 | 3 | 79 | 120203 | 120279 |
| 51B12 | NT_007140 | 1 | 85 | 309298 | 309214 | 79 | 609 | 300215 | 299684 |
| 191F6 | NT_010194 | 7 | 330 | 6405063 | 6405386 | 329 | 473 | 6407864 | 6408008 |
| 459F10 | NT_008982 | 1 | 121 | 92783 | 92903 | 116 | 314 | 93005 | 93202 |
| 461H12 | NT_023539 | 19 | 94 | 332693 | 332768 | 92 | 166 | 334220 | 334294 |
| 463C3 | NT_010478 | 1 | 186 | 1307774 | 1307960 | 183 | 314 | 1308993 | 1309124 |
| 465B3 | NT_010222 | 41 | 227 | 700806 | 700992 | 227 | 414 | 701556 | 701743 |
| 513G4 | NT_005130 | 1 | 134 | 384702 | 384569 | 133 | 204 | 383722 | 383651 |
| 515E10 | NT_023563 | 1 | 169 | 9743 | 9575 | 169 | 309 | 8111 | 7971 |
| 466B10 | NT_006292 | 1 | 331 | 936306 | 935977 | 244 | 745 | 935875 | 935374 |
| 466F9 | NT_024872 | 17 | 186 | 64694 | 64525 | 184 | 295 | 61751 | 61640 |
| 121B6 | NT_023169 | 2 | 98 | 183171 | 183075 | 258 | 455 | 164976 | 164779 |
| 462D1 | NT_023923 | 139 | 298 | 191231 | 191072 | 297 | 528 | 190168 | 189937 |
| 64G9 | NT_025892 | 68 | 210 | 367311 | 367453 | 209 | 394 | 369301 | 369486 |
| 467C6 | NT_010101 | 1 | 73 | 1265999 | 1266071 | 218 | 330 | 1295695 | 1295807 |
| | NT_010101 | 546 | 687 | 1334907 | 1335047 | | | | |
| 467G9 | NT_011157 | 69 | 142 | 917117 | 917044 | 142 | 253 | 916090 | 915979 |
| 476G4 | NT_007592 | 58 | 121 | 2382380 | 2382443 | 120 | 362 | 2382598 | 2382840 |
| 477E1 | NT_008680 | 1 | 116 | 1185208 | 1185323 | 116 | 472 | 1186107 | 1186462 |
| 477A11 | NT_006292 | 1 | 325 | 936300 | 935977 | 238 | 851 | 935875 | 935262 |
| 480A3 | NT_010478 | 1 | 99 | 2220394 | 2220492 | 181 | 525 | 2221546 | 2221890 |
| 518H1 | NT_005337 | 1 | 73 | 2383056 | 2383128 | 125 | 229 | 2386650 | 2386754 |
| 519A9 | NT_016632 | 64 | 193 | 172305 | 172434 | 191 | 279 | 176990 | 177078 |
| 521F2 | NT_023563 | 3 | 107 | 7651 | 7756 | 110 | 254 | 7968 | 8111 |
| 597A4 | NT_023563 | 1 | 109 | 7647 | 7755 | 109 | 256 | 7964 | 8111 |
| 491G11 | NT_010265 | 1 | 127 | 284740 | 284866 | 123 | 242 | 288529 | 288648 |

TABLE 3C-continued

Table of novel human nucleotide sequences compared to assembled human sequences, depicting putative exon-intron structure

| Clone | Accession | Exon Clone Start | Stop | Genome Start | Stop | Exon Clone Start | Stop | Genome Start | Stop |
|---|---|---|---|---|---|---|---|---|---|
| 494B11 | NT_007343 | 25 | 246 | 3168142 | 3167921 | 244 | 334 | 3162477 | 3162387 |
| 479A1 | NT_015169 | 1 | 109 | 293941 | 293833 | 112 | 217 | 289082 | 288977 |
| 47D11 | NT_008060 | | | | | | | | |
| 53G7 | NT_008060 | | | | | | | | |
| 62C9 | NT_015169 | 449 | 518 | 220668 | 220737 | 517 | 774 | 220958 | 221215 |
| 62G9 | NT_006328 | 217 | 315 | 563987 | 563889 | 315 | 418 | 563775 | 563672 |
| 65B1 | NT_006098 | | | | | | | | |
| 65D10 | NT_025892 | | | | | | | | |
| 65D11 | NT_025892 | 423 | 562 | 370288 | 370427 | 561 | 690 | 376519 | 376648 |
| 65D12 | NT_025892 | 402 | 541 | 370290 | 370427 | | | | |
| 72D4 | NT_008060 | 491 | 585 | 489271 | 489365 | | | | |
| 73A7 | NT_008060 | | | | | | | | |
| 75B12 | NT_010265 | 264 | 441 | 316976 | 317153 | 440 | 588 | 317239 | 317387 |
| | NT_010265 | | | | | | | | |
| 100B5 | NT_006098 | 331 | 416 | 561268 | 561353 | | | | |
| 105B11 | NT_022315 | | | | | | | | |
| 170F9 | NT_010194 | | | | | | | | |
| 144F5 | NT_011595 | 279 | 347 | 123833 | 123765 | 490 | 559 | 118816 | 118747 |
| 166H7 | NT_009729 | 282 | 362 | 529971 | 529891 | 363 | 581 | 495632 | 495414 |
| | NT_009729 | | | | | | | | |
| 171A10 | NT_009151 | | | | | | | | |
| 98E1 | NT_006098 | 330 | 506 | 561271 | 561447 | | | | |
| 134B4 | NT_011512 | 336 | 448 | 12523936 | 12524048 | | | | |
| 172E5 | NT_009935 | | | | | | | | |
| 176F12 | NT_011520 | | | | | | | | |
| 51B9 | NT_021980 | | | | | | | | |
| 51B12 | NT_007140 | | | | | | | | |
| 191F6 | NT_010194 | | | | | | | | |
| 459F10 | NT_008982 | | | | | | | | |
| 461H12 | NT_023539 | 164 | 298 | 334438 | 334572 | 300 | 470 | 335340 | 335510 |
| 463C3 | NT_010478 | 315 | 429 | 1309210 | 1309324 | 427 | 559 | 1309492 | 1309625 |
| 465B3 | NT_010222 | | | | | | | | |
| 513G4 | NT_005130 | 202 | 281 | 378695 | 378616 | 287 | 346 | 299615 | 299556 |
| 515E10 | NT_023563 | | | | | | | | |
| 466B10 | NT_006292 | | | | | | | | |
| 466F9 | NT_024872 | 294 | 626 | 59515 | 59185 | | | | |
| 121B6 | NT_023169 | 460 | 576 | 163071 | 162955 | | | | |
| 462D1 | NT_023923 | | | | | | | | |
| 64G9 | NT_025892 | 392 | 531 | 370288 | 370427 | | | | |
| 467C6 | NT_010101 | 330 | 468 | 1315073 | 1315211 | 467 | 547 | 1315798 | 1315878 |
| | NT_010101 | | | | | | | | |
| 467G9 | NT_011157 | | | | | | | | |
| 476G4 | NT_007592 | | | | | | | | |
| 477E1 | NT_008680 | | | | | | | | |
| 477A11 | NT_006292 | | | | | | | | |
| 480A3 | NT_010478 | | | | | | | | |
| 518H1 | NT_005337 | 227 | 366 | 2393104 | 2393243 | | | | |
| 519A9 | NT_016632 | | | | | | | | |
| 521F2 | NT_023563 | | | | | | | | |
| 597A4 | NT_023563 | 258 | 452 | 9575 | 9771 | | | | |
| 491G11 | NT_010265 | | | | | | | | |
| 494B11 | NT_007343 | | | | | | | | |
| 479A1 | NT_015169 | 218 | 338 | 285931 | 285811 | | | | |

TABLE 4

The Library Browser at the NCBI UniGene web site was used to identify genes that are specifically expressed in leukocyte cell populations.

| Library | Library Name | Category | Sequences before reduction | Sequences on array* |
|---|---|---|---|---|
| Lib. 2228 | Human_leukocyte_MATCHMAKER_cDNA_Library | other/unclassified | 4 | 3 |
| Lib. 238 | RA-MO-III (activated monocytes from RA patient) | Blood | 2 | 1 |
| Lib. 242 | Human_peripheral_blood_(Whole)_(Steve_Elledge) | Blood | 4 | 2 |
| Lib. 2439 | Subtracted_cDNA_libraries_from_human_Jurkat_cells | other/unclassified | 4 | 1 |
| Lib. 323 | Activated_T-cells_I | other/unclassified | 19 | 3 |
| Lib. 327 | Monocytes,_stimulated_II | Blood | 92 | 35 |

TABLE 4-continued

The Library Browser at the NCBI UniGene web site was used to identify genes that are specifically expressed in leukocyte cell populations.

| Library | Library Name | Category | Sequences before reduction | Sequences on array* |
|---|---|---|---|---|
| Lib. 387 | Macrophage_I | other/unclassified | 84 | 24 |
| Lib. 409 | Activated_T-cells_IV | other/unclassified | 37 | 10 |
| Lib. 410 | Activated_T-cells_VIII | other/unclassified | 27 | 10 |
| Lib. 411 | Activated_T-cells_V | other/unclassified | 41 | 9 |
| Lib. 412 | Activated_T-cells_XII | other/unclassified | 29 | 12 |
| Lib. 413 | Activated_T-cells_XI | other/unclassified | 13 | 6 |
| Lib. 414 | Activated_T-cells_II | other/unclassified | 69 | 30 |
| Lib. 429 | Macrophage_II | other/unclassified | 56 | 24 |
| Lib. 4480 | Homo_sapiens_rheumatoid_arthritis_fibroblast-like_synovial | other/unclassified | 7 | 6 |
| Lib. 476 | Macrophage,_subtracted_(total_cDNA) | other/unclassified | 11 | 1 |
| Lib. 490 | Activated_T-cells_III | other/unclassified | 9 | 5 |
| Lib. 491 | Activated_T-cells_VII | other/unclassified | 27 | 8 |
| Lib. 492 | Activated_T-cells_IX | other/unclassified | 16 | 5 |
| Lib. 493 | Activated_T-cells_VI | other/unclassified | 31 | 15 |
| Lib. 494 | Activated_T-cells_X | other/unclassified | 18 | 5 |
| Lib. 498 | RA-MO-I (activated peripheral blood monocytes from RA patient) | Blood | 2 | 1 |
| Lib. 5009 | Homo_Sapiens_cDNA_Library_from_Peripheral_White_Blood_Cell | other/unclassified | 3 | 3 |
| Lib. 6338 | human_activated_B_lymphocyte | Tonsils | 9 | 8 |
| Lib. 6342 | Human_lymphocytes | other/unclassified | 2 | 2 |
| Lib. 646 | Human_leukocyte_(M. L. Markelov) | other/unclassified | 1 | 1 |
| Lib. 689 | Subtracted_cDNA_library_of_activated_B_lymphocyte | Tonsil | 1 | 1 |
| Lib. 773 | PMA-induced_HL60_cell_subtraction_library (leukemia) | other/unclassified | 6 | 3 |
| Lib. 1367 | cDNA_Library_from_rIL-2_activated_lymphocytes | other/unclassified | 3 | 2 |
| Lib. 5018 | Homo_sapiens_CD4+_T-cell_clone_HA1.7 | other/unclassified | 6 | 3 |
| Lib. 376 | Activated_T-cells_XX | other/unclassified | 999 | 119 |
| Lib. 669 | NCI_CGAP_CLL1 (Lymphocyte) | Blood | 353 | 81† |
| Lib. 1395 | NCI_CGAP_Sub6 (germinal center b-cells) | B cells germinal | 389 | 100† |
| Lib. 2217 | NCI_CGAP_Sub7 (germinal center b-cells) | B cells germinal | 605 | 200† |
| Lib. 289 | NCI_CGAP_GCB1 (germinal center b-cells) | Tonsil | 935 | 200† |
| | Total | | 3914 | 939 |

*Redundancy of UniGene numbers between the libraries was eliminated.
†A subset of genes flagged as "Found only in this library" were taken.

TABLE 5

Nucleotide sequence databases used for analysis

| Database | Version | Description | Location of file | Threshold of Significance Used |
|---|---|---|---|---|
| nr | Release 123.0 | GenBank + EMBL + DDBJ + PDB sequences (but no EST, STS, GSS, or HTGS sequences). No longer "non-redundant". | ftp:/ncbi.nlm.nih.gov/blast/nt.Z | Expect value $(e) < 10^{-25}$ |
| dbEST | Apr. 10, 2001 | Non-redundant Database of GenBank + EMBL + DDBJ EST Division | ftp:/ncbi.nlm.nih.gov/blast/est_human.Z | Expect value $(e) < 10^{-25}$ |
| UniGene_unique | Build 132 | One sequence selected from each UniGene cluster (the one with the longest region of high-quality sequence data). | ftp:/ncbi.nlm.nih.gov/pub/shuler/unigene/Hs.seq.uniq.Z | Expect value $(e) < 10^{-25}$ |
| Human Genome | Build 22 | Sequence data of all contigs used to assemble the human genome | ftp:/ncbi.nlm.nih.gov/genomes/H_sapiens/CHR_#/hs_chr#.fa.gz | Expect value $(e) < 10^{-25}$ |

TABLE 6

Algorithms used for exon and polypeptide prediction

| Algorithm | Description | Web address |
|---|---|---|
| Genscan | Predicts the locations and exon-intron structures of genes in genomic | genes.mit.edu/GENSCAN.html |

TABLE 6-continued

Algorithms used for exon and polypeptide prediction

| Algorithm | Description | Web address |
|---|---|---|
| Genomescan | sequences. Incorporates protein homology information when predicting genes. | genes.mit.edu/genomescan.html |
| GrailEXP | Predicts exons, genes, promoters, polyAs, CpG islands, EST similarities, and repetitive elements within a DNA sequence. | Grail.lsd.ornl.gov/grailexp/ |
| G-Known | Predicts genes and features of a DNA sequence at user-specified levels of complexity. Can incorporate extra information supplied by user including gene predictions from other gene finding programs, EST hits, similarities to known proteins, synteny between corresponding genomic regions in related organisms, methylation of the bases, regulatory binding sites, and topology information. | cse.ucsc.edu/research/compbio/pgf/ |
| FGENES | Uses linear and hidden Markov models for exon prediction | genomic.sanger.ac.uk/gf/gf.shtml |

TABLE 7

Databases and algorithms used for Protein Analysis

| Algorithm | Description | Web address |
|---|---|---|
| BLASTP, version 2.0 | Identification of unknown protein or subunit based on similarity to known proteins or subunits. | .ncbi.nlm.nih.gov/BLAST/ |
| BLASTX | Algorithm for translating a nucleotide query sequence and aligning the translation to sequences in protein databases | .ncbi.nlm.nih.gov/BLAST/ |
| TBLASTN | Algorithm for aligning an unidentified peptide sequence to predicted translations of nucleotide sequences | ncbi.nlm.nih.gov/BLAST/ |
| SWISS-PROT, release 39.0 | Protein sequence database | expasy.ch/cgi-bin/sprot-search-de |
| Protein International Resource (PIR) | Protein sequence database | nbrf.georgetown.edu/pirwww/ |
| GenPept | Amino acid translations from GenBank/EMBL/DDBJ records that are annotated with one or more CDS features | ncbi.nlm.nih.gov/genbank/genpept.fsa.gz |
| TrEMBL | Contains the translations of all coding sequences present in the EMBL Nucleotide Sequence Database, which are not yet integrated into SWISS-PROT | ebi.ac.uk/swissprot/ |
| Prosite, release 16.39 | Database of protein families and domains. Consists of biologically significant sites, patterns and profiles. | expasy.ch/prosite/ |
| Pfam, version 6.2 | Collection of multiple sequence alignments and hidden Markov models covering many common protein domains | .sanger.ac.uk/Software/Pfam/ |
| ProDom, version 2001.1 | Domain arrangements of proteins and protein families | protein.toulouse.inra.fr/prodom.html |
| TMpred | Prediction of transmembrane regions to aid in subcellular localization and function predictions | ch.embnet.org/software/TMPRED_form.html |

TABLE 8

| SEQ ID | Origin | Unigene | Locus | GI | Nominal Description | Strand | Probe Sequence |
|---|---|---|---|---|---|---|---|
| 1 | cDNA T-cells | Hs.100001 | NM_005074 | 4827009 | solute carrier family 17 (sodium phosphate), member 1 (SLC17A1). | 1 | AGAGCACTTGCAGAGCCTGGGACAA CCTCCTTATTGAAGGGAAGAGGGAC |
| 2 | cDNA T-cells | Hs.104157 | AW968823 | 8158664 | EST380899 cDNA/gb = AW968823 direction unknown | 1 | TGGTCTCAAAGATTTACATGGCAACA TTCGAAAGTCCCCAGAGAAGTCCT |
| 3 | cDNA | Hs.104157 | AW968823 | 8158664 | Complement of EST380899 cDNA | −1 | AGGACTTCTCTGGGGACTTTCGAATG |

TABLE 8-continued

| SEQ ID | Origin | Unigene | Locus | GI | Nominal Description | Strand | Probe Sequence |
|---|---|---|---|---|---|---|---|
| | T-cells | | | | /gb = AW968823 direction unknown | | TTGCCATGTAAATCTTTGAGACCA |
| 4 | literature | Hs.1051 | NM_004131 | 7262379 | granzyme B (granzyme 2, cytotoxic T-lymphocyte-associated serine esterase 1) (GZMB). | 1 | AGGTGCCAGCAACTGAATAAATACCT CTCCCAGTGTAAATCTGGAGCCAA |
| 5 | cDNA T-cells | Hs.105230 | AA489227 | 2218829 | aa57f07.s1 cDNA, 3' end /clone = IMAGE:825061 strand unknown | 1 | GGGTGTCTTTAAATAGCACTAGCCAA ATCACATATCTCCAACACTCCTTA |
| 6 | cDNA T-cells | Hs.105230 | AA489227 | 2218829 | Complement, aa57f07.s1 cDNA, 3' end/clone = IMAGE:825061 strand unknown | −1 | TAAGGAGTGTTGGAGATATGTGATTT GGCTAGTGCTATTTAAAGACACCC |
| 7 | cDNA T-cells | Hs.107979 | NM_014313 | 7657594 | small membrane protein 1 (SMP1), mRNA/cds = (99, | 1 | CCCACAGTGCAATTCAGAATATGCTC AGGGAATGCCAGCCACCTTGTAAA |
| 8 | cDNA T-cells | Hs.10888 | AK025212 | 10437679 | cDNA: FLJ21559 fis, clone COL05406/cds = UNKNOW | 1 | GCCAAGACAATAAGCTAGGCTACTGG GTCCAGCTACTACTTTGGTGGGAT |
| 9 | cDNA T-cells | Hs.10888 | AK025212 | 10437679 | complement cDNA: FLJ21559 fis, clone COL06406/cds = UNKNOW | −1 | ATCCCACCAAAGTAGTAGCTGGACCC AGTAGCCTAGCTTATTGTCTTGGC |
| 10 | cDNA T-cells | Hs.1100 | M55654 | 339491 | TATA-binding protein mRNA, complete cds/cds = (241, 12 | 1 | AATTTATAACTCCTAGGGGTTATTTCT GTGCCAGACACATTCCACCTCTC |
| 11 | cDNA T-cells | Hs.11000 | NM_015344 | 7662509 | MY47_BRAIN MY047 PROTEIN | 1 | ACTAATTGCATTGGCAGCATTGTGTC TTTGACCTTGTATACTAGCTTGAC |
| 12 | cDNA T-cells | Hs.1101 | NM_002698 | 4505958 | POU domain, class 2, transcription factor 2 (P | 1 | AAACCAAAAATAATCACAACAGAAAC CAGCTGCCCCAAAGGAACCAGAGG |
| 13 | cDNA T-cells | Hs.11238 | AB014522 | 3327057 | KIAA0622 protein; *Drosophila* "multiple asters" (Mast)-like homolog 1 | 1 | TCCCACCAGGACTTTGCTAACAATAA TGTTTGGAAATAAAGAAGTGCTCT |
| 14 | cDNA T-cells | Hs.116481 | NM_001782 | 4502682 | CD72, B cell differentiation antigen | 1 | TGACACTCATGCCAACAAGAACCTGT GCCCCTCCTTCCTAACCTGAGGCC |
| 15 | cDNA T-cells | Hs.295726 | M14648 | 340306 | cell adhesion protein (vitronectin) receptor alpha s Platelets, megakaryocytes | 1 | ACAAATTTTACCCTAACAGTTTTACCA CCTAGCAACAGTCATTTCTGAAA |
| 16 | cDNA T-cells | Hs.119155 | AL109786 | 5725475 | mRNA full length insert cDNA clone EUROIMAGE 81 | 1 | TTTATTGGTACTTCCTAAAGATAGAGA CTAAAGTCATGGTAGTATTGGCC |
| 17 | cDNA T-cells | Hs.119155 | AL109786 | 5725475 | Complement of mRNA full length insert cDNA clone EUROIMAGE 82 | −1 | GGCCAATACTACCATGACTTTAGTCT CTATCTTTAGGAAGTACCAATAAA |
| 18 | cDNA T-cells | Hs.119537 | NM_006559 | 5730026 | GAP-associated tyrosine phosphoprotein p62 (Sam88) | 1 | CCTCCCATTTTGTTCTCGGAAGATTA AATGCTACATGTAAGTCTGCCT |
| 19 | cDNA T-cells | Hs.121025 | NM_014205 | 7656935 | chromosome 11 open reading frame 5 (C11ORF5), m | 1 | CCGTGCCCGGAAACAGGCCGTGGCT AGAGAAGAGCGAGATCATCTTTACC |
| 20 | literature | Hs.126256 | NM_000576 | 10835144 | interleukin 1-beta (IL1B) mRNA, monocytes, macrophages | 1 | GGTCTAATTTATTCAAAGGGGGCAAG AAGTAGCGTGTCTGTAAAAGAGC |
| 21 | cDNA T-cells | Hs.126925 | AK023275 | 10435137 | FLJ13213 fis, clone NT2RP4001126, weakly | 1 | AGATGGGTGAATCAGTTGGGTTTTGT AAATACTTGTATGTGGGGAAGACA |
| 22 | cDNA T-cells | Hs.1279 | AK024951 | 10437374 | FLJ21298 fis, clone COL02040, highly sim | 1 | TCTCTAGTTGTCACTTTCCTCTTCCAC TTTGATACCATTGGGTCATTGAA |
| 23 | cDNA T-cells | Hs.129780 | NM_003327 | 4507578 | OX40 homolog, ACT35 Antigen, TNF receptor superfamily, member 4 | 1 | TCAAAAGAAAGCCTTCTGGATGCTGT TAAGATGTACCCTTCAGGTGAACC |
| 24 | cDNA T-cells | Hs.1309 | M28825 | 180035 | thymocyte antigen CD1a mRNA | 1 | CCCCCTTTCCTTCTAATTTTTCAGCTC CTTCAATGCAAAGTACATGTATT |
| 25 | cDNA T-cells | Hs.1349 | NM_000758 | 4503076 | colony stimulating factor 2 (granulocyte-macrophage) (CSF2). | 1 | CCTCCAACCCCGGAAACTTCCTGTGC AACCCAGACTATCACCTTTGAAAG |
| 26 | cDNA T-cells | Hs.136375 | BF513274 | 11598453 | ESTs, Weakly similar to S65824 reverse transcriptase homolog (3' EST read) | 1 | GGAAGGTAGTCTTCATTTGCAATCAG GAAAACGAACGTAAAGGCACAGGT |
| 27 | cDNA T-cells | Hs.138375 | BF513274 | 11598453 | Complement of ESTs, Weakly similar to S65824 reverse transcriptase homolog (3' EST read) | −1 | ACCTGTGCCTTTACGTTCGTTTTCCT GATTGCAAATGAAGACTACCTTCC |
| 28 | cDNA T-cells | Hs.137548 | NM_003874 | 4502686 | CD84 antigen (leukocyte antigen) (CD84) | 1 | TGTTTTCCTCACTACATTGTACATGTG GGAATTACAGATAAACGGAAGCC |
| 29 | cDNA T-cells | Hs.1418 | M15059 | 182447 | Fc-epsilon receptor (IgE receptor) mRNA, complete cd | 1 | CAGAGCAAGACCCTGAAGACCCCCA ACCACGGCCTAAAAGCCTCTTTGTG |
| 30 | cDNA T-cells | Hs.142023 | NM_005816 | 5032140 | TACT_T-CELL SURFACE PROTEIN | 1 | GCTTCATATGTATGGCTGTTGCTTTG CTTCATGTGTATGGCTATTTGTAT |
| 31 | cDNA T-cells | Hs.1481 | NM_002112 | 4504364 | histidine decarboxylase (EC 4.1.1.22) (HDC). | 1 | CAGATGGGTTCAGCAGTCTGGTCAGT GAGAAAGGGCCGAGGGTAGACAGG |
| 32 | cDNA T-cells | Hs.150403 | NM_000790 | 4503260 | dopa decarboxylase (aromatic L-amino acid decarboxylase) | 1 | TCCAGGGCAATCAATGTTCACGCAAC TTGAAATTATATCTGTGGTCTTCA |
| 33 | cDNA T-cells | Hs.1513 | NM_000629 | 10835182 | interferon (alpha, beta and omega) receptor 1 (IFNAR1). | 1 | TCATCCGAGAACATTGGCTTCCACA TCACAGTATCTACCCTTACATGGT |
| 34 | literature | Hs.153053 | NM_001774 | 4502662 | leukocyte antigen CD37 | 1 | CGCTCTCGATATTCCTGTGCAGAAAC CTGGACCACGTCTACAACCGGCTC |
| 35 | cDNA T-cells | Hs.153952 | X55740 | 23896 | placental cDNA coding for 5'nucleotidase (EC 3.1.3.5) | 1 | CCTGCTCAGCTCTGCATAAGTAATTC AAGAAATGGGAGGCTTCACCTTAA |

TABLE 8-continued

| SEQ ID | Origin | Unigene | Locus | GI | Nominal Description | Strand | Probe Sequence |
|---|---|---|---|---|---|---|---|
| 36 | cDNA T-cells | Hs.155595 | NM_004404 | 4758157 | Neural precursor cell expressed, developmentally down-regulated 5 | 1 | GGAGGACCCACACTGCTACACTTCTG ATCCCCTTTGGTTTTACTACCCAA |
| 37 | cDNA T-cells | Hs.1570 | Z34897 | 510295 | H1 histamine receptor | 1 | GAAGAACAGCAGATGGCGGTGATCA GCAGAGAGATTGAACTTTGAGGAGG |
| 38 | cDNA T-cells | Hs.159557 | AK024833 | 10437239 | FLJ21180 fis, clone CAS11176, highly sim | 1 | GGAATTTCCTATCTTGCAGCATCCTG TAAATAAACATTCAAGTCCACCCT |
| 39 | cDNA T-cells | Hs.160417 | NM_013390 | 7019554 | transmembrane protein 2 (TMEM2), mRNA/cds = (14 | 1 | CCTCAAAGTGCTACCGATAAACCTTT CTAATTGTAAGTGCCCTTACTAAG |
| 40 | cDNA T-cells | Hs.16488 | BC007911 | 14043948 | calreticulin | 1 | AGTGGGTCCCAGATTGGCTCACACT GAGAATGTAAGAACTACAAACAAAA |
| 41 | cDNA T-cells | Hs.166120 | NM_004031 | 4809287 | interferon regulatory factor 7 (IRF7), transc | 1 | CTGTCCAGCGCCAACAGCCTCTATGA CGACATCGAGTGCTTCCTTATGGA |
| 42 | cDNA T-cells | Hs.166975 | NM_006925 | 5902077 | splicing factor, arginine/serine-rich 5 (SFR | 1 | AAATTCTGGTAAGTATGTGCTTTTCTG TGGGGGTGGGATTTGGAAGGGGG |
| 43 | literature | Hs.167988 | S71824 | 632775 | N-CAM = 145 kda neural cell adhesion molecule | 1 | ATGGGTGAAGAGAACCGAGCAAAGA TCAAAATAAAAAGTGACACAGCAGC |
| 44 | cDNA T-cells | Hs.168103 | AF026402 | 2655201 | U5 snRNP 100 kD protein mRNA, cds/cds = (39, 2501 | 1 | GCTGTGTCCATCTTTGTCACTGAGTG AAATCTCTGTTTTCTATTCTCTGA |
| 45 | cDNA T-cells | Hs.168132 | U14407 | 540098 | interleukin 15 (IL15) mRNA | 1 | ATGTGCTGTCAAAACAAGTTTTTCTGT CAAGAAGATGATCAGACCTTGGA |
| 46 | literature | Hs.168383 | NM_000201 | 4557877 | intercellular adhesion molecule 1 (CD54), rhinovirus receptor (ICAM1). | 1 | CAGTGATCAGGGTCCTGCAAGCAGT GGGGAAGGGGGCCAAGGTATTGGAG |
| 47 | cDNA T-cells | Hs.169191 | U58913 | 4204907 | chemokine (hmrp-2a) mRNA, complete cds/cds = (71, 484) | 1 | TGGACACACGGATCAAGACCAGGAA GAATTGAACTTGTCAAGGTGAAGGG |
| 48 | literature | Hs.169610 | AJ251595 | 6491738 | transmembrane glycoprotein (CD44 gene). | 1 | AACAGACCCCCTCTAGAAATTTTCA GATGCTTCTGGGAGACACCAAAGG |
| 49 | cDNA T-cells | Hs.170311 | D89678 | 3218539 | 50 for A + U-rich element RNA binding factor. | 1 | GTCAGTAGGTGCGGTGTCTAGGGTA GTGAATCCTGTAAGTTCAAATTTAT |
| 50 | cDNA T-cells | Hs.170311 | D89678 | 3218539 | 60 for A + U-rich element RNA binding factor. | 1 | AGTTGTGTGGTCAGTAGGTGCGGTG TCTAGGGTAGTGAATCCTGTAAGTTC AAATTTATG |
| 51 | cDNA T-cells | Hs.170311 | D89678 | 3218539 | 70 for A + U-rich element RNA binding factor. | 1 | TTTAAGTTGTGTGGTCAGTAGGTGCG GTGTCTAGGGTAGTGAATCCTGTAAG TTCAAATTTATGATTAGG |
| 52 | cDNA T-cells | Hs.171763 | X59350 | 36090 | mRNA for B cell membrane protein CD22 | 1 | GTTTGAGATGGACACACTGGTGTGGA TTAACCTGCCAGGGAGACAGAGCT |
| 53 | cDNA T-cells | Hs.171917 | AB037855 | 7243265 | mRNA for KIAA1434 protein, partial cds | 1 | TTGTGACTCTGAATCCCATGTTCTCA AACTACGCTGCCTTCCGAAGTCTG |
| 54 | cDNA T-cells | Hs.172089 | AL110202 | 5817121 | cDNA DKFZp586I2022 (from clone DKFZp586I | 1 | TTTAAGTACTAAGTCATCATTTGCCTT GAAAGTTTCCTCTGCATTGGGTT |
| 55 | cDNA T-cells | Hs.172089 | AL110202 | 5817121 | Complement of cDNA DKFZp586I2022 (from clone DKFZp586I | -1 | AACCCAATGCAGAGGAAACTTTCAAG GCAAATGATGACTTAGTACTTAAA |
| 56 | literature | Hs.1722 | M28983 | 186279 | 50 interleukin 1 alpha (IL 1) mRNA, macrophages | 1 | TACCTGGGCATTCTTGTTTCATTCAAT TCCACCTGCAATCAAGTCCTACA |
| 57 | literature | Hs.1722 | M28983 | 186279 | 60 interleukin 1 alpha (IL 1) mRNA, macrophages | 1 | CCATTAAACTTACCTGGGCATTCTTG TTTCATTCAATTCCACCTGCAATCAAG TCCTACA |
| 58 | literature | Hs.1722 | M28983 | 186279 | 70 interleukin 1 alpha (IL 1) mRNA, macrophages | 1 | CACCTGCAATCAAGTCCTACAAGCTA AAATTAGATGAACTCAACTTTGACAA CCATGAGACCACTGTTAT |
| 59 | literature | Hs.1724 | X01057 | 33812 | 50 mRNA for interleukin-2 receptor | 1 | AATGCGTACGTTTCCTGAGAAGTGTC TAAAAACACCAAAAAGGGATCCGT |
| 60 | literature | Hs.1724 | X01057 | 33812 | 60 mRNA for interleukin-2 receptor | 1 | ACGTTTCCTGAGAAGTGTCTAAAAAC ACCAAAAAGGGATCCGTACATTCAAT GTTTATGC |
| 61 | literature | Hs.1724 | X01057 | 33812 | 70 mRNA for interleukin-2 receptor | 1 | CAAATCAATGCGTACGTTTCCTGAGA AGTGTCTAAAAACACCAAAAAGGGAT CCGTACATTCAATGTTTA |
| 62 | cDNA T-cells | Hs.172631 | J04145 | 189068 | neutrophil adherence receptor alpha-M subunit mRNA | 1 | CTCCGGGAGAGGGGACGGTCAATCC TGTGGGTGAAGACAGAGGGAAACAC |
| 63 | cDNA T-cells | Hs.305870 | NM_003781 | 14043025 | vesicle-associated membrane protein 8 (endob | 1 | GGCTGGGAAACTGTTGGTGGCCAGT GGGTAATAAAGACCTTTCAGTATCC |
| 64 | cDNA T-cells | Hs.172791 | NM_004182 | 4759297 | ubiquitously-expressed transcript (UXT), mR | 1 | TGCTAGAGGGGCTTAGAGAACTACAA GGCCTGCAGAATTTCCCAGAGAAG |
| 65 | literature | Hs.173894 | NM_000757 | 4503074 | macrophage-specific colony-stimulating factor (CSF-1) | 1 | CTGACTCAGGATGACAGACAGGTGG AACTGCCAGTGTAGAGGGAATTCTA |
| 66 | cDNA T-cells | Hs.174103 | NM_002209 | 4504756 | integrin, alpha L (CD11A (p180), lymphocyte function-associated antigen 1; alpha polypeptide) | 1 | GTAAAGGCTATACTTGTCTTGTTCAC CTTGGGATGACGCCGCATGATATG |
| 67 | cDNA T-cells | Hs.174142 | X03663 | 29899 | c-fms proto-oncogene Monocytes | 1 | CAAGCAGGAAGCACAAACTCCCCCA AGCTGACTCATCCTAACTAACAGTC |
| 68 | cDNA T-cells | Hs.169610 | AA156937 | 1728552 | zl19c02.s1 Soares_pregnant_uterus_NbHPU | 1 | TCTTCAACAGACCCCCTCTAGAAATT TTTCAGATGCTTCTGGGAGACACC |
| 69 | cDNA | Hs.17483 | NM_000616 | 10835168 | CD4 antigen (p55) (CD4). | 1 | GTCCTCCACGCCATTTCCTTTTCCTT |

TABLE 8-continued

| SEQ ID | Origin | Unigene | Locus | GI | Nominal Description | Strand | Probe Sequence |
|---|---|---|---|---|---|---|---|
| | T-cells | | | | | | CAAGCCTAGCCCTTCTCTCATTAT |
| 70 | cDNA T-cells | Hs.177559 | U05875 | 463549 | clone pSK1 interferon gamma receptor accessory factor | 1 | GGCCCTTCATGTACATCCATGGTGTG CTGGCTTAAAATGTAATTAATCTT |
| 71 | cDNA T-cells | Hs.179526 | S73591 | 688296 | brain-expressed HHCPA78 homolog VDUP1 (Gene) | 1 | AAGATGCCCAACCCTGTGATCAGAAC CTCCAAATACTGCCATGAGAAACT |
| 72 | cDNA T-cells | Hs.1799 | J04142 | 619799 | (lambda-gt11ht-5) MHC class I antigen-like gl | 1 | CAGGAGTTTGTGTGTCTTTTATAAAAA GTTTGCCCTGGATGTCATATTGG |
| 73 | cDNA T-cells | Hs.180804 | AK000271 | 7020240 | cDNA FLJ20264 fis, clone COLF7912/cds = UNKNOWN | 1 | CCCTGAGTGACAGTCACGACAGAAC AAAACCACAAGACCAGACCACATTT |
| 74 | cDNA T-cells | Hs.180866 | NM_000416 | 4557879 | interferon gamma receptor 1 (IFNGR1). | 1 | CCTTTACATCCAGATAGGTTACCAGT AACGGAACATATCCAGTACTCCTG |
| 75 | cDNA T-cells | Hs.181165 | AK026650 | 10439548 | FLJ22997 fis, clone KAT11962, highly sim | 1 | TGCATCGTAAAACCTTCAGAAGGAAA GGAGAATGTTTTGTGGACCACTTT |
| 76 | cDNA T-cells | Hs.181357 | NM_002295 | 9845501 | laminin receptor 1 (67 kD, ribosomal protein SA | 1 | GGCCACTGAATGGGTAGGAGCAACC ACTGACTGGTCTTAAGCTGTTCTTG |
| 77 | cDNA T-cells | Hs.187660 | NM_014504 | 7657495 | Major histocompatibility complex, class I, E (HLA-E) | 1 | TGTAGGGTAAATGTGACTGGAATACA CCTTTGGAACGGAATTCTTTATCA |
| 78 | cDNA T-cells | Hs.182740 | NM_001015 | 14277698 | ribosomal protein S11 (RPS11), mRNA/cds = (15, 4 | 1 | AGGCTGGACATCGGCCCGCTCCCCA CAATGAAATAAAGTTATTTTCTCAT |
| 79 | cDNA T-cells | Hs.187660 | NM_014504 | 7657495 | putative Rab5 GDP/GTP exchange factor homologu | 1 | TGTAGGGTAAATGTGACTGGAATACA CCTTTGGAACGGAATTCTTTATCA |
| 80 | cDNA T-cells | Hs.197345 | NM_001469 | 4503840 | thyroid autoantigen 70 kD (Ku antigen) (G22P1). | 1 | GTTGCCATGGTGATGGTGTAGCCCTC CCACTTTGCTGTTCCTTACTTTAC |
| 81 | cDNA T-cells | Hs.198253 | M33906 | 184194 | MHC class II HLA-DQA1 mRNA, complete cds/cds = (43, 810) | 1 | CCACCCACCCCTCAATTAAGGCAACA ATGAAGTTAATGGATACCCTCTGC |
| 82 | cDNA T-cells | Hs.197345 | NM_001469 | 4503840 | thyroid autoantigen 70 kD (Ku antigen) (G22P1). | 1 | GTTGCCATGGTGATGGTGTAGCCCTC CCACTTTGCTGTTCCTTACTTTAC |
| 83 | cDNA T-cells | Hs.198253 | M33906 | 184194 | MHC class II HLA-DQA1 mRNA, complete cds/cds = (43, 810) | 1 | CCACCCACCCCTCAATTAAGGCAACA ATGAAGTTAATGGATACCCTCTGC |
| 84 | cDNA T-cells | Hs.1987 | NM_006139 | 5453610 | CD28 antigen (Tp44) (CD28) | 1 | GCTCACCTATTTGGGTTAAGCATGCC AATTTAAAGAGACCAAGTGTATGT |
| 85 | cDNA T-cells | Hs.336769 | NM_002074 | 11321584 | guanine nucleotide binding protein (G protein) | 1 | TCCACCTTTTGTATTTAATTTTAAAGT CAGTGTACTGCAAGGAAGCTGGA |
| 86 | cDNA T-cells | Hs.211576 | L10717 | 307507 | T cell-specific tyrosine kinase mRNA, complete | 1 | CCCTATCCCGCAAAATGGGCTTCCTG CCTGGGTTTTTCTCTTCTCACATT |
| 87 | cDNA T-cells | Hs.336769 | NM_002074 | 11321584 | guanine nucleotide binding protein (G protein) | 1 | TCCACCTTTTGTATTTAATTTTAAAGT CAGTGTACTGCAAGGAAGCTGGA |
| 88 | cDNA T-cells | Hs.2188 | AF119850 | 7770136 | PRO1608 mRNA, complete cds /cds = (1221, 2174)/ | 1 | AGATCTTCAAGTGAACATCTCTTGCC ATCACCTAGCTGCCTGCACCTGCC |
| 89 | cDNA T-cells | Hs.21907 | NM_007067 | 5901961 | histone acetyltransferase (HBOA), mRNA/cds = | 1 | GCTAATTTTAAGCATGTTCAGTGGCA GCTCCCCTCCAGTTTCAGTGTCAC |
| 90 | cDNA T-cells | Hs.2200 | NM_005041 | 4826941 | Perforin 1 (pore forming protein; PRF1) | 1 | CCTGTGATCAGGCTCCCAAGTCTGGT TCCCATGAGGTGAGATGCAACCTG |
| 91 | cDNA T-cells | Hs.2233 | NM_000759 | 4503078 | granulocyte colony-stimulating factor 3 (CFS3) | 1 | ACATGGTTTGACTCCCGAACATCACC GACGTGTCTCCTGTTTTTCTGGGT |
| 92 | cDNA T-cells | Hs.2236 | Z29067 | 479172 | NEK3_SERINE/THREONINE-PROTEIN KINASE NEK3 | 1 | TCAGAGCTGAAGAAGCGAGCTGGAT GGCAAGGCCTGTGCGACAGATAATG |
| 93 | cDNA T-cells | Hs.233938 | NM_006471 | 5453739 | myosin, light polypeptide, regulatory, non-s | 1 | TCAGCCATTTTGGGCATATGTATCTTT ATAATCAGACTGGAAACGGGACT |
| 94 | cDNA T-cells | Hs.236449 | NM_024898 | 13376352 | cDNA: FLJ22757 fis, clone KAIA0803/cds = (92, 24 | 1 | ATCCTGCAACCTTACAATTCCTCTC GGCATTTGTCACTTCCATCTCAGC |
| 95 | cDNA T-cells | Hs.238848 | NM_003999 | 4557039 | oncostatin-M specific receptor beta subunit (OSMRB) | 1 | AGCTTACTACAGTGAAAGAATGGGAT TGGCAAGTAACTTCTGACTTACTG |
| 96 | cDNA T-cells | Hs.238707 | NM_024901 | 13378358 | cDNA: FLJ22457 fis, clone HRC09925/cds = (56, 14 | 1 | ATTATAACATCTTCAACACAGAACACA CTTTGTGGTCGAAAGGCTCAGCC |
| 97 | cDNA T-cells | Hs.239138 | NM_005746 | 5031976 | pre-B-cell colony-enhancing factor (PBEF), m | 1 | TGTCAGAGATTGCCTGTGGCTCTAAT ATGCACCTCAAGATTTTAAGGAGA |
| 98 | cDNA T-cells | Hs.239189 | NM_014905 | 7662327 | glutaminase (GLS). | 1 | TGTCTGGCAGGGACTGAATGACCTG ATGTCAGATTTAGATTCTTCCTGGG |
| 99 | cDNA T-cells | Hs.241392 | NM_002985 | 4506848 | small inducible cytokine A5 (RANTES) (SCYA5). | 1 | GGGAGGAACACTGCACTCTTAAGCTT CCGCCGTCTCAACCCCTCACAGGA |
| 100 | cDNA T-cells | Hs.241587 | NM_016838 | 8400721 | RNA binding motif, single stranded interacting | 1 | ATGAAGAAGGGTGTGAAGGCTGAAC AATCATGGATTTTTCTGATCAATTG |
| 101 | cDNA T-cells | Hs.241570 | NM_000594 | 10835154 | Tumor necrosis factor (TNF superfamily, member 2 | 1 | GCCTCTGCTCCCCAGGGAGTTGTGT CTGTAATCGGCCTACTATTCAGTGG |
| 102 | cDNA T-cells | Hs.247885 | NM_022304 | 13435404 | Histamine receptor H2 (HRH2) | 1 | GGATGCTACTGATGGGAATGATTAAG GGAGCTGCTGTTTAGGTGGTGCTG |
| 103 | cDNA T-cells | Hs.248156 | NM_020530 | 10092620 | oncostatin M (OSM). | 1 | TCAGGAACAACATCTACTGCATGGCC CAGCTGCTGGACAACTCAGACACG |
| 104 | cDNA T-cells | Hs.298469 | NM_000789 | 4503272 | dipeptidyl carboxypeptidase 1 (angiotensin I converting enzyme) (ACE) | 1 | CTTACATCAGGTACTTTGTCAGCTTC ATCATCCAGTTCCAGTTCCACGAG |
| 105 | cDNA T-cells | Hs.336780 | NM_006088 | 5174734 | tubulin, beta, 2 (TUBB2), mRNA | 1 | CATCCAGGAGCTGTTCAAGCGCATCT CCGAGCAGTTCACGGCCATGTTCC |
| 106 | cDNA T-cells | Hs.252723 | NM_000981 | 4506608 | ribosomal protein L19 (RPL19), mRNA/cds = (28, 6 | 1 | ACCTCCCACTTTGTCTGTACATACTG GCCTCTGTGATTACATAGATCAGC |

TABLE 8-continued

| SEQ ID | Origin | Unigene | Locus | GI | Nominal Description | Strand | Probe Sequence |
|---|---|---|---|---|---|---|---|
| 107 | cDNA T-cells | NA | X53795 | 35832 | R2 mRNA for an inducible membrane protein/cds = (156, 95 | 1 | GTCTTTGAGAATATGATGTCAGACAT TTTCGGATGGGCTGTTTAGATGTT |
| 108 | literature | Hs.25648 | NM_001250 | 4507580 | Tumor necrosis factor receptor superfamily, member 5 | 1 | GGTCACCCAGGAGGATGGCAAAGAG AGTCGCATCTCAGTGCAGGAGAGAC |
| 109 | cDNA T-cells | Hs.258503 | AF160973 | 5816319 | P53 inducible protein | 1 | AGACCCTTATCTGGAGGAGGAAGAG AAGCAGGAGAGAGAAAGCCACAGCC |
| 110 | cDNA T-cells | Hs.265829 | NM_002204 | 4504748 | integrin, alpha 3 (antigen CD49C, alpha 3 subunit of VLA-3 receptor) (ITGA3). | 1 | GGCTGTGTCCTAAGGCCCATTTGAGA AGCTGAGGCTAGTTCCAAAAACCT |
| 111 | cDNA T-cells | Hs.271387 | Y18645 | 2916795 | for monocyte chemotactic protein-2/cds = | 1 | GTGCTCCTGTAAGTCAAATGTGTGCT TTGTACTGCTGTTGTTGAAATTGA |
| 112 | cDNA T-cells | Hs.272493 | NM_004167 | 14602450 | small inducible cytokine subfamily A (Cys—Cys) | 1 | CAGAGACATAAAGAGAAGATGC CAAGGCCCCCTCCTCCACCCACC GCTAA |
| 113 | cDNA T-cells | Hs.176683 | NM_000570 | 10835138 | Fc fragment of IgG, low affinity IIIb, receptor for (CD16) (FCGR38). | 1 | ATGGGAGTAATAAGAGCAGTGGCAG CAGCATCTCTGAACATTTCTCTGGA |
| 114 | literature | Hs.278443 | NM_004001 | 4557021 | Fc fragment of IgG, low affinity IIb, receptor for (CD32) (FCGR2B). | 1 | CCACTAATCCTGATGAGGCTGACAAA GTTGGGGCTGAGAACACAATCACC |
| 115 | cDNA T-cells | Hs.62954 | J04755 | 182512 | ferritin H processed pseudogene, complete cds/cds = UN | 1 | TGTTGGGGTTTCCTTTACCTTTTCTAT AAGTTGTACCAAAACATCCACTT |
| 116 | cDNA T-cells | Hs.279581 | AK000575 | 7020763 | FLJ20588 fis, clone REC00775 /cds = (6, 422) | 1 | CAGAGTAGGCATCTGGGCACCAAGA CCTTCCCTCAACAGAGGACACTGAG |
| 117 | cDNA T-cells | Hs.279930 | V00522 | 32122 | encoding major histocompatibility complex gene | 1 | CTTTGCCTAAACCCTATGGCCTTCCTG TGCATCTGTACTCACCCTGTACCA |
| 118 | cDNA T-cells | Hs.181357 | NM_002295 | 9845501 | Laminin receptor 1 (67 kD, ribosomal protein SA) | 1 | GGCCACTGAATGGGTAGGAGCAACC ACTGACTGGTCTTAAGCTGTTCTTG |
| 119 | cDNA T-cells | Hs.283722 | NM_020151 | 9910251 | GTT1 protein (GTT1), mRNA /cds = (553, 1440)/gb | 1 | TGATTCTGCACTTGGGGTCTGTCTGT ACAGTTACTCATGTCATTGTAATG |
| 120 | cDNA T-cells | Hs.78961 | NM_014110 | 13899255 | PRO2047 protein (PRO2047), mRNA/cds = (798, 988 | 1 | TGTGTAATAGGCCTTTTCATGCTTTAT GTGTAGCTTTTTACCTGTAACCT |
| 121 | cDNA T-cells | Hs.334853 | NM_006013 | 5174430 | cDNA DKFZp762B195 (from clone DKFZp762B195) | 1 | AAGTTATCATGTCCATCCGCACCAAG CTGCAGAACAAGGAGCATGTGATT |
| 122 | cDNA T-cells | Hs.334853 | NM_006013 | 5174430 | Complement cDNA DKFZp762B195 (from clone DKFZp762B195) | -1 | AAGTTATCATGTCCATCCGCACCAAG CTGCAGAACAAGGAGCATGTGATT |
| 123 | cDNA T-cells | Hs.284283 | U90552 | 2082705 | butyrophilin (BTF5) mRNA, complete cds/cds = (359, 190 | 1 | TGGTGGATGTTAAACCAATATTCCTTT CAACTGCTGCCTGCTAGGGAAAA |
| 124 | cDNA T-cells | Hs.286212 | AK021791 | 10433048 | cDNA FLJ11729 fis, clone HEMBA1005394, modera | 1 | TGAACTTGCTGAATGTAAGGCAGGCT ACTATGCGTTATAATCTAATCACA |
| 125 | cDNA T-cells | Hs.287369 | NM_020525 | 10092624 | 50 interleukin 22 (IL22), mRNA /cds = (71, 610)/gb | 1 | ATTTGACCAGAGCAAAGCTGAAAAAT GAATAACTAACCCCCTTTCCCTGC |
| 126 | cDNA T-cells | Hs.287369 | NM_020525 | 10092624 | 60 interleukin 22 (IL22), mRNA /cds = (71, 610)/gb | 1 | GCAATTGGAGAACTGGATTTGCTGTT TATGTCTCTGAGAAATGCCTGCATTT GACCAGAG |
| 127 | cDNA T-cells | Hs.287369 | NM_020525 | 10092624 | 70 interleukin 22 (IL22), mRNA /cds = (71, 610)/gb | 1 | TTTGACCAGAGCAAAGCTGAAAAATG AATAACTAACCCCCTTTCCCTGCTAG AAATAACAATTAGATGCC |
| 128 | cDNA T-cells | Hs.288061 | NM_001101 | 5016088 | actin, beta (ACTB). | 1 | CCCTTTTTGTCCCCCAACTTGAGATG TATGAAGGCTTTTGGTCTCCCTGG |
| 129 | cDNA T-cells | Hs.315054 | NM_032921 | 14249707 | hypothetical protein MGC15875 (MGC15875). | 1 | ATTAGACCAGACCAGTGTATTTCTAA AGAAAATCCTGACATGCACACCCA |
| 130 | cDNA T-cells | Hs.289088 | NM_005348 | 13129149 | heat shock 90 kD protein 1, alpha (HSPCA). | 1 | GACCCTACTGCTGATGATACCAGTGC TGCTGTAACTGAAGAAATGCCACC |
| 131 | cDNA T-cells | Hs.29052 | AK000196 | 7020122 | FLJ20189 fis, clone COLF0657 /cds = (122, 84 | 1 | ACAGGCAAAGTGACAGGGGAAAAGG AATTAGTCTAAGAGTAAGGGGATGA |
| 132 | cDNA T-cells | Hs.291129 | AA837754 | 2912953 | oe10d02.s1 cDNA /clone = IMAGE: 1385475/gb = AA | 1 | CTTTCCTCTTGCTGCTGGGGCCTAGG TCTTCTTGCTGCTGCTTCCTTTTC |
| 133 | cDNA T-cells | Hs.292590 | O59502 | 960608 | HUM041H11A cDNA, 3' end /clone = GEN-041H11/cl | 1 | AGAGTTTTGTTGGTAGACTGGAGCT GGGATGTTGAATCAACCTCAGGCA |
| 134 | cDNA T-cells | Hs.292590 | D59502 | 960608 | Complement HUM041H11A cDNA, 3' end/clone = GEN-041H11/cl | -1 | TGCCTGAGGTTGATTCAACATCCCAG CTCCAGTCTACCAACAAAAACTCT |
| 135 | cDNA T-cells | Hs.99858 | X61923 | 36646 | Ribosomal protein L7a Gene with exons/introns | 1 | CTGACGATCAGCTTGGAACAGCCAAA CAGAATTAACGCAACTAATAACCT |
| 136 | cDNA T-cells | Hs.323483 | AL050141 | 4884352 | cDNA DKFZp586O031 (from clone DKFZp586O0 | 1 | TCCTTTTATGCATTGGAGGAAAAACA TGTTGGCTTTTCTCTTGACGTGGG |
| 137 | cDNA T-cells | Hs.323463 | AL050141 | 4884352 | Complement cDNA DKFZp586O031 (from clone DKFZp586O1 | -1 | CCCACGTCAAGAGAAAAGCCAACATG TTTTTCCTCCAATGCATAAAAGGA |
| 138 | cDNA T-cells | Hs.323822 | AB046771 | 10047166 | for KIAA1551 protein, partial cds/cds = (0 | 1 | CTCAGGAAACCCGACAGAAGAAA CATGTAACACAGAACTCACGTCC ACTA |
| 139 | cDNA | NA | AF347015 | 13273284 | Mitochondial DNA, chyochrome B | 1 | ACTCGAGACGTAAATTATGGCTGAAT |

TABLE 8-continued

| SEQ ID | Origin | Unigene | Locus | GI | Nominal Description | Strand | Probe Sequence |
|---|---|---|---|---|---|---|---|
| | T-cells | | | | gene | | CATCCGCTACCTTCACGCCAATGG |
| 140 | cDNA T-cells | Hs.30035 | U61267 | 1418285 | putative splice factor transformer2-beta mRN | 1 | TGCTGTTTTCATTCTGCATTTGTGTAG TTTGGTGCTTTGTTCCAAGTTAA |
| 141 | cDNA T-cells | Hs.30909 | NM_019081 | 11464998 | KIAA0430 gene product (KIAA0430), mRNA/cds = ( | 1 | AAAAATGACAAAAGTTATCACCAAAA CCCCCTTTCCCATCTTGCACTGTT |
| 142 | cDNA T-cells | Hs.3195 | NM_002995 | 4506852 | sapiens small inducible cytokine subfamily C, member 1 (lymphotactin) (SCYC1). | 1 | AGCTTTTAATGCTCCAAATGCTGACC CATGCAATATTTCCTCATGTGATC |
| 143 | cDNA T-cells | Hs.322645 | AL050376 | 4914609 | mRNA; cDNA DKFZp586J101 (from clone DKFZp586J1 | 1 | AAAAGAAATGCAGGTTTATTATCCAG CACTGAGAGAGTTAACAAGGACTG |
| 144 | cDNA T-cells | Hs.324481 | AL050376 | 4914609 | Complement mRNA; cDNA DKFZp586J101 (from clone DKFZp586J2 | -1 | AGAGAGACTTCTCATTGGCTGTGAAG GTAGAGCTTTTGGGGAAATTCCTG |
| 145 | cDNA T-cells | Hs.324481 | AW968541 | 8158382 | Complement EST380617 cDNA /gb = AW968541 unknown coding strand | -1 | CAGGAATTTCCCCAAAAGCTCTACCT TCACAGCCAATGAGAAGTCTCTCT |
| 146 | cDNA T-cells | Hs.324481 | AW968541 | 8158382 | EST380617 cDNA/gb = AW968541 unknown coding strand | 1 | AGAGAGACTTCTCATTGGCTGTGAAG GTAGAGCTTTTGGGGAAATTCCTG |
| 147 | cDNA T-cells | Hs.327 | NM_001558 | 4504632 | interleukin-10 receptor mRNA, complete IL10RA | 1 | CATCTCAGCCCTGCCTTTCTCTGGAG CATTCTGAAAACAGATATTCTGGC |
| 148 | cDNA T-cells | Hs.32970 | NM_003037 | 4506968 | signaling lymphocytic activation molecule (S | 1 | TCATGATAACCTGCAGACCTGATCAA GCCTCTGTGCCTCAGTTTCTCTCT |
| 149 | literature | Hs.334687 | NM_000569 | 12056966 | Fc fragment of IgG, low affinity IIIa, receptor for (CD18) (FCGR3A) | 1 | ATGGGGGTAATAAGAGCAGTAGCAG CAGCATCTCTGAACATTTCTCTGGA |
| 150 | cDNA T-cells | Hs.303649 | M26683 | 184641 | interferon gamma treatment inducible mRNA Monocytes | 1 | GAAATTGCTTTTCCTCTTGAACCACA GTTCTACCCCTGGGATGTTTTGAG |
| 151 | cDNA T-cells | Hs.105938 | X53961 | 34415 | lactoferrin/cds = (294, 2429) Neutrophils | 1 | AATTCCTCAGGAAGTAAAACCGAAGA AGATGGCCCAGCTCCCCAAGAAAG |
| 152 | cDNA T-cells | Hs.38 | D12614 | 219911 | lymphotoxin (TNF-beta), complete cds T-cells, B-cells | 1 | AACATCCAAGGAGAAACAGAGACAG GCCCAAGAGATGAAGAGTGAGAGGG |
| 153 | cDNA T-cells | Hs.278870 | AB034205 | 6899845 | Acid-inducible phosphoprotein | 1 | TCGTGTGAATCAGACTAAGTGGGATT TCATTTTTACAACTCTGCTCTACT |
| 154 | cDNA T-cells | Hs.3886 | NM_002267 | 4504898 | karyopherin alpha 3 (importin alpha 4) (KPNA3) | 1 | GCATATACAAGTTGGAAGACTAAAGA GGTGCAATGTGATCTGAGCCTCCA |
| 155 | cDNA T-cells | Hs.394 | NM_001124 | 4501944 | adrenomedullin (ADM). | 1 | TGAGTGTGTTTGTGTGCATGAAAGAG AAAGACTGATTACCTCCTGTGTGG |
| 156 | literature | Hs.40034 | NM_000885 | 6006032 | integrin, alpha 4 (antigen CD49D, alpha 4 subunit of VLA-4 receptor) (ITGA4) | 1 | AGCTGTTCCCAAATTTTCTAACGAGT GGACCATTATCACTTTAAAGCCCT |
| 157 | cDNA T-cells | Hs.41724 | NM_002190 | 4504650 | interleukin 17 (cytotoxic T-lymphocyte-associated serine esterase 8) | 1 | ATCAACAGACCAACATTTTTCTCTTCC TCAAGCAACACTCCTAGGGCCTG |
| 158 | cDNA T-cells | Hs.44163 | NM_018838 | 10092656 | 13 kDa differentiation-associated protein (L | 1 | TATGACTGATGATCCTCCAACAACAA AACCACTTACTGCTCGTAAATTCA |
| 159 | cDNA T-cells | Hs.44926 | X60708 | 35335 | pcHDP7 mRNA for liver dipeptidyl peptidase IV/cds = (75 | 1 | AAAATACTGATGTTCCTAGTGAAAGA GGCAGCTTGAAACTGAGATGTGAA |
| 160 | literature | Hs.46 | D10202 | 219975 | for platelet-activating factor receptor. | 1 | GGAAGACTTTAAACCACCTAGTTCTC CCACTGGGGCATCGGTCTAAAGCT |
| 161 | cDNA T-cells | Hs.48433 | NM_014345 | 7657183 | endocrine regulator (HRIHFB2436), mRNA/cds = | 1 | CCCTGTTCCACAAACCCATATGTATC CTTTCCTCAACCTCCTCCTTTCCC |
| 162 | cDNA T-cells | Hs.50002 | AB000887 | 2189952 | for EBI1-ligand chemokine, complete cds | 1 | GTGTGTGAGTGTGAGTGTGAGCGAG AGGGTGAGTGTGGTCAGAGTAAAGC |
| 163 | cDNA T-cells | Hs.50404 | U86358 | 2388626 | chemokine (TECK) mRNA, complete cds/cds = (0, 452)/gb | 1 | TCTGGTCATTCAAGGATCCCCTCCCA AGGCTATGCTTTTCTATAACTTTT |
| 164 | cDNA T-cells | Hs.50984 | NM_001712 | 4502404 | carcinoembryonic antigen-related cell adhesion molecule 1 (CEACAM1) | 1 | GGCAGCTCAGGACCACTCCAATGAC CCACCTAACAAGATGAATGAAGTTA |
| 165 | cDNA T-cells | Hs.301921 | NM_001295 | 4502630 | chemokine (C—C motif) receptor 1 (CCR1). | 1 | TGTTCTTCATCTAAGCCTTCTGGTTTT ATGGGTCAGAGTTCCGACTGCCA |
| 166 | cDNA T-cells | Hs.54457 | NM_004358 | 4757943 | CD81 antigen (target of antiproliferative antibody 1) | 1 | GCCTTCATGCACCTGTCCTTTCTAAC ACGTCGCCTTCAACTGTAATCACA |
| 167 | cDNA T-cells | Hs.54460 | U46573 | 1280140 | eotaxin precursor mRNA, complete cds/cds = (53, 346)/ | 1 | CCCTCTCCTCTCTTCCTCCCTGGAAT CTTGTAAAGGTCCTGGCAAAGATG |
| 168 | cDNA T-cells | Hs.54609 | NM_014291 | 7857117 | glycine C-acetyltransferase (2-amino-3-keto | 1 | CTGGGCTGGGACGTGACCTGTGCTG AGGGCTGTGAGAATGTGAAACAACA |
| 169 | cDNA T-cells | Hs.55921 | NM_004446 | 4758293 | glutamyl-prolyl-tRNA synthetase (EPRS), mRN | 1 | GGGATGAACGAAAGCCCCCTCTTCAA CTCCTCTCACTTTTTAAAGCATTG |
| 170 | cDNA T-cells | Hs.57987 | NM_022898 | 12597634 | B-cell lymphoma/leukaemia 11B (BCL11B), mRNA | 1 | ACAATGTTGAGTTCAGCATGTGTCTG CCATTTCATTTGTACGCTTGTTCA |
| 171 | cDNA T-cells | Hs.59403 | NM_004863 | 4758667 | serine palmitoyltransferase, long chain base subunit 2 (SPTLC2) | 1 | TTTCAGTCCCAGAACCTACAGATACC CTGCTACTTGCTTCACGTGGATGC |
| 172 | cDNA T-cells | Hs.5985 | NM_020240 | 9910377 | non-kinase Cdc42 effector protein SPEC2 (LOC56990). | 1 | AATTCAGTTAGCTCCATTCAGAACCA AATGCAGTCCAAGGGAGGTTATGG |
| 173 | cDNA T-cells | Hs.6179 | BG929114 | 14323837 | Does not hit the NM_numbers two splice variants. Direction unknown | 1 | CCCATCTTACAGAAGTTGAGGCCAAG GGAGAATGGTAGGCACAGAAGAAA |

TABLE 8-continued

| SEQ ID | Origin | Unigene | Locus | GI | Nominal Description | Strand | Probe Sequence |
|---|---|---|---|---|---|---|---|
| 174 | cDNA T-cells | Hs.62192 | J02931 | 339501 | placental tissue factor (two forms) mRNA, complete cd | 1 | TGTGTTAAGTGCAGGAGACATTGGTA TTCTGGGCACCTTCCTAATATGCT |
| 175 | cDNA T-cells | Hs.62192 | NM_001993 | 10518499 | coagulation factor III (thromboplastin, tissue factor) (F3), mRNA. | 1 | TGTGTTAAGTGCAGGAGACATTGGTA TTCTGGGCAGCTTCCTAATATGCT |
| 176 | literature | Hs.624 | NM_000584 | 10834977 | interleukin 8 (IL8). | 1 | AGCTGTGTTGGTAGTGCTGTGTTGAA TTACGGAATAATGAGTTAGAACTA |
| 177 | literature | Hs.62954 | NM_002032 | 4503794 | 50 ferritin, heavy polypeptide 1 (FTH1), mRNA/c | 1 | TGTTGGGGTTTCCTTTACCTTTTCTAT AAGTTGTACCAAAACATCCACTT |
| 178 | literature | Hs.62954 | NM_002032 | 4503794 | 60 ferritin, heavy polypeptide 1 (FTH1), mRNA/c | 1 | TGCATGTTGGGGTTTCCTTTACCTTTT CTATAAGTTGTACCAAAACATCCACTT AAGTTC |
| 179 | literature | Hs.62954 | NM_002032 | 4503794 | 70 ferritin, heavy polypeptide 1 (FTH1), mRNA/c | 1 | TGTTGGGGTTTCCTTTACCTTTTCTAT AAGTTGTACCAAAACATCCACTTAAG TTCTTTGATTTGTACCA |
| 180 | literature | Hs.652 | NM_000074 | 4557432 | tumor necrosis factor (ligand) superfamily, member 5, TNFSF5 | 1 | TCTACCTGCAGTCTCCATTGTTTCCA GAGTGAACTTGTAATTATCTTGTT |
| 181 | cDNA T-cells | Hs.66053 | AB051540 | 12698050 | mRNA for KIAA1753 protein, partial cds/cds = (0 | 1 | GTGTGCGTGTGTGTGTGCCTGTCCA GTGTATATTGTGTCTTAGCTTCCAT |
| 182 | cDNA T-cells | Hs.66151 | AL157438 | 7018513 | mRNA; cDNA DKFZp434A115 (from clone DKFZp434A1 | 1 | CTGAAGGGAAGAGAGCCTTGAATAG ACTGAAGCGAAGACGGTTCTGCAAG |
| 183 | cDNA T-cells | Hs.6975 | NM_014088 | 7662589 | PRO1073 protein (PRO1073). | 1 | TTCTCTGCATCTAGGCCATCATACTG CCAGGCTGGTTATGACTCAGAAGA |
| 184 | cDNA T-cells | Hs.70188 | NM_003169 | 4507312 | suppressor of Ty (S. cerevisiae) 5 homolog (SUP | 1 | CTTCCTGTACCTCCTCCCCACAGCTT GCTTTTGTTGTACCGTCTTTCAAT |
| 185 | cDNA T-cells | Hs.70258 | N21089 | 1126259 | IMAGE:265324 Foreskin 3' read 2.0 kb | 1 | AACCTGCACAAGCATGTAATAAAAGA GCACACTTAAAAACATTCTGACCA |
| 186 | cDNA T-cells | Hs.70258 | N21089 | 1126259 | Complement IMAGE:265324 Foreskin 3' read 2.0 kD | -1 | TGGTCAGAATGTTTTTAAGTGTGCTC TTTTATTACATGCTTGTGCAGGTT |
| 187 | cDNA T-cells | Hs.70258 | AA743863 | 2783214 | IMAGE:1308639 5' read, perfect hit. | 1 | CCTTCTGAAGGTGTATAGATACAGCT TGTCTTGAAATGTCTTTCTCCACA |
| 188 | cDNA T-cells | Hs.70258 | AA743863 | 2783214 | Complement IMAGE:1308639 5' read, perfect hit. | -1 | TGTGGAGAAAGACATTTCAAGACAAG CTGTATCTATACACCTTCAGAAGG |
| 189 | cDNA T-cells | Hs.72918 | NM_002981 | 4506832 | small inducible cytokine A1 (I-309, homologous to mouse Tca-3) (SCYA1) | 1 | TGCTAGGTCACAGAGGATCTGCTTGG TCTTGATAAGCTATGTTGTTGCAC |
| 190 | cDNA T-cells | Hs.73165 | U64198 | 1685027 | Il-12 receptor beta2 mRNA, complete cds/cds = (640, 322 | 1 | CTAGAGGACCATTCATGCAATGACTA TTTCTAAAGCACCTGCTACACAGC |
| 191 | cDNA T-cells | Hs.737 | NM_004907 | 4758313 | immediate early protein (ETR101), mRNA/cds = ( | 1 | GGGAGTTTCTGAGGGTCTGCTTTGTT TACCTTTCGTGCGGTGGATTCTTT |
| 192 | cDNA T-cells | Hs.73742 | NM_001002 | 4506666 | ribosomal protein, large, P0 (RPLP0). | 1 | TCGGAGGAGTCGGACGAGGATATGG GATTTGGTCTCTTTGACTAATCACC |
| 193 | cDNA T-cells | Hs.73792 | J03565 | 181919 | Epstein-Barr virus complement receptor type II (cr2) | 1 | TTCCTTCCTCGGTGGTGTTAATCATTT CGTTTTTACCCTTTACCTTCGGA |
| 194 | cDNA T-cells | Hs.73798 | NM_002415 | 4505184 | macrophage migration inhibitory factor (MIF) | 1 | GTCTACATCAACTATTACGACATGAA CGCGGCCAATGTGGGCTGGAACAA |
| 195 | cDNA T-cells | Hs.738 | NM_003973 | 4506800 | ribosomal protein L14 (RPL14), mRNA/cds = (17, 6 | 1 | CAGAAGGGTCAAAAAGCTCCAGCCC AGAAAGCACCTGCTCCAAAGGCATC |
| 196 | cDNA T-cells | Hs.73800 | NM_003005 | 6031196 | selectin P (granule membrane protein 140 kD, antigen CD62) (SELP) | 1 | GACCTTCCTGCCACCAGTCACTGTCC CTCAAATGACCCAAAGACCAATAT |
| 197 | cDNA T-cells | Hs.73817 | D90144 | 219905 | LD78 alpha precursor, complete cds/c | 1 | GAGATGGGGAGGGCTACCACAGAGT TATCCACTTTACAACGGAGACACAG |
| 198 | cDNA T-cells | Hs.73818 | NM_006004 | 5174744 | ubiquinol-cytochrome c reductase hinge prote | 1 | ATGGGTTTGGCTTGAGGCTGGTAGCT TCTATGTAATTCGCAATGATTCCA |
| 199 | cDNA T-cells | Hs.73839 | NM_002935 | 4508550 | ribonuclease, RNase A family, 3 (eosinophil cationic protein) (RNASE3) | 1 | CATCCCTCCATGTACTCTGGGTATCA GCAACTGTCCTCATCAGTCTCCAT |
| 200 | cDNA T-cells | Hs.73917 | M13982 | 186334 | interleukin 4 (IL-4) mRNA | 1 | ACCTTACAGGAGATCATCAAAACTTT GAACAGCCTCACAGAGCAGAAGAC |
| 201 | cDNA T-cells | Hs.74011 | NM_002286 | 11693297 | lymphocyte-activation gene 3 (LAG3). | 1 | GAGAAGACAGTGGCGACCAAGACGA TTTTCTGCCTTAGAGCAAGGGATTC |
| 202 | cDNA T-cells | Hs.74085 | X54870 | 35082 | NKG2-D gene/cds = (338, 988) /gb = X54870/gi = 3 | 1 | CAGGGGATCAGTGAAGGAAGAAGAA GCCAGCAGATCAGTGAGAGTGCAAC |
| 203 | cDNA T-cells | Hs.74335 | NM_007355 | 6880306 | heat shock 90 kD protein 1, beta (HSPCB), mRNA/ | 1 | CCCATTCCCTCTCTACTCTTGACAGC AGGATTGGATGTTGTGTATTGTGG |
| 204 | cDNA T-cells | Hs.74821 | NM_000311 | 4508112 | prion protein (p27–30) (Creutzfeld-Jakob dis | 1 | ACTTAATATGTGGGAAACCCTTTGC GTGGTCCTTAGGCTTACAATGTGC |
| 205 | cDNA T-cells | Hs.75249 | D31885 | 505097 | ADP-ribosylation factor-like 6 interacting protein | 1 | AAAATACAAGGGCTGTTGGTGAGAGC AGACTTGAGGTGATGATAGTTGGC |
| 206 | cDNA T-cells | Hs.75348 | NM_008263 | 5453989 | proteasome (prosome, macropain) activator subunit 1 (PA28 alpha) (PSME1) | 1 | CCAGATTTCCCCAAACTTGCTTCTG TTGAGATTTTTCCCTCACCTTGCC |
| 207 | cDNA T-cells | Hs.75545 | X52425 | 33833 | interleukin 4 receptor | 1 | ACCTTGGGTTGAGTAATGCTCGTCTG TGTGTTTAGTTTCATCACCTGTT |
| 208 | cDNA | Hs.75596 | NM_000878 | 4504664 | interleukin 2 receptor, beta | 1 | AAACTCCCCTTTCTTGAGGTTGTCTG |

TABLE 8-continued

| SEQ ID | Origin | Unigene | Locus | GI | Nominal Description | Strand | Probe Sequence |
|---|---|---|---|---|---|---|---|
| | T-cells | | | | (IL2RB). | | AGTCTTGGGTCTATGCCTTGAAAA |
| 209 | literature | Hs.75813 | M24795 | 178670 | CD36 antigen mRNA | 1 | CTCAGTGTTGGTGTGGTGATGTTTGT TGCTTTTATGATTTCATATTGTGC |
| 210 | cDNA T-cells | Hs.75678 | NM_006732 | 5803018 | FBJ murine osteosarcoma viral oncogene homolo | 1 | CTGTATCTTTGACAATTCTGGGTGCG AGTGTGAGAGTGTGAGCAGGGCTT |
| 211 | cDNA T-cells | Hs.75703 | J04130 | 178017 | 50 activation (Act-2) mRNA, complete cds/cds = (108, 386) | 1 | GATAAGTGTCCTATGGGGATGGTCCA CTGTCACTGTTTCTCTGCTGTTGC |
| 212 | cDNA T-cells | Hs.75703 | J04130 | 178017 | 60 activation (Act-2) mRNA, complete cds/cds = (108, 386) | 1 | TTTAGCCAAAGGATAAGTGTCCTATG GGGATGGTCCACTGTCACTGTTTCTC TGCTGTTG |
| 213 | cDNA T-cells | Hs.75703 | J04130 | 178017 | 70 activation (Act-2) mRNA, complete cds/cds = (108, 386) | 1 | ATTTATATTAGTTTAGCCAAAGGATAA GTGTCCTATGGGGATGGTCCACTGTC ACTGTTTCTCTGCTGTT |
| 214 | cDNA T-cells | Hs.75968 | NM_021109 | 11056060 | thymosin, beta 4, X chromosome (TMSB4X), mRNA | 1 | GAAGGAAGAAGTGGGGTGGAAGAAG TGGGGTGGGACGACAGTGAAATCTA |
| 215 | cDNA T-cells | Hs.76506 | NM_002298 | 7382490 | lymphocyte cytosolic protein 1 (L-plastin) (L | 1 | CCATCAATGAGGTATCTTCTTTAGTG GTGGTATGTAATGGAACTTAGCCA |
| 216 | cDNA T-cells | Hs.76640 | NM_014059 | 7682650 | RGC32 protein (RGC32), mRNA /cds = (148, 499)/g | 1 | AAAGACGTGCACTCAACCTTCTACCA GGCCACTCTCAGGCTCACCTTAAA |
| 217 | cDNA T-cells | Hs.76753 | NM_000118 | 4557554 | endoglin (Oster-Rendu-Weber syndrome 1) (ENG). | 1 | CCAAGCTGCTTGTCCTGGGCCTGCC CCTGTGTATTCACCACCAATAAATC |
| 218 | cDNA T-cells | Hs.77039 | NM_001006 | 4508722 | ribosomal protein S3A (RPS3A), mRNA/cds = (36, 8 | 1 | CACTGGGGACGAGACAGGTGCTAAA GTTGAACGAGCTGATGGATATGAAC |
| 219 | literature | Hs.77318 | L13385 | 349823 | Miller-Dieker lissencephaly protein (LIS1) | 1 | CGTTGCTGAAGTGGTAATTGAGGAAA ACAGTTCCCCAGATTGTTAAGAGT |
| 220 | cDNA T-cells | Hs.77424 | X14358 | 31331 | high affinity Fc receptor (FcRI)/cds = (36, 118 | 1 | CTCCCCGTGAGCACTGCGTACAAACA TCCAAAAGTTCAACAACACCAGAA |
| 221 | cDNA T-cells | Hs.77502 | BC001854 | 12804818 | , methionine adenosyltransferase II, alpha, c | 1 | AGTGCCTTTCAGGATCTATTTTTGGA GGTTTATTACGTATGTCTGGTTCT |
| 222 | cDNA T-cells | Hs.77729 | NM_002543 | 4505500 | oxidised low density lipoprotein (lectin-like | 1 | AGAACAAACTAAGCCAGGTATGCAAA TATCGCTGAATAGAAACAGATGGA |
| 223 | cDNA T-cells | Hs.77729 | AB010710 | 2828355 | lectin-like oxidized LDL receptor | 1 | AGAACAAACTAAGCCAGGTATGCAAA TATCGCTGAATAGAAACAGATGGA |
| 224 | cDNA T-cells | Hs.78148 | M28526 | 189775 | platelet endothelial cell adhesion molecule (PECAM-1) | 1 | GCAATTCCTCAGGCTAAGCTGCCGGT TCTTAAATCCATCCTGCTAAGTTA |
| 225 | cDNA T-cells | Hs.78225 | NM_000700 | 4502100 | annexin A1 (ANXA1), mRNA/cds = (74, 1114)/gb = N | 1 | TCCTGGTGGCTCTTTGTGGAGGAAAC TAAACATTCCCTTGATGGTCTCAA |
| 226 | literature | Hs.785 | NM_000419 | 6006009 | integrin, alpha 2b (platelet glycoprotein IIb | 1 | CTTTGGGTTGGAGCTGTTCCATTGGG TCCTCTTGGTGTCGTTTCCCTCCC |
| 227 | cDNA T-cells | Hs.78713 | NM_002635 | 4505774 | solute carrier family 25 (mitochondrial carri | 1 | AGAAAAAGCTTGGGTTAACTCAGTAG TTAGATCAAAGCAAATGTGGACTG |
| 228 | cDNA T-cells | Hs.78864 | M31932 | 182473 | IgG low affinity Fc fragment receptor (FcRIIa) mRNA, c | 1 | ACAGATGTAGCAACATGAGAAACGCT TATGTTACAGGTTACATGAGAGCA |
| 229 | cDNA T-cells | Hs.789 | X54489 | 34825 | melanoma growth stimulatory activity (MGSA) | 1 | TGTTTAATGGTAGTTTTACAGTGTTTC TGGCTTAGAACAAAGGGGCTTAA |
| 230 | literature | Hs.78996 | BC000491 | 12653440 | proliferating cell nuclear antigen | 1 | TGCCAGCATATACTGAAGTCTTTTCT GTCACCAAATTTGTACCTCTAAGT |
| 231 | cDNA T-cells | Hs.79008 | NM_012245 | 6912675 | SKI-INTERACTING PROTEIN (SNW1), mRNA/cds = (2 | 1 | GCTGCATATGAGTAAAGTTACCCCAA CCACAGTGAGGAGGAAGATGTTCA |
| 232 | cDNA T-cells | Hs.79022 | U10550 | 762886 | Gem GTPase (gem) mRNA, complete cds/cds = (213, 1103)/ | 1 | AAACCTCCAGTACTTTGGTTGACCCT TGTATGTCACAGCTCTGCTCTATT |
| 233 | cDNA T-cells | Hs.79110 | NM_005381 | 4885510 | nucleolin (NCL). | 1 | ACCTGATCAATGACAGAGCCTTCTGA GGACATTCCAAGACAGTATACAGT |
| 234 | cDNA T-cells | Hs.79197 | NM_004233 | 4757945 | CD83 antigen (activated B lymphocytes, immuno | 1 | GCCCTTCCCTTCTTGGTTTCCAAAGG CATTTATTGCTGAGTTATATGTTC |
| 235 | cDNA T-cells | Hs.79630 | S75217 | 241773 | mb-1 = IgM-alpha | 1 | CTGATTGTAGCAGCCTCGTTAGTGTC ACCCCCTCCTCCCTGATCTGTCAG |
| 236 | cDNA T-cells | Hs.80358 | NM_004653 | 4759149 | SMC (mouse) homolog, Y chromosome (SMCY), mRNA | 1 | ACCAAAAAGAATAGGGAAAAA CAAGAATTTCATGACTCTACCTGT GGTCT |
| 237 | cDNA T-cells | Hs.80420 | U84487 | 1888522 | CX3C chemokine precursor, mRNA, alternatively splice | 1 | GACTTTTCCAACCCTCATCACCAACG TCTGTGCCATTTTGTATTTTACTA |
| 238 | cDNA T-cells | Hs.80617 | NM_001020 | 14591912 | ribosomal protein S16 (RPS16), mRNA/cds = (37, 4 | 1 | GCTCGCTACCAGAAATCCTACCGATA AGCCCATCGTGACTCAAAACTCAC |
| 239 | cDNA T-cells | Hs.80642 | L78440 | 1479978 | STAT4 mRNA, complete cds /cds = (81, 2327)/gb = L | 1 | ACCTGAGTCCCACAACAATTGAAACT GCAATGAAGTCTCCTTATTCTGCT |
| 240 | cDNA T-cells | Hs.81226 | X60992 | 29817 | CD8 mRNA for T cell glycoprotein CD8/cds = (120, 152 | 1 | AATTGATGAGGATGCTCCTGGGAGG GATGCTGACTATGTGGTGTTGCAC |
| 241 | cDNA T-cells | Hs.8128 | NM_014338 | 13489111 | phosphatidylserine decarboxylase (PISD). | 1 | TGAAATATGGGAAAGTTGCTGCTATT GATTCAGGGTCTGTCTTGGAGGCA |
| 242 | cDNA T-cells | Hs.81584 | NM_002619 | 4505732 | platelet factor 4 (PF4), mRNA. | 1 | CAACTGATAGCCACGCTGAAGAATGG AAGGAAAATTTGCTTGGACCTGCA |
| 243 | cDNA T-cells | Hs.81665 | X06182 | 34084 | c-kit proto-oncogene mRNA /cds = (21, 2951)/gb = X06182 | 1 | TGTGTAAATACATAAGCGGCGTAAGT TTAAAGGATGTTGGTGTTCCACGT |
| 244 | cDNA T-cells | Hs.82132 | NM_002460 | 4505286 | 50 interferon regulatory factor 4 (IRF4), mRNA/ | 1 | AACCCTCCTCCAATGGAAATTCCCGT GTTGCTTCAAACTGAGACAGATGG |

TABLE 8-continued

| SEQ ID | Origin | Unigene | Locus | GI | Nominal Description | Strand | Probe Sequence |
|---|---|---|---|---|---|---|---|
| 245 | cDNA T-cells | Hs.82132 | NM_002460 | 4505286 | 60 interferon regulatory factor 4 (IRF4), mRNA/ | 1 | CCTCCAATGGAAATTCCCGTGTTGCT TCAAACTGAGACAGATGGGACTTAAC AGGCAATG |
| 246 | cDNA T-cells | Hs.82132 | NM_002460 | 4505286 | 70 interferon regulatory factor 4 (IRF4), mRNA/ | 1 | CCAACCCTCCTCCAATGGAAATTCCC GTGTTGCTTCAAACTGAGACAGATGG GACTTAACAGGCAATGGG |
| 247 | literature | Hs.82359 | X63717 | 28741 | APO-1 cell surface antigen /cds = (220, 122 | 1 | AATCATCATCTGGATTAGGAATTGC TCTTGTCATACCCCCAAGTTTCTA |
| 248 | literature | Hs.82401 | NM_001781 | 4502680 | CD69 antigen (p60, early T-cell) Activated B & T cells. | 1 | GCAAGACATAGAATAGTGTTGGAAAA TGTGCAATATGTGATGTGGCAAAT |
| 249 | cDNA T-cells | Hs.279841 | NM_006296 | 5454163 | vaccinia related kinase 2 (VRK2), mRNA/cds = (1 | 1 | TCTCCATCTTGGTATAAATACACTTCC ACAGTCAGCACGGGGATCACAGA |
| 250 | cDNA T-cells | Hs.82829 | M25393 | 190740 | protein tyrosine phosphatase (PTPase) mRNA, complete | 1 | TCTCCTTACTGGGATAGTCAGGTAAA CAGTTGGTCAAGACTTTGTAAAGA |
| 251 | literature | Hs.82848 | NM_000655 | 5713320 | selectin L (lymphocyte adhesion molecule 1) ( | 1 | ACCCATGATGAGCTCCTCTTCCTGGC TTCTTACTGAAAGGTTACCCTGTA |
| 252 | cDNA T-cells | Hs.83077 | D49950 | 1405318 | for interferon-gamma inducing activated macrophages | 1 | TGACATCATATTCTTTCAGAGAAGTG TCCCAGGACATGATAATAAGATGC |
| 253 | cDNA T-cells | Hs.83086 | L38935 | 1008845 | GT212 mRNA/cds = UNKNOWN /gb = L38935/gi = 100884 | 1 | ATCAGAAACCGAAGATTAACTACACA GCTCCAGAAGACTCAGACCTCAAA |
| 254 | cDNA T-cells | Hs.83583 | NM_005731 | 5031598 | actin related protein 2/3 complex, subunit 2 ( | 1 | CAGGTTCTTAAGGGATTCTCCGTTTT GGTTCCATTTTGTACACGTTTGGA |
| 255 | cDNA T-cells | Hs.83731 | NM_001772 | 4502654 | CD33 antigen (gp67) (CD33), mRNA. | 1 | CTAGAAGATCCACATCCTCTACAGGT CGGGGACCAAAGGCTGATTCTTGG |
| 256 | cDNA T-cells | Hs.838 | NM_005191 | 4885122 | CD80 antigen (CD28 antigen ligand 1, B7-1 antig | 1 | CTTCTTTTGCCATGTTTCCATTCTGCC ATCTTGAATTGTCTTGTCAGCCA |
| 257 | literature | Hs.83968 | NM_000211 | 4557885 | integrin, beta 2 (antigen CD18 (p95), macrophage antigen 1 (mac-1) | 1 | CATGGAGACTTGAGGAGGGCTTGAG GTTGGTGAGGTTAGGTGCGTGTTTC |
| 258 | literature | Hs.84 | D11086 | 303611 | interleukin 2 receptor gamma chain | 1 | CCCATGTAAGCACCCCTTCATTTGGC ATTCCCCACTTGAGAATTACCCTT |
| 259 | cDNA T-cells | Hs.845 | U31120 | 1045451 | interleukin-13 (IL-13) precursor gene, activated T cells | 1 | CTTGGGCCAGACTGTCAGGGTTCAA GGAGGGCATCAGGAGCAGACGGAGA |
| 260 | cDNA T-cells | Hs.85258 | M12824 | 339426 | T-cell differentiation antigen Leu-2/T8 mRNA | 1 | CCTCCGCTCAACTAGCAGATACAGG GATGAGGCAGACCTGACTCTCTTAA |
| 261 | cDNA T-cells | Hs.85266 | X51841 | 33910 | mRNA for integrin beta(4)subunit | 1 | CAGCGGAACCCTTAGCACCCACATG GACCAACAGTTCTTCCAAACTTGAC |
| 262 | literature | Hs.856 | NM_000619 | 10835170 | interferon, gamma (IFNG), mRNA T-cells, NK cells | 1 | ATGCCTGGTGCTTCCAAATATTGTTG ACAACTGTGACTGTACCCAAATGG |
| 263 | cDNA T-cells | Hs.87149 | M35999 | 183532 | platelet glycoprotein IIIa (GPIIIa) mRNA, complete c | 1 | CCTCTCTCCAAACCCGTTTTCCAACA TTTGTTAATAGTTACGTCTCTCCT |
| 264 | cDNA T-cells | Hs.87409 | X14787 | 37464 | thrombospondin/cds = (111, 3823) /gb = X14787 | 1 | TCATTTGTTGTGTGACTGAGTAAAGA ATTTTTGGATCAAGCGGAAAGAGT |
| 265 | cDNA T-cells | Hs.88474 | M59979 | 189886 | prostaglandin endoperoxide synthase | 1 | TGAGGATGTAGAGAGAACAGGTGGG CTGTATTCACGCCATTGGTTGGAAG |
| 266 | cDNA T-cells | Hs.88820 | NM_018849 | 7705402 | HDCMC28P protein (HDCMC28P). | 1 | GAAATTAAATGGGTTCCAGGTCTTAA AGAAAGTGCAGAAGAGATGGTCAA |
| 267 | cDNA T-cells | NA | AQ338195 | 4143104 | cDNA clone IMAGE:4143104 blood 3' read | 1 | AACCACTATCATCTACGGCACAAACT TGCAAAAGCTGTCCACACCATTTT |
| 268 | literature | Hs.89137 | X13916 | 34338 | LDL-receptor related protein | 1 | CCCGTTTTGGGGACGTGAACGTTTTA ATAATTTTTGCTGAATTCTTTACA |
| 269 | cDNA T-cells | Hs.89414 | AF147204 | 6002763 | chemokine receptor CXCR4-Lo (CXCR4) mRNA, alt | 1 | TCAGTTTTCAGGAGTGGGTTGATTTC AGCACCTACAGTGTACAGTCTTGT |
| 270 | cDNA T-cells | Hs.89476 | M16338 | 180093 | T-cell surface antigen CD2 (T11) mRNA, complete cds, c | 1 | AGCCTATCTGCTTAAGAGACTCTGGA GTTTCTTATGTGCCCTGGTGGCAA |
| 271 | cDNA T-cells | Hs.89575 | M89957 | 179311 | immunoglobulin superfamily member B cell receptor co | 1 | GAGTAGAAGGACAACAGGGCAGCAA CTTGGAGGGAGTTCTCTGGGGATGG |
| 272 | literature | Hs.89879 | NM_000586 | 10835148 | 50 interleukin 2 (IL2). | 1 | GTTCTGGAACTAAAGGGATCTGAAAC AACATTCATGTGTGAATATGCAGA |
| 273 | literature | Hs.89879 | NM_000586 | 10835148 | 60 interleukin 2 (IL2). | 1 | TGGAACTAAAGGGATCTGAAACAACA TTCATGTGTGAATATGCAGATGAGAC AGCAACCA |
| 274 | literature | Hs.89879 | NM_000588 | 10835148 | 70 interleukin 2 (IL2). | 1 | CAGGGACTTAATCAGCAATATCAACG TAATAGTTCTGGAACTAAAGGGATCT GAAACAACATTCATGTGT |
| 275 | cDNA T-cells | Hs.89751 | NM_021950 | 11386188 | CD20 antigen | 1 | ACCCATTCCATTTATCTTTCTACAGG GCTGACATTGTGGCACATTCTTAG |
| 276 | cDNA T-cells | Hs.89887 | D38081 | 533325 | thromboxane A2 receptor | 1 | TGAACCTCCAACAGGGAAGGCTCTGT CCAGAAAGGATTGAATGTGAAACG |
| 277 | cDNA T-cells | Hs.93304 | U24577 | 1314245 | LDL-phospholipase A2 mRNA, complete cds/cds = (216, 15 | 1 | TGAAGGAGATGATGAGAATCTTATTC CAGGGACCAACATTAACACAACCA |
| 278 | cDNA T-cells | Hs.93649 | NM_003367 | 4507846 | upstream transcription factor 2, c-fos intera | 1 | CTCTCTGGAGGTACTGAGACAGGGT GCTGATGGGAAGGAGGGGAGCCTTT |
| 279 | literature | Hs.93913 | X04430 | 32673 | IFN-beta 2a mRNA for interferon-beta-2, T-cells, macrophages | 1 | CTCTTCGGCAAATGTAGCATGGGCAC CTCAGATTGTTGTTGTTAATGGGC |
| 280 | cDNA | Hs.960 | NM_000590 | 10834979 | interleukin 9 (IL9). | 1 | TTCCAGAAAGAAAAGATGAGAGGGAT |

TABLE 8-continued

| SEQ ID | Origin | Unigene | Locus | GI | Nominal Description | Strand | Probe Sequence |
|---|---|---|---|---|---|---|---|
| 281 | cDNA T-cells | Hs.96023 | M28170 | 882622 | cell surface protein CD19 (CD19) gene, Most B cells | 1 | GAGAGGCAAGATATGAAGATGAAA GGCCAGCCTGGACCCAATCATGAGG AAGATGCAGACTCTTATGAGAACAT |
| 282 | cDNA T-cells | Hs.96487 | BF222826 | 11130003 | ESTs, Highly similar to SO8228 ribosomal protein S2, cytosolic | 1 | AATGTTTGCCCAGAATAAAGAAAATA AGCTTTGCACACACTCTCAATTCT |
| 283 | cDNA T-cells | Hs.9663 | NM_013374 | 7019486 | programmed cell death 6-interacting protein (PDCD6IP). | 1 | GGGAAAGAAATACCAACCCTGCAATA AGTGTACTAAACTCTACGCTCTGG |
| 284 | cDNA T-cells | Hs.96731 | AB014555 | 3327123 | mRNA for KIAA1375 protein, partial cds/cds = (0 | 1 | CACCAGCGCCTTGGCTTTGTGTTAGC ATTTCCTCCTGAAGTGTTCTGTTG |
| 285 | literature | Hs.99863 | NM_001972 | 4503548 | elastase 2, neutrophil (ELA2). | 1 | ACATCGTGATTCTCCAGCTCAACGGG TCGGCCACCATCAACGCCAACGTG |
| 286 | cDNA T-cells | Hs.99899 | NM_001252 | 4507604 | tumor necrosis factor (ligand) superfamily, member 7 (TNFSF7) | 1 | AGCTACGTATCCATCGTGATGGCATC TACATGGTACACATCCAGGTGACG |
| 287 | literature | Hs.169476 | NM_002048 | 7669491 | 50 Glyceraldehyde-3-phosphate dehydrogenase | 1 | CCACACTGAATCTCCCCTCCTCACAG TTGCCATGTAGACCCCTTGAAGAG |
| 288 | literature | Hs.169476 | NM_002048 | 7689491 | 60 Glyceraldehyde-3-phosphate dehydrogenase | 1 | CAGTCCCCCACCACACTGAATCTCCC CTCCTCACAGTTGCCATGTAGACCCC TTGAAGAG |
| 289 | literature | Hs.169476 | NM_002048 | 7669491 | 70 Glyceraldehyde-3-phosphate dehydrogenase | 1 | CCATGTAGACCCCTTGAAGAGGGGA GGGGCCTAGGGAGCCGCACCTTGTC ATGTACCATCAATAAAGTAC |
| 290 | literature | Hs.169478 | NM_002048 | 7669491 | 50 Complement Glyceraldehyde-3-phosphate dehydrogenase | -1 | CTCTTCAAGGGGTCTACATGGCAACT GTGAGGAGGGGAGATTCAGTGTGG |
| 291 | literature | Hs.169476 | NM_002048 | 7669491 | 60 Complement Glyceraldehyde-3-phosphate dehydrogenase | -1 | CTCTTCAAGGGGTCTACATGGCAACT GTGAGGAGGGGAGATTCAGTGTGGT GGGGGACTG |
| 292 | literature | Hs.169476 | NM_002048 | 7669491 | 70 Complement Glyceraldehyde-3-phosphate dehydrogenase | -1 | GTACTTTATTGATGGTACATGACAAG GTGCGGCTCCCTAGGCCCCTCCCCT CTTCAAGGGGTCTACATGG |
| 293 | literature | Hs.182937 | NM_021130 | 10883926 | 50 peptidylprolyl isomerase A (cyclophilin A), clone | 1 | TTTCCTTGTTCCCTCCCATGCCTAGC TGGATTGCAGAGTTAAGTTTATGA |
| 294 | literature | Hs.182937 | NM_021130 | 10883926 | 60 peptidylprolyl isomerase A (cyclophilin A), clone | 1 | TTTCCTTGTTCCCTCCCATGCCTAGC TGGATTGCAGAGTTAAGTTTATGATT ATGAAATA |
| 295 | literature | Hs.182937 | NM_021130 | 10883926 | 70 peptidylprolyl isomerase A (cyclophilin A), clone | 1 | GTTCCATGTTTTCCTTGTTCCCTCCC ATGCCTAGCTGGATTGCAGAGTTAAG TTTATGATTATGAAATAA |
| 296 | literature | Hs.182937 | NM_021130 | 10863926 | 50 complement peptidylprolyl isomerase A (cyclophilin A), clone | -1 | TCATAAACTTAACTCTGCAATCCAGC TAGGCATGGGAGGGAACAAGGAAA |
| 297 | literature | Hs.182937 | NM_021130 | 10883926 | 60 complement peptidylprolyl isomerase A (cyclophilin A), clone | -1 | TATTTCATAATCATAAACTTAACTCTG CAATCCAGCTAGGCATGGGAGGGAA CAAGGAAA |
| 298 | literature | Hs.182937 | NM_021130 | 10883926 | 70 complement peptidylprolyl isomerase A (cyclophilin A), clone | -1 | TTATTTCATAATCATAAACTTAACTCT GCAATCCAGCTAGGCATGGGAGGGA ACAAGGAAAACATGGAAC |
| 299 | literature | Hs.288883 | NM_005877 | 5032088 | mRNA for splicing factor (SF3A1) (120 kD) | 1 | GTCATCCACCTGGCCCTCAAGGAGA GAGGCGGGAGGAAGAAGTAGACAAG |
| 300 | literature | Hs.12084 | NM_003321 | 4507732 | Tu translation elongation factor, mitochondrial (TUFM) | 1 | TGACTGAGGAGGAGAAGAATATCAAA TGGGGTTGAGTGTGCAGATCTCTG |
| 301 | literature | Hs.75887 | NM_004371 | 6996002 | coatomer protein complex, subunit alpha (COPA) | 1 | TGGTTTTCCAAAATGCACACTGCGGG TTATTGATTTGTTCTTTACAACTA |
| 302 | literature | Hs.182278 | NM_001743 | 4502548 | calmodulin 2 (phosphorylase kinase, delta) (CALM2). | 1 | ACTGTCAGCATGTTGTTGTTGAAGTG TGGAGTTGTAACTCTGCGTGGACT |
| 303 | literature | Hs.2795 | NM_005568 | 5031856 | mRNA for lactate dehydrogenase-A (LDH-A, EC 1.1.1.27) | 1 | TGAGTCACATCCTGGGATCCAGTGTA TAAATCCAATATCATGTCTTTGTGC |
| 304 | literature | Hs.1708 | NM_005998 | 5174726 | chaperonin containing TCP1, subunit 3 (gamma) (CCT3). | 1 | GTTCTGCTACTGCGAATTGATGACAT CGTTTCAGGCCACAAAAAGAAAGG |
| 305 | literature | Hs.75428 | NM_000454 | 4507148 | superoxide dismutase (SOD-1) mRNA, complete cds. | 1 | ACATTCCCTTGGATGTAGTCTGAGGC CCCTTAACTCATCTGTTATCCTGC |
| 306 | literature | Hs.2271 | NM_001955 | 4503460 | Arabidopsis endothelin-1 (EDN1) | 1 | ACTGGCTTCCATCAGTGGTAACTGCT TTGGTCTCTTCTTTCATCGGGGA |
| 307 | literature | NA | X56062 | 16208 | Arabidopsis CAB photosystem 1 chlorophyll a/b-binding protein (500 bp) | 1 | CCATTGGAGAACTTGGCAACTCACTT GGCGGATCCATGGCACAACAACAT |
| 308 | literature | NA | X14212 | 16470 | Arabidopsis RCA RUBISCO activase (513) | 1 | TTTTCTCCTTTGTGTAATTGTGGATTG GATCTTGTCCTCTTTTGTTCCCT |
| 309 | literature | NA | U91968 | 1928871 | Arabidopsis RBCL ribulose-1,5-biophosphate carboxylase/ oxygenase large subunit | 1 | TATTCTTTCGTGTCAGGGCTTGAACC AAGTATCCCCGCTTCTTCTACCCC |
| 310 | literature | NA | AF159801 | 8571922 | Arabidopsis lipid transfer protein 4 (527) | 1 | CATCAAGTGAAGTGGGGAATAACGAC ATCATTTGCCTGAAGAGTATGTT |
| 311 | literature | NA | AF159803 | 8571926 | Arabidopsis lipid transfer protein 6 (477) | 1 | AATGAGGGCATTGGTTTGCTAGTTGC TAATTGATCAGTGATGTATTGTCA |
| 312 | literature | NA | AF191028 | 6708182 | Arabidopsis papain-type cysteine endopepidase (507) | 1 | TGGAATCAACAAGATGGCTTCTTTCC CCACCAAAACTAAGTGATCATCAG |
| 313 | literature | NA | AF168390 | 6137137 | Arabidopsis root cap 1 (533) | 1 | TGGACCGTAATGAATGAATGTACACG |

TABLE 8-continued

| SEQ ID | Origin | Unigene | Locus | GI | Nominal Description | Strand | Probe Sequence |
|---|---|---|---|---|---|---|---|
| 314 | literature | NA | AF198054 | 6649235 | Arabidopsis NAC1 (457) | 1 | CCATAAACGCCCTTTGTTCAAGCA CCTCACTCTTGTACCCACGGTAGATT CATGTAAAATACCACTTATGACGC |
| 315 | literature | NA | AF247559 | 7839390 | Arabidopsis triosphosphate isomerase (498) | 1 | GGTTAGCGACCTTGTTGTTGTTGTTG TGTTCTTACATCTTCTTCTTGAAC |
| 316 | literature | NA | X58149 | 16440 | Arabidopsis PRKase gene for ribulose-5-phosphate kinase (497) | 1 | GGCGAAAAGGACGGTCTTGCTTGTTT GTAATTTGTGTGGAGATAAAAAGA |
| 317 | literature | Hs.288061 | NM_001101 | 5016088 | actin, beta (ACTB). | 1 | CCCTTTTTGTCCCCCAACTTGAGATG TATGAAGGCTTTTGGTCTCCCTGG |
| 318 | literature | Hs.77356 | XM_002788 | 4507456 | 50 Transferrin receptor | 1 | TGAAATATCAGACTAGTGACAAGCTC CTGGTCTTGAGATGTCTTCTCGTT |
| 319 | literature | Hs.77356 | XM_002788 | 4507456 | 60 Transferrin receptor | 1 | GGTTGAGTTACTTCCTATCAAGCCAG TACCGTGCTAACAGGCTCAATATTCC TGAATGAA |
| 320 | literature | Hs.77356 | XM_002788 | 4507456 | 70 Transferrin receptor | 1 | GTTGAGTTACTTCCTATCAAGCCAGT ACCGTGCTAACAGGCTCAATATTCCT GAATGAAATATCAGACTA |
| 321 | literature | Hs.77356 | XM_002788 | 4507456 | 50 Complement Transferrin receptor | -1 | AACGAGAAGACATCTCAAGAC CAGGAGCTTGTCACTAGTCTGA TATTTCA |
| 322 | literature | Hs.77356 | XM_002788 | 4507456 | 60 Complement Transferrin receptor | -1 | TTCATTCAGGAATATTGAGCCTGTTA GCACGGTACTGGCTTGATAGGAAGTA ACTCAACC |
| 323 | literature | Hs.77356 | XM_002788 | 4507456 | 70 Complement Transferrin receptor | -1 | TAGTCTGATATTTCATTCAGGAATATT GAGCCTGTTAGCACGGTACTGGCTT GATAGGAAGTAACTCAAC |
| 324 | Table 3A | NA | | | 36E9 | 1 | TTTCAAGACAGAAAGTGACGCA GAGAACCTCCCCGGCCCAGTCTCG ACGC |
| 325 | Table 3A | NA | | | 38E9 | -1 | GCGTCGAGACTGGGCCGGGGAGGTT CTCTGCGTCACTTTCTGTCTTGAAA |
| 326 | Table 3A | NA | | | 47D11 | 1 | CCTAGACACCTGCATCAGTCAAGGTC ATGGATATTGGGAAGACAGACAGC |
| 327 | Table 3A | NA | | | 47D11 | -1 | GCTGTCTGTCTTCCCAATATCCATGA CCTTGACTGATGCAGGTGTCTAGG |
| 328 | Table 3A | NA | | | 53G7 | 1 | AAATAAGAAGAGGAAAGAGAGAGGC CTGCCCTAACCCACTGTTGTGCTGA |
| 329 | Table 3A | NA | | | 53G7 | -1 | TCAGCACAACAGTGGGTTAGGGCAG GCCTCTCTCTTTCCTCTTCTTATTT |
| 330 | Table 3A | NA | | | 82C9 | 1 | CTCATGCCTGCAGTGCTGCTCATGTT GCCCCCTTGGAATTACTTGTTCAA |
| 331 | Table 3A | NA | | | 82C9 | -1 | TTGAACAAGTAATTCCAAGGGGGCAA CATGAGCAGCACTGCAGGCATGAG |
| 332 | Table 3A | NA | | | 82G9 | 1 | CCAATTTCTATAATTATTGAACAGCTT TTCGTGGGGCCAGCACAAAGTCT |
| 333 | Table 3A | NA | | | 82G9 | -1 | AGACTTTGTGCTGGCCCCACGAAAAG CTGTTCAATAATTATAGAAATTGG |
| 334 | Table 3A | NA | | | 65B1 | 1 | TGGCTACAAATAGAGTAGAGAACAGA CTCCAGTCCTCAAAGACTTTCAGT |
| 335 | Table 3A | NA | | | 65B1 | -1 | ACTGAAAGTCTTTGAGGACTGGAGTC TGTTCTCTACTCTATTTGTAGCCA |
| 336 | Table 3A | NA | | | 65D10 | 1 | AGTTAAGATGGAAGAATATAGAGACC TTCTGAAGAGCACTGTAGCTTGGA |
| 337 | Table 3A | NA | | | 65D10 | -1 | TCCAAGCTACAGTGCTCTTCAGAAGG TCTCTATATTCTTCCATCTTAACT |
| 338 | Table 3A | NA | | | 100D7 | 1 | CACTCCTATGGCATGTGGAAGCAGGT CTGAGCAGTGCATAGAAGAAAA |
| 339 | Table 3A | NA | | | 100D7 | -1 | TTTTCTTCTATGCACACTGCTCAGAC CTGCTTCCACATGCCATAGGAGTG |
| 340 | Table 3A | NA | | | 107H8 | 1 | GCTCTCCGTTGACAATGGCCAAAGAA TAGAAGCTCTAGACCTTCCTTATT |
| 341 | Table 3A | NA | | | 107H8 | -1 | AATAAGGAAGGTCTAGAGCTTCTATT CTTTGGCCATTGTCAACGGAGAGC |
| 342 | Table 3A | NA | | | 129F10 | 1 | GGCAAAACGCACCTGGCACAACAGA ACGAATAATACAGAAGCTGGATGAC |
| 343 | Table 3A | NA | | | 129F10 | -1 | GTCATCCAGCTTCTGTATTATTCGTTC TGTTGTGCCAGGTGCGTTTTGCC |
| 344 | Table 3A | NA | | | 137B5 | 1 | TAGCCATTTCTTCCTGATTGTGCCTA GTATATCCCAGACAGTTTGTTTCT |
| 345 | Table 3A | NA | | | 137B5 | -1 | AGAAACAAACTGTCTGGGATATACTA GGCACAATCAGGAAGAAATGGCTA |
| 346 | Table 3A | NA | | | 139G6 | 1 | GGTTGGAATGGTGATCGGGATGCAG TGAGATACTCTTGTGAGAGGGCAAA |
| 347 | Table 3A | NA | | | 139G6 | -1 | TTTGCCCTCTCACAAGAGTATCTCAC TGCATCCCGATCACCATTCCAACC |
| 348 | Table 3A | NA | | | 142E4 | 1 | GCCATGAGATTCAACAGTCAACATCA |

TABLE 8-continued

| SEQ ID | Origin | Unigene | Locus | GI | Nominal Description | Strand | Probe Sequence |
|---|---|---|---|---|---|---|---|
| 349 | Table 3A | NA | | 142E4 | | -1 | GTCTGATAAGCTACCCGACAAAGT ACTTTGTCGGGTAGCTTATCAGACTG |
| 350 | Table 3A | NA | | 142E9 | | 1 | ATGTTGACTGTTGAATCTCATGGC AAGAGGACAAGTTTGAGAGGCAACA |
| 351 | Table 3A | NA | | 142E9 | | -1 | CTTAAACACTAGGGCTACTGTGGCA TGCCACAGTAGCCCTAGTGTTTAAGT |
| 352 | Table 3A | NA | | 142F9 | | 1 | GTTGCCTCTCAAACTTGTCCTCTT ATTTGCTTTAAATTGAGTTTCCTTGCC |
| 353 | Table 3A | NA | | 142F9 | | -1 | ATTGCACACTCCTATCTTTCTGA TCAGAAAGATAGGAGTGTGCAATGGC |
| 354 | Table 3A | NA | | 331A3 | | 1 | AAGGAAACTCAATTTAAAGCAAAT AAAAGTCACTACCAGGCTGGCAGGG |
| 355 | Table 3A | NA | | 331A3 | | -1 | AATGGGGCAATCTATTCATACTGAT ATCAGTATGAATAGATTGCCCCATTC |
| 356 | Table 3A | NA | | 138G5 | | 1 | CCTGCCAGCCTGGTAGTGACTTTT ATATTGATTTGGATACGGTGAATAAG |
| 357 | Table 3A | NA | | 138G5 | | -1 | CTGGACAAGATGTTGAGGAGAGGG CCCTCTCCTCAACATCTTGTCCAGCT |
| 358 | Table 3A | NA | | 145C5 | | 1 | TATTCACCGTATCCAAATCAATAT AATGTGCAAGGTGAAATGCTTTTGGA |
| 359 | Table 3A | NA | | 145C5 | | -1 | TAAACGTAAGCCTATTTTCTGACG CGTCAGAAAATAGGCTTACGTTTATC |
| 360 | Table 3A | NA | | 184H1 | | 1 | CAAAAGCATTTCACCTTGCACATT TTCATCTCTAAGGCACACTTGCTACC |
| 361 | Table 3A | NA | | 184H1 | | -1 | CCTCTTTGCTGACCCCAGATTGTG CACAATCTGGGGTCAGCAAAGAGGG |
| 362 | Table 3A | NA | | 45B9 | | 1 | GTAGCAAGTGTGCCTTAGAGATGAA TTCTGGCAAGCTCTTGTCATGGTGTT |
| 363 | Table 3A | NA | | 45B9 | | -1 | CGACACTTCCTTCTGTCTTCTTGG CCAAGAAGACAGAAGGAAGTGTCGA |
| 364 | Table 3A | NA | | 112B5 | | 1 | ACACCATGACAAGAGCTTGCCAGAA GGTCAATGTAGCCAATTATTTGTTTCA |
| 365 | Table 3A | NA | | 112B5 | | -1 | ACAGTTGCAGAACAGATATTTCA TGAAATATCTGTTCTGCAACTGTTGA |
| 366 | Table 3A | NA | | 117H9 | | 1 | AACAAATAATTGGCTACATTGACC TGAAAAGACAGCTAATTTGGTCCAAC |
| 367 | Table 3A | NA | | 117H9 | | -1 | AAACATGACTGGGTCTAGGGCACC GGTGCCCTAGACCCAGTCATGTTTGT |
| 368 | Table 3A | NA | | 515H10 | | 1 | TGGACCAAATTAGCTGTCTTTTCA TGGATCATTGCCCAAAGTTGCACGCA |
| 369 | Table 3A | NA | | 515H10 | | -1 | CTGACTCCTTACCTGTGAGGAATG CATTCCTCACAGGTAAGGAGTCAGTG |
| 370 | Table 3A | NA | | 103C4 | | 1 | CGTGCAACTTTGGGCAATGATCCA TTAAAACATTAAAAGATTGACTCCACT |
| 371 | Table 3A | NA | | 103C4 | | -1 | TTGTGCCAAGCTCTGCGGGTAGG CCTACCCGCAGAGCTTGGCACAAAG |
| 372 | Table 3A | NA | | 116E10 | | 1 | TGGAGTCAATCTTTTAATGTTTTAA TGAAATTTGGAGTCCCTGGCACATAAA |
| 373 | Table 3A | NA | | 116E10 | | -1 | TCTACCTTCAAATCAGAGGTCCTT AAGGACCTCTGATTTGAAGGTAGATT |
| 374 | Table 3A | NA | | 196D7 | | 1 | TATGTGCCAGGGACTCCAAATTCA TGGGTCAGAGACGAAAAGGGCTATTA |
| 375 | Table 3A | NA | | 196D7 | | -1 | TTAGGTCAAACATTACAGAAATCA TGATTTCTGTAATGTTTGACCTAATAA |
| 376 | Table 3A | NA | | 524A9 | | 1 | TAGCCCTTTTCGTCTCTGACCCA CTGATTAACAGGTGGTTCTGCGGGC |
| 377 | Table 3A | NA | | 524A9 | | -1 | GTCCAGGTCAACATCTTTTTGTCC GGACAAAAAGATGTTGACCTGGACG |
| 378 | Table 3A | NA | | 485A6 | | 1 | CCCGCAGAACCACCTGTTAAATCAG GTCACTTTAGCGAGCGGAAAACAAT |
| 379 | Table 3A | NA | | 485A6 | | -1 | GGCGGAAAGGGAAAACCTGGAAAG CTTTCCAGGTTTTCCCTTTCCGCCAT |
| 380 | Table 3A | NA | | 485D5 | | 1 | TGTTTTCCCGCTCGCTAAAGTGAC TAATTAATAGAGCTCACTTAAGATTGC |
| 381 | Table 3A | NA | | 485D5 | | -1 | CCATCAAGAAACAGGAGGGTGGT ACCACCCTCCTGTTTCTTGATGGGCA |
| 382 | Table 3A | NA | | 479G6 | | 1 | ATCTTAAGTGAGCTCTATTAATTA AGTCCTGCTGAATCATTGGTTTATAG |
| 383 | Table 3A | NA | | 479G6 | | -1 | AAGACTATCTGGAGGGCCTGATAG CTATCAGGCCCTCCAGATAGTCTTCT |
| 384 | Table 3A | NA | | 482A5 | | 1 | ATAAACCAATGATTCAGCAGGACT ATGTGATTCCATGATAATCAAATAGT |
| 385 | db mining | Hs.195219 | W83776 | 1371377 | hypothetical protein FLJ14486 (FLJ14486), mRNA/cds = (80, 1615) | 1 | GAATACATTATAAAGTCAGCAACT ATATATGGGGGCTGGGCCTCGGGAC TCTCGCTCTAATAAAGGACTGTAGG |

TABLE 8-continued

| SEQ ID | Origin | Unigene | Locus | GI | Nominal Description | Strand | Probe Sequence |
|---|---|---|---|---|---|---|---|
| 386 | Table 3A | Hs.183454 | AK027789 | 14042727 | cDNA FLJ14883 fis, clone PLACE1003596, moderately similar to OLIGOSACCHARYL TRANSFERASE STT3 SUBUNIT/cds = (2, 862) | 1 | TTTTGACCCAGATGATGGTTCCTTTA CAGAACAATAAAATGGCTGAACAT |
| 387 | db mining | Hs.69171 | NM_006256 | 5453973 | protein kinase C-like 2 (PRKCL2), mRNA/cds = (9, 2963) | 1 | TGAGCACTGGAAACAGTTTCATGGAG TTTAAGTTGAGTGAACATCGGCCA |
| 388 | Table 3A | Hs.131828 | R67468 | 840106 | EST390979 cDNA | 1 | ATGCATTTAGTTTTTGGCACCGTAGT TTAAGGGTGGGATTGCCAGTTTT |
| 389 | Table 3A | Hs.181297 | AA010282 | 1471308 | tc35a11.x1 cDNA, 3' end /clone = IMAGE:2066588/ clone_end = 3' | 1 | GGTTGTGTCTCTGGTTTCCCCTTTTC CCCGTGGTTTTAATTTTTAAGAAC |
| 390 | Table 3A | Hs.235883 | AA020845 | 1484616 | 602628774F1 cDNA, 5' end /clone = IMAGE:4753483/ clone_end = 5' | 1 | GGAGGACACCCCTGTGTGTTGCTGC TGCCTTCCGTGCTGTCTACTGTATC |
| 391 | Table 3A | Hs.330145 | AA044450 | 1522307 | RST29149 cDNA | 1 | GCATCAGAGAGAATATGGAAGGACAT CGACCCTAACTTCATCCAGTGAGG |
| 392 | Table 3A | Hs.189468 | AA069335 | 1576904 | tm30a06.x1 cDNA, 3' end /clone = IMAGE:2158066/ clone_end = 3' | 1 | ACCATAGCAGACAGGGTCAGATGGA ATATTAGCGGTTTAGGTGAAGAACC |
| 393 | Table 3A | Hs.205675 | AA111921 | 1664016 | EST389824 cDNA | 1 | AGACAGAAGACAAGGCCAAATGGGT GTCTCTGGAATGATAGACTTAGAAA |
| 394 | Table 3A | Hs.13859 | AA115345 | 1670525 | mRNA; cDNA DKFZp586F2423 (from clone DKFZp586F2423) /cds = UNKNOWN | 1 | ATCCACATTCTTACCTTTGGTAGTCA GGTTTGGCTACTTTGCAGCTCGCC |
| 395 | Table 3A | Hs.11861 | AA122297 | 1678553 | thyroid hormone receptor-associated protein, 240 kDa subunit (TRAP240), mRNA/cds = (77, 6601) | 1 | ATAGCAGTGGATTACCAACACCTTGA CTTCTTGTACAGTGCTAACATCTT |
| 396 | Table 3A | Hs.183454 | AA149078 | 1719368 | cDNA FLJ14883 fis, clone PLACE1003596, moderately similar to OLIGOSACCHARYL TRANSFERASE STT3 SUBUNIT/cds = (2, 862) | 1 | TAGTAAAAGTGAAAGAGAAAGGGTTT TTCCTGCCACAGGATATAACTTTT |
| 397 | Table 3A | Hs.124601 | AA203497 | 1799265 | zx58g05.r1 cDNA, 5' end /clone = IMAGE:446744/ clone_end = 5' | 1 | AAAGCGGTCGTTTCCCCACAAGGTGT CCAACTTTGCGGTACTCACACTTA |
| 398 | Table 3A | Hs.73798 | AA210788 | 1809440 | macrophage migration inhibitory factor (glycosylation-inhibiting factor) (MIF), mRNA/cds = (97, 444) | 1 | CTAGGCCCGCCCACCCCAACCTTCT GGTGGGGAGAAATAAACGGTTTAGA |
| 399 | Table 3A | NA | AA214691 | 1814479 | Express cDNA library cDNA 5' | 1 | TGCACTAAACAGTTGCCCCAAAAGAC ATATCTTGTTTTAAGGCCCAGACC |
| 400 | Table 3A | NA | AA243144 | 1874139 | cDNA clone IMAGE:685113 5' | 1 | TTGGATGAAGCTGAAAAGACACTAAG ACCTTCTGTGCCTCAGATCCCTGA |
| 401 | Table 3A | Hs.135187 | AA250809 | 1885832 | zs06a08.r1 cDNA, 5' end | 1 | GTGTGGCCTAAGGAACACCTCTTGTG GGGAGTAAGAGCCAGCCCTTCTCC |
| 402 | Table 3A | Hs.100651 | AA251184 | 1886149 | golgi SNAP receptor complex member 2 (GOSR2), mRNA/cds = (0, 638) | 1 | AAGGATGAAGGACTGATGGAGGGCA GAGGAACTGGAGGCAGCAGGCACAA |
| 403 | Table 3A | NA | AA252909 | 1885512 | cDNA clone IMAGE:669292 5' | 1 | AGATGTCTGTATAAACAACCTTTGGG TAGCAGGTGGTCAGTTAGGCAGGA |
| 404 | Table 3A | Hs.194480 | AA258979 | 1894268 | EST389427 cDNA | 1 | TGCTTGTCTTTTAAACACCTTCACAGA TATCATTTGCACCTTGCCAAAGG |
| 405 | Table 3A | Hs.5241 | AA280051 | 1921589 | fatty acid binding protein 1, liver (FABP1), mRNA/cds = (42, 425) | 1 | GGGTAGGCAGCTTGCACCCAGTTCT CCTTTATCTCAACTTATTTTCCTGG |
| 406 | Table 3A | NA | AA282774 | 1925825 | cDNA clone IMAGE:713136 5' | 1 | CCGGTGTCCCTGAGTGAGGGCAAAG TTGTAATAACACTTGTTCTCTCCTT |
| 407 | Table 3A | Hs.89072 | AA283061 | 1926050 | hypothetical protein MGC4618 (MGC4618), mRNA/cds = (107, 1621) | 1 | ACGGCGTTCTGAAATTTAGCACACTG GGAAGTCCACATGGTTCATCTGAA |
| 408 | Table 3A | Hs.291448 | AA290921 | 1938772 | EST388168 cDNA | 1 | AATGAGATCACAGATGGTGACACTGA GCGGAAGGATGCAGTACCTCGGAG |
| 409 | Table 3A | Hs.211866 | AA290993 | 1938989 | wh99f02.x1 cDNA, 3' end /clone = IMAGE:2388891/ clone_end = 3' | 1 | TCCTTGCAAAACATTTGGCTAGTGGT GTTCAGAGAAATACCAAAACGTGT |
| 410 | Table 3A | Hs.323950 | AA307854 | 1960203 | zinc finger protein 6 (CMPX1) (ZNF6), mRNA/cds = (1285, 3381) | 1 | GGCAAAGGGGAAGGATGATGCCATG TAGATCCTGTTTGACATTTTTATGG |
| 411 | Table 3A | Hs.100293 | AA312681 | 1965030 | O-linked N-acetylglucosamine (GlcNAc) transferase (UDP-N-acetylglucosamine:polypeptide-N-acetylglucosaminyl transferase) (OGT), mRNA/cds = (2039, 4801) | 1 | ACTGTTAACCAAATTTTGAGCAAGGA GTCTCAAAGGTAATTCTGAACCAG |
| 412 | Table 3A | Hs.217493 | AA314369 | 1966698 | annexin A2 (ANXA2), mRNA /cds = (49, 1068) | 1 | ACTAGCAGATTGAATCGATATTCATTA AGTTAGGAATGGTTGGTGGTCCT |

TABLE 8-continued

| SEQ ID | Origin | Unigene | Locus | GI | Nominal Description | Strand | Probe Sequence |
|---|---|---|---|---|---|---|---|
| 413 | Table 3A | Hs.85844 | AA322158 | 1974484 | neurotrophic tyrosine kinase, receptor, type 1 (NTRK1), mRNA/cds = (0, 2390) | 1 | AATTGTGCTTTGTATCAGTCAGTGCT GGAGAAATCTTGAATAGCTTATGT |
| 414 | Table 3A | Hs.260238 | AA332553 | 1984806 | hypothetical protein FLJ10842 (FLJ10842), mRNA/cds = (39, 1307) | 1 | AGGAAACCAAGCCCTCACAGGAAAG AAAGCCTGAATCAAGAAAACAAAGT |
| 415 | Table 3A | Hs.323463 | AA360634 | 2012954 | mRNA for KIAA1693 protein, partial cds/cds = (0, 2707) | 1 | ACTGAGCAGGACAACTGACCTGTCTC CTTCACATAGTCCATATCACCACA |
| 416 | Table 3A | NA | AA377352 | 2029681 | EST89924 Small intestine II cDNA 5' end | 1 | GCGTAAAACGCCAGGGCCATCTTCTT ACTTAAGCCACATCCTGAACCAGG |
| 417 | Table 3A | Hs.27973 | AA397592 | 2050712 | KIAA0874 protein (KIAA0874), mRNA/cds = (0, 6188) | 1 | AGCGACAAGAAGGAATCTGGTGAATT TTAGTCATCCCAGCTTTTTAGTCT |
| 418 | Table 3A | Hs.343557 | AA401648 | 2056830 | 601500320F1 cDNA, 5' end /clone = IMAGE:3902237/ clone_end = 5' | 1 | GCTGGGGCTGAGAGAGGGTCTGGGT TATCTCCTTCTGATCTTCAAAACAA |
| 419 | Table 3A | Hs.186674 | AA402069 | 2056860 | qf56f06.x1 cDNA, 3' end /clone = IMAGE:1754051/ clone_end = 3' | 1 | TCATGGACACAAACTTTGGAGTATAA GCGACATCCCTTAAGCAACAGGCT |
| 420 | Table 3A | Hs.301985 | AA412436 | 2071006 | 602435787F1 cDNA, 5' end /clone = IMAGE:4553884/ clone_end = 5' | 1 | ATTCAAGTCAGGGCCTCTCTGCCCTT TTCCCTCCAGAAACAAAACCAAGA |
| 421 | Table 3A | Hs.9691 | AA418765 | 2080566 | cDNA: FLJ23249 fis, clone COL04196/cds = UNKNOWN | 1 | TGTTTGTACCACTAGCATTCTTATGTC TGTACTTGAACGTGTAGTTAGCA |
| 422 | Table 3A | Hs.24143 | AA426506 | 2106769 | Wiskott-Aldrich syndrome protein interacting protein (WASPIP), mRNA/cds = (108, 1619) | 1 | AATATAGCTCCACTAAAGGACCATAG GGAAGAGCCAGCCTTGCCTTTTCT |
| 423 | Table 3A | Hs.303214 | AA427653 | 2111519 | 7o45b01.x1 cDNA, 3' end /clone = IMAGE:3576912/ clone_end = 3' | 1 | GACAGTCCATTAAGTTGATTTCCAGT GGTGAAGGGTCAGACACGCCTCCC |
| 424 | Table 3A | Hs.89519 | AA429783 | 2112974 | KIAA1046 protein (KIAA1046), mRNA/cds = (577, 1782) | 1 | CCTGGGTTGCCTTGTAATGAAAAGGG AGATCGAGCCATTGTACCACCTTA |
| 425 | Table 3A | Hs.112071 | AA442585 | 2154463 | zv57f09.r1 cDNA, 5' end /clone = IMAGE:757769/ clone_end = 5' | 1 | GTTCACTGTTTAACAGCCAGAAGCCA GAGCCTGCGTACTAGAAGTGGATG |
| 426 | Table 3A | Hs.8832 | AA454036 | 2167705 | zx48b04.r1 cDNA, 5' end /clone = IMAGE:795439/ clone_end = 5' | 1 | TTGTCAAGTGGATCTGCCCCAAAGTT TGCTTTGAGGAAACGGGCCTCCCT |
| 427 | Table 3A | Hs.286148 | AA454987 | 2177763 | stromal antigen 1 (STAG1), mRNA/cds = (400, 4176) | 1 | CTTGTATGGAAAACAGATGCTGACAG AATTGTAGACTACCATGCCACACA |
| 428 | Table 3A | Hs.255452 | AA455707 | 2178483 | aa22d09.r1 cDNA, 5' end /clone = IMAGE:814001/ clone_end = 5' | 1 | AAATCTAAGACACCCAAACCCCTCTT TGTCCCTAAGTAGCCCTAGCCTGG |
| 429 | Table 3A | NA | AA457757 | 2180477 | fetal retina 937202 cDNA clone IMAGE:838756 5' | 1 | AGCTGTTTAATTGAATTGGAATCGTT CCACTTGGAACCCAAGTTTGGAAA |
| 430 | Table 3A | Hs.82772 | AA460876 | 2185996 | collagen, type XI, alpha 1 (COL11A1), mRNA/cds = (161, 5581) | 1 | TTTTTCTACGTTATCTCATCTCCTTGT TTTCAGTGTGCTTCAATAATGCA |
| 431 | Table 3A | Hs.292451 | AA461604 | 2185468 | zx51d08.r1 cDNA, 5' end /clone = IMAGE:795759/ clone_end = 5' | 1 | CTCCCATCTGCACACCTGGATCAAGG TAGCCTCTCTGCACAAGGGCAGGT |
| 432 | Table 3A | Hs.13809 | AA476568 | 2204779 | mRNA for KIAA1525 protein, partial cds/cds = (0, 2922) | 1 | TGTTTTTGCTTCCTCAGAAACTTTTA TTGCATCTGCCATCCTTCATTGG |
| 433 | Table 3A | Hs.83733 | AA479163 | 10433041 | cDNA FLJ11724 fis, clone HEMBA1005331/cds = UNKNOWN | 1 | ACAGCCAACTGGAAAGATATAAAAGT TTGGGTCTGTCTCCTCTCCTTCAG |
| 434 | Table 3A | Hs.190154 | AA490796 | 2219969 | td07e03.x1 cDNA, 3' end /clone = IMAGE:2074972/ clone_end = 3' | 1 | ACTCCTGCTTTAGAGAGAAGCCACCA TGAAAAGTCCTCATCATCAGGGGA |
| 435 | Table 3A | Hs.119960 | AA496483 | 2229804 | mRNA; cDNA DKFZp727G051 (from clone DKFZp727G051); partial cds/cds = (0, 1423) | 1 | TCCGTACTGTATGTGATATAGTGCCA TTTTCAGTAACTGCTGTACACACA |
| 436 | Table 3A | Hs.75470 | AB000115 | 2564034 | hypothetical protein, expressed in osteoblast (GS3686), mRNA /cds = (241, 1482) | 1 | ACTTGCCATTACTTTTCCTTCCCACTC TCTCCAACATCACATTCACTTTA |
| 437 | Table 3A | Hs.50002 | AB000887 | 2189952 | small inducible cytokine subfamily A (Cys—Cys), member 19 (SCYA19), mRNA/cds = (138, 434) | 1 | GTGAGTGTGAGCGAGAGGGTGAGTG TGGTCAGAGTAAAGCTGCTCCACCC |
| 438 | Table 3A | Hs.76730 | AB002299 | 2224542 | mRNA for KIAA0301 gene, partial cds/cds = (0, 6144) | 1 | TAATATGCTGGCTTTGCAGCAGAATG AAAAGGATGAGTTGGTGTAGCCTT |
| 439 | Table 3A | Hs.7911 | AB002321 | 2224586 | mRNA for KIAA0323 gene, partial cds/cds = (0, 2175) | 1 | TTCCTTCCCTGGAGGAACTCTTTGGT TGCAGGGCTAAACTTAGAGGCTGC |
| 440 | Table 3A | Hs.7720 | AB002323 | 2224590 | mRNA for KIAA0325 gene, partial cds/cds = (0, 6285) | 1 | TCTGACGGTTGGGAGTGGTGGAAATT GGAAGGATACCAGGAGGTATTTGG |
| 441 | Table 3A | Hs.278671 | AB002334 | 2224612 | KIAA0338 gene product (KIAA0338), mRNA/cds = | 1 | TGATTACAAAAGGCGTATTCTTTCAT GGTTTCTGCAATGAGAGGAAGTGT |

TABLE 8-continued

| SEQ ID | Origin | Unigene | Locus | GI | Nominal Description | Strand | Probe Sequence |
|---|---|---|---|---|---|---|---|
| 442 | Table 3A | Hs.23311 | AB002365 | 2224674 | mRNA for KIAA0367 gene, partial cds/cds = (0, 2150) (253, 5004) | 1 | TCATGCATTGGATTGCTCAGAATAAA GTGTCTGTTAGACTTCGTTTTGGT |
| 443 | Table 3A | Hs.3852 | AB002368 | 2224876 | mRNA for KIAA0368 gene, partial cds/cds = (0, 4327) | 1 | TGACGTTAACACCAGGAATCTCCATG TTTATTATTTTTCGTGGAAACTCC |
| 444 | Table 3A | Hs.70500 | AB002368 | 2224680 | mRNA for KIAA0370 gene, partial cds/cds = (0, 2406) | 1 | TTGCAAAGACTCACGTTTTTGTTGTTT TCTCATCATTCCATTGTGATACT |
| 445 | Table 3A | Hs.63302 | AB002369 | 2224682 | myotubularin related protein 3 (MTMR3), mRNA/cds = (247, 3843) | 1 | AGCTGTACATATAACCCTTTTCTCCTA AAGAGGAGTCAGTCAGTGCTCCT |
| 446 | Table 3A | Hs.32556 | AB002377 | 6634024 | mRNA for KIAA0379 protein, partial cds/cds = (0, 3180) | 1 | AGTTCAGGAGATCTCTAAGTGTAGCT GTAAATTTTGGGGTTAATTTGGCT |
| 447 | Table 3A | Hs.101359 | AB002384 | 2224712 | mRNA for KIAA0386 gene, complete cds/cds = (177, 3383) | 1 | TGTTTGGTTGAGGGGTGCTTTTAGTT GTGTGGCATTTGTATTCATTGATC |
| 448 | Table 3A | Hs.100955 | AB007859 | 6834028 | mRNA for KIAA0399 protein, partial cds/cds = (0, 2961) | 1 | TCAGCCTGAGTGAGTTCAGCCTGTAA AAAGGATGTTAAGCTGTGGGTAAA |
| 449 | Table 3A | Hs.118047 | AB007861 | 2662082 | 602971981F1 cDNA, 5' end /clone = IMAGE:5111324/ clone_end = 5' | 1 | AGGGGAAAAGAGGGGAGAAAAACAG GAGTGATGTCATTTCTTTTTCATGT |
| 450 | Table 3A | Hs.28578 | AB007888 | 2887430 | muscleblind (*Drosophila*)-like (MBNL), mRNA/cds = (1414, 2526) | 1 | ACTTTCTGCTTGTAGTTGCTTAAAATT ATGTATTTTGTCTTGGGCTGCAA |
| 451 | Table 3A | Hs.32168 | AB007902 | 2662164 | KIAA0442 mRNA, partial cds /cds = (0, 3519) | 1 | AAGCAACTGAATCTTCAGCATGTTCT CATCGGCGGAGCCTTCTTGTGTAA |
| 452 | Table 3A | Hs.158286 | AB007915 | 6634034 | mRNA for KIAA0446 protein, partial cds/cds = (3480, 4586) | 1 | TGATTGGAGCACTGAGGAACAAGGG AATGAAAAGGCAGACTCTCTGAACG |
| 453 | Table 3A | Hs.214646 | AB007916 | 6683704 | mRNA for KIAA0447 protein, partial cds/cds = (233, 1633) | 1 | TTGTCCAAACGAAGCAGCCGTGGTA GTAGCTGTCTATGATTCTTGCTCAG |
| 454 | Table 3A | Hs.28169 | AB007928 | 3413879 | mRNA for KIAA0459 protein, partial cds/cds = (0, 461) | 1 | TGGTGCAATAGAAGCTGCAAAGATGT GCCACTTTATCTATGAAATGGAGT |
| 455 | Table 3A | Hs.7764 | AB007938 | 3413899 | KIAA0469 gene product (KIAA0469), mRNA/cds = (184, 1803) | 1 | GGCTTCCATGTCCAGAATCCTGCTTA AGGTTTTAGGGTACCTTCAGTACT |
| 456 | Table 3A | Hs.92381 | AB007956 | 3413930 | mRNA, chromosome 1 specific transcript KIAA0487/cds = UNKNOWN | 1 | TTTTGGCCAGCTTTTCTAGATAAGGT TGTATTGCTACTGCAACTAACAAA |
| 457 | Table 3A | Hs.306193 | AB011087 | 9558752 | hypothetical protein (LQFBS-1), mRNA/cds = (0, 743) | 1 | CACACATCCTGGTACCCTTGGTCTTC AAAGGCCATTTCCAGCAGACCCTC |
| 458 | Table 3A | Hs.59403 | AB011098 | 3043575 | serine palmitoyltransferase, long chain base subunit 2 (SPTLC2), mRNA/cds = (188, 1876) | 1 | AAACATGTCTTTTTCTCGCCTCAACTT TATCCACATGAAATGTGTGCCCA |
| 459 | Table 3A | Hs.173081 | AB011102 | 3043583 | mRNA for KIAA0530 protein, partial cds/cds = (0, 4692) | 1 | TAAGCATAAAACCTGACACGTTAAAA TCCCTGCCCTTTGGTGAGCCCACT |
| 460 | Table 3A | Hs.198891 | AB011108 | 3043595 | mRNA for KIAA0536 protein, partial cds/cds = (0, 3087) | 1 | AACTTGCATTTTAGCAGTGCATGTTT CTAATTGACTTACTGGGAAACTGA |
| 461 | Table 3A | Hs.62209 | AB011114 | 6635200 | mRNA for KIAA0542 protein, partial cds/cds = (390, 4028) | 1 | AGGCCTCAGGCCACCTCCAGGAACA GAACACAGTTTTAAGTTTGATTTTT |
| 462 | Table 3A | Hs.13273 | AB011164 | 3043707 | mRNA for KIAA0592 protein, partial cds/cds = (0, 4061) | 1 | TGAGTCTTAGCAATATGGGAGCAGGT TTTCACTGAATTCTGAGGGTGCCT |
| 463 | Table 3A | Hs.20141 | AB011169 | 3043717 | mRNA for KIAA0597 protein, partial cds/cds = (0, 2915) | 1 | GTTGTCCTGGCACACAAGGAGGCGA GGCTATGCGTTCGAGGCCAACCTAG |
| 464 | Table 3A | Hs.118087 | AB011182 | 3043743 | DNA sequence from clone RP11-251J8 on chromosome 13 Contains ESTs, STSs, GSSs and a CpG island. Contains two novel genes with two isoforms each and the KIAA0610 gene with two isoforms/cds = (61, 2061) | 1 | TGGGAACACATAGAACTGATGGAGG CTTTTCCTAAGGCCAAGGATAATGT |
| 465 | Table 3A | Hs.9075 | AB011420 | 3834353 | serine/threonine kinase 17a (apoptosis-inducing) (STK17A), mRNA/cds = (117, 1361) | 1 | GGATTGAACAGTTCAGTTGTATCTAT GCCCCACAGTGACCAGTAAAGTCC |
| 466 | Table 3A | Hs.120996 | AB011421 | 3834355 | serine/threonine kinase 17b (apoptosis-inducing) (STK17B), mRNA/cds = (261, 1379) | 1 | CGATGACTCATTACCCAATCCCCATG AACTTGTTTCAGATTTGCTCTGTT |
| 467 | Table 3A | Hs.180383 | AB013382 | 3869139 | dual specificity phosphatase 6 (DUSP6), transcript variant 1, mRNA/cds = (351, 1496) | 1 | GTCGCAAAGGGGATAATCTGGGAAA GACACCAAATCATGGGCTCACTTTA |
| 468 | Table 3A | Hs.323712 | AB014515 | 3327043 | KIAA0615 gene product (KIAA0615), mRNA/cds = (237, 2927) | 1 | ACTCAAGCTCACACCTGTACCTGATG GGAATGAACATAATGTGAAGAAAC |
| 469 | Table 3A | Hs.11238 | AB014522 | 3327057 | mRNA for KIAA0622 protein, partial cds/cds = (0, 3869) | 1 | CACCAAAATAGTTATGTTGGCACTGT GTTCACACGCATGGTCCCCACACC |
| 470 | Table 3A | Hs.12259 | AB014530 | 3327073 | mRNA for KIAA0630 protein, partial cds/cds = (0, 1473) | 1 | GTGCGCTTTCTTTTACAACAAGCCTC TAGAAACAGATAGTTTCTGAGAAT |
| 471 | Table 3A | Hs.31921 | AB014548 | 3327109 | mRNA for KIAA0648 protein, partial cds/cds = (0, 2557) | 1 | GTGTGTATAATGTAAAGTAGTTTTGC ATATTCTTGTGCTGCACATGGGCT |

TABLE 8-continued

| SEQ ID | Origin | Unigene | Locus | GI | Nominal Description | Strand | Probe Sequence |
|---|---|---|---|---|---|---|---|
| 472 | Table 3A | Hs.8118 | AB014550 | 3327113 | mRNA for KIAA0650 protein, partial cds/cds = (0, 2548) | 1 | AGGAATCCTTTTCTACATTTGAGCAA ATACTGAGGTTCATGTTGTACCAA |
| 473 | Table 3A | Hs.96731 | AB014555 | 3327123 | mRNA for KIAA0655 protein, partial cds/cds = (0, 3253) | 1 | CGCCTTGGCTTTGTGTTAGCATTTCC TCCTGAAGTGTTCTGTTGGCAATA |
| 474 | Table 3A | Hs.65450 | AB014558 | 3327129 | reticulon 4a mRNA, complete cds /cds = (141, 3719) | 1 | AGAGATTTTCTATTGCTGGGAAGGTG TGTTTCTCCCACAATTTGTTTGTG |
| 475 | Table 3A | Hs.6727 | AB014560 | 3327133 | mRNA for KIAA0660 protein, complete cds/cds = (120, 1568) | 1 | TGCAACCAAATTGGCTTTACCATCTT GGCTTTAGTAGGTATAGAAGACAA |
| 476 | Table 3A | Hs.52526 | AB014569 | 3327151 | KIAA0669 gene product (KIAA0669), mRNA/cds = (1016, 3358) | 1 | TGTCAAATAAAAGAGAACGAACAGGT AGTTTGGTGGAGCTGAGCTAGTGT |
| 477 | Table 3A | Hs.5734 | AB014579 | 3327171 | meningioma expressed antigen 5 (hyaluronidase) (MGEA5), mRNA /cds = (395, 3145) | 1 | TCCTGTAGAAAACGAACTGTAAAAGA CCATGCAAGAGGCAAAATAAAACT |
| 478 | Table 3A | Hs.153293 | AB014601 | 3327215 | mRNA for KIAA0701 protein, partial cds/cds = (0, 1892) | 1 | ACAGTAGCTTTGTAGTGGGTTTTCTG TGCTGTGCTTTTTAATTTCATGTA |
| 479 | Table 3A | Hs.192705 | AB015798 | 11087388 | PRO0457 protein (PRO0457), mRNA/cds = (985, 1431) | 1 | GATTCCTGTCATGAAGGAAAGCAAGA CAGCTCACAGACCAGCGGCATCTG |
| 480 | Table 3A | Hs.247433 | AB015856 | 3953530 | activating transcription factor 6 (ATF6), mRNA/cds = (42, 2054) | 1 | TTTTCTGTACCTTTCTAAACCTCTCTT CCCTCTGTGATGGTTTTGTGTTT |
| 481 | Table 3A | Hs.288031 | AB016247 | 3721881 | sterol-C5-desaturase (fungal ERG3, delta-5-desaturase)-like (SC5DL), mRNA/cds = (48, 947) | 1 | AAATCTTATTCCTCCTCTTCTCCCCTC ACTTTTCCCTACTTCCTCTGCAA |
| 482 | Table 3A | Hs.179729 | AB016811 | 4514825 | collagen, type X, alpha 1 (Schmid metaphyseal chondrodysplasia) (COL10A1), mRNA/cds = (0, 2042) | 1 | TGGAATCAGACATCTTCCAGATGGTT TGGACCCTGTCCATGTGTAGGTCA |
| 483 | Table 3A | Hs.10458 | AB018249 | 4033626 | gene for CC chemokine LEC, complete cds | 1 | AATTTAGCACCTCAGGAATAACTTATT GGTTTAGGTCAGTTCTTGGCGGG |
| 484 | Table 3A | Hs.19822 | AB018298 | 3882230 | SEC24 (S. cerevisiae) related gene family, member D (SEC24D), mRNA/cds = (200, 3298) | 1 | AACCATGTAACTCCATTGAACATTTTT CAACTTAAGGTCTGCATAGCAGA |
| 485 | Table 3A | Hs.5378 | AB018305 | 3882244 | mRNA for KIAA0762 protein, partial cds/cds = (0, 1874) | 1 | AAACCAGGTTAATGGCTAAGAATGGG TAACATGACTCTTGTTGGATTGTT |
| 486 | Table 3A | Hs.21264 | AB018325 | 3882284 | mRNA for KIAA0762 protein, partial cds/cds = (0, 3540) | 1 | CTCTTGGCTGAGCTTCTACAGGGCTG AGAGCTGCGCTTTGGGGACTTCAG |
| 487 | Table 3A | Hs.8182 | AB018339 | 3882312 | mRNA for KIAA0796 protein, partial cds/cds = (0, 3243) | 1 | TTTCCTTTGGGGCATGATGTTTTAAC CTTTGCTTTAGAAGCACAAGCTGT |
| 488 | Table 3A | Hs.55947 | AB018348 | 3882330 | mRNA for KIAA0805 protein, partial cds/cds = (0, 3985) | 1 | ATAGAATGAGCTTGGTTAAGCACCTC TCCTTTGCCCTTCACCCTGACTCC |
| 489 | Table 3A | Hs.181300 | AB020335 | 6518494 | Pancreas-specific TSA305 mRNA, complete cds/cds = (45, 2429) | 1 | TTGAGTAGAACTCTGATTTTCCCTAG AGGCCAAATTCTTTTTATCTGGGT |
| 490 | Table 3A | Hs.22960 | AB020623 | 3985929 | breast carcinoma amplified sequence 2 (BCAS2), mRNA/ cds = (48, 725) | 1 | TTCTAAACACATTCTTGATCACCAAAC AACTTCAGAAAGACAGTGACTGT |
| 491 | Table 3A | Hs.45719 | AB020630 | 4240131 | CAAX box protein TIMAP mRNA, complete cds/cds = (52, 1755) | 1 | TGGAGTTGCTTCCAGCTGCCAAGGC CTGTGACAGAATTCGCTGTTAAGAG |
| 492 | Table 3A | Hs.123654 | AB020631 | 4240136 | mRNA for KIAA0824 protein, partial cds/cds = (0, 4936) | 1 | AATGATGCAAAGTTTTATTCTTGAACT TGGACACTGATGCCATCAAACAA |
| 493 | Table 3A | Hs.334700 | AB020640 | 14133218 | mRNA for KIAA0833 protein, partial cds/cds = (0, 5017) | 1 | GGCCAGTAAATTCCATGTTTTTGGCT ATATCTCATCCAAACTGAGCAGTT |
| 494 | Table 3A | Hs.14945 | AB020644 | 4240162 | mRNA for KIAA0837 protein, partial cds/cds = (0, 2237) | 1 | TTCCCATTGTCCTCCTACTCAACTAAA ATTCATAGTTGGCTTTAAGCCCA |
| 495 | Table 3A | Hs.197298 | AB020657 | 4240188 | NS1-binding protein-like protein mRNA, complete cds/cds = (555, 2483) | 1 | GCATGTCCTAATGCTTGCTGCTGATT TAAACACATTAAAGGTACTTTGCA |
| 496 | Table 3A | Hs.13264 | AB020683 | 4240200 | mRNA for KIAA0856 protein, partial cds/cds = (0, 3212) | 1 | ACAATGGCATAAAAGTAACTTTCTCT GAAGATGTGATGTTCAGGCTGTGA |
| 497 | Table 3A | Hs.104315 | AB020669 | 4240212 | suppressor of clear, C. elegans, homolog of (SHOC2), mRNA /cds = (277, 2025) | 1 | AATGGAAGGCAGGTGAAGATATAAAA CCCTAGAATGCTTAAATGTGCTGT |
| 498 | Table 3A | Hs.18166 | AB020877 | 6635136 | mRNA for KIAA0870 protein, partial cds/cds = (0, 3061) | 1 | TTAATGCCAGTCCTCATGTAACCTCA GGTATCTTCAGCTTGTGGAGAATA |
| 499 | Table 3A | Hs.27973 | AB020681 | 4240236 | KIAA0874 protein (KIAA0874), mRNA/cds = (0, 6188) | 1 | TGGAGTATATGCCTGAAAAGGTTTTG GATTCAGAAAGAAAAAGGATGGTT |
| 500 | Table 3A | Hs.75415 | AB021288 | 4038732 | cDNA: FLJ22810 fis, clone KAIA2933, highly similar to AB021288 mRNA for beta 2-microglobulin/cds = UNKNOWN | 1 | AAAGTAAGGCATGGTTGTGGTTAATC TGGTTTATTTTTGTTCCACAAGTT |
| 501 | Table 3A | Hs.215857 | AB022683 | 5019617 | HFB30 mRNA, complete cds /cds = (238, 1660) | 1 | GGTGTGTGTGTCCAGAGTGAGCAAG GATTATGTTTTTGGATTGTCAAAGA |
| 502 | Table 3A | Hs.104305 | AB023143 | 4589483 | death effector filament-forming Ced-4-like apoptosis protein (DEFCAP), transcript variant B, mRNA/cds = (522, 4811) | 1 | AACCATTTGCCTCTGGCTGTGTCACA GGGTGAGCCCCAAAATTGGGGTTC |

TABLE 8-continued

| SEQ ID | Origin | Unigene | Locus | GI | Nominal Description | Strand | Probe Sequence |
|---|---|---|---|---|---|---|---|
| 503 | Table 3A | Hs.154296 | AB023149 | 4589507 | mRNA for KIAA0932 protein, partial cds/cds = (0, 2782) | 1 | GAAAGTGGAGAGGACCTAACATATGT CTCTACCTAGAAAGGATGGTTTCA |
| 504 | Table 3A | Hs.4014 | AB023163 | 4589535 | mRNA for KIAA0946 protein, partial cds/cds = (0, 2005) | 1 | ACCAACTATAAACCCAGTTCTAAAGT TGTGTATGATGGTGAACCTTTGGG |
| 505 | Table 3A | Hs.75478 | AB023173 | 4589555 | mRNA for KIAA0956 protein, partial cds/cds = (0, 2020) | 1 | GGACCTGAGACACTGTGGCTGTCTAA TGTAATCCTTTAAAAATTCTCTGC |
| 506 | Table 3A | Hs.184523 | AB023182 | 4589573 | mRNA for KIAA0965 protein, partial cds/cds = (0, 1392) | 1 | TTTGGTGTTCAGTTACTGAGTTTCAAA AATGTTTTGGTGGCATGAGGACA |
| 507 | Table 3A | Hs.103329 | AB023187 | 14133226 | KIAA0970 protein (KIAA0970), mRNA/cds = (334, 2687) | 1 | CCTGTTTAAGAAAGTGAAATGTTATG GTCTCCCCTCTTCCAATGAGCTTA |
| 508 | Table 3A | Hs.158135 | AB023198 | 4589605 | mRNA for KIAA0981 protein, partial cds/cds = (0, 1737) | 1 | ACGGACCAGGCCATTCATTATTCCTC AAGTGTTAATATACTGACTTATGC |
| 509 | Table 3A | Hs.75381 | AB023200 | 4589609 | mRNA for KIAA0983 protein, complete cds/cds = (55, 2106) | 1 | ACAGTTTTGTCAAAAAGTGTATCTTGA CCCCACCATCAGTACTCCATTCT |
| 510 | Table 3A | Hs.343557 | AB023216 | 14133228 | 601500320F1 cDNA, 5' end /clone = IMAGE:3902237/ clone_end = 5' | 1 | TTTGGTTCATCCGTGTGCTGTTCTTTT GGGTTCTGAGAGGGTTTTGCCAT |
| 511 | Table 3A | Hs.23860 | AB023227 | 4589669 | mRNA for KIAA1010 protein, partial cds/cds = (0, 3949) | 1 | GGCAGTAATGCAAGAGTCCTTTTGTG AAGAGTGTTTCTATGTAGAGATGT |
| 512 | Table 3A | Hs.90093 | AB023420 | 4579908 | mRNA for heat shock protein apg-2, complete cds/cds = (278, 2800) | 1 | AAAATGCAGAGCAGAATGGACCAGTG GATGGACAAGGAGACAACCCAGGCC |
| 513 | Table 3A | Hs.6790 | AB026908 | 5931603 | microvascular endothelial differentiation gene 1 (MDG1), mRNA/cds = (202, 873) | 1 | AGTGTTCCTGCTGCCAGTTCTTTCCT CTTTAGGCGTGGTTGAGAAAAAGC |
| 514 | Table 3A | Hs.21542 | AB028958 | 5689406 | KIAA1035 protein (KIAA1035), mRNA/cds = (88, 3648) | 1 | CAGTCTCTGCCACTTGTGCTAGTTTT TGTGTGGTGTTTAGAAACATGGGC |
| 515 | Table 3A | Hs.9846 | AB028963 | 5689416 | mRNA for KIAA1040 protein, partial cds/cds = (0, 1636) | 1 | TTCCACTTAGGTTTGGCATTTTGGCA GATAAGCTAATCTTGTATAAAGCA |
| 516 | Table 3A | Hs.89519 | AB028969 | 5889428 | KIAA1046 protein (KIAA1046), mRNA/cds = (577, 1782) | 1 | GTAAATGCCCTACATGGTGTGATGCT GCATTATATATAAAACTGTGTGCA |
| 517 | Table 3A | Hs.126084 | AB028978 | 5689446 | mRNA for KIAA1055 protein, partial cds/cds = (0, 2607) | 1 | AGCTCCTGTGCTGACCTTCAAGTTAC GTTTTGGAACTGTAATACTAAAGG |
| 518 | Table 3A | Hs.7243 | AB028980 | 5689450 | mRNA for KIAA1057 protein, partial cds/cds = (0, 2934) | 1 | ACACTAGGGAAGAACCTTAATTCTAA ATTTGGTTCATGTGTGGCAAAGTT |
| 519 | Table 3A | Hs.8021 | AB028981 | 5689452 | mRNA for KIAA1058 protein, partial cds/cds = (0, 4604) | 1 | TAACTGGAATCACTGCCCTGCTGTAA TTAAACATTCTGTACCACATCTGT |
| 520 | Table 3A | Hs.76118 | AB028986 | 5689462 | ubiquitin carboxyl-terminal esterase L1 (ubiquitin thiolesterase) (UCHL1), mRNA/cds = (31, 669) | 1 | CCCCCAGTGCTTTGTAGTCTCTCCTA TGTCATAATAAAGCTACATTTTCT |
| 521 | Table 3A | Hs.325530 | AB028990 | 5689470 | mRNA for KIAA1067 protein, partial cds/cds = (0, 2072) | 1 | GACAGACTTGGACACAAAACCGATCC ATAGAAGGGCTTCCCAAACCTTGT |
| 522 | Table 3A | Hs.154525 | AB028999 | 5689488 | mRNA for KIAA1076 protein, partial cds/cds = (0, 2415) | 1 | CCATATGTAACTTGTTTTGAAGAGAA GTGTTTCCGTTGTGTGTCTTGATG |
| 523 | Table 3A | Hs.155546 | AB029003 | 5689496 | mRNA for KIAA1080 protein, partial cds/cds = (0, 1554) | 1 | GTATCATCTGCCAAGACCAGGGCCT GCTTCACCACAGCCACAATAAAGTC |
| 524 | Table 3A | Hs.26334 | AB029008 | 5689502 | mRNA for KIAA1083 protein, complete cds/cds = (221, 1975) | 1 | AATGAACCATTTACAGTTCGGTTTTG GACTCTGAGTCAAAGGATTTTCCT |
| 525 | Table 3A | Hs.54886 | AB029015 | 5689520 | mRNA for KIAA1092 protein, partial cds/cds = (0, 3484) | 1 | GCCGAGTCAGCACATGGGTAGAGAT GATGTAAAAGCAGCCAATCTGGAAA |
| 526 | Table 3A | Hs.117333 | AB029016 | 14133234 | mRNA for KIAA1093 protein, partial cds/cds = (179, 5382) | 1 | ACCTTCTGGGAGGAGGGTCGGATTC AATCTGAACTTAGAACTTTCAACTC |
| 527 | Table 3A | Hs.279039 | AB029027 | 5689544 | KIAA1104 protein (KIAA1104), mRNA/cds = (494, 2281) | 1 | GCACCATGTAGAATTTTCACTTTGTA CTGGCAGGCTCGTTTTACCTCATT |
| 528 | Table 3A | Hs.278586 | AB029031 | 5689552 | mRNA for KIAA1108 protein, partial cds/cds = (0, 2291) | 1 | TCTCCAGTCCTGATTACTGTACACAG TAGCTTTAGATGGCGTGGACGTGA |
| 529 | Table 3A | Hs.7910 | AB029551 | 6714542 | YEAF1 mRNA for YY1 and E4TF1 associated factor 1, complete cds/cds = (198, 878) | 1 | TTCCTGTTACTGGCATGTGCACGACT ATGTTATTAGAAGCCACTTTATCA |
| 530 | Table 3A | Hs.14805 | AB031050 | 7664246 | solute carrier family 21 (organic anion transporter), member 11 (SLC21A11), mRNA/cds = (193, 2325) | 1 | GCCAGCTTGGAGGATGGACATTTCTG GATACACATACACATACAAAACAG |
| 531 | db mining | Hs.91600 | AB031479 | 6539431 | SEEK1 protein (SEEK1), mRNA/cds = (274, 732) | 1 | TCAGCTCCTTGATCTAAGCCTCCCAG AGAGACCCCTAGAATGTTTCCCTC |
| 532 | db mining | Hs.146824 | AB031480 | 6539433 | SPR1 protein (SPR1), mRNA/cds = (315, 725) | 1 | CCGGCGGCAGGAACTATCAGTAGAC AGCTGCTGCTTCCATGAAACGGAAA |
| 533 | Table 3A | Hs.99872 | AB032251 | 6683491 | BPTF mRNA for bromodomain PHD finger transcription factor, complete cds/cds = (471, 8816) | 1 | TGTTGCCTTGAATATAACAGTACAATT TGTCAATTACTCTGCACCAGGCT |
| 534 | Table 3A | Hs.8858 | AB032252 | 6683493 | bromodomain adjacent to zinc finger domain, 1A (BAZ1A), mRNA/cds = (115, 5139) | 1 | AAAAGTAACACCCTCCCTTTTCCTG ACAGTTCTTTCAGCTTTACAGAAC |
| 535 | Table 3A | Hs.288430 | AB032948 | 6329727 | 601655928R1 cDNA, 3' end /clone = IMAGE:3855679/ clone_end = 3' | 1 | AATGAAATGTAGTTGGGTTCTTCCTG TAATGCGCTATTATGTCTTGGGCT |

TABLE 8-continued

| SEQ ID | Origin | Unigene | Locus | GI | Nominal Description | Strand | Probe Sequence |
|---|---|---|---|---|---|---|---|
| 536 | Table 3A | Hs.44087 | AB032952 | 6329754 | mRNA for KIAA1126 protein, partial cds/cds = (0, 1857) | 1 | AACCTCCTTGTGTCTGTTTCTCTGTTC CTCTGTGGCTGACTCAATAAACT |
| 537 | Table 3A | Hs.153489 | AB032972 | 6330026 | mRNA for KIAA1146 protein, partial cds/cds = (0, 815) | 1 | GTGGGAGGGTGAGATGTGAAGATGT GGGATGAACCTGGAATGAACGAATT |
| 538 | Table 3A | Hs.12461 | AB032973 | 6330032 | mRNA for KIAA1147 protein, partial cds/cds = (0, 589) | 1 | GGCCTAAAGAAAGCTGGGGTTAATCC TGAAGCTAAAAGTAAATGTTTCTT |
| 539 | Table 3A | Hs.343199 | AB032976 | 6330050 | EST374106 cDNA | 1 | TCCCATCCTTTCCATCAAGACCTTCA TTAGCTTATGATATTTGCTGCCGA |
| 540 | Table 3A | Hs.6298 | AB032977 | 6382017 | mRNA for KIAA1151 protein, partial cds/cds = (0, 689) | 1 | GGAGGTCTCTTCCAGATTGCTCTTCT GCCGAATTATTTGTATCTATTCCG |
| 541 | Table 3A | Hs.290398 | BF341403 | 11287894 | 602013389F1 cDNA, 5' end /clone = IMAGE:4149209/ clone_end = 5' | 1 | GCACACCTCGTCAGAGGACCATAAC CGTGTGGGGACAATAACCGCAGGGG |
| 542 | Table 3A | Hs.7041 | AB033034 | 6382021 | mRNA for KIAA1208 protein, partial cds/cds = (24, 2015) | 1 | ACAATGGATTTGTGAAGAGCAGATTC CATGAGTAACTCTGACAGGTATTT |
| 543 | Table 3A | Hs.29679 | AB033042 | 6330568 | cofactor required for Sp1 transcriptional activation, subunit 3 (130 kD) (CRSP3), mRNA/cds = (119, 4225) | 1 | TGAGAGACATTGTTAATTTTGGGGGA ATTGGCATTGCGAAAGACTTGAAA |
| 544 | Table 3A | Hs.7252 | AB033050 | 6330623 | mRNA for KIAA1224 protein, partial cds/cds = (0, 1908) | 1 | TGCTAGACATTTCTATACTCTGTTGTA ACACTGAGGTATCTCATTTGCCC |
| 545 | Table 3A | Hs.267690 | AB033054 | 6330689 | mRNA for KIAA1228 protein, partial cds/cds = (0, 2176) | 1 | GTGGGGGATGGGGGTTAAAAAGTAG AGAACCTCCTTTCTGTTCAACTAAT |
| 546 | Table 3A | Hs.9873 | AB033076 | 14133246 | mRNA for KIAA1250 protein, partial cds/cds = (139, 5472) | 1 | CAGGTGAGTAGTTGCCGCGTAATATC ATTGGAGTACATTCTTTATACTGT |
| 547 | Table 3A | Hs.146888 | AB033079 | 6382025 | mRNA for KIAA1253 protein, partial cds/cds = (0, 1416) | 1 | CCCCAACCTTATTCTGTGTGTAGACA TTGTATTCCACAATTTTGAATGGC |
| 548 | Table 3A | Hs.301721 | AB033081 | 6330899 | mRNA for KIAA1255 protein, partial cds/cds = (0, 2866) | 1 | CGAATGGCTTAAACTAATTTGCTATG ATCCTCTAACACCGAAATTTCCCA |
| 549 | Table 3A | Hs.40193 | AB033085 | 6330932 | mRNA for KIAA1259 protein | 1 | AGAGGGAATCAGAAAAATGCCAAGC CTTTTCTCTTTGAATGTGCTATTTT |
| 550 | Table 3A | Hs.43141 | AB033093 | 6331205 | mRNA for KIAA1267 protein, partial cds/cds = (94, 3411) | 1 | CACCCTTCTCTGTTAACCTTGTGCCT GTCTCCTGTATGATCACATCACCA |
| 551 | Table 3A | Hs.42179 | AB033112 | 6331388 | mRNA for KIAA1288 protein, partial cds/cds = (197, 3841) | 1 | TGTGTCTCTGTCGCGTCTGCTGTGAA GCACATGATGCTCTATTTATTGTA |
| 552 | Table 3A | Hs.63126 | AB033118 | 6331442 | mRNA for KIAA1292 protein, partial cds/cds = (0, 1788) | 1 | TGAGAGTAAGCACATGACAGCGTCTG CTTGCGTTGTGTCTGTTTTATGTT |
| 553 | Table 3A | Hs.278870 | AB034205 | 6899845 | acid-inducible phosphoprotein (OA48-18), mRNA/cds = (275, 445) | 1 | TCGTGTGAATCAGACTAAGTGGGATT TCATTTTTACAACTCTGCTCTACT |
| 554 | Table 3A | Hs.76507 | AB034747 | 12862475 | LPS-induced TNF-alpha factor (PIG7), mRNA/cds = (233, 919) | 1 | TGCAACGAATATGGATACCACATAGT ACTTTGGTGTTACCTGCTTTTGAA |
| 555 | db mining | Hs.184 | AB036432 | 6691625 | advanced glycosylation end product-specific receptor (AGER), mRNA/cds = (0, 1214) | 1 | AGAACTGAATCAGTCGGAGGAACCT GAGGCAGGCGAGAGTAGTACTGGAG |
| 556 | Table 3A | Hs.194369 | AB036737 | 8096339 | mRNA for RERE, complete cds /cds = (638, 5336) | 1 | TTGCCATGAGATAACACAGTGTAAAC AGTAGACACCCAGAAATCGTGACT |
| 557 | Table 3A | Hs.125037 | AB037752 | 7243042 | hypothetical protein FLJ20548 (FLJ20548), mRNA/cds = (167, 1432) | 1 | GCTGTTAGGCTAAGAGGGTGCAGGG CTAGACACGAAGCTTAAACTATTCA |
| 558 | Table 3A | Hs.22941 | AB037784 | 7243106 | mRNA for KIAA1383 protein, partial cds/cds = (0, 1293) | 1 | CCAGTGTGGAGGTAGCAAAGCATCTA TCTATTCTGAATCATGTTTGGAAA |
| 559 | Table 3A | Hs.258730 | AB037790 | 7243118 | mRNA for KIAA1369 protein, partial cds/cds = (0, 1963) | 1 | GCCAGTATGCCACAGAATGTCCTAAA CCCTTGCTGCCTCTTATCAAAACC |
| 560 | Table 3A | Hs.29716 | AB037791 | 7243120 | mRNA for KIAA1370 protein, partial cds/cds = (49, 3372) | 1 | TTTGTACTGTTGAAACCACTTCATTG GACATGTTGCAATAGCAAAACCCC |
| 561 | Table 3A | Hs.9663 | AB037796 | 7243130 | mRNA for KIAA1375 protein, partial cds/cds = (0, 1640) | 1 | AGGGGGAACATTGTAAAGAAAC AAAAAGGTCCAGATGAATGTATGC TAGA |
| 562 | Table 3A | Hs.24684 | AB037797 | 7243132 | mRNA for KIAA1376 protein, partial cds/cds = (143, 1456) | 1 | GGTGCTGAATATGTCCTTGTAGGCTC TGTTTTAAGAAAACAATATGTGGG |
| 563 | Table 3A | Hs.6685 | AB037801 | 7243140 | mRNA for KIAA1380 protein, partial cds/cds = (0, 3798) | 1 | ACATTGGCTTGCTTTTGTTAAAGTGC AAGTGTTACATATGGCTTTGTACA |
| 564 | Table 3A | Hs.334878 | NM_032837 | 14249549 | hypothetical protein FLJ14775 (FLJ14775), mRNA/cds = (171, 533) | 1 | TTGGTAGTGTCAGCGGGCACCTTTTA CACCTTCTAGTAGCTCAAGCTAGT |
| 565 | Table 3A | Hs.301434 | AB037808 | 7243154 | mRNA for KIAA1387 protein, partial cds/cds = (0, 2852) | 1 | TCCTGGAATCGTTTAATCTAAAGCAG TTTCCCCTGTTTTGGAGATTTTGT |
| 566 | Table 3A | Hs.301434 | AB037808 | 7243154 | mRNA for KIAA1387 protein, partial cds/cds = (0, 2852) | 1 | TCCTGGAATCGTTTAATCTAAAGCAG TTTCCCCTGTTTTGGAGATTTTGT |
| 567 | Table 3A | Hs.15370 | AB037828 | 7243194 | mRNA for KIAA1407 protein, partial cds/cds = (0, 2235) | 1 | TGAGAAAGTCCTGTGCAGTCCTGAGA TGATTACTCTTATTGGTGTGCTG |
| 568 | Table 3A | Hs.274396 | AB037844 | 7243226 | mRNA for KIAA1423 protein, partial cds/cds = (0, 1851) | 1 | TCGTCTTTTGCGAATGGCTTAATTCT GACACTACCTTCTGGGAAATGTT |
| 569 | Table 3A | Hs.149918 | AB037901 | 10567183 | GASC-1 mRNA, complete cds | 1 | TTTGATTGTGTCTGATGGGAACTGAG |

TABLE 8-continued

| SEQ ID | Origin | Unigene | Locus | GI | Nominal Description | Strand | Probe Sequence |
|---|---|---|---|---|---|---|---|
| 570 | Table 3A | Hs.284205 | AB040120 | 12657580 | /cds = (150, 3320) up-regulated by BCG-CWS (LOC64116), mRNA/cds = (477, 1859) | 1 | TTGTTGGCCTTTGTGAAATGAAAT TTGACAAAGCCCAACAATGATCTCAG GAATTACATTTTCCAACAGACCAA |
| 571 | Table 3A | Hs.6682 | AB040875 | 13516845 | solute carrier family 7, (cationic amino acid transporter, y+ system) member 11 (SLC7A11), mRNA/cds = (235, 1740) | 1 | ACCTGTCACGCTTCTAGTTGCTTCAA CCATTTTATAACCATTTTTGTACA |
| 572 | Table 3A | Hs.109694 | AB040884 | 7959160 | mRNA for KIAA1451 protein, partial cds/cds = (0, 1467) | 1 | TCCTTAAGGTGCACAGTAAATGTACA GATAGTTATAGGCCACTGTTTTGT |
| 573 | Table 3A | Hs.210958 | AB040919 | 7959232 | mRNA for KIAA1486 protein, partial cds/cds = (11, 2044) | 1 | AGCTCTATATGAACACTGCTCTGAACT CCTCTGACTTAGCATTCAACTTAA |
| 574 | Table 3A | Hs.20237 | AB040922 | 7959238 | mRNA for KIAA1489 protein, partial cds/cds = (1619, 3154) | 1 | CATGACAAACATTACTAGCATGTTCA ACTGCACCATGTTCTGGCACTGTA |
| 575 | Table 3A | Hs.35089 | AB040929 | 7959252 | mRNA for KIAA1496 protein, partial cds/cds = (0, 2763) | 1 | ACCTCTTTCCTACCAATTTCACATTTT GCAGAAACTTGTTCACATTTCCA |
| 576 | Table 3A | Hs.201500 | AB040942 | 7959278 | mRNA for KIAA1509 protein, partial cds/cds = (0, 3982) | 1 | GGGTTGTGTATTAAATAGCCATTCAT TCTGGAACTCAAGGACAGGACTGT |
| 577 | Table 3A | Hs.93836 | AB040959 | 7959318 | mRNA for KIAA1526 protein, partial cds/cds = (0, 2892) | 1 | GCCTTGCAGGTGACCAGCAGTGTCA TTGTATTTATATACAGAGCTTATGA |
| 578 | Table 3A | Hs.89135 | AB040961 | 7959322 | mRNA for KIAA1528 protein, partial cds/cds = (4, 2226) | 1 | CTGGACGGGCGTGGGTTCTGGGTCA GCTTCTTTTACCTCAATTTTGTTTG |
| 579 | Table 3A | Hs.85752 | AB040974 | 7959348 | mRNA for KIAA1541 protein, partial cds/cds = (908, 2341) | 1 | AAAGTCTGAGGTGTGGAACAGTTATT TAAGCATTAGTCAACCCTGGTCCT |
| 580 | Table 3A | Hs.18259 | AB044661 | 11094140 | XPA binding protein 1; putative ATP(GTP)-binding protein (NTPBP), mRNA/cds = (24, 1148) | 1 | TGGGCAAGACATGATTAATGAATCAG AATCCTGTTTCATTGGTGACTTGG |
| 581 | Table 3A | Hs.142838 | AB044971 | 13699901 | nucleolar protein interacting with the FHA domain of pKi-67 (NIFK), mRNA/cds = (54, 935) | 1 | CCTGTGTAAAAGAAGAAATACAAGAG ACTCAAACACCTACACATTCACGG |
| 582 | Table 3A | Hs.140720 | AB045118 | 13365650 | FRAT2 mRNA, complete cds /cds = (129, 830) | 1 | TGGCTTGTTCATCCTCCAGATGTAGC TATTGATGTACACTTCGCAACGGA |
| 583 | Table 3A | Hs.136414 | AB045278 | 13588433 | UDP-GlcNAc:betaGal beta-1,3-N-acetylglucosaminyltransferase 5 (B3GNT5), mRNA/cds = (129, 1265) | 1 | AACTATCAGCTTGGATGGTCACTTGA ATAGAAGATGGTTATACACAGTGT |
| 584 | Table 3A | Hs.127270 | AB046765 | 10047154 | mRNA for KIAA1545 protein, partial cds/cds = (0, 2445) | 1 | CCACGGTGGACCCTGTTTGTTTTAAA TATTCTGTTCCCATGTCAATCAGT |
| 585 | Table 3A | Hs.65641 | AB048766 | 10047156 | hypothetical protein FLJ20073 (FLJ20073), mRNA/cds = (16, 1908) | 1 | TTGTGTAGGAAACTTTTGCAGTTTGA CACTAAGATAACTTCTGTGTGCAT |
| 586 | Table 3A | Hs.323822 | AB046771 | 10047168 | mRNA for KIAA1551 protein, partial cds/cds = (0, 3750) | 1 | ACTCAAATCAGTTAGCTTCAAACAAA AACGAAAGTTAGACCAAGGGAACG |
| 587 | Table 3A | Hs.323822 | AB048771 | 10047166 | mRNA for KIAA1551 protein, partial cds/cds = (0, 3750) | 1 | ACTCAAATCAGTTAGCTTCAAACAAA AACGAAAGTTAGACCAAGGGAACG |
| 588 | Table 3A | Hs.17767 | AB046774 | 10047172 | mRNA for KIAA1554 protein, partial cds/cds = (0, 3983) | 1 | TTGTGTGCTGTGCTTCAAAGCCTTAA CTGTCAAATCTTGCATTATCTTGT |
| 589 | Table 3A | Hs.44054 | AB046785 | 10047194 | ninein (GSK3B interacting protein) (NIN), mRNA/cds = (202, 6345) | 1 | ACATTATCATGGCATGACTTAAGGGA ACATTGGTTTGTGAAGGAAAAACA |
| 590 | Table 3A | Hs.168640 | AB046801 | 10047236 | mRNA for KIAA1581 protein, partial cds/cds = (0, 1839) | 1 | TGTGTGACTTTCATGCTTCTGGGGTT GGAGCTTAAAGATCCAAACTGAGA |
| 591 | Table 3A | Hs.129750 | AB046805 | 10047244 | mRNA for KIAA1585 protein, partial cds/cds = (27, 1814) | 1 | TGCTGGTATTCTCACTGCCACATTTT GGAAACCTGTATTACACCTTAAA |
| 592 | Table 3A | Hs.18587 | AB046808 | 10047250 | Homo sapiens, clone MGC:15071 IMAGE:4110510, mRNA, complete cds/cds = (977, 2212) | 1 | TTGAGTGTCTGCAGCAGCCCTGGACT TCCAGACTTCTATCACATGAGAAA |
| 593 | Table 3A | Hs.11123 | AB046813 | 10047260 | mRNA for KIAA1593 protein, partial cds/cds = (477, 3338) | 1 | TGGTGCTGATGCTTAGTTGTCTCATG CCATTAAATTGTAAAAGTGAGTTG |
| 594 | Table 3A | Hs.343582 | AB046825 | 10047284 | RC6-HT0592-270300-011-D11 cDNA | 1 | GGAGGTCAGTTGATTTCCCCAGGTAC ATTCATGGTGTGACAGACACATGG |
| 595 | Table 3A | Hs.222748 | AB046830 | 10047294 | mRNA for KIAA1610 protein, partial cds/cds = (0, 1458) | 1 | AGATCCTTTCAGTCCCTAGACCTCCA TTCACTCTGTTTCTCTTCTGCTGG |
| 596 | Table 3A | Hs.6639 | AB046844 | 10047324 | mRNA for KIAA1624 protein, partial cds/cds = (0, 1800) | 1 | GATCCGATCATGGTGATGTACGGGG TGAATTCTCTTGCCGTGTTGCAAAT |
| 597 | Table 3A | Hs.288140 | AB046857 | 10047350 | mRNA for KIAA1637 protein, partial cds/cds = (0, 1441) | 1 | ATGGTTTCAAAATTCAAGGTCCCCAA ATGGCAGCATTTTATGTTCTGACC |
| 598 | Table 3A | Hs.44566 | AB046861 | 10047358 | KIAA1841 protein (KIAA1641), mRNA/cds = (40, 453) | 1 | CAAGTATGTATGCAACTTTGCACACC AACAACTGTTAATCTGTAGCTAGT |
| 599 | Table 3A | Hs.82113 | AB049113 | 10257384 | dUTP pyrophosphatase (DUT), mRNA/cds = (29, 523) | 1 | TGGTGATTCTCCAGGCCATTAATAC CCTGCAATGTAATTGTCCCTCTGT |
| 600 | Table 3A | Hs.323463 | AB051480 | 12697930 | mRNA for KIAA1693 protein, partial cds/cds = (0, 2707) | 1 | TTCTGCCTCAATGTTTACTGTGCCTTT GTTTTTGCTAGTTTGTGTTGTTG |
| 601 | Table 3A | Hs.19597 | AB051481 | 12697932 | mRNA for KIAA1694 protein, partial cds/cds = (0, 2274) | 1 | ACTACTGTCACGTAGCTGTGTACAAA GAGATGTGAAATACTTTCAGGCAA |
| 602 | Table 3A | Hs.20281 | AB051487 | 12697944 | mRNA for KIAA1700 protein, | 1 | TGTTGAACGGTTAAACTGTGCATTTC |

TABLE 8-continued

| SEQ ID | Origin | Unigene | Locus | GI | Nominal Description | Strand | Probe Sequence |
|---|---|---|---|---|---|---|---|
| 603 | Table 3A | Hs.7076 | AB051492 | 12697954 | mRNA for KIAA1705 protein, partial cds/cds = (108, 2180) | 1 | TCATTTTGATGTGTCATGTATGTT AATGGTCAAGGTTCAGCATATTCTAT |
| 604 | Table 3A | Hs.25127 | AB051512 | 12697994 | mRNA for KIAA1725 protein, partial cds/cds = (1713, 3209) | 1 | ATGAAGATCACAAGGTGGTATCGT TGTGAACTTGTGCGCAAATGTGCAGA TTCAATGTTCTTGTTACAGATTGA |
| 605 | Table 3A | Hs.66053 | AB051540 | 12698050 | mRNA for KIAA1753 protein, partial cds/cds = (0, 3129) | 1 | CCCCTTGGGCTCAGCACGAAAGGGC TTTCAATGAATTAAGTGAAAACTTT |
| 606 | Table 3A | Hs.7187 | AB051544 | 12698058 | mRNA for KIAA1757 protein, partial cds/cds = (347, 4576) | 1 | AATGAGTTGTGTTGAAGCCTCCGTCT CCCATCCTTGCCTGTAGCCCGTAG |
| 607 | Table 3A | Hs.248367 | AB058677 | 14017778 | MEGF11 protein (MEGF11), mRNA/cds = (159, 3068) | 1 | AGCCTAAACATGTATACTGTGCATTTT ATGGGTGACTTTGAAAGATCTGT |
| 608 | Table 3A | Hs.227400 | AF000145 | 3095031 | mitogen-activated protein kinase kinase kinase kinase 3 (MAP4K3), mRNA/cds = (360, 3014) | 1 | ACCAGGTTTTAGCAAAATGCACACTT TTGGCTCTTTTTGGTATATGTTCT |
| 609 | Table 3A | Hs.8180 | AF000852 | 2795862 | syndecan binding protein (syntanin) (SDCBP), mRNA/cds = (148, 1044) | 1 | CCTGACTCCTCCTTGCAAACAAAATG ATAGTTGACACTTTATCCTGATTT |
| 610 | Table 3A | Hs.147916 | AF000982 | 2580549 | DEAD/H (Asp—Glu—Ala—Asp/His) box polypeptide 3 (DDX3), transcript variant 2, mRNA/cds = (856, 2844) | 1 | TTGTATTGGCATAATCAGTGACTTGT ACATTCAGCAATAGCATTTGAGCA |
| 611 | Table 3A | Hs.13980 | AF000993 | 2580571 | ubiquitously transcribed tetratricopeptide repeat gene, X chromosome (UTX), mRNA/cds = (26, 4231) | 1 | TTGTTAAGTTGCAATTACTGCAATGA CAGACCAATAAACAATTGCTGCCA |
| 612 | Table 3A | Hs.159523 | AF001622 | 3930162 | class-I MHC-restricted T cell associated molecule (CRTAM), mRNA/cds = (0, 1181) | 1 | ACAGCAAACTTTGGCATTTATGTGGA GCATTTCTCATTGTTGGAATCTGA |
| 613 | Table 3A | Hs.58435 | AF001862 | 2232149 | FYN-binding protein (FYB-120/130) (FYB), mRNA/cds = (30, 2381) | 1 | TGGTCATTCTGCTGTGTTCATTAGGT GCCAATGTGAAGTCTGGATTTTAA |
| 614 | Table 3A | Hs.78918 | AF002020 | 2276462 | Niemann-Pick disease, type C1 (NPC1), mRNA/cds = (123, 3959) | 1 | GGCATGAAATGAGGGACAAAGAAAG CATCTCGTAGGTGTGTCTACTGGGT |
| 615 | Table 3A | Hs.18792 | AF003938 | 2897941 | thioredoxin-like, 32 kD (TXNL), mRNA/cds = (205, 1074) | 1 | AATCTTGACACATGCAATTGTAAATAA AAGTCACCACTTTTGCCAAGCTT |
| 616 | Table 3A | Hs.337778 | AF004230 | 2343108 | hypothetical protein FLJ11068 (FLJ11068), mRNA/cds = (163, 1188) | 1 | TGATGCCTTCATCTGTTCAGTCATCT CCAAAAACAGTAAAAATAACCACT |
| 617 | Table 3A | Hs.183805 | AF005213 | 2843115 | ankyrin 1, erythrocytic (ANK1), transcript variant 3, mRNA/cds = (84, 5726) | 1 | GGCCAAGCTGAATGCCATGAATATCA GTGAGACGCGTTATAAGGAATCCT |
| 618 | Table 3A | Hs.42915 | AF006082 | 2282029 | ARP2 (actin-related protein 2, yeast) homolog (ACTR2), mRNA/cds = (74, 1258) | 1 | CCTGCCAGTGTCAGAAAATCCTATTT ATGAATCCTGTCGGTATTCCTTGG |
| 619 | Table 3A | Hs.6895 | AF006086 | 2282037 | actin related protein 2/3 complex, subunit 3 (21 kD) (ARPC3), mRNA/cds = (25, 581) | 1 | TCAAGAATTTGGGTGGGAGAAAAGAA AGTGGGTTATCAAGGGTGATTTGA |
| 620 | Table 3A | Hs.82425 | AF006088 | 2282041 | actin related protein 2/3 complex, subunit 5 (18 kD) (ARPC5), mRNA/cds = (24, 479) | 1 | CAAACTGGTGCAGAAATTCTATAAAC TCTTTGCTGTTTTTGATACCTGCT |
| 621 | Table 3A | Hs.22670 | AF006513 | 2645428 | chromodomain helicase DNA binding protein 1 (CHD1), mRNA/cds = (163, 5292) | 1 | GCTACTTGTTTACATTGTACACTGCG ACCACCTTGCCGCTTTTCATCACA |
| 622 | Table 3A | Hs.24752 | AF006516 | 2245670 | spectrin SH3 domain binding protein 1 (SSH3BP1), mRNA/cds = (81, 1607) | 1 | ACTGGATGCTACAGACTTATAACAGC ATAGTGAATGGTAAGACTAGTGCA |
| 623 | Table 3A | Hs.321149 | AF007155 | 2852635 | cDNA FLJ10257 fis, clone HEMBB1000887/cds = UNKNOWN | 1 | CCTCCCCTATGCCTCAGCCCATCTC TGCTCCTGTTTGAATTTTGTTATT |
| 624 | Table 3A | Hs.5409 | AF008442 | 2266928 | RNA polymerase I subunit (RPA40), mRNA/cds = (22, 1050) | 1 | CCAGTGTGACTAGGGATCCTGAGTTT TCTGGGACAATTCCAGCTTTAATC |
| 625 | Table 3A | Hs.225977 | AF012108 | 2331249 | nuclear receptor coactivator 3 (NCOA3), mRNA/cds = (183, 4421) | 1 | TGACCCTTCTTTAAGTTATGTGTGTG GGGAGAAATAGAATGGTGCTCTTA |
| 626 | Table 3A | Hs.334874 | AF012872 | 2326226 | phosphatidylinositol 4-kinase 230 (pl4K230) mRNA, complete cds/cds = (0, 6134) | 1 | GTGTGAGTCCTCTGTTTGCACTGGAC ATATTCCCTACCTGTCTTATTTCA |
| 627 | Table 3A | Hs.199291 | AF015041 | 4102706 | NUMB-R protein (NUMB-R) mRNA, complete cds/cds = (209, 2038) | 1 | AGGGGAAGGGGTGCCTGGCGGGTAC TTTTCTATCTTTATTTCCAGATTT |
| 628 | Table 3A | Hs.51233 | AF016266 | 2529582 | TRAIL receptor 2 mRNA, complete cds/cds = (117, 1439) | 1 | TCATGCTTCTGCCCTGTCAAAGGTCC CTATTTGAAATGTGTTATAATACA |
| 629 | Table 3A | Hs.76807 | AF016270 | 2655005 | major histocompatibility complex, class II, DR alpha (HLA-DRA), mRNA/cds = (26, 790) | 1 | AGCTAGCAGATCGTAGCTAGTTTGTA TTGTCTTGTCAATTGTACAGACTT |
| 630 | Table 3A | Hs.104624 | AF016495 | 6560598 | aquaporin 9 (AQP9), mRNA | 1 | AGCCCAGAATTCCCAAAGGCATTAGG |

TABLE 8-continued

| SEQ ID | Origin | Unigene | Locus | GI | Nominal Description | Strand | Probe Sequence |
|---|---|---|---|---|---|---|---|
| 631 | Table 3A | Hs.10958 | AF021819 | 2460317 | RNA-binding protein regulatory subunit (DJ-1), mRNA/cds = (20, 589) | 1 | TTTCCCAACTGCTTTGTGCTGATA GTGTCTATACATTTCTAAGCCTTGTTT GCAGAATAAACAGGGCATTTAGC |
| 632 | Table 3A | Hs.125134 | AF023142 | 4102966 | pre-mRNA splicing SR protein rA4 mRNA, partial cds/cds = (0, 3473) | 1 | TAGAGGTGTACAGATGCTATATTATA TCCGCTCCCGGTGTACTGCAGCCC |
| 633 | Table 3A | Hs.108809 | AF028292 | 2559009 | chaperonin containing TCP1, subunit 7 (eta) (CCT7), mRNA/cds = (68, 1699) | 1 | TTTTACAAGGAAGGGGTAGTAATTGG CCCACTCTCTTCTTACTGGAGGCT |
| 634 | Table 3A | Hs.168103 | AF026402 | 2655201 | prp28, U5 snRNP 100 kd protein (U5-100K), mRNA/cds = (39, 2501) | 1 | ACACGGTGAACTGGCTGTGTCCATCT TTGTCACTGAGTGAAATCTCTGTT |
| 635 | Table 3A | Hs.9573 | AF027302 | 2522533 | ATP-binding cassette, sub-family F (GCN20), member 1 (ABCF1), mRNA/cds = (94, 2517) | 1 | TGAGGACTTGGGGCAGGAAAGGAAT GCTGCTGAACTTGAATTTCCCTTTA |
| 636 | Table 3A | Hs.168132 | AF031167 | 2739159 | interleukin 15 (IL15), mRNA /cds = (316, 804) | 1 | TCAGACCTTGGATCAGATGAACTCTT AGAAATGAAGGCAGAAAAATGTCA |
| 637 | Table 3A | Hs.170133 | AF032885 | 2895491 | forkhead box O1A (rhabdomyosarcoma) (FOXO1A), mRNA/cds = (385, 2352) | 1 | CCACGTTCTTGTTCCGATACTCTGAG AAGTGCCTGATGTTGATGTACTTA |
| 638 | Table 3A | Hs.74276 | AF034607 | 4426566 | chloride intracellular channel 1 (CLIC1), mRNA/cds = (236, 961) | 1 | GCCTGGGTCAGATTTTTATTGTGGGG TGGGATGAGTAGGACAACATATTT |
| 639 | Table 3A | Hs.106890 | AF035306 | 2681087 | clone 23771 mRNA sequence /cds = UNKNOWN | 1 | GGGTGCCCACCTGCATGTGAAGGGG AGGCAGTTCTCAATTTATTTCAATA |
| 640 | Table 3A | Hs.184897 | AF035307 | 2661068 | clone 23785 mRNA sequence /cds = UNKNOWN | 1 | CAGTCACTGGGTCTATATTAAACAGC AACCAGAGCAACAAATGGCAAACA |
| 641 | Table 3A | Hs.278589 | AF035737 | 2827179 | general transcription factor II, i (GTF2i), transcript variant 1, mRNA/cds = (370, 3366) | 1 | TGACATGGTAGCAGAAATAGGCCCTT TTATGTGTTGCTTCTATTTTACCT |
| 642 | Table 3A | Hs.8257 | AF035947 | 9695283 | cytokine-inducible inhibitor of signalling type 1b mRNA, complete cds/cds = (3131, 3925) | 1 | AGCAAAGAACAGTTTGGTGGTCTTTT CTCTTCCACTGATTTTTCTGTAAT |
| 643 | Table 3A | Hs.8900 | AF037204 | 2906012 | ring finger protein 13 (RNF13), mRNA/cds = (151, 1296) | 1 | AGCCCTGCTAAACTATGTACAGAGGA AACTGTTCAAGTATTGGATTTGAA |
| 644 | Table 3A | Hs.155489 | AF037448 | 3037012 | NS1-associated protein 1 (NSAP1), mRNA/cds = (204, 1892) | 1 | TGTCAACGATGTTTCCAGTAGTGTTT AGATTTGGTGTCTTCAAAGGTAGT |
| 645 | Table 3A | Hs.12311 | AF038202 | 2795923 | clone 23570 mRNA sequence /cds = UNKNOWN | 1 | GGCTTTTTGCCCATCAAGAATAAAAA GAAATAAAACCAAAGGGTTACCGG |
| 646 | Table 3A | Hs.76807 | AF038564 | 2708328 | major histocompatibility complex, class II, DR alpha (HLA-DRA), mRNA/cds = (26, 790) | 1 | TGCCTGTTGCACATCTTGTAAAATTG GACAATGGCTCTTTAGAGAGTTAT |
| 647 | Table 3A | Hs.303627 | AF039575 | 2773157 | heterogeneous nuclear ribonucleoprotein D (AU-rich element RNA-binding protein 1, 37 kD) (HNRPD), transcript variant 1, mRNA/cds = (285, 1352) | 1 | TGCGGCTAGTTCAGAGAGATTTTTAG AGCTGTGGTGGACTTCATAGATGA |
| 648 | Table 3A | Hs.29417 | AF039942 | 4730928 | HCF-binding transcription factor Zhangfei (ZF), mRNA/cds = (457, 1275) | 1 | AATGGAAGGATTAGTATGGCCTATTT TTAAAGCTGCTTTGTTAGGTTCCT |
| 649 | Table 3A | Hs.8185 | AF042284 | 5256829 | CGI-44 protein; sulfide dehydrogenase like (yeast) (CGI-44), mRNA/cds = (76, 1428) | 1 | CCATGTGGGCTACTCATGATGGGCTT GATTCTTTGGGAATAATAAAATGA |
| 650 | db mining | Hs.298727 | AF042838 | 2815887 | MEK kinase 1 (MEKK1) mRNA, partial cds/cds = (0, 4487) | 1 | AACGAGGCCAGTGGGGAACCCTTAC CTAAGTATGTGATTGACAAATCATG |
| 651 | Table 3A | Hs.82280 | AF045229 | 2908029 | regulator of G-protein signalling 10 (RGS10), mRNA/cds = (43, 546) | 1 | CCTCTCAGGACGTGCCGGGTTATCA TTGCTTTGTTATTTGTAAGGACTG |
| 652 | Table 3A | Hs.62112 | AF046001 | 2895869 | zinc finger protein 207 (ZNF207), mRNA/cds = (202, 1838) | 1 | CCACTGCCTGAAAGGTTTGTACAGAT GCATGCCACAGTAGATGTCCACAT |
| 653 | Table 3A | Hs.241520 | AF047002 | 2896145 | transcriptional coactivator ALY mRNA, partial cds/cds = (0, 701) | 1 | TTTTGGGATAAATTTTACTGGTTGCTG TTGTGGAGAAGGTGGCGTTTCCA |
| 654 | Table 3A | Hs.132904 | AF047033 | 5051627 | sodium bicarbonate cotransporter 3 (SLC4A7) mRNA, complete cds /cds = (71, 3715) | 1 | TGAAGTATAAGCCTCTACTGGGTCTA TATTGTGAATCATCCTGCCTTTCA |
| 655 | Table 3A | Hs.50785 | AF047442 | 3335139 | SEC22, vesicle trafficking protein (S. cerevisiae)-like 1 (SEC22L1), mRNA/cds = (119, 766) | 1 | CTCGTCTATTGGCCCCTGTAGAAAGT TAACCTTTGTTGTTTTCCTTTTAT |
| 656 | Table 3A | Hs.40323 | AF047472 | 2921872 | BUB3 (budding uninhibited by benzimidazoles 3, yeast) homolog (BUB3), mRNA/cds = (70, 1056) | 1 | TCCCCTTCTGTCCCCTAGTAAGCCCA GTTGCTGTATCTGAACAGTTTGAG |
| 657 | Table 3A | Hs.26584 | AF051782 | 2947237 | diaphanous 1 (HDIA1) mRNA, complete cds/cds = (0, 3746) | 1 | AAACCTATTTCCCTTGCCTCATAGGC TTCTGGGATGTCATCACCTCCAGT |
| 658 | Table 3A | Hs.313 | AF052124 | 3360431 | secreted phosphoprotein 1 (osteopontin, bone sialoprotein I, early T-lymphocyte activation 1) (SPP1), mRNA/cds = (67, 989) | 1 | GAATTTGGTGGTGTCAATTGCTTATTT GTTTTCCCACGGTTGTCCAGCAA |

TABLE 8-continued

| SEQ ID | Origin | Unigene | Locus | GI | Nominal Description | Strand | Probe Sequence |
|---|---|---|---|---|---|---|---|
| 659 | Table 3A | Hs.227949 | AF052155 | 3360468 | SEC13 (*S. cerevisiae*)-like 1 (SEC13L1), mRNA/cds = (60, 1028) | 1 | CTATTTTGGGTCATTTTTATGTACCTT TGGGTTCAGGCATTATTTGGGGG |
| 660 | literature | Hs.115770 | AF053712 | 3057145 | tumor necrosis factor (ligand) superfamily, member 11 (TNFSF11), transcript variant 1, mRNA/cds = (156, 1109) | 1 | TAATTGTTGAACAGGTGTTTTTCCACA AGTGCCGCAAATTGTACCTTTTT |
| 661 | Table 3A | Hs.178710 | AF054174 | 3341991 | clathrin, heavy polypeptide (Hc) (CLTC), mRNA/cds = (172, 5199) | 1 | CCCCCTCAGAAGAATCATGAATTTGC AACAGACCTAATTTTTGGTTACTT |
| 662 | Table 3A | Hs.233952 | AF054185 | 4092057 | proteasome (prosome; macropain) subunit, alpha type, 7 (PSMA7), mRNA/cds = (24, 770) | 1 | GGCCTTTCCATTCCATTTATTCACACT GAGTGTCCTACAATAAACTTCCG |
| 663 | Table 3A | Hs.158164 | AF054187 | 4092059 | transporter 1, ATP-binding cassette, sub-family B (MDR/TAP) (TAP1), mRNA/cds = (30, 2456) | 1 | TGGTGTCTCAAAGGAGTAACTGCAGC TTGGTTTGAAATTTGTACTGTTTC |
| 664 | Table 3A | Hs.334826 | AF054284 | 4033734 | splicing factor 3b, subunit 1, 155 kD (SF3B1), mRNA/cds = (0, 3914) | 1 | TGCCAGTAGTGACCAAGAACACAGTG ATTATATACACTATACTGGAGGGA |
| 665 | Table 3A | Hs.13131 | AF055581 | 3845720 | lymphocyte adaptor protein (LNK), mRNA/cds = (357, 2084) | 1 | AGGACACATCTGACATCCTGTGTTTG GTTAAAATATACAGCACATTGTGA |
| 666 | Table 3A | Hs.278501 | AF056322 | 3252910 | SPG-100 (SP100) gene, partial cds; and high mobility group 1-like protein L3 (HMG1L3) retropseudogene sequence/cds = (0, 617) | 1 | TGGGGGTTGTAAATTGGCATGGAAAT TTAAAGCAGGTTCTTGTTAGTGCA |
| 667 | Table 3A | Hs.6856 | AF056717 | 3046994 | ash2 (absent, small, or homeotic, *Drosophila*, homolog)-like (ASH2L), mRNA/cds = (4, 1890) | 1 | TGTGAAAGAAACTTGCTTGCAGCTTT AACAAAATGAGAAACTTCCCAAAT |
| 668 | Table 3A | Hs.169895 | AF061738 | 4335938 | ubiquitin-conjugating enzyme E2L 6 (UBE2L6), mRNA/cds = (47, 508) | 1 | GTATATATCCTCCAGCATTCAGTCCA GGGGGAGCCACGGAAACCATGTTC |
| 669 | Table 3A | Hs.182579 | AF061738 | 4335940 | leucine aminopeptidase (LOC51058), mRNA/cds = (188, 1745) | 1 | TGTGATGCTAGGAACATGAGCAAACT GAAAATTACTATGCACTTGTCAGA |
| 670 | Table 3A | Hs.184592 | AF061944 | 6933863 | protein kinase, lysine deficient 1 (PRKWNK1), mRNA/cds = (0, 7148) | 1 | AACCCAGTATATCTGTGTTATCTGAT GGGACGGTTGACAGTGGTCAGGGA |
| 671 | Table 3A | Hs.79015 | AF063591 | 12002013 | antigen identified by monoclonal antibody MRC OX-2 (MOX2), mRNA/cds = (57, 866) | 1 | ATCCAGTGGCCTAGGAATTAAAGTGT TGTTGTTTTGCTGTTAAATTGGA |
| 672 | Table 3A | Hs.11000 | AF083805 | 4071360 | MY047 protein (MY047), mRNA /cds = (84, 479) | 1 | GCATTGGCAGCATTGTGTCTTTGACC TTGTATACTAGCTTGACATAGTGC |
| 673 | Table 3A | Hs.129708 | AF064090 | 3283355 | tumor necrosis factor (ligand) superfamily, member 14 (TNFSF14), mRNA/cds = (48, 770) | 1 | TTTCATGGTGTGAAGGAAGGAGCGT GGTGCATTGGACATGGGTCTGACAC |
| 674 | Table 3A | Hs.83530 | AF064839 | 4206051 | map 3p21; 3.15 cR from WI-9324 repeat region, complete sequence /cds = UNKNOWN | 1 | AGACTGCACAACCAAGAAGTTACTCA AAGCTCTGTGGGAGCCCCTGCCTG |
| 675 | Table 3A | Hs.4747 | AF067008 | 3873220 | dyskeratosis congenita 1, dyskerin (DKC1), mRNA/cds = (92, 1836) | 1 | CAGTGCTCACCTAAATCCATCTGACT ACTTGTTCCTGTGCCCTCTTGTTT |
| 676 | Table 3A | Hs.307357 | AF067519 | 3850317 | PITSLRE protein kinase beta SV1 isoform (CDC2L2) mRNA, complete cds/cds = (79, 2412) | 1 | GTGACGACGACCTGAAGGAGACGGG CTTCCACCTTACCACCACGAACCAG |
| 677 | Table 3A | Hs.307357 | AF067529 | 3850337 | PITSLRE protein kinase beta SV1 isoform (CDC2L2) mRNA, complete cds/cds = (79, 2412) | 1 | AACAGGATAAAGCTCGCCGGGAATG GGAAAGACAGAAGAGAAGGGAAATG |
| 678 | Table 3A | Hs.268763 | AF068235 | 4321975 | Breakpoint cluster region protein, uterine leiomyoma, 1; barrier to autointegration factor (BCRP1), mRNA/cds = (507, 776) | 1 | CCTCACCCCCACCCTCACTTTCAATC CGTTTGATACCATTTGGCTCCTTT |
| 679 | Table 3A | Hs.341182 | AF068836 | 3192908 | 602417258F1 cDNA, 5' end /clone = IMAGE:4538829/ clone_end = 5' | 1 | ATGGAAAGATGTGGTCTGAGATGGGT GCTGCAAAGATCATAATAAAGTCA |
| 680 | Table 3A | Hs.92384 | AF070523 | 3764088 | vitamin A responsive; cytoskeleton related (JWA), mRNA/cds = (89, 655) | 1 | CCATGACTTCACAGACATGGTCTAGA ATCTGTACCCTTACCCACATATGA |
| 681 | Table 3A | Hs.151903 | AF070525 | 3387880 | clone 24706 mRNA sequence /cds = UNKNOWN | 1 | CTGTGAATGTTTGCAGTCTCCTACCG TCTCAACTACAGCTGCAGTTGCTA |
| 682 | Table 3A | Hs.26118 | AF070582 | 3387954 | hypothetical protein MGC13033 (MGC13033), mRNA/cds = (200, 304) | 1 | CAGCCTGAATTGCCTCTGGGAAGAG GGGTGGGAATGACTTTTCAATGTAC |
| 683 | Table 3A | Hs.106823 | AF070635 | 3283905 | mRNA for KIAA1823 protein, partial cds/cds = (52, 1185) | 1 | AATGGCCTAGAATTTGTGGTAGTTGC CAAAGAGGTTCTCCTAGGTGGTCT |
| 684 | Table 3A | Hs.108112 | AF070640 | 3283913 | *Homo sapiens*, histone fold protein CHRAC17; DNA polymerase | 1 | CAGTGAAAAGTTTGTGAGTGAAGAAT GCTGAGAAGATTGTAATGCTTTGT |

TABLE 8-continued

| SEQ ID | Origin | Unigene | Locus | GI | Nominal Description | Strand | Probe Sequence |
|---|---|---|---|---|---|---|---|
| | | | | | epsilon p17 subunit, clone MGC:2725 IMAGE:2822216, mRNA, complete cds/cds = (80, 523) | | |
| 685 | Table 3A | Hs.76691 | AF070673 | 3978241 | stannin mRNA, complete cds /cds = (175, 441) | 1 | TTGTCTCAAAGCTACCAAGTTTGTGC AATAAGTGGAAGGGATGTCATCCT |
| 686 | Table 3A | Hs.223615 | AF070874 | 3978243 | RC2-BN0074-150400-018-c08 cDNA | 1 | ACATCGAAGGTGTGCATATATGTTGA ATGACATTTTAGGGACATGGTGTT |
| 687 | Table 3A | Hs.112255 | AF071076 | 4545098 | nucleoporin 98 kD (NUP98), mRNA/cds = (124, 5262) | 1 | GGCTATCTCAGGCAATATGGCCAGCA CCTGGGTCTTTATGCATGAAGATA |
| 688 | Table 3A | Hs.76095 | AF071596 | 3851531 | immediate early response 3 (IER3), mRNA/cds = (11, 481) | 1 | GCTGTCACGGAGCGACTGTCGAGAT CGCCTAGTATGTTCTGTGAACACAA |
| 689 | Table 3A | Hs.18571 | AF072860 | 3290197 | protein kinase, interferon-inducible double stranded RNA dependent activator (PRKRA), mRNA /cds = (96, 1037) | 1 | AGCTGCTGACTTGACTGTCATCCTGT TCTTGTTAGCCATTGTGAATAAGA |
| 690 | Table 3A | Hs.79877 | AF072928 | 3916215 | myotubularin related protein 6 mRNA, partial cds/cds = (0, 1398) | 1 | CTCACAGGTGGACTGAGAAATCAGTT ACATCTTAAGTGACCTACAGGGTA |
| 691 | Table 3A | Hs.143648 | AF073310 | 4511968 | insulin receptor substrate-2 (IRS2) mRNA, complete cds/cds = (518, 4532) | 1 | GTGCATTGTATTTAGTCTGTATTGATC ATGGATGCCCTCCTTAATAGCCA |
| 692 | Table 3A | Hs.151411 | AF075587 | 3319325 | KIAA0916 protein (KIAA0916), mRNA/cds = (146, 14071) | 1 | CCTGTACAATTGCATCACGGGTGGG GATAAAAAGAGGAATATTCTGGTTT |
| 693 | Table 3A | Hs.550 | AF076485 | 5430704 | phosducin (PDC), transcript variant PhLOP2, mRNA/cds = (5, 358) | 1 | AAACAGAGCTGTCTTCAGCAACATTA TTAGTAGACAAAGAGGATGTGGAT |
| 694 | Table 3A | Hs.4311 | AF079566 | 4574148 | SUMO-1 activating enzyme subunit 2 (UBA2), mRNA/cds = (25, 1947) | 1 | ACTCAAGTTTTCAGTTTGTACCGCCT GGTATGTCTGTGTAAGAAGCCAAT |
| 695 | db mining | Hs.159376 | AF080577 | 3551871 | RAG2 mRNA, partial cds/cds = (0, 324) | 1 | TGACTCCTGCCAAGAAATCCTTTCTT AGAAGGTTGTTTGATTAGTTTTGC |
| 696 | Table 3A | Hs.107979 | AF081282 | 4336324 | small membrane protein 1 (SMP1), mRNA/cds = (99, 572) | 1 | TTGTATTATCTGCTTTGCTGATGTAGA CAAGAGTTAACTGAGTAGCATGC |
| 697 | Table 3A | Hs.36794 | AF082589 | 4206702 | cyclin D-type binding-protein 1 (CCNDBP1), mRNA/cds = (87, 1172) | 1 | AAAGATTGTTGGTTAGGCCAGATTGA CACCTATTTATAAACCATATGCGT |
| 698 | Table 3A | Hs.8765 | AF083255 | 3435311 | RNA helicase-related protein (RNAHP), mRNA/cds = (17, 2148) | 1 | TGGTAACTGTTCCAGGATTGCTCCAG GTTTGAGATGGTATTGCTAAATTT |
| 699 | Table 3A | Hs.168913 | AF083420 | 5326765 | serine/threonine kinase 24 (Ste20, yeast homolog) (STK24), mRNA/cds = (78, 1373) | 1 | TGCACCTTGTAGTGGATTCTGCATAT CATCTTTCCCACCTAAAAATGTCT |
| 700 | Table 3A | Hs.327546 | AF084555 | 5813858 | hypothetical protein MGC10786 (MGC10786), mRNA/cds = (38, 169) | 1 | CACTAGCACTTGTGATGCAATAGAAC ACTTCGCCTGTACTGAAAGGGCCA |
| 701 | Table 3A | Hs.211610 | AF090693 | 4249665 | apoptosis-related RNA binding protein (NAPOR-3) mRNA, complete cds/cds = (67, 1593) | 1 | ACGCAGGCTTTCCTATTTCTACAACT GATTGTACTTATGCATTTTGTACC |
| 702 | Table 3A | Hs.5437 | AF090891 | 6690159 | Tax1 (T-cell leukemia virus type I) binding protein 1 (TAX1BP1), mRNA/cds = (83, 2326) | 1 | CAGGAGCTACTTTGAGTTTGGTGTTA CTAGGATCAGGGTCAGTCTTTGGC |
| 703 | Table 3A | Hs.192705 | AF090927 | 6890220 | PRO0457 protein (PRO0457), mRNA/cds = (985, 1431) | 1 | TAGAGAGAGGCCCGTGGCCTGAGGT AGTGCAGAGGAGGATAGTAGAGCAG |
| 704 | Table 3A | Hs.201675 | AF091263 | 4140646 | RNA binding motif protein 5 (RBM5), mRNA/cds = (148, 2595) | 1 | TTTTGGAAGATTTTCAGTCTAGTTGC CAAATCTGGCTCCTTTACAAAAGA |
| 705 | Table 3A | Hs.241558 | AF099149 | 3930775 | ariadne (Drosophila) homolog 2 (ARIH2), mRNA/cds = (144, 1825) | 1 | AAGTTAATTGAGGCAATGTCATCTGC TCAAAGTTGAGTGGTTTATTCACA |
| 706 | Table 3A | Hs.306357 | AF103458 | 4378245 | isolate donor N clone N168K immunoglobulin kappa light chain variable region mRNA, partial cds /cds = (0, 303) | 1 | TTGCAGTGTATTACTGTCAGCAGTAT GGTAGCTCACCGTGGACGTTCGGC |
| 707 | Table 3A | Hs.184601 | AF104032 | 4426639 | L-type amino acid transporter subunit LAT1 mRNA, complete cds/cds = (66, 1589) | 1 | TATTCTGTGTTAATGGCTAACCTGTTA CACTGGGCTGGGTTGGGTAGGGT |
| 708 | Table 3A | Hs.294603 | AF104398 | 4063708 | 601657573R1 cDNA, 3' end /clone = IMAGE:3875611/ clone_end = 3' | 1 | AAACTGAATGAGAGAAAATTGTATAA CCATCCTGCTGTTCCTTTAGTGCA |
| 709 | Table 3A | Hs.7043 | AF104921 | 9409793 | succinate-CoA ligase, GDP-forming, alpha subunit (SUCLG1), mRNA/cds = (31, 1032) | 1 | TGACACTGGTCTTGCAGTACAACTGG AAGCCAAAACAAGGTGGAAGATGT |
| 710 | Table 3A | Hs.4876 | AF105366 | 5106522 | solute carrier family 12 (potassium/chloride transporters), member 6 (SLC12A6), mRNA/cds = (51, 3350) | 1 | GGTCAAGTATATTTGGACCTATTATC CTCGGCAAGCCAAGATGCAAACAT |
| 711 | Table 3A | Hs.167460 | AF107405 | 5531903 | pre-mRNA splicing factor (SFRS3) mRNA, complete cds/cds = | 1 | AGTTCACAATATGGTTCAAATGTAAC AGTGCAGAATTGAATATGGAGGCA |

TABLE 8-continued

| SEQ ID | Origin | Unigene | Locus | GI | Nominal Description | Strand | Probe Sequence |
|---|---|---|---|---|---|---|---|
| 712 | Table 3A | Hs.79335 | AF109733 | 4566529 | SWI/SNF related, matrix associated, actin dependent regulator of chromatin, subfamily d, member 1 (SMARCD1), mRNA/cds = (95, 589) (265, 1572) | 1 | TTGCATCTTTCCAGGAGAGCCTCACA TTCTTCTTCCAGGTTGTATCACCC |
| 713 | Table 3A | Hs.274472 | AF113008 | 6642739 | high-mobility group (nonhistone chromosomal) protein 1 (HMG1), mRNA/cds = (52, 699) | 1 | GTGAGTCAGGAGCAGGAGCGTGCGG ACCAAAAATCCTCAGCCCTTACGAC |
| 714 | Table 3A | Hs.180946 | U66589 | 1575566 | ribosomal protein L5 pseudogene mRNA, complete cds/cds = UNKNOWN | 1 | TCACCTTATGCAATGTGAATTATCACT ACAGAACTCCATCTTACTCCAGA |
| 715 | Table 3A | Hs.109441 | AF113213 | 11640573 | cDNA FLJ14235 fis, clone NT2RP4000167/cds = (82, 2172) | 1 | TTTGATGTAATATAACCTAACGTTGTG CTGGTACCTGTTTTACCATGTGT |
| 716 | Table 3A | Hs.297681 | AF113676 | 6855600 | clone FLB2803 PRO0684 mRNA, complete cds/cds = (1108, 2364) | 1 | CTCCATCCCTGGCCCCCTCCCTGGAT GACATTAAAGAAGGGTTGAGCTGG |
| 717 | Table 3A | Hs.297681 | AF113676 | 6855600 | clone FLB2803 PRO0684 mRNA, complete cds/cds = (1108, 2364) | 1 | CTCCATCCCTGGCCCCCTCCCTGGAT GACATTAAAGAAGGGTTGAGCTGG |
| 718 | Table 3A | Hs.75117 | AF113702 | 6855838 | interleukin enhancer binding factor 2, 45 kD (ILF2), mRNA/cds = (39, 1259) | 1 | GGCTTAGCTGCCAGTCTCCCATTTGT GACCTATGCCATCCATCTATAATG |
| 719 | Table 3A | Hs.177415 | AF116606 | 7959715 | PRO0890 mRNA, complete cds /cds = (1020, 1265) | 1 | GGCCCCAATGCCAACTCTTAAGTCTT TTGTAATTCTGGCTTTCTCTAATA |
| 720 | Table 3A | Hs.321158 | AF116620 | 8924006 | hypothetical protein PRO1068 (PRO1068), mRNA/cds = (1442, 1750) | 1 | TGTCAGGTTTGGGTCTTGGGTTCAAG TGTATATATTCCTGTAAGTTTCTT |
| 721 | Table 3A | Hs.288036 | AF116679 | 7959856 | tRNA isopentenylpyrophosphate transferase (IPT), mRNA /cds = (60, 1040) | 1 | TGCATCGTAAAACCTTCAGAAGGAAA GGAGAATGTTTTGTGGACCACTTT |
| 722 | Table 3A | Hs.238205 | AF116682 | 7959882 | PRO2013 mRNA, complete cds /cds = (135, 380) | 1 | TTGACATTCTGCGAAAGCAACAAGCA AACTGAAGACCAACTCCTATGAGA |
| 723 | Table 3A | Hs.83583 | NM_005731 | 5031598 | actin related protein 2/3 complex, subunit 2 (34 kD) (ARPC2), mRNA/cds = (84, 986) | 1 | CGCCTCTTCAGGTTCTTAAGGGATTC TCCGTTTTGGTTCCATTTTGTACA |
| 724 | Table 3A | Hs.128740 | AF118274 | 4680228 | DNb-5 mRNA, partial cds /cds = (0, 1601) | 1 | CCTTGTTGGACAGGGGGACAGGCTG CCTACTGGAATGTAAATATGTGATA |
| 725 | Table 3A | Hs.225939 | AF119417 | 7670074 | sialyltransferase 9 (CMP-NeuAc:lactosylceramide alpha-2,3-sialyltransferase; GM3 synthase) (SIAT9), mRNA/cds = (277, 1365) | 1 | TTTCTGAATGCCTACCTGGCGGTGTA TACCAGGCAGTGTCCCAGTTTAAA |
| 726 | Table 3A | Hs.184011 | AF119665 | 6563255 | pyrophosphatase (inorganic) (PP), nuclear gene encoding mitochondrial protein, mRNA/cds = (77, 946) | 1 | TGTGCAAGGGGAGCACATATTGGAT GTATATGTTACCATATGTTAGGAAA |
| 727 | Table 3A | Hs.2186 | AF119850 | 7770136 | Homo sapiens, eukaryotic translation elongation factor 1 gamma, clone MGC:4501 IMAGE:2964623, mRNA, complete cds/cds = (2278, 3231) | 1 | TCAAGTGAACATCTCTTGCCATCACC TAGCTGCCTGCACCTGCCCTTCAG |
| 728 | Table 3A | Hs.111334 | AF119897 | 7770230 | PRO2760 mRNA, complete cds /cds = UNKNOWN | 1 | CCGAGGAGAAGCGCGAGGGCTACGA GCGTCTCCTGAAGATGCAAAACCAG |
| 729 | Table 3A | Hs.9851 | AF123073 | 12698331 | C/EBP-induced protein (LOC81558), mRNA/cds = (30, 1391) | 1 | GCAGCTGTTTGAAGTTTGTATATTTC CGTACTGCAGAGCTTACACAAAA |
| 730 | Table 3A | Hs.180566 | AF123094 | 5669089 | mucosa associated lymphoid tissue lymphoma translocation gene 1 (MALT1), mRNA/cds = (164, 2638) | 1 | GCCTGTGAAATAGTACTGCACTTACA TAAAGTGAGACATTGTGAAAAGGC |
| 731 | Table 3A | Hs.7540 | AF126026 | 7158285 | unknown mRNA/cds = (0, 1261) | 1 | GCTCTGATTGTACAAGAATTACCTGT GCTAGTCAAGTTGTTGTTTTTCCT |
| 732 | Table 3A | Hs.15259 | AF127139 | 6724085 | BCL2-associated athanogene 3 (BAG3), mRNA/cds = (306, 2033) | 1 | CTGTCTTTTGTAGCTCTGGACTGGAG GGGTAGATGGGGAGTCAATTACCC |
| 733 | Table 3A | Hs.304177 | AF130085 | 11493474 | clone FLB8503 PRO2286 mRNA, complete cds/cds = UNKNOWN | 1 | GGTACAACCTTCAACTATTTCTTCCAT GCGGACCCCCTCCTGCCAAAAGA |
| 734 | Table 3A | Hs.279789 | AF130094 | 11493492 | histone deacetylase 3 (HDAC3), mRNA/cds = (55, 1341) | 1 | GCAATTCTCCCTGCGTCATGGATTTC AAGGTCTTTTAATCACCTTCGGTT |
| 735 | Table 3A | Hs.6456 | AF130110 | 11493523 | clone FLB6303 PRO1633 mRNA, complete cds/cds = (2546, 3097) | 1 | CCTTCGCTTTAACATAGGTCTAATTTA TTTGCCGTGCCATTTTCCATACA |
| 736 | Table 3A | Hs.333555 | AF131753 | 4406571 | cytoplasmic protein mRNA, complete cds/cds = (236, 3181) | 1 | TGGTTGGAAGTGGGTGGGGTTATGA AATTGTAGATGTTTTTAGAAAAACT |
| 737 | Table 3A | Hs.64001 | AF131762 | 4406584 | clone 25218 mRNA sequence /cds = UNKNOWN | 1 | ACCTTCCTCCAGGAAAAGCCATTCAA GCCTGATTATTTTTCTAAGTAACT |
| 738 | Table 3A | Hs.8148 | AF131856 | 4406702 | selenoprotein T (LOC51714), mRNA/cds = (138, 629) | 1 | CTGTATAGCTTTCCCCACCTCCCACA AAATCACCCAGTTAATGTGTGTGT |

TABLE 8-continued

| SEQ ID | Origin | Unigene | Locus | GI | Nominal Description | Strand | Probe Sequence |
|---|---|---|---|---|---|---|---|
| 739 | Table 3A | Hs.301824 | AF132197 | 11493539 | hypothetical protein PRO1331 (PRO1331), mRNA/cds = (422, 616) | 1 | GGGGTACCTGTGTTGAGTTGATAAAC ATTTCCATCTTCATTAAAACTGCT |
| 740 | Table 3A | Hs.79933 | AF135162 | 7259481 | cyclin I (CCNI), mRNA/cds = (0, 1133) | 1 | TGTCCACCTTTGCAGCCTGTTTCTGT CATGTAGTTTCAACAAGTGCTACC |
| 741 | Table 3A | Hs.160417 | AF137030 | 6649056 | transmembrane protein 2 (TMEM2), mRNA/cds = (148, 4299) | 1 | ATGCTACCTCAAAGTGCTACCGATAA ACCTTTCTAATTGTAAGTGCCCTT |
| 742 | Table 3A | Hs.70337 | AF138903 | 7767238 | nectin-like protein 2 (NECL2) mRNA, complete cds/cds = (3, 1331) | 1 | AGCACCCATTCCGACCATAGTATAAT CATATCAAAGGGTGAGAATCATTT |
| 743 | Table 3A | Hs.65450 | AF148537 | 10039550 | reticulon 4a mRNA, complete cds /cds = (141, 3719) | 1 | TGTGGTTTAAGCTGTACTGAACTAAA TCTGTGGAATGCATTGTGAACTGT |
| 744 | Table 3A | Hs.334468 | AF151049 | 7106819 | hypothetical protein (LOC51245), mRNA/cds = (0, 359) | 1 | ATTACGAAGATGAACCAGTAAACGAG GACATGGAGTGACTATCGGGGCGG |
| 745 | Table 3A | Hs.278429 | AF151054 | 7106829 | hepatocellular carcinoma-associated antigen 59 (LOC51759), mRNA/cds = (27, 896) | 1 | TCCTCCAGCTGACAGAAAAATCCAGG ATGAGATCAGAAGGATACTGGTGT |
| 746 | db mining | Hs.274509 | AF151103 | 5758136 | T-cell receptor aberrantly rearranged gamma-chain mRNA from cell line HPB-MLT/cds = UNKNOWN | 1 | TTTACACGCCCTGAAGCAGTCTTCTT TGCTAGTTGAATTATGTGGTGTGT |
| 747 | Table 3A | Hs.279918 | AF151875 | 4929702 | hypothetical protein (HSPC111), mRNA/cds = (62, 598) | 1 | GTTCACGGAAAAGCCAGAACCTGCT GTTTTCAGGGTGGGTGATGTAAATA |
| 748 | Table 3A | Hs.31323 | AF153419 | 13133509 | IkappaBkinase complex-associated protein (IKBKAP) mRNA, complete cds/cds = (310, 4308) | 1 | AGTGCTCTTGCTTTGGATAACTGTAA AGGGACCCATGCTGATAGACTGGA |
| 749 | Table 3A | Hs.296323 | AF153609 | 5231142 | serum/glucocorticoid regulated kinase (SGK), mRNA/cds = (42, 1337) | 1 | TGCCCCAGTTGTCAGTCAGAGCCGTT GGTGTTTTTCATTGTTTAAAATGT |
| 750 | Table 3A | Hs.22350 | AF157116 | 8571911 | cDNA: FLJ23595 fis, clone LNG15262/cds = UNKNOWN | 1 | AAACCAATGGACAAACTTCTTGCTTC AAGGAACAAACTCTTAGGTTGGCA |
| 751 | Table 3A | Hs.5548 | AF157323 | 7688696 | p45SKP2-like protein mRNA, complete cds/cds = (37, 2061) | 1 | AAACATCATGAGAGTGGAGGCCTGC CACCCAGAAAGGCACATACTAGTGC |
| 752 | Table 3A | Hs.19807 | AF161339 | 6841091 | rho-gtpase activating protein ARHGAP9 (ARHGAP9), mRNA/cds = (406, 2658) | 1 | AGTGGATTAACCCCTGCTTCTCTTCT TGTTCCCTGTTATCATTCCTCCCC |
| 753 | Table 3A | Hs.259683 | AF161384 | 6841141 | HSPC101 mRNA, partial cds /cds = (0, 556) | 1 | GTCTGCTTATTCGTGTCTCTTACTAG GTTCAATTTCTTGGAGGCCGTGAT |
| 754 | Table 3A | Hs.180145 | AF161415 | 6841243 | HSPC297 mRNA, partial cds /cds = (0, 438) | 1 | TGGCCTGACTGACATGCAGTTCCATA AATGCAGATGTTTGTCTCATTACC |
| 755 | Table 3A | Hs.339814 | AF161430 | 6841273 | nt85d12.s1 cDNA /clone = IMAGE:1205303 | 1 | GCCAGACTTGAAAGAGGGCTCCAGA AAAAGTAGATGCGTATCTGTACAAA |
| 756 | Table 3A | Hs.284295 | AF161451 | 6841315 | HSPC333 mRNA, partial cds /cds = (0, 443) | 1 | CGTCTTAATGTTCACCGTCCACAGCT TTGGAATAAACCATCCTGGGAAGT |
| 757 | Table 3A | Hs.284295 | AF161455 | 6841323 | HSPC333 mRNA, partial cds /cds = (0, 443) | 1 | TTAATGTTCACCGTCCACAGCTTTGG AATAAACCATCCTGGGAAGTTGCT |
| 758 | Table 3A | Hs.284162 | AF165521 | 9294748 | 60S ribosomal protein L30 isolog (LOC51187), mRNA/cds = (143, 634) | 1 | TCTAGCCCAGCATTGATCTAGAAGCA GAGGAATCCCAGCGCCTTTTAAAA |
| 759 | Table 3A | Hs.283740 | AF173296 | 9622516 | DC6 protein (DC6), mRNA /cds = (161, 466) | 1 | TTGCTCAGCATGCCAGCCTTTAAGAT TGAATTAGATTGTGTTGTTGTGGT |
| 760 | Table 3A | NA | AF173954 | 6002958 | Cloning vector pGEM-URA3 | 1 | AAAAGGTATAGAAATGCTGGTTGGAA TGCTTATTTGAAAAAGACTGGCCA |
| 761 | Table 3A | Hs.81001 | AF174605 | 6164752 | F-box protein Fbx25 (FBX25) mRNA, partial cds/cds = (0, 818) | 1 | CTGCTTCACGCCTGTGTCTCCGCAGC ACTTCATCGACCTCTTCAAGTTTT |
| 762 | Table 3A | Hs.288836 | AF176706 | 6573265 | hypothetical protein FLJ12673 (FLJ12673), mRNA/cds = (2, 1687) | 1 | AGAGCAGCTTGTGTATGTAAACGCTT CAGTGAACTTGCTAATGATCCAAT |
| 763 | Table 3A | Hs.250619 | AF182420 | 10197639 | phorbolin-like protein MDS019 (MDS019), mRNA/cds = (231, 1385) | 1 | TCAAACCTACTAATCCAGCGACAATT TGAATCGGTTTTGTAGGTAGAGGA |
| 764 | Table 3A | Hs.279789 | AF187554 | 6653225 | histone deacetylase 3 (HDAC3), mRNA/cds = (55, 1341) | 1 | TCAACCTCCGTCATGTTTTAGAAACC TTTTATCTTTTCCTTCCTCATGCT |
| 765 | Table 3A | Hs.49163 | AF189011 | 8886721 | ribonuclease III (RN3) mRNA, complete cds/cds = (245, 4369) | 1 | TTTCCATCTGTGTCCCAGATTGTGAC CCTAGACTTTCAATTGACAAGTAA |
| 766 | Table 3A | Hs.106778 | AF189723 | 6826913 | calcium transport ATPase ATP2C1 (ATP2C1A) mRNA, complete cds /cds = (202, 2913) | 1 | CATGTCGTTAGATGGAACATGGAAGC CATTGTCTAATCAACTCTATCATT |
| 767 | Table 3A | Hs.102506 | AF193339 | 7341090 | eukaryotic translation initiation factor 2-alpha kinase 3 (EIF2AK3), mRNA/cds = (72, 3419) | 1 | ATGTAATCCTGTAGGTTGGTACTTCC CCCAAACTGATTATAGGTAACAGT |
| 768 | Table 3A | Hs.179573 | AF193556 | 6907041 | collagen, type I, alpha 2 (COL1A2), mRNA/cds = (139, 4239) | 1 | TGAATGATCAGAACTGACATTTAATTC ATGTTTGTCTCGCCATGCTTCTT |

TABLE 8-continued

| SEQ ID | Origin | Unigene | Locus | GI | Nominal Description | Strand | Probe Sequence |
|---|---|---|---|---|---|---|---|
| 769 | Table 3A | Hs.126550 | AF195514 | 11225484 | VPS4-2 ATPase (VPS42) mRNA, complete cds/cds = (201, 1535) | 1 | TTTGCACATTTTACATATGCTATGTGG TTGCCTTTGGGTTTTCTGTACAG |
| 770 | Table 3A | Hs.56542 | AF195530 | 9739016 | *Homo sapiens*, X-prolyl aminopeptidase (aminopeptidase P) 1, soluble, clone MGC:15561 IMAGE:3139868, mRNA, complete cds/cds = (140, 2011) | 1 | TGGTCATGTTCCAGGTGCTAGTACAT CATTCATGATCACCTTAATGCTCA |
| 771 | Table 3A | Hs.44143 | AF197569 | 11385353 | BAF180 (BAF180) mRNA, complete cds/cds = (96, 4844) | 1 | AGCATAAAGAGTTGTGGATCAGTAGC CATTTTAGTTACTGGGGGTGGGGG |
| 772 | Table 3A | Hs.160999 | AF198614 | 7582270 | AV648418 cDNA, 3' end /clone = GLCBJC04/ clone_end = 3' | 1 | TCAACACTTTGCTTTATTTGACACAAC CAGACTTTCTCAGTTCCTGTTCT |
| 773 | Table 3A | Hs.26367 | AF202092 | 11493699 | PC3-96 protein (PC3-96), mRNA /cds = (119, 586) | 1 | ATGAAGAAAATCATTGAGACTGTTGC AGAAGGAGGGGGAGAACTTGGAGT |
| 774 | Table 3A | Hs.182982 | AF204231 | 6808610 | 88-kDa Golgi protein (GM88) mRNA, complete cds/cds = (342, 2237) | 1 | ACTGAAAGACTTTTGCTTAAAGTGGC ATTATTGACTGCTGATGTGATGCT |
| 775 | Table 3A | Hs.197298 | AF205218 | 12003206 | NS1-binding protein-like protein mRNA, complete cds/cds = (555, 2483) | 1 | TTGGTTGGTAACTCTGTAATTCCTAA CTATCACTGGTTTGGTTCTGGACT |
| 776 | Table 3A | Hs.155530 | AF208043 | 6644296 | IFI16b (IFI16b) mRNA, complete cds/cds = (264, 2312) | 1 | CCACCATATATACTAGCTGTTAATCCT ATGGAATGGGGTATTGGGAGTGC |
| 777 | literature | Hs.185708 | AF208502 | 6630993 | early B-cell transcription factor (EBF) mRNA, partial cds/cds = (0, 1761) | 1 | AGAGGAATCTGAAAGTGCAGGGTGTT GGTTAAAGTTGTACCTCCCAAGTA |
| 778 | Table 3A | Hs.5862 | AF208844 | 7582275 | hypothetical protein (BM-002), mRNA/cds = (39, 296) | 1 | TTTTTCTCCATCCTGTTTCTAGCACAA AAATTTGCCTGCTGTGTTACAAA |
| 779 | Table 3A | Hs.82911 | AF208850 | 7582287 | BM-008 mRNA, complete cds /cds = (341, 844) | 1 | CAGATTGATTTGAAAGGTGTGCAGCC TGATTTAAAACCAAACCCTGAACC |
| 780 | Table 3A | Hs.12830 | AF208855 | 7582297 | hypothetical protein (LOC51320), mRNA/cds = (67, 459) | 1 | GCAACTAATAAGCCAAGGAATCGACA TATATTAGGTGCGTGTACTGTTTC |
| 781 | Table 3A | Hs.295231 | AF212224 | 9437514 | CLK4 mRNA, complete cds /cds = (153, 1514) | 1 | TGTCCAGTGATAAATGTGATTGATCT TGCCTTTTGTACATGGAGGTCACC |
| 782 | Table 3A | Hs.284162 | AF212226 | 13445483 | 60S ribosomal protein L30 isolog (LOC51187), mRNA/cds = (143, 634) | 1 | TCTAGCCCAGCATTGATCTAGAAGCA GAGGAATCCCAGCGCCTTTTAAAA |
| 783 | Table 3A | Hs.68644 | AF212233 | 13182746 | microsomal signal peptidase subunit mRNA, complete cds/ cds = (57, 635) | 1 | AGGGAACAGTGTGGAGATGTTTTTGT CTTGTCCAAATAAAAGATTCACCA |
| 784 | Table 3A | Hs.332404 | AF212241 | 13182760 | CDA02 protein (CDA02), mRNA /cds = (2, 1831) | 1 | ACCCATTGGTATACACAGAATATTCC TGTGCCCACACTTAATGTCAATCT |
| 785 | Table 3A | Hs.9414 | AF217190 | 11526792 | MLEL1 protein (MLEL1) mRNA, complete cds/cds = (73, 3099) | 1 | TTGATGATACCACCAGTAAAAATAGG ATGTTTACCCCAAAACAAGTGTCA |
| 786 | Table 3A | Hs.288850 | AF220656 | 7107358 | cDNA: FLJ22528 fis, clone HRC12825/cds = UNKNOWN | 1 | TTTCAACCGAAAGGGCAGATCCAATA GAAGACCCGCTCCTTAAATAAACA |
| 787 | Table 3A | Hs.46847 | AF223469 | 7578788 | TRAF and TNF receptor-associated protein (AD022), mRNA/cds = (16, 1104) | 1 | ACAGAGGCAAAGTTAAGCTTGATGAT GGTTAAAATCGGTTTGATAGCACC |
| 788 | Table 3A | Hs.79025 | AF226044 | 9295326 | HSNFRK (HSNFRK) mRNA, complete cds/cds = (641, 2938) | 1 | TGGTTGATTTCCCTCATTGTGTAAAC ATTGACAGGTATGTGACAAATGGG |
| 789 | Table 3A | Hs.112242 | AF228422 | 12656020 | normal mucosa of esophagus specific 1 (NMES1), mRNA/ cds = (189, 440) | 1 | CACAAACTAGATTCTGGACACCAGTG TGCGGAAATGCTTCTGCTACATTT |
| 790 | Table 3A | Hs.55173 | AF231023 | 7407145 | cadherin, EGFLAG seven-pass G-type receptor 3, flamingo (*Drosophila*) homolog (CELSR3), mRNA/cds = (281, 10219) | 1 | GGCCCTCTTTCCTGTCTGTGTAAATT GTTCCGTGAAGCCGCGCTCTGTTT |
| 791 | Table 3A | Hs.4788 | AF240468 | 9992877 | nicastrin mRNA, complete cds /cds = (142, 2271) | 1 | CACTGTCCTTTCTCCAGGCCCTCAGA TGGCCACATTAGGGTGGGCGTGCTG |
| 792 | Table 3A | Hs.196015 | AF241534 | 9502099 | hydatidiform mole associated and imprinted (HYMAI) mRNA, complete sequence/cds = UNKNOWN | 1 | AGGAGCTATGATTAGACTTCTGTTAG ACTTCCTCACTCTATCACCCACAT |
| 793 | Table 3A | Hs.81897 | AF241785 | 12005486 | NPD012 (NPD012) mRNA, complete cds/cds = (552, 2252) | 1 | ACCCACTTTCTCCTTGGTAAAGCGTT TACTTAACAAAATAATACCCGAGA |
| 794 | Table 3A | Hs.153042 | AF244129 | 10197716 | cell-surface molecule Ly-9 mRNA, complete cds/cds = (30, 1994) | 1 | GTCACACATGACACAAGATGTACATA ATATCATGCTCACGCCTGGAGTGT |
| 795 | Table 3A | Hs.20597 | AF244137 | 7670839 | host cell factor homolog (LCP), mRNA/cds = (316, 1536) | 1 | ATGTGCATGTGAATGGCCTAGAGAAC CTATTTTGTGTCTAAAGTTTACA |
| 796 | Table 3A | Hs.145956 | AF246126 | 8571416 | zinc finger protein mRNA, complete cds/cds = (1073, 3133) | 1 | AGATCCTGTCCTCCTTTAGCCTCACT AATCAAGTTGGGTCCTATCTTCCC |
| 797 | Table 3A | Hs.239625 | AF246221 | 7658294 | integral membrane protein 2B (ITM2B), mRNA/cds = (170, 970) | 1 | AGTTGTTAGTTGCCCTGCTACCTAGT TTGTTAGTGCATTTGAGCACACAT |
| 798 | Table 3A | Hs.6289 | AF246238 | 12005510 | hypothetical protein FLJ20886 (FLJ20886), mRNA/cds = (0, 524) | 1 | AATCCTTTAACTCTGCGGATAGCATT TGGTAGGTAGTGATTAACTGTGAA |
| 799 | Table 3A | Hs.81248 | AF248648 | 9246972 | CUG triplet repeat, RNA-binding | 1 | GGAGGAGGAGCTTATTTCTTGGTGTA |

TABLE 8-continued

| SEQ ID | Origin | Unigene | Locus | GI | Nominal Description | Strand | Probe Sequence |
|---|---|---|---|---|---|---|---|
| | | | | | protein 1 (CUGBP1), mRNA /cds = (137, 1585) | | CTTGAATCAGAAGGTCCCTGCAAG |
| 800 | Table 3A | Hs.81248 | AF248648 | 9248972 | CUG triplet repeat, RNA-binding protein 1 (CUGBP1), mRNA /cds = (137, 1585) | 1 | GGAGGAGGAGCTTATTTCTTGGTGTA CTTGAATCAGAAGGTCCCTGCAAG |
| 801 | Table 3A | Hs.183434 | AF248966 | 12005668 | ATPase, H+ transporting, lysosomal (vacuolar proton pump) membrane sector associated protein M8-9 (APT6M8-9), mRNA/cds = (102, 1154) | 1 | AAGTGGAAGTGGGTGAATTCTACTTT TTATGTTGGAGTGGACCAATGTCT |
| 802 | Table 3A | Hs.24125 | AF251039 | 7547030 | putative zinc finger protein (LOC51780), mRNA/cds = (744, 4997) | 1 | TGGGATTCATTGGCCCATAGGTACAT TGGAAAATGTATATCTCTCCAGCT |
| 803 | Table 3A | Hs.103521 | AF254411 | 9438032 | ser/arg-rich pre-mRNA splicing factor SR-A1 (SR-A1) gene | 1 | GGGACCCCCAGGAGGCTGAGGATGG GAGACAGAGACCAGACTGTGACTTG |
| 804 | Table 3A | Hs.42949 | AF260237 | 14009497 | hypothetical protein HES6 (HES6), mRNA/cds = (0, 674) | 1 | TGTTTGTAGCACACTTGAGTTTGTGT ATTCCATTGACATCAAATGTGACA |
| 805 | Table 3A | Hs.174131 | AF261087 | 9802305 | ribosomal protein L6 (RPL6), mRNA/cds = (26, 892) | 1 | CGATCTGTGTTTGCTCTGACGAATGG AATTTATCCTCACAAATTGGTGTT |
| 806 | Table 3A | Hs.153612 | AF261091 | 10179833 | iron inhibited ABC transporter 2 mRNA, complete cds/cds = (111, 1982) | 1 | CCAGGAGCGTGGTTTTCTGATTGTGA TCTGAGGTTCTGCCCCAACTGCAC |
| 807 | Table 3A | Hs.44198 | AF263613 | 8453173 | membrane-associated calcium-independent phospholipase A2 gamma mRNA, complete cds/cds = (225, 2573) | 1 | ACATTACCTAATATTCTCACTAGCTAT GTTCTCCAATCCACACTGCCTTT |
| 808 | Table 3A | Hs.107707 | AF265439 | 12005981 | mitochondrial ribosomal protein S15 (MRPS15), mRNA/cds = (0, 851) | 1 | AGACAGCCCTGCCAAAGCCATACCAA AGACACTCAAAGACAGCCAATAAA |
| 809 | Table 3A | Hs.8084 | AF287856 | 12006038 | HT033 mRNA, complete cds /cds = (203, 931) | 1 | AGAGATAGCACAGATGGACCAAAGG TTATGCACAGGTGGGAGTCTTTTGT |
| 810 | Table 3A | Hs.8084 | AF267856 | 12006038 | HT033 mRNA, complete cds /cds = (203, 931) | 1 | AGAGATAGCACAGATGGACCAAAGG TTATGCACAGGTGGGAGTCTTTTGT |
| 811 | Table 3A | Hs.77690 | AF267863 | 12006052 | RAB5B, member RAS oncogene family (RAB5B), mRNA/cds = (20, 687) | 1 | GCCTTTCTTCCTCTCCCAACATAACA ATCGTGGTAACAGAATGCGACTGC |
| 812 | Table 3A | Hs.8203 | AF269150 | 9755050 | endomembrane protein emp70 precursor isolog (LOC58889), mRNA/cds = (19, 1779) | 1 | ACCGTGTAAAGTGGGGATGGGGTAA AAGTGGTTAACGTACTGTTGGATCA |
| 813 | Table 3A | Hs.267288 | AF271994 | 8515856 | dopamine responsive protein DRG-1 mRNA, complete cds/cds = (15, 938) | 1 | GCCCAGTGCTTAAAAACGCCTTCTTG CATGAGGGGATTGAACTATACAAT |
| 814 | Table 3A | Hs.147644 | AF272148 | 8575774 | zinc finger protein 331: zinc finger protein 463 (ZNF361), mRNA /cds = (376, 1767) | 1 | GCGGGAAGGCATGTAACCACCTAAA CCATCTCCGAGAACATCAGAGGATC |
| 815 | Table 3A | Hs.339912 | AF277292 | 9664852 | qh07h06.x1 cDNA, 3' end /clone = IMAGE:1844027/ clone_end = 3' | 1 | TGTCAGGCTGGCTTGGTTAGGTTTTA CTGGGGCAGAGGATAGGGAATCTC |
| 816 | Table 3A | Hs.287389 | AF279437 | 10719561 | interleukin 22 (IL22), mRNA /cds = (71, 610) | 1 | GGTGGATTCCAAATGAACCCCTGCGT TAGTTACAAAGGAAACCAATGCCA |
| 817 | Table 3A | Hs.196270 | AF283645 | 11545416 | folate transporter/carrier (LOC81034), mRNA/cds = (128, 1075) | 1 | ATTTATCGTAAACATCCACGAGTGCT GTTGCACTACCATCTATTTGTTGT |
| 818 | Table 3A | Hs.324278 | L08048.1 | 184250 | mRNA: cDNA DKFZp566M063 (from clone DKFZp566M063) /cds = UNKNOWN | 1 | TGGGGGTTGTAAATTGGCATGGAAAT TTAAAGCAGGTTCTTGTTGGTGCA |
| 819 | Table 3A | Hs.116481 | AF283777 | 10281735 | CD72 antigen (CD72), mRNA /cds = (108, 1187) | 1 | GATAGGGGCGGCCCGGAGCCAGCCA GGCAGTTTATTGAAATCTTTTAA |
| 820 | Table 3A | Hs.283022 | AF287008 | 9624485 | triggering receptor expressed on myeloid cells 1 (TREM1), mRNA/cds = (47, 751) | 1 | CATTTGTACCCTAGGCCCACGAACCC ACGAGAATGTCCTCTGACTTCCAG |
| 821 | Table 3A | Hs.44865 | AF288571 | 9858157 | lymphoid enhancer factor-1 (LEF1) mRNA, complete cds/cds = (654, 1853) | 1 | AGTGGGATTTATGCCAGTTGTTAAA ATGAGCATTGATGTACCCATTTTT |
| 822 | Table 3A | Hs.212172 | AF294900 | 10242315 | beta-carotene 15,15'-dioxygenase (BCDO), mRNA/cds = (218, 1861) | 1 | CTTTCCTTTGCTCCCTCCCATGTTTCT GGTGGACTAAATTGTGTATCTGG |
| 823 | Table 3A | Hs.7886 | AF302505 | 10242358 | pellino (Drosophila) homolog 1 (PELI1), mRNA/cds = (4038, 5294) | 1 | AGTTTTCTAGATTGTCACATGCTTTGT GACTAATGCAAGAAAGCAAGTCC |
| 824 | Table 3A | Hs.47783 | AF307339 | 12751140 | B aggressive lymphoma gene (BAL), mRNA/cds = (228, 2792) | 1 | GAAACACTTTCAGGACCTTCCTTCCT CTTGCAGTTGTTCTTTAATCTCCT |
| 825 | Table 3A | Hs.250528 | AF308285 | 12060821 | *Homo sapiens*, clone IMAGE: 4098694, mRNA, partial cds/ cds = (0, 2501) | 1 | CTCGAGGGGCCAATTACAGGAGCAC AGGAAGGTTCTGATTACACACCTCT |
| 826 | Table 3A | Hs.153057 | AF311312 | 10863767 | infertility-related sperm protein | 1 | TTGAGTTAAGTTGCATTTCTTTGGGC |

TABLE 8-continued

| SEQ ID | Origin | Unigene | Locus | GI | Nominal Description | Strand | Probe Sequence |
|---|---|---|---|---|---|---|---|
| | | | | | mRNA, complete cds/cds = (198, 2978) | | TATGAAGGAGTCCTCTTAAGTTTG |
| 827 | Table 3A | Hs.6151 | AF315591 | 11139703 | pumilio (Drosophila) homolog 2 (PUM2), mRNA/cds = (23, 3217) | 1 | AGGGATTGTTTCTGGACCAGTTTGTC TAAGTCCTGGCTCTTATTGGTTCA |
| 828 | Table 3A | Hs.194976 | AF319438 | 12667351 | SH2 domain-containing phosphatase anchor protein 1 (SPAP1), mRNA/cds = (303, 1070) | 1 | TGAACTGCTGCTACATCCAGACACTG TGCAAATAAATTATTTCTGCTACC |
| 829 | Table 3A | Hs.36752 | AF319476 | 11762083 | protein kinase anchoring protein GKAP42 (GKAP42), mRNA /cds = (174, 1274) | 1 | ACTATGCAGTTTTTCTTGAAGGAACT AAAAGCAACTAGCTCCCTAATGGT |
| 830 | Table 3A | Hs.114309 | AF323540 | 12408012 | apolipoprotein L-I mRNA, splice variant B, complete cds /cds = (273, 1517) | 1 | GTCTTTCCAGCATCCACTCTCCCTTG TCCTCCTGGGGGCATATCTCAGTC |
| 831 | Table 3A | Hs.27721 | AF332469 | 12642816 | Wolf-Hirschhorn syndrome candidate 1-like 1 (WHSC1L1), transcript variant long, mRNA/cds = (518, 4831) | 1 | GCAGTAGGTAGGCTCACTTCTCTTTC CCTTCAAAATGCTTTTCATAGGCT |
| 832 | Table 3A | Hs.203181 | AF333025 | 13936737 | Bv8 protein (BV8) mRNA, partial cds/cds = (0, 358) | 1 | TCTGCTGTTGGGCTGGTGTGTGGAC AGAAGGAATGGAAAGCCAAATTAAT |
| 833 | Table 3A | NA | AI904802 | 6495189 | 1q12-21.2 Contains a cyclophilin-like gene, a novel gene, ESTs, GSSs and STS | 1 | CCACTTGGAATAGGAATATCACCCCT ATCTTGGAAGACCAGGTGGAGGCT |
| 834 | Table 3A | Hs.5122 | AJ001235 | 12418001 | 602293015F1 cDNA, 5' end /clone = IMAGE:4387778/ clone_end = 5' | 1 | GCCCTATGGCGTTGTTAAACACGAGC GTATGCTAGTAAGTATCATTCATA |
| 835 | Table 3A | Hs.9071 | AJ002030 | 2570006 | progesterone receptor membrane component 2 (PGRMC2), mRNA/cds = (6, 677) | 1 | GTGGGTGCATGGGGCTGTGGAGTGG GTGTCAGTATGGATGTGTCTGAATG |
| 836 | Table 3A | Hs.196769 | AJ006835 | 3236105 | RNA transcript from U17 small nucleolar RNA host gene, variant U17HG-AB/cds = UNKNOWN | 1 | CATTCGTCTGTATGCCCAGTCCCATC CGTGTCCTGCTGTAACTACATAGA |
| 837 | Table 3A | Hs.181461 | AJ009771 | 3846273 | ariadne (Drosophila) homolog, ubiquitin-conjugating enzyme E2-binding protein, 1 (ARIH1), mRNA/cds = (314, 1987) | 1 | TGTCTGCTTCTTCCATTTTCTCGTCTC TCTCCCCTCTTCCCCCATTATCC |
| 838 | Table 3A | Hs.18259 | AJ010842 | 3846129 | XPA binding protein 1: putative ATP(GTP)-binding protein (NTPBP), mRNA/cds = (24, 1148) | 1 | TGGGCAAGACATGATTAATGAATCAG AATCCTGTTTCATTGGTGACTTGG |
| 839 | Table 3A | Hs.109281 | AJ011895 | 3758818 | Nef-associated factor 1 (NAF1), mRNA/cds = (110, 2017) | 1 | CCAGATTAGGGTGGCTGTCCATCCCT GGATAGCTATTTGCACGAATCATG |
| 840 | Table 3A | Hs.306328 | AJ012504 | 5441364 | mRNA activated in tumor suppression, clone TSAP13 extended/cds = UNKNOWN | 1 | CGGAGCTCTGGCTCTGCTGTAGGAA GCCCGGTACGTCCTTCATGACAGCA |
| 841 | Table 3A | Hs.118958 | AJ012506 | 5441365 | syntaxin 11 (STX11), mRNA /cds = (183, 1046) | 1 | GCACTGAATATCGAACAAGCACTCAA ATTGAAGTATCAGTCATGTTTTGT |
| 842 | Table 3A | Hs.58103 | AJ131693 | 4584422 | mRNA for AKAP450 protein /cds = (222, 11948) | 1 | AGCTCGAGGTGTCCTGCACTTTTCTT ATAAGGCTACTGAAGTTACATGTT |
| 843 | Table 3A | Hs.59757 | AJ132592 | 6822171 | zinc finger protein 281 (ZNF281), mRNA/cds = (23, 2710) | 1 | TGCCATTGGAATGTTTCTACACGATC CTATTAAGAATAATGTGATGCCCT |
| 844 | Table 3A | Hs.326159 | AJ223075 | 3355596 | leucine rich repeat (in FLII) interacting protein 1 (LRRFIP1), mRNA/cds = (178, 2532) | 1 | GGATAACAAGTAAATGTCTGAAAGCA TGAGGGGCTTTATTTGCCTTTACC |
| 845 | Table 3A | Hs.137548 | AJ223324 | 3392916 | CD84 antigen (leukocyte antigen) (CD84), mRNA/cds = (44, 1030) | 1 | TGTTTTCCTCACTACATTGTACATGTG GGAATTACAGATAAACGGAAGCC |
| 846 | Table 3A | Hs.333140 | AJ225093 | 3090427 | mRNA for single-chain antibody, complete cds (scFv2)/cds = (0, 806) | 1 | AAAACTCATCTCAGAAGAGGATCTGA ATGGGGCCGCACATCACCATCATC |
| 847 | Table 3A | Hs.27182 | AJ238243 | 4826530 | mRNA for phospholipase A2 activating protein/cds = (28, 2244) | 1 | AAACCCCTTTAAATGAGGGCCAGTAT TATCTCTGCTTTCAGAAGTAGACA |
| 848 | Table 3A | Hs.6947 | AJ238403 | 12697195 | mRNA for huntingtin interacting protein 1 | 1 | GACCTGACTCCACTCTTAAACCTGGG TCTTCTCCTTGGCGGTGCTGTCAG |
| 849 | Table 3A | Hs.54842 | AJ243721 | 6006497 | methionine adenosyltransferase II, beta (MAT2B), mRNA/cds = (0, 1004) | 1 | CTTTTATAGCAGTTTATGGGGAGCAC TTGAAAGAGCGTGTGTACATGTAT |
| 850 | Table 3A | Hs.55968 | AJ245539 | 6688168 | partial mRNA for GalNAc-T5 (GALNT5 gene)/cds = (0, 2006) | 1 | AGATCCTGAAAGTAGCTGCCTGTGAC CCAGTGAAGCCATATCAAAAGTGG |
| 851 | Table 3A | Hs.18827 | AJ250014 | 8250235 | cylindromatosis (turban tumor syndrome) (CYLD), mRNA /cds = (391, 3261) | 1 | TACTGCTAAGTGCTTGGTTGGGGTGG TGAGATGATGATTAGATCAGGGGT |
| 852 | Table 3A | Hs.250905 | AJ250865 | 6688221 | hypothetical protein (LOC51234), mRNA/cds = (0, 551) | 1 | TTGTACCCAGAGACTATGATTTATATT GATTGCACTTGCCTGCCATGATT |
| 853 | Table 3A | Hs.169610 | AJ251595 | 6491738 | mRNA for transmembrane glycoprotein (CD44 gene) | 1 | TTTCAGATGCTTCTGGGAGACACCAA AGGGTGAAGCTATTTATCTGTAGT |

TABLE 8-continued

| SEQ ID | Origin | Unigene | Locus | GI | Nominal Description | Strand | Probe Sequence |
|---|---|---|---|---|---|---|---|
| 854 | Table 3A | Hs.107393 | AJ270952 | 7687995 | chromosome 3 open reading frame 4 (C3orf4), mRNA/cds = (178, 2406)/cds = (880, 1641) | 1 | TTGTGGTAATATGATGTGCCTTTCCTT GCCTAAATCCCTTCCTGGTGTGT |
| 855 | Table 3A | Hs.135187 | AJ271326 | 12043566 | unc93 (C. elegans) homolog B (UNC938), mRNA/cds = (41, 1834) | 1 | CACAAGGTGCGCGGTTACCGCTACTT GGAGGAGGACAACTCGGACGAGAG |
| 856 | Table 3A | Hs.126355 | AJ271684 | 6900101 | C-type (calcium dependent, carbohydrate-recognition domain) lectin, superfamily member 5 (CLECSF5), mRNA/cds = (197, 763) | 1 | TAGACTCACGAACAAATCCACCTGAG ATCAGCAGAGCCACCCTAGATCAG |
| 857 | Table 3A | Hs.334647 | AJ271747 | 9714271 | hypothetical protein FLJ20011 (FLJ20011), mRNA/cds = (380, 856) | 1 | CCTCAGAGGCTTACTCTAACCCATCC CAGAATAAATGGAGACTTCATGTGT |
| 858 | Table 3A | Hs.88414 | AJ271878 | 12666977 | BTB and CNC homology 1, basic leucine zipper transcription factor 2 (BACH2), mRNA/cds = (708, 3233) | 1 | AGGCTGTTGATGCTTATTCTCTGTAA CTAAGAATTTTACCTTTTGGGGGA |
| 859 | Table 3A | Hs.150601 | AJ272212 | 7981276 | mRNA for protein serine kinase (PSKH1 gene)/cds = (130, 1404) | 1 | GTAAACGTATCCTCTGTATTCAGTAA ACAGGCTGCCTCTCCAGGGAGGGC |
| 860 | Table 3A | Hs.287389 | AJ277247 | 9968293 | interleukin 22 (IL22), mRNA/cds = (71, 610) | 1 | AACTAACCCCTTTCCCTGCTAGAAA TAACAATTAGATGCCCCAAAGCGA |
| 861 | Table 3A | Hs.56247 | AJ277832 | 9968295 | mRNA for inducible T-cell co-stimulator (ICOS gene)/cds = (67, 668) | 1 | GCCTCGACACATCCTCATCCCCAGCA TGGGACACCTCAAGATGAATAATA |
| 862 | Table 3A | Hs.14512 | AJ278191 | 8745180 | DIPB protein (HSA249128), mRNA/cds = (177, 1211) | 1 | GCACAGTGACATTCCCTCCTTAGGAA TCTTCCCCTTCCACCCTTTACA |
| 863 | Table 3A | Hs.134342 | AJ278245 | 12227251 | mRNA for LanC-like protein 2 (lancl2 gene)/cds = (186, 1538) | 1 | TTTGAGGTTCTTTGGTTTTGTTAGTAA AAGCCAGTTCTGTGGTGATGACC |
| 864 | Table 3A | Hs.279860 | AJ400717 | 7573518 | tumor protein, translationally-controlled 1 (TPT1), mRNA/cds = (94, 612) | 1 | CATCTGAAGTGTGGAGCCTTACCCAT TTCATCACCTACAACGGAAGTAGT |
| 865 | Table 3A | Hs.130881 | AJ404611 | 11558481 | B-cell CLL/lymphoma 11A (zinc finger protein) (BCL11A), mRNA/cds = (228, 2735) | 1 | TTTTGGCAGTTGTCTGCATTAACCTG TTCATACACCCATTTTGTCCCTTT |
| 866 | Table 3A | Hs.10647 | AK000005 | 7209310 | mRNA for FLJ00005 protein, partial cds/cds = (0, 337) | 1 | TGGTGTTTATGTACTACTCTATAGAAC TCTTGGCTTGCACTTCTACAGCT |
| 867 | Table 3A | Hs.29052 | AK000196 | 7020122 | hypothetical protein FLJ20189 (FLJ20189), mRNA/cds = (122, 841) | 1 | ACAGGCAAAGTGACAGGGGAAAAGG AATTAGTCTAAGAGTAAGGGGATGA |
| 868 | Table 3A | Hs.79110 | AK000221 | 7020163 | nucleolin (NCL), mRNA/cds = (111, 2234) | 1 | TGGTCTCCTTGGAAATCCGTCTAGTT AACATTTCAAGGGCAATACCGTGT |
| 869 | Table 3A | Hs.20157 | NM_025197 | 13376787 | hypothetical protein FLJ13680 similar to CDK5 activator-binding protein C53 (FLJ13660), mRNA/cds = (993, 2252) | 1 | GTCTACCAGGCGAAAACCACAGATTC TCCTTCTAGTTAGTATAGCGGACT |
| 870 | Table 3A | Hs.180804 | AK000271 | 7020240 | cDNA FLJ20264 fis, clone COLF7912/cds = UNKNOWN | 1 | ACTTCTCTTGATGTAGAAAGAGATGA CGTTGTTACCCTGAGTGACAGTCA |
| 871 | Table 3A | Hs.180952 | AK000299 | 7020318 | cDNA FLJ20292 fis, clone HEP05374/cds = (21, 1403) | 1 | TGAGCTAAGTGTCATGCATATTTGTG AAGAAACACCCTTGTTTGGTCCCT |
| 872 | Table 3A | Hs.272793 | AK000316 | 7020318 | hypothetical protein FLJ20309 (FLJ20309), mRNA/cds = (41, 1279) | 1 | CTGAGCAAGGCAGATGACCTAATCAC CTCACGACAGCAATACAGCAGTGA |
| 873 | Table 3A | Hs.102669 | AK000354 | 7020383 | cDNA FLJ20347 fis, clone HEP13790/cds = (708, 1481) | 1 | TTTGTACTATTGCTAGACCCTCTTCTG TAATGGGTAATGCGTTTGATTGT |
| 874 | Table 3A | Hs.26434 | AK000367 | 7020405 | hypothetical protein FLJ20360 (FLJ20360), mRNA/cds = (79, 2304) | 1 | TGCTATGCTAATGTCTAGAAAGGCAT ACGATGCTACTATTATGCTCTGTT |
| 875 | Table 3A | Hs.120769 | AK000470 | 7020580 | cDNA FLJ20483 fis, clone KAT08143/cds = UNKNOWN | 1 | ACTGCTCTTTCTCAGGCCCAAGGTAA AAAGGTTTTTGGTCTCATGTTGAC |
| 876 | Table 3A | Hs.5811 | AK000474 | 7020586 | chromosome 21 open reading frame 59 (C21ORF59), mRNA/cds = (360, 776) | 1 | TCACCAGCTGATGACACTTCCAAAGA GATTAGCTCACCTTTCTCCTAGGC |
| 877 | Table 3A | Hs.279581 | AK000575 | 7020763 | hypothetical protein FLJ20568 (FLJ20568), mRNA/cds = (6, 422) | 1 | CAGAGTAGGCATCTGGGCACCAAGA CCTTCCCTCAACAGAGGACACTGAG |
| 878 | Table 3A | Hs.75884 | AK000639 | 7020863 | DKFZP586A011 protein (DKFZP586A011), mRNA/cds = (330, 632) | 1 | TGCATGAAGCACTGTTTTTAAACCCA AGTAAAGACTGCTTGAAACCTGTT |
| 879 | Table 3A | Hs.234149 | AK000654 | 7020886 | hypothetical protein FLJ20647 (FLJ20647), mRNA/cds = (90, 836) | 1 | TGATTTTGCAACTTAGGATGTTTTGA GTCCCATGGTTCATTTTGATTGT |
| 880 | Table 3A | Hs.266175 | AK000680 | 7020924 | cDNA FLJ20673 fis, clone KAIA4464/cds = (104, 1402) | 1 | TTTGAGCGATCTCTCACATGATGGGG TTCTTTAGTACATGGTAACAGCCA |
| 881 | Table 3A | Hs.30882 | AK000689 | 7020935 | cDNA FLJ20682 fis, clone | 1 | CCCGGCCTGGGACTCAGCATTTCTG |

TABLE 8-continued

| SEQ ID | Origin | Unigene | Locus | GI | Nominal Description | Strand | Probe Sequence |
|---|---|---|---|---|---|---|---|
|  |  |  |  |  | KAIA3543, highly similar to AF131826 clone 24945 mRNA sequence/cds = UNKNOWN |  | ATATGCCTTAAGAATTCATTCTGTT |
| 882 | Table 3A | Hs.243901 | AK000745 | 7021025 | cDNA FLJ20738 fis, clone HEP08257/cds = UNKNOWN | 1 | AGTTTTGCTGAAGACTGGCCTTATTA ATGGACAGCTTTCCTAACAAGAGA |
| 883 | Table 3A | Hs.274248 | AK000765 | 7021058 | hypothetical protein FLJ20758 (FLJ20758), mRNA/cds = (464, 1306) | 1 | GGGTCAATAGTTTCCCAATTTCAGGA TATTTCGATGTCAGAAATAACGCA |
| 884 | Table 3A | Hs.93872 | AK000987 | 7021958 | mRNA for KIAA1682 protein, partial cds/cds = (19, 2346) | 1 | TGAGAGCTGAAATGAGACCATTTACT TTGTTTAAAATGCTGTACTGTGCA |
| 885 | Table 3A | Hs.321245 | AK001111 | 7022169 | cDNA FLJ10249 fis; clone HEMBB1000725, highly similar to Rattus norvegicus GTPase Rab8b mRNA/cds = UNKNOWN | 1 | TTGAGCTAAGACCTTAGGAAATTCAC TTTCTGCATGATAAAATGACCCAA |
| 886 | Table 3A | Hs.117950 | AK001163 | 7022244 | multifunctional polypeptide similar to SAICAR synthetase and AIR carboxylase (ADE2H1), mRNA/cds = (24, 1301) | 1 | TGTCATTGTACACTTTATTTCCCTCAC ACTGTGTTATGCTCTGATGTGCT |
| 887 | Table 3A | Hs.194676 | AK001313 | 7022490 | tumor necrosis factor receptor superfamily, member 6b, decoy (TNFRSF6B), transcript variant 2, mRNA/cds = (827, 4486) | 1 | GGTCTCTTTGACTAATCACCAAAAAG CAACCAACTTAGCCAGTTTTATTT |
| 888 | Table 3A | Hs.7837 | AK001319 | 7022500 | phosphoprotein regulated by mitogenic pathways (C8FW), mRNA/cds = (273, 1391) | 1 | AGGTTCTTCCTGTACATACGTGTATA TATGTGAACAGTGAGATGGCCGTT |
| 889 | Table 3A | Hs.44672 | AK001332 | 7022524 | hypothetical protein FLJ10470 (FLJ10470), mRNA/cds = (6, 2054) | 1 | ACTTGGATGCTGCCGCTACTGAATGT TTACAAATTGCTTGCCTGCTAAAG |
| 890 | Table 3A | Hs.76556 | AK001381 | 7022572 | protein phosphatase 1, regulatory (inhibitor) subunit 15A (PPP1R15A), mRNA/cds = (240, 2264) | 1 | GGGAGGCGTGGCTGAGACCAACTGG TTTGCCTATAATTTATTAACTATTT |
| 891 | Table 3A | Hs.173374 | AK001382 | 7022574 | cDNA FLJ10500 fis, clone NT2RP2000369/cds = UNKNOWN | 1 | TCTCCCAGAATGTACTTATCTTACCTC GGCATGTACTGTAGTCACTCAGT |
| 892 | Table 3A | Hs.808 | AK001364 | 7022577 | heterogeneous nuclear ribonucleoprotein F (HNRPF), mRNA/cds = (323, 1570) | 1 | TGTGCACTGTTGTAAACCATTCAGAA TTTTCCTGCTAGGCCCTTGATGCT |
| 893 | Table 3A | Hs.279521 | AK001403 | 7022638 | hypothetical protein FLJ20530 (FLJ20530), mRNA/cds = (10, 1683) | 1 | CATCGGCCAGACAGAGTTGAATGCAA GCAATCCAGAAGAAGTGTTACAGC |
| 894 | Table 3A | Hs.108332 | AK001428 | 7022679 | cDNA FLJ10566 fis, clone NT2RP2002959, highly similar to UBIQUITIN-CONJUGATING ENZYME E2-17 KD 2 (EC 6.3.2.19)/cds = UNKNOWN | 1 | TGCTCTAGCCATCAGGTTCTTTCAAA TGCATCTTTACACTCTTGCACAAA |
| 895 | Table 3A | Hs.183297 | AK001433 | 7022686 | enhancer of polycomb 1 (EPC1) mRNA, complete cds/cds = (151, 2442) | 1 | TGAGCATGAAATGGGATCCTGCATCA CTTGTTTTAACTATTTATTTGCC |
| 896 | Table 3A | Hs.7943 | AK001437 | 7022693 | RPB5-mediating protein (RMP), mRNA/cds = (465, 1991) | 1 | TTTGCGGCTAGTTGGCTATTCAAGAA ACCTCGCCCCTCTGAATGTCATAC |
| 897 | Table 3A | Hs.343211 | AK001451 | 7022717 | 602321909F1 cDNA, 5' end /clone = IMAGE:4425098/ clone_end = 5' | 1 | GTTTACGTGGAAGAAACGCTAAGGGT TTGCTCCCAGGAAAGGAGAGGAAG |
| 898 | Table 3A | Hs.268012 | AK001471 | 7022749 | fatty-acid-Coenzyme A ligase, long-chain 3 (FACL3), mRNA /cds = (142, 2304) | 1 | TGCTCAAATCAGGACTTAAATCATAG GCACCACATTTTTCATGTCAGACT |
| 899 | Table 3A | Hs.238844 | AK001514 | 7022816 | hypothetical protein FLJ10652 (FLJ10652), mRNA/cds = (50, 1141) | 1 | TGAAATTCTACCCATCTTGAGGGAGG ACCGTTCCTCAGTTAAGGACTTGT |
| 900 | Table 3A | Hs.215766 | AK001548 | 7022888 | GTP-binding protein (NGB), mRNA/cds = (23, 1924) | 1 | ATGAGTGTGTCGGAATCCCGTGCTTA AAATACGCTCTTAAATTATTTTCT |
| 901 | Table 3A | Hs.18063 | AK001630 | 7023001 | cDNA FLJ10768 fis, clone NT2RP4000150/cds = UNKNOWN | 1 | AAATCAGAACTGAGGTAGCTTAGAGA TGTAGCGATGTAAGTGTCGATGTT |
| 902 | Table 3A | Hs.14347 | AK001685 | 7023061 | cDNA FLJ12877 fis, clone NT2RP2003825/cds = (313, 738) | 1 | AGGCTTTAGCAAAGATGGATATATTG GTGACTGAGACAGAAGAACTGGCA |
| 903 | Table 3A | Hs.12457 | AK001676 | 7023081 | hypothetical protein FLJ10814 (FLJ10814), mRNA/cds = (92, 3562) | 1 | AGTGGGCCTAACTCATGTGAGCTTGA TAACTGATGAACTCATTGGGAGCA |
| 904 | Table 3A | Hs.169407 | AK001725 | 7023165 | SAC2 (suppressor of actin mutations 2, yeast, homolog)-like (SACM2L), mRNA/cds = (0, 2165) | 1 | AACACTAACCTCTCCCCTCCTGGCTC AAGAATTACTCCGAAGTCAGTCTG |
| 905 | Table 3A | Hs.267604 | AK001749 | 7023206 | hypothetical protein FLJ10450 | 1 | TCTGTCAGGAAATGTAACTTTGGTTTT |

TABLE 8-continued

| SEQ ID | Origin | Unigene | Locus | GI | Nominal Description | Strand | Probe Sequence |
|---|---|---|---|---|---|---|---|
| | | | | | (FLJ10450), mRNA/cds = (68, 1622) | | ATTTTTGGCTTATTCCAAGGGGT |
| 906 | Table 3A | Hs.110445 | AK001779 | 7023263 | CGI-97 protein (LOC51119), mRNA/cds = (170, 922) | 1 | AAATTGTGCCGGACTTACCTTTCATT GAACATGCTGCCATAACTTAGATT |
| 907 | Table 3A | Hs.12999 | AK001822 | 7023330 | cDNA FLJ10960 fis, clone PLACE1000564/cds = UNKNOWN | 1 | TGGCAGGGAGCTGGGACCTGGAGAG ACAACTCCTGTAAATAAAACACTTT |
| 908 | Table 3A | Hs.296323 | AK001838 | 7023355 | serum/glucocorticoid regulated kinase (SGK), mRNA/cds = (42, 1337) | 1 | AGGGAGATAATGGAGTCCACTTTAAT TTGGAATTCTGTGTGAGCTATGAT |
| 909 | Table 3A | Hs.81648 | AK001883 | 7023426 | hypothetical protein FLJ11021 similar to splicing factor, arginine/serine-rich 4 (FLJ11021), mRNA/cds = (446, 1054) | 1 | AGATCAGTGATACTGGTGTTAGTGTT GTAATCAGGTTAAACCCACTTCCA |
| 910 | Table 3A | Hs.181112 | AK001934 | 7023506 | HSPC126 protein (HSPC126), mRNA/cds = (25, 837) | 1 | CCATTTGACAGTAAAGGCTCTTGGCT TCTGTTGGAGGCATGGGAAATTGT |
| 911 | Table 3A | Hs.4863 | AK001942 | 7023519 | cDNA FLJ11080 fis, clone PLACE1005181/cds = UNKNOWN | 1 | TTTAACAGCCTGTCCTCCCGGCATCA GGAGTCATTGAACAATCATGGATT |
| 912 | Table 3A | Hs.30822 | AK001972 | 7023569 | hypothetical protein FLJ11110 (FLJ11110), mRNA/cds = (44, 1033) | 1 | AATACTTATTGTTTGGCAGGTCATCC ACACACTTCTGCCCCCACTGCATT |
| 913 | Table 3A | Hs.173203 | AK002009 | 7023629 | beta-1,3-N-acetylglucosaminyltransferase (BETA3GNT), mRNA/cds = (235, 1428) | 1 | TTATCAGATGGGATACTGGGGACTAT AAACAATGGAAATAAAGCCACTGT |
| 914 | Table 3A | Hs.8033 | AK002026 | 7023858 | hypothetical protein FLJ11164 (FLJ11164), mRNA/cds = (56, 1384) | 1 | CCCTGTGCCTTTCCTTTGAGAGTGAA GGTGGGTGGAGTTGACCAGAGAAA |
| 915 | Table 3A | Hs.92918 | AK002059 | 7023711 | hypothetical protein (BM-009), mRNA/cds = (385, 1047) | 1 | TGTGTGCGTAGAATATTACGTATGCA TGTTCATGTCTAAAGAATGGCTGT |
| 916 | Table 3A | Hs.155313 | AK002127 | 7023814 | DNA sequence from clone RP5-885L7 on chromosome 20q13.2-13.33 Contains ESTs, STSs, GSSs and eight CpG islands. Contains the 3' end of the NTSR1 gene for high affinity neurotensin receptor 1, a putative novel gene, a novel gene similar to a fly gene, the gene for opioid growth factor receptor (7-60 protein), the COL9A3 gene for collagen IX alpha 3, a putative novel gene similar to a fly gene, the TCFL5 gene for basic helix-loop-helix transcription factor-like 5, an ARF4 (ADP-ribosylation factor 4) pseudogene, a novel gene and the 3' end of the gene for a novel protein similar to mouse death inducer obliterator 1 (DIO-1) (contains KIAA0333)/cds = (0, 3129) | 1 | TCTACATGTGACTGGCTTTCTTGCCC TCGTCTCTTGAATGTTTAGACTCT |
| 917 | Table 3A | Hs.5518 | AK002173 | 7023889 | cDNA FLJ11311 fis, clone PLACE1010102/cds = UNKNOWN | 1 | TGGTACCCAAACTCACCATTTGGTCC TCTTTAATCTTTGAGGGTTTCAAT |
| 918 | Table 3A | Hs.270557 | AK021517 | 10432713 | cDNA FLJ11455 fis, clone HEMBA1001497/cds = UNKNOWN | 1 | TTCCATTTATTCATGTACATTGGCCAG TTCCTGGTCCTTGTCTGACTTCT |
| 919 | Table 3A | Hs.126707 | AK021519 | 10432715 | hypothetical protein FLJ11457 (FLJ11457), mRNA/cds = (103, 867) | 1 | AACCATCTGGAGTCAGTACAGATCAT CAATCCTTCCACATATACAAGTTC |
| 920 | Table 3A | Hs.77558 | AK021563 | 10432767 | cDNA FLJ11501 fis, clone HEMBA1002100/cds = UNKNOWN | 1 | GGCCACCTGCTGACTATTTGTGGTTT AAAATAAAAGGTTTACTTGTCTGC |
| 921 | Table 3A | Hs.11571 | AK021632 | 10432852 | cDNA FLJ11570 fis, clone HEMBA1003309/cds = UNKNOWN | 1 | TCTTTGTAAAGCACGATGATACAAAT CTGGTGCCAGTGTTATATTTTGCA |
| 922 | Table 3A | Hs.12315 | AK021670 | 10432901 | hypothetical protein FLJ11608 (FLJ11608), mRNA/cds = (561, 1184) | 1 | CATGGATATCATGTATCCTTCCTGGT GCTCACACACCTGTCACCTTGTAA |
| 923 | Table 3A | Hs.241567 | AK021704 | 10432943 | RNA binding motif, single stranded interacting protein 1 (RBMS1), transcript variant | 1 | ATAAGGTGCATAAAACCCTTAAATTC ATCTAGTAGCTGTTCCCCCGAACA |

TABLE 8-continued

| SEQ ID | Origin | Unigene | Locus | GI | Nominal Description | Strand | Probe Sequence |
|---|---|---|---|---|---|---|---|
| 924 | Table 3A | Hs.271541 | AK021715 | 10432954 | MSSP-2, mRNA/cds = (265, 1434) cDNA FLJ11653 fis, clone HEMBA1004538/cds = UNKNOWN | 1 | TGGACCGGAGTCTGCTGAGTTTATAA GGTTCCAAAAATATGGTAAAATCT |
| 925 | Table 3A | Hs.5019 | AK021776 | 10433029 | cDNA FLJ11714 fis, clone HEMBA1005219, weakly similar to NUCLEAR PROTEIN SNF7 /cds = UNKNOWN | 1 | ACTCGACCTTGGTAAACGGAAATGTT GGGGGTGAAGAGAAACAATCACTA |
| 926 | Table 3A | Hs.288212 | AK021791 | 10433048 | hypothetical protein FLJ11729 (FLJ11729), mRNA/cds = (311, 1150) | 1 | TTCAAGGTTCTGCGAAATTAATTGGG CAGGTTAATTGTGTACCTGAAACT |
| 927 | Table 3A | Hs.9096 | AK021925 | 10433223 | hypothetical protein FLJ20473 (FLJ20473), mRNA/cds = (57, 1472) | 1 | TCCCCAGGATGGGGCCTCATACAAC CCTTCATCTGCACTCAACATTTAAT |
| 928 | Table 3A | Hs.288178 | AK022030 | 10433346 | cDNA FLJ11968 fis, clone HEMBB1001133/cds = UNKNOWN | 1 | TTTTAGACATGGAGTGCAGGTGGACA CTGTGTGAACTGTTTTTGGTCAGT |
| 929 | Table 3A | Hs.22265 | AK022057 | 10433376 | pyruvate dehydrogenase phosphatase (PDP), mRNA/ cds = (131, 1855) | 1 | CAAGAAACTTGGTCTGCAGTCTGGAA GCTTGTCTGCTCTATAGAAATGAA |
| 930 | Table 3A | Hs.22265 | AK022057 | 10433376 | pyruvate dehydrogenase phosphatase (PDP), mRNA/ cds = (131, 1855) | 1 | CAAGAAACTTGGTCTGCAGTCTGGAA GCTTGTCTGCTCTATAGAAATGAA |
| 931 | Table 3A | Hs.20281 | AK022103 | 10433424 | mRNA for KIAA1700 protein, partial cds/cds = (108, 2180) | 1 | TGTTGAACGGTTAAACTGTGCATTTC TCATTTTGATGTGTCATGTATGT |
| 932 | Table 3A | Hs.9043 | AK022215 | 10433563 | cDNA FLJ12153 fis, clone MAMMA1000458/cds = UNKNOWN | 1 | CCCCTTCAACTGAGGGTCATTTTACC AGAGTCAATAAAGGCCAACCCTTC |
| 933 | Table 3A | Hs.94576 | AK022267 | 10433826 | cDNA FLJ12205 fis, clone MAMMA1000931/cds = UNKNOWN | 1 | ATTCTGAGGGTGACTGAGGCTACAG CTGCTATCACATGCCGAACTTTCTT |
| 934 | Table 3A | Hs.318725 | AK022280 | 10433640 | CGI-72 protein (LOC51105), mRNA/cds = (69, 1400) | 1 | TGGTATCAGGAGTTGGGATTTCTCAG CACTGCTAATGAAGATCCCCTCTT |
| 935 | Table 3A | Hs.132221 | AK022463 | 10433867 | hypothetical protein FLJ12401 (FLJ12401), mRNA/cds = (3, 1526) | 1 | CGCAGAGAGGAGAAAAGGAGACAGC AAGACGCCAATAAAGAAACACAACT |
| 936 | Table 3A | Hs.105779 | AK022481 | 10433892 | cDNA FLJ12419 fis, clone MAMMA1003047, highly similar to protein inhibitor of activated STAT protein PIASy mRNA/cds = UNKNOWN | 1 | CCCGCACGGGCAGCTGAAGGCCGCT GTTTTCTAATATTTGTATTCTAATT |
| 937 | Table 3A | Hs.8068 | AK022497 | 10433916 | hematopoietic PBX-interacting protein (HPIP), mRNA/ cds = (80, 2275) | 1 | CCCCTGGGAGATGTAGCAAATTGAGT GTGGGTTTTGGAGTCTGAGCCTCA |
| 938 | Table 3A | Hs.179882 | AK022499 | 10433920 | hypothetical protein FLJ12443 (FLJ12443), mRNA/cds = (187, 900) | 1 | GCAGAGGGAGGGTTGCCATGAAGGA ACTTGGGATTTTCAATGGAATAAAT |
| 939 | Table 3A | Hs.287863 | AK022537 | 10433983 | hypothetical protein FLJ12475 (FLJ12475), mRNA/cds = (16, 1065) | 1 | CCTTTCACGTCTGGACGAATTACCAA ATGCCATGAATTGCCACTGTGTGT |
| 940 | Table 3A | Hs.332541 | AK022546 | 10433997 | Homo sapiens, Similar to RIKEN cDNA 2700083B06 gene, clone MGC:4669 IMAGE:3531883, mRNA, complete cds/cds = (67, 1050) | 1 | AGGAAGATGGCGCTGTTATCAGCGG GGAAATGTACTATTTAAGATCAGCT |
| 941 | Table 3A | Hs.21938 | AK022554 | 10434010 | hypothetical protein FLJ12492 (FLJ12492), mRNA/cds = (172, 1848) | 1 | ATCCAAGTCTGAAACTCTGCGCTCTA GTACTGCTGTTAAGATACACAACT |
| 942 | Table 3A | Hs.7010 | AK022568 | 10434032 | Homo sapiens, clone MGC:14452 IMAGE:4304209, mRNA, complete cds/cds = (88, 1953) | 1 | TGGATAGCCATTTCTGCTCAACCACA CATTCTCTAAGAAACAGCTTGAAA |
| 943 | Table 3A | Hs.11556 | AK022628 | 10434128 | cDNA FLJ12568 fis, clone NT2RM4000852/cds = UNKNOWN | 1 | TGTTGTATGTGGATGGGGAAGTTTTG TTTCTCCTCTTAGCATTTGTTTCT |
| 944 | Table 3A | Hs.173885 | AK022681 | 10434216 | hypothetical protein FLJ12619 (FLJ12619), mRNA/cds = (391, 1080) | 1 | TCTGAATGATCCTACTCCTTTGGAGT AAAACTAGTGCTTACCAGTTTCCA |
| 945 | Table 3A | Hs.288836 | AK022735 | 10434309 | hypothetical protein FLJ12673 (FLJ12673), mRNA/cds = (2, 1687) | 1 | TCCTTTTGTAGCCACTTTGAGTCTGC AGTTGTCAGTAAGCCTTTTAAAG |
| 946 | Table 3A | Hs.9908 | AK022758 | 10434350 | cDNA FLJ12696 fis, clone NT2RP1000513, highly similar to NifU-like protein (hNifU) mRNA/cds = UNKNOWN | 1 | GGGGGAAATTACCAGTAGAATGCCTT GGTCTGAATATTTGATAGAACCAA |
| 947 | Table 3A | Hs.77573 | AK022790 | 10434395 | uridine phosphorylase (UP), | 1 | CTGGTACTTTACAGTTTTGCACCAAC |

TABLE 8-continued

| SEQ ID | Origin | Unigene | Locus | GI | Nominal Description | Strand | Probe Sequence |
|---|---|---|---|---|---|---|---|
| 948 | Table 3A | Hs.27475 | AK022611 | 10434426 | cDNA FLJ12749 fis, clone NT2RP2001149/cds = UNKNOWN | 1 | TCTGCCAAGCCACTGGATCTTACA ATCCAGTCACTCATCAAGTGTAATCT GTCTCCTAAATATCTCTGGAACCT |
| 949 | Table 3A | Hs.58488 | AK022834 | 10434461 | catenin (cadherin-associated protein), alpha-like 1 (CTNNAL1), mRNA/cds = (43, 2247) | 1 | AGCTTTTGGGGTCAGATCTCTGGAAC ATCATGTGATGAAGCTGACATTTT |
| 950 | Table 3A | Hs.108779 | AK022874 | 10434520 | cDNA FLJ12812 fis, clone NT2RP2002498/cds = (3, 2360) | 1 | AGCAGTTAGGCTTGACTTTGAGGAGA GGCTGTGATGTTTATGATCCCTGA |
| 951 | Table 3A | Hs.56847 | AK022936 | 10434613 | cDNA FLJ12874 fis, clone NT2RP2003769/cds = UNKNOWN | 1 | GCTGTCCACAGAAAACGCCCTTAAGT AGCCCTACCTTACTCCTTAGAGCT |
| 952 | Table 3A | Hs.14347 | AK022939 | 10434618 | cDNA FLJ12877 fis, clone NT2RP2003825/cds = (313, 738) | 1 | CATGGGTATTAATAGTCTTTGCTGCT GGTAATACTGAAAGAACCTGCTTT |
| 953 | Table 3A | Hs.4859 | AK022974 | 10434675 | cyclin L ania-6a (LOC57018), mRNA/cds = (54, 1634) | 1 | AGGATTTGATTTCTTGAAACCCTCTA GGTCTCTAGAACACTGAGGACAGT |
| 954 | Table 3A | Hs.193313 | AK023013 | 10434731 | Homo sapiens, NADH dehydrogenase (ubiquinone) 1, subcomplex unknown, 2 (14.5 kD, B14.5b), clone MGC:1432 IMAGE:2990088, mRNA, complete cds/cds = (150, 509) | 1 | GGACTCAGGAGCTAATACTGTCTACA GTGGAGCTTGGTGCAATTAGAAGC |
| 955 | Table 3A | Hs.288141 | AK023078 | 10434831 | hypothetical protein MGC3156 (MGC3156), mRNA/cds = (156, 2501) | 1 | ACCAGGAGGACAGAGTTTGCTTTCAT ATTTTCCCTGTAAGTAAGAGGGCT |
| 956 | Table 3A | Hs.17279 | AK023088 | 10434845 | tyrosylprotein sulfotransferase 1 (TPST1), mRNA/cds = (81, 1193) | 1 | CCATGAAGAAGCAAGACGAAAA-CACA CAGGAGGGAAAATCCTGGGATTCT |
| 957 | Table 3A | Hs.142442 | AK023129 | 10434909 | cDNA FLJ13067 fis, clone NT2RP3001712, highly similar to HP1-BP74 protein mRNA/cds = UNKNOWN | 1 | TTGGAATTTGTGTTGCATGTAAGGCA ATCTTTCCTGTTGTAAATCTTCCT |
| 958 | Table 3A | Hs.180838 | AK023143 | 10434930 | hypothetical protein FLJ13081 (FLJ13081), mRNA/cds = (170, 2098) | 1 | AGGAAACTGAGTAGACTCCTGTGTAA CCCTGTTTGGAACTTTGCCTTCTT |
| 959 | Table 3A | Hs.172035 | AK023154 | 10434948 | cDNA FLJ13092 fis, clone NT2RP3002147/cds = (34, 606) | 1 | TTTACAAGGCAGAATGGGGTGTAACA GTTGAATTAAACTAGCAATCACGT |
| 960 | Table 3A | Hs.7797 | AK023166 | 10434966 | TERF1 (TRF1)-interacting nuclear factor 2 (TINF2), mRNA /cds = (262, 1326) | 1 | TAGTAGGAATGAAGTGGAAGTCCAG GCTTGGGATTGCCTAACTACACTGCT |
| 961 | Table 3A | Hs.72782 | AK023183 | 10434995 | hypothetical protein FLJ11171 (FLJ11171), mRNA/cds = (134, 2446) | 1 | AGTGTTTAGTCTCATGTTGGGAACAC ATGAATGTGATGAACATAGTGAAT |
| 962 | Table 3A | Hs.234265 | AK023204 | 10435025 | cDNA FLJ13142 fis, clone NT2RP3003212, moderately similar to Rattus norvegicus lamina associated polypeptide 1C (LAP1C) mRNA/cds = (55, 1443) | 1 | ACCCTTTGAGAGTTCCACAAGTGGTA GTAGAGTGGTTTAACGTCTTTCCT |
| 963 | Table 3A | Hs.236494 | AK023223 | 10435057 | RAB10, member RAS oncogene family (RAB10), mRNA/cds = (90, 692) | 1 | TTGCCCCTTTTCTGTAAGTCTCTTGG GATCCTGTGTAGAAGCTGTTCTCA |
| 964 | Table 3A | Hs.288932 | AK023256 | 10435106 | hypothetical protein FLJ13194 (FLJ13194), mRNA/cds = (300, 809) | 1 | ACTCATCAATTGAAAAGTCCTCCAAA AAGAGAACTATTGGGAAACCATGG |
| 965 | Table 3A | Hs.126925 | AK023275 | 10435137 | hypothetical protein FLJ13213 (FLJ13213), mRNA/cds = (233, 1669) | 1 | AGATGGGTGAATCAGTTGGGTTTTGT AAATACTTGTATGTGGGGAAGACA |
| 966 | Table 3A | Hs.75748 | AK023290 | 10435162 | cDNA FLJ13228 fis, clone OVARC1000085, highly similar to mRNA for proteasome subunit HC5/cds = UNKNOWN | 1 | TCAGACCTGGTTGATTTTGTACTTTG GAACTGTACCTTGGATGGTTTTGT |
| 967 | Table 3A | Hs.285017 | AK023291 | 10435163 | hypothetical protein FLJ21799 (FLJ21799), mRNA/cds = (159, 923) | 1 | GTATCTCATGGCCTCTTGATGTGGAA AGAAGTTGACAGAGGGTTGCAGGG |
| 968 | Table 3A | Hs.288929 | AK023320 | 10435204 | hypothetical protein FLJ13258 similar to fused toes (FLJ13258), mRNA/cds = (163, 1041) | 1 | AGTTCAGTGAGAAGAAACCAGA ACACTTGTTCCTAGTGTTGTGTTG TTTT |
| 969 | Table 3A | Hs.227400 | AK023362 | 10435266 | mitogen-activated protein kinase kinase kinase kinase 3 (MAP4K3), mRNA/cds = (360, 3014) | 1 | GCAGATGGCTATGTGCTAGAGGGCA AAGAGTTGGAGTTCTATCTTAGGAA |
| 970 | Table 3A | Hs.155180 | AK023379 | 10435291 | Homo sapiens, Similar to splicing factor, arginine/serine-rich 2 (SC-35), clone MGC:2622 IMAGE:3501687, mRNA, complete cds/cds = (30, 878) | 1 | TTGGTGTCAATGATCTGGTGACAATA GGATTACATTGGAGCCAATTGAAT |
| 971 | Table 3A | Hs.125034 | AK023402 | 10435324 | mRNA for putative | 1 | AACTAGAAGATGTACTTCGACAGCAT |

TABLE 8-continued

| SEQ ID | Origin | Unigene | Locus | GI | Nominal Description | Strand | Probe Sequence |
|---|---|---|---|---|---|---|---|
| | | | | | N-acetyltransferase/cds = (208, 2808) | | CCATTTTACTTCAAGGCAGCAAGA |
| 972 | Table 3A | Hs.285107 | AK023459 | 10435401 | hypothetical protein FLJ13397 (FLJ13397), mRNA/cds = (221, 1558) | 1 | ATACACTTTTCCAAATTTGTCCCAACA GCCCTGTAAGCCAGCTTTCTTCT |
| 973 | Table 3A | Hs.172028 | AK023460 | 10435403 | a disintegrin and metalloproteinase domain 10 (ADAM10), mRNA /cds = (469, 2715) | 1 | GCATTTTCTTCACTTGCAGGCAAACT TGGCTCTCAATAAACTTTTACCAC |
| 974 | Table 3A | Hs.315054 | AK023470 | 10435414 | hypothetical protein MGC15875 (MGC15875), mRNA/cds = (651, 1178) | 1 | ATTAGACCAGACCAGTGTATTTCTAA AGAAAATCCTGACATGCACACCCA |
| 975 | Table 3A | Hs.164005 | AK023494 | 10435442 | cDNA FLJ13432 fis, clone PLACE1002537/cds = UNKNOWN | 1 | AGCCAAATGTGTCATACATCAAATCT TCAGCAGCTTTTGCATAATCCAGG |
| 976 | Table 3A | Hs.129872 | AK023512 | 10435467 | sperm associated antigen 9 (SPAG9), mRNA/cds = (110, 2410) | 1 | TCCTCAAAGGGGAAAACTATGAAGGG GAAGAAGACAAACCTAAGATACCA |
| 977 | Table 3A | Hs.63525 | AK023529 | 10435489 | cDNA FLJ13467 fis, clone PLACE1003519, highly similar to hnRNP-E2 mRNA/cds = UNKNOWN | 1 | AGATGGACTGGAGCTTTTTCTTTGTG AATAGAAACTGGATGCCACAGTGA |
| 978 | Table 3A | Hs.116278 | AK023633 | 10435617 | cDNA FLJ13571 fis, clone PLACE1008405/cds = UNKNOWN | 1 | AGTTGTCAGAAGACTCCTGGGTGTAC AGAGCAAATCAAGCTGCATCAGTA |
| 979 | Table 3A | Hs.43047 | AK023647 | 10435832 | cDNA FLJ13585 fis, clone PLACE1009150/cds = UNKNOWN | 1 | AGTGGCTTCATAGCTACTGACAAATG TCTGAACTATTGTCGTGCCCTTCA |
| 980 | Table 3A | Hs.163495 | AK023670 | 10435662 | cDNA FLJ13608 fis, clone PLACE1010628/cds = UNKNOWN | 1 | GCCTGTACAAACATTCAAGTTAGTTG GCAGTCTATAAATGTGAGTTGGGT |
| 981 | Table 3A | Hs.17448 | AK023680 | 10435678 | cDNA FLJ13618 fis, clone PLACE1010925/cds = UNKNOWN | 1 | AAGGAAGGTAAAGTTAGGGGACTAG AAGACTCTAAATTGGCTTCTACAGA |
| 982 | Table 3A | Hs.178357 | AK023719 | 10435734 | hypothetical protein FLJ13657 (FLJ13657), mRNA/cds = (87, 1172) | 1 | AGAACTAATTGCCCATGTTAATTATA GCAGACACGCCATTCTAACAGGT |
| 983 | Table 3A | Hs.30818 | AK023743 | 10435768 | cDNA FLJ13681 fis, clone PLACE2000014, weakly similar to HYPOTHETICAL HELICASE C28H8.3 IN CHROMOSOME III/ cds = UNKNOWN | 1 | AACTTGGTATTGTTGTAGTTTATGTAG TAAGTGACTTGGCACCCATCAGA |
| 984 | Table 3A | Hs.157777 | AK023779 | 10435815 | cDNA FLJ13717 fis, clone PLACE2000425/cds = UNKNOWN | 1 | AGTTTAACTTTTCCTCACCCCTGTATA GAAAATGCCTTGCCTCTCAAGAG |
| 985 | Table 3A | Hs.7871 | AK023813 | 10435861 | cDNA FLJ13751 fis, clone PLACE3000339, weakly similar to GLUCOAMYLASE S1/S2 PRECURSOR (EC 3.2.1.3)/ cds = (436, 2805) | 1 | GTCTTGGGCTGGATGGGTTATAGAG CTGAGCGGCTGTGATGGTTCTGTTT |
| 986 | Table 3A | Hs.49391 | AK023825 | 10435876 | cDNA FLJ13763 fis, clone PLACE4000089/cds = (58, 547) | 1 | GACACATCTAGAATGTTTTTCTTTCAC CGTACCTCCAAAAGAGGCAATTT |
| 987 | Table 3A | Hs.119908 | AK023975 | 10436193 | nucleolar protein NOP5/NOP58 (NOP5/NOP58), mRNA/cds = (0, 1589) | 1 | ACCAGGGATGCTCTCTAACGTAATCA AGGGAAGGTTCAGTAAGACAAAGT |
| 988 | Table 3A | Hs.26039 | AK023999 | 10436234 | cDNA FLJ13937 fis, clone Y79AA1000805/cds = UNKNOWN | 1 | ACACAGTTCAGTTTTTGAGGGAACTA GTTTTGTCATAATACTACACCCCT |
| 989 | Table 3A | Hs.23170 | AK024023 | 10436276 | homolog of yeast SPB1 (JM23), mRNA/cds = (300, 1289) | 1 | TGCAGTGGGAATTCTTGAGTGAGGTC TTACCTCTTCTTTAAACCTCTTCA |
| 990 | Table 3A | Hs.24719 | AK024029 | 10436287 | cDNA FLJ13987 fis, clone Y79AA1001402, weakly similar to paraneoplastic cancer-testis-brain antigen (MA4) mRNA/cds = (684, 1397) | 1 | AAGGCAGAATAGAATGCTGAGATTGG TTAAGTTTGCAATGACCATCTTGA |
| 991 | Table 3A | Hs.168232 | AK024030 | 10438289 | hypothetical protein FLJ13855 (FLJ13855), mRNA/cds = (314, 1054) | 1 | TGCCCTAATCTTGAGTTGAGGAAATA TATGCACAGGAGTCAAAGAGATGT |
| 992 | Table 3A | Hs.129872 | AK024068 | 10436350 | sperm associated antigen 9 (SPAG9), mRNA/cds = (110, 2410) | 1 | GCTAGATTGTGAAGTACATGGGATTT CATGAGCCAGAGGAGGCATTTGGA |
| 993 | Table 3A | Hs.333300 | AK024088 | 10438379 | hypothetical protein FLJ14026 (FLJ14026), mRNA/cds = (57, 1826) | 1 | GCCTCAAAGAAAACCCAGAGTGCCCT GTTCTAAAACGTAGTTCTGAATCC |
| 994 | Table 3A | Hs.281434 | AK024090 | 10436383 | cDNA FLJ14028 fis, clone HEMBA1003838/cds = | 1 | AATCCCAGGGCTTGGTTAAGTGCTGT GTGATAACTTGTTTGGATGAGACT |

TABLE 8-continued

| SEQ ID | Origin | Unigene | Locus | GI | Nominal Description | Strand | Probe Sequence |
|---|---|---|---|---|---|---|---|
| 995 | Table 3A | Hs.287864 | AK024092 | 10436385 | cDNA FLJ14030 fis, clone HEMBA1004086/cds = UNKNOWN | 1 | AGGTTTCTTACCCAACACAAATGGAC AGTGGATTTGACTTTCTAAAGACT |
| 996 | Table 3A | Hs.288856 | AK024094 | 10436388 | prefoldin 5 (PFDN5), mRNA /cds = (423, 926) | 1 | CCTGGTGATGGGAAGGGTCTTGTGTT TTAATGCCAATAAATGTGCCAGCT |
| 997 | Table 3A | Hs.206868 | AK024118 | 10436421 | cDNA FLJ14056 fis, clone HEMBB1000335/cds = UNKNOWN | 1 | AAAATATTGAGCCAGGCCCTGGGGA AGTGGGAAGTGAGAGCCAGAGCGGC |
| 998 | Table 3A | Hs.118990 | AK024119 | 10436422 | cDNA FLJ14057 fis, clone HEMBB1000337/cds = UNKNOWN | 1 | AGCACACAAGGAATCCCAGAAAATGT TGGCTGAAGGAATAAATGGATGGA |
| 999 | Table 3A | Hs.235498 | AK024137 | 10436443 | hypothetical protein FLJ14075 (FLJ14075), mRNA/cds = (111, 2027) | 1 | CACTGCCTACCGCCATTCATGATTAA ACCATCCAGAAATACCATCCCTGT |
| 1000 | Table 3A | Hs.289037 | AK024197 | 10436518 | cDNA FLJ14135 fis, clone MAMMA1002728/cds = UNKNOWN | 1 | AAATGAGATGGCCTCTGCGGACACAT GAAAGGGTACTTCAGCTTACCAAA |
| 1001 | Table 3A | Hs.289088 | AK024202 | 10436523 | heat shock 90 kD protein 1, alpha (HSPCA), mRNA/cds = (60, 2258) | 1 | TGGACTAGGAGAGACTTGATTTTGGT GCTAAAGTTCCCCAGTTCATATGT |
| 1002 | Table 3A | Hs.14070 | AK024228 | 10436554 | hypothetical protein FLJ14166 (FLJ14166), mRNA/cds = (203, 568) | 1 | CTCACAGCCAGCACGACCCCCAGAA AGAGGCGTCCCACAATAAACACGTC |
| 1003 | Table 3A | Hs.24115 | AK024240 | 10436567 | cDNA FLJ14178 fis, clone NT2RP2003339/cds = UNKNOWN | 1 | ACAGAACATTGAGATGTGCCTAGTTC CGTATTTACAGTTTGGTCTGGCTG |
| 1004 | Table 3A | Hs.193063 | AK024263 | 10436597 | cDNA FLJ14201 fis, clone NT2RP3002955/cds = UNKNOWN | 1 | TGAATTTCAGATGGGTGATTTAAGTG AGTCACAAGTCACAAAACTTTGCT |
| 1005 | Table 3A | Hs.183506 | AK024275 | 10436615 | hypothetical protein FLJ14213 (FLJ14213), mRNA/cds = (119, 841) | 1 | TGTACTTAAGTGCTGATGACTGTTAG CCAGTTTACAACTTTTTACCATCG |
| 1006 | Table 3A | Hs.109441 | AK024297 | 10436644 | cDNA FLJ14235 fis, clone NT2RP4000167/cds = (82, 2172) | 1 | TTCTGAACATTTTAGTCAAGCTACAAC AGGTTTGGAAAACCTCTGTGGGG |
| 1007 | Table 3A | Hs.9343 | AK024327 | 10436684 | cDNA FLJ14265 fis, clone PLACE1002256/cds = UNKNOWN | 1 | TGTCAAGGGCATTAAAAGCCTCCTGA AGCATAATCTTATCAAAGGGATAC |
| 1008 | Table 3A | Hs.287631 | AK024331 | 10436690 | cDNA FLJ14269 fis, clone PLACE1003864/cds = UNKNOWN | 1 | TCAGTCCATCTCAAGACCTGTGCCTG TCAGATTTCACAATTATGGAGATT |
| 1009 | Table 3A | Hs.287634 | AK024372 | 10436742 | hypothetical protein FLJ14310 (FLJ14310), mRNA/cds = (406, 768) | 1 | GGTAGGAGTGAAATCTCTCTCTCAAA CTCTAGGAAAGCCCGAGTCATACT |
| 1010 | Table 3A | Hs.246112 | AK024391 | 10436767 | cDNA FLJ14329 fis, clone PLACE4000259, highly similar to gene for U5 snRNP-specific 200 kD protein/cds = (188, 5623) | 1 | ACAGCAGGTGTCATGGGTCAAGCATA AATCATATATAGCATTTTCAGGCA |
| 1011 | Table 3A | Hs.246112 | AK024391 | 10436767 | cDNA FLJ14329 fis, clone PLACE4000259, highly similar to gene for U5 snRNP-specific 200 kD protein/cds = (188, 5623) | 1 | ACAGCAGGTGTCATGGGTCAAGCATA AATCATATATAGCATTTTCAGGCA |
| 1012 | Table 3A | Hs.137354 | AK024426 | 10440360 | mRNA for FLJ00015 protein, partial cds/cds = (373, 1296) | 1 | TGTGGGTCCCTATGAGTGTAGAGCC CATATCCCCATAGAGTCTACCTAGA |
| 1013 | Table 3A | Hs.171118 | AK024436 | 10440380 | DNA sequence from clone RP11-165F24 on chromosome 9. Contains the 3' end of the gene for a novel protein (similar to *Drosophila* CG6630 and CG11376, KIAA1058, rat TRG), an RPL12 (60S ribosomal protein L12) pseudogene, ESTs, STSs, GSSs and a CpG island/cds = (0, 4617) | 1 | TGTTTTCATTTCAGAACATTGTGCTGT CTGTCAGCATATGTATATCAGCT |
| 1014 | Table 3A | Hs.43816 | AK024439 | 14020950 | mRNA for FLJ00029 protein, partial cds/cds = (0, 723) | 1 | TGGCTACTGCAAAACCAGTTTTGACA GGTCAGATTTTCATATGTATAGGT |
| 1015 | Table 3A | Hs.132569 | AK024449 | 10440411 | mRNA for FLJ00041 protein, partial cds/cds = (0, 994) | 1 | AGAGGTTCTGAAAGGTCTGTGTCTTG TCAAAACAAGTAAACGGTGGAACT |
| 1016 | Table 3A | Hs.289034 | AK024456 | 10440425 | mRNA for FLJ00048 protein, partial cds/cds = (2940, 3380) | 1 | ATGCGTCCTGGTTTTCAATCGCTGCT GAACAAACCTATCAAAAATGTAGC |
| 1017 | Table 3A | Hs.273230 | AK024471 | 10440455 | mRNA for FLJ00064 protein, partial cds/cds = (0, 830) | 1 | AGTATGATCCCTCAAAACCTCACTAA CTGGAAGGATGATTTTGTCTCAGT |
| 1018 | Table 3A | Hs.41045 | AK024474 | 10440461 | mRNA for FLJ00067 protein, partial cds/cds = (1209, 2933) | 1 | GAGGGTTCCTCACTGAGGTTGAGAG GTGTGTTGGATAGGACTGATCCCAC |
| 1019 | Table 3A | Hs.7049 | AK024478 | 10440469 | mRNA for FLJ00071 protein, partial cds/cds = (3020, 3772) | 1 | AAGTGTGGTTCCTGAAGGCTGTCTTT GTAACTTTTTGTAGTTCTTTGTGT |
| 1020 | Table 3A | Hs.6289 | AK024539 | 10436843 | hypothetical protein FLJ20886 | 1 | AATCCTTTAACTCTGCGGATAGCATT |

TABLE 8-continued

| SEQ ID | Origin | Unigene | Locus | GI | Nominal Description | Strand | Probe Sequence |
|---|---|---|---|---|---|---|---|
| 1021 | Table 3A | Hs.108854 | AK024569 | 10436879 | (FLJ20886), mRNA/cds = (0, 524) cDNA: FLJ20916 fis, clone ADSE00738, highly similar to AF161512 HSPC163 mRNA /cds = UNKNOWN | 1 | TGGTAGGTAGTGATTAACTGTGAA CTGGAAAGGGGGCTAAGATCAGGGC CTTCATTCTGGATCAGGCGAAATTT |
| 1022 | Table 3A | Hs.10382 | AK024597 | 10436910 | cDNA: FLJ20944 fis, clone ADSE01780/cds = UNKNOWN | 1 | GTTCCTCTTCGGGAAGCTTTTGATAA GGAATTCTCAGACCGATAGGGTGT |
| 1023 | Table 3A | Hs.289089 | AK024689 | 10437005 | hypothetical protein FLJ21016 (FLJ21016), mRNA/cds = (90, 1193) | 1 | AGTTTTGTACTTTTCACATAGCTTGTT GCCCCGTAAAAGGGTTAACAGCA |
| 1024 | Table 3A | Hs.10600 | AK024740 | 10437104 | DNA sequence from clone RP11-353C18 on chromosome 20 Contains ESTs, STSs, GSSs and CpG islands. Contains the NIFS gene for cysteine desulfurase, two genes for novel proteins and the gene for the splicing factor CC1.3 with a second isoform (CC1.4)/cds = (68, 839) | 1 | TTGGATCTGGTTCTGAGGAGGACACA CCTGGCATCGGATGACCTTTATAA |
| 1025 | Table 3A | Hs.12293 | AK024756 | 10437124 | hypothetical protein FLJ21103 (FLJ21103), mRNA/cds = (88, 1143) | 1 | TAGACATGCTTGTGTCCACACAGCAC ACCAATGTGATACTTCCACTGACC |
| 1026 | Table 3A | Hs.23410 | AK024764 | 10437139 | translocase of inner mitochondrial membrane 13 (yeast) homolog B (TIMM13B), mRNA/cds = (46, 333) | 1 | ATGGGATGCGGTGGGTTGCCCAATA AACGGCTGTGGAGTGGAAATTCCTC |
| 1027 | Table 3A | Hs.180139 | AK024823 | 10437226 | SMT3 (suppressor of mif two 3, yeast) homolog 2 (SMT3H2), mRNA/cds = (90, 377) | 1 | TTTGTACGTAGCTGTTACATGTAGGG CAATCTGTCTTTAAGTAGGGATAA |
| 1028 | Table 3A | Hs.159557 | AK024833 | 10437239 | karyopherin alpha 2 (RAG cohort 1, importin alpha 1) (KPNA2), mRNA/cds = (132, 1721) | 1 | GGAATTTCCTATCTTGCAGCATCCTG TAAATAAACATTCAAGTCCACCCT |
| 1029 | Table 3A | Hs.325093 | AK024863 | 10437271 | cDNA: FLJ21210 fis, clone COL00479/cds = UNKNOWN | 1 | GAGATGAGTTTTGTTATTTGGGGTT TTCAAGCATTGGAACCAAAGGCCA |
| 1030 | Table 3A | Hs.306720 | AK024890 | 10437303 | cDNA: FLJ21237 fis, clone COL01114/cds = UNKNOWN | 1 | TCACTTAGACCCCTGTAACAGGTTAA ATCTTCATGGTGTTCTGTTTCCTA |
| 1031 | Table 3A | Hs.135570 | AK024921 | 10437337 | cDNA: FLJ21268 fis, clone COL01718/cds = UNKNOWN | 1 | GCTCTCCAGACTGTTACAGTGCATGA GTGATAATAAAAATGAGTCAGTCA |
| 1032 | Table 3A | Hs.6019 | AK024941 | 10437362 | cDNA: FLJ21288 fis, clone COL01927/cds = UNKNOWN | 1 | GGAGGTAAACATTGGAGATGTTTGTG AAAATATTACTCTTGCTGTGAGGT |
| 1033 | Table 3A | Hs.1279 | AK024951 | 10437374 | cDNA: FLJ21298 fis, clone COL02040, highly similar to HSC1R mRNA for complement component C1r/cds = UNKNOWN | 1 | GGCCCCTTTCTTTCTTCTGAGGATTG CAGAGGATATAGTTATCAATCTCT |
| 1034 | Table 3A | Hs.29977 | AK024961 | 10437386 | hypothetical protein FLJ21308 (FLJ21308), mRNA/cds = (287, 1792) | 1 | TCAACAGCACTTAAACTGAAGTTTGG GTTGCTCATACAATAAACAGATTG |
| 1035 | Table 3A | Hs.166254 | AK024969 | 10437398 | hypothetical protein DKFZp566I133 (DKFZP566I133), mRNA/cds = (133, 1353) | 1 | GGGCCATTTTATGATGCATTGCACAC CCTCTGGGGAAATTGATCTTTAAA |
| 1036 | Table 3A | Hs.156110 | AK024974 | 10437403 | cDNA: FLJ21321 fis, clone COL02335, highly similar to HSA010422 mRNA for immunoglobulin kappa light chain/cds = UNKNOWN | 1 | TTTTCCACAGGGGACCTACCCCTATT GCGGTCCTCCAGCTCATCTTTCAC |
| 1037 | Table 3A | Hs.323376 | AK024978 | 10437405 | coated vesicle membrane protein (RNP24), mRNA/cds = (27, 632) | 1 | GGGTGAGAACACTTGCAACAGTTTAT TAATGAGGTGACTTTCACCTTAGG |
| 1038 | Table 3A | Hs.21056 | AK025019 | 10437453 | cDNA: FLJ21386 fis, clone COL03012, highly similar to AB002445 mRNA from chromosome 5q21-22 /cds = UNKNOWN | 1 | AATGTACCATCAATAAAATTGGCTGC TTGGGCAGTTTTAGTTACCACCTT |
| 1039 | Table 3A | Hs.337266 | AK025021 | 10437455 | RC-BT163-140599-023 cDNA | 1 | TTTTCAGAGGCTTCCTAATTAATCTTG CCCTCCTCCATTTCAGTCCATTT |
| 1040 | Table 3A | Hs.120170 | AK025068 | 10437507 | hypothetical protein FLJ21415 (FLJ21415), mRNA/cds = (138, 755) | 1 | AGCTCCAACCTTACGATGGAGAATTA AACTTGCTTGTATTTCCACTTTGT |
| 1041 | Table 3A | Hs.288872 | AK025092 | 10437538 | mRNA for KIAA1840 protein, partial cds/cds = (71, 4384) | 1 | AGCTTCCTCTTCCTCAGGACAGCTTC TACTTTAGATGATCCAATAATGAT |
| 1042 | Table 3A | Hs.14555 | AK025168 | 10437628 | cDNA: FLJ21513 fis, clone COL05778/cds = UNKNOWN | 1 | CACTGACTTCTATTCCATGAGCTTTTT CAAGGCGCTTATTTTATGGCAGC |
| 1043 | Table 3A | Hs.83623 | AK025198 | 10437682 | nuclear receptor subfamily 1, group I, member 3 (NR1I3), mRNA/cds = (272, 1318) | 1 | TGTTTCGTAAATTAAATAGGTCTGGC CCAGAAGACCCACTCAATTGCCTT |
| 1044 | Table 3A | Hs.322680 | AK025200 | 10437664 | cDNA: FLJ21547 fis, clone | 1 | GGAAGACCCAAGGAAATCCGGAATTT |

TABLE 8-continued

| SEQ ID | Origin | Unigene | Locus | GI | Nominal Description | Strand | Probe Sequence |
|---|---|---|---|---|---|---|---|
| 1045 | Table 3A | Hs.10888 | AK025212 | 10437679 | COL06206/cds = UNKNOWN hypothetical protein FLJ21709 (FLJ21709), mRNA/cds = (55, 2316) | 1 | CGCACCAGAGGACCCACCACGTCC TCTTGTTACTTCCAAGGAGAACCAAG AATGGCTCTGTCACACTCGAAGCC |
| 1046 | Table 3A | Hs.288708 | AK025215 | 10437682 | hypothetical protein FLJ21562 (FLJ21562), mRNA/cds = (238, 2145) | 1 | TCTTTCTCTAAAGCTTGTTTGATGAAA CTGGTTGGTCCTTTCAGTGAACA |
| 1047 | Table 3A | Hs.337581 | AK025269 | 10437749 | hypothetical protein FLJ21616 (FLJ21616), mRNA/cds = (119, 1093) | 1 | GCTGTGTGACTTAGTAGATAAAATAC TGCCTTCTGCCTTTGGGACCATGA |
| 1048 | Table 3A | Hs.2083 | AK025306 | 10437795 | cDNA: FLJ21853 fis, clone COL08586, highly similar to HUMKINCDC protein kinase mRNA/cds = UNKNOWN | 1 | TCTGTAATTGGACAGCTCTCTCGAAG AGATCTTACAGACTGTATCAGTCT |
| 1049 | Table 3A | Hs.76230 | AK025353 | 10437852 | cDNA: FLJ21700 fis, clone COL09849, highly similar to HSU14972 ribosomal protein S10 mRNA/cds = UNKNOWN | 1 | GGTCGTGGACGTGGTCAGCCACCTC AGTAAAATTGGAGAGGATTCTTTTG |
| 1050 | Table 3A | Hs.117268 | AK025384 | 10437866 | cDNA: FLJ21711 fis, clone COL10156/cds = UNKNOWN | 1 | AAAGTGAAACCAAGAGTACAA GAGACAGGTGAAATTAAAGAGCC CCTTGA |
| 1051 | Table 3A | Hs.5181 | AK025387 | 10437869 | proliferation-associated 2G4, 38 kD (PA2G4), mRNA/cds = (97, 1281) | 1 | GTCCAGGATGCAGAGCTAAAGGCCC TCCTCCAGAGTTCTACAAGTCGAAA |
| 1052 | Table 3A | Hs.288061 | AK025375 | 10437878 | actin, beta (ACTB), mRNA /cds = (73, 1200) | 1 | CCAACTTGAGATGTATGAAGGCTTTT GGTCTCCCTGGGAGTGGGTGGAGG |
| 1053 | Table 3A | Hs.14040 | AK025425 | 10437933 | cDNA: FLJ21772 fis, clone COLF7808/cds = UNKNOWN | 1 | TTCCTCATCCCATTTACAGTTTTTCTA ACTCCAGGGTAGTGTTTAGTGTT |
| 1054 | Table 3A | Hs.85963 | AK025446 | 10437961 | cDNA: FLJ21793 fis, clone HEP00468/cds = UNKNOWN | 1 | CATGCCAAAGACTCAACTGCTTTCAA AGATAATGTGGGTGCTAGATGCAG |
| 1055 | Table 3A | Hs.82689 | AK025459 | 10437979 | tumor rejection antigen (gp96) 1 (TRA1), mRNA/cds = (105, 2516) | 1 | TCCCCTTCTCCCCTGCACTGTAAAAT GTGGGATTATGGGTCACAGGAAAA |
| 1056 | Table 3A | Hs.289008 | AK025467 | 10437988 | cDNA: FLJ21814 fis, clone HEP01068/cds = UNKNOWN | 1 | ACCATGCATAGAGTCAATCAAATCCT TGTGATGTTTTGTATGGACTTTGA |
| 1057 | Table 3A | Hs.22678 | AK025485 | 10438014 | chromosome 10 open reading frame 2 (C10orf2), mRNA/cds = (32, 1552) | 1 | TGTGCTGCCTCAAGACTGCTGGAGTC AGGACATTTTATAGAGCCTTTTCC |
| 1058 | Table 3A | Hs.184793 | AK025533 | 10438078 | *Homo sapiens*, clone IMAGE: 3865907, mRNA, partial cds/ cds = (0, 1534) | 1 | GTGCAGTCTCTTAGCAGACTTCAGGC CCAAACTGTATTCTTCACTCAGGC |
| 1059 | Table 3A | Hs.121849 | AK025556 | 10438108 | microtubule-associated proteins 1A/1B light chain 3 (MAP1A/1BLC3), mRNA/cds = (84, 461) | 1 | GTTAGTGAAAGCTGTTTACTGTAACG GGGAAAACCAGATTCTTTGCATCT |
| 1060 | Table 3A | Hs.110771 | AK025557 | 10438108 | cDNA: FLJ21904 fis, clone HEP03585/cds = UNKNOWN | 1 | GCTTCTGTAAATGCCATCCCAATGTG GTTTGGTTTTGTTGAACAGAAACC |
| 1061 | Table 3A | Hs.82845 | AK025583 | 10438142 | cDNA: FLJ21930 fis, clone HEP04301, highly similar to HSU90918 clone 23815 mRNA sequence/cds = UNKNOWN | 1 | TTGCCTCGATAAGTTTCCAAGTCACT GAAATCTGCTGAAGGTTTTACTGT |
| 1062 | Table 3A | Hs.27268 | AK025586 | 10438146 | cDNA: FLJ21933 fis, clone HEP04337/cds = UNKNOWN | 1 | ACTTCTGAACTGAGGAATTTGCTGTT GACAGCCAAAGTATAGTGTACAAG |
| 1063 | Table 3A | Hs.7567 | AK025615 | 10438186 | cDNA: FLJ21962 fis, clone HEP05564/cds = UNKNOWN | 1 | AGAGCCATCTGGTGTGAAGAACTCTA TATTTGTATGTTGAGAGGGCATGG |
| 1064 | Table 3A | Hs.5985 | AK025620 | 10438193 | cDNA: FLJ21967 fis, clone HEP05652, highly similar to AF131831 clone 25188 mRNA sequence/cds = UNKNOWN | 1 | AGAACAAGTTTGCCTTGATTTTGTTTA AAATGACTTCTGCTAAGCACCCA |
| 1065 | Table 3A | Hs.279901 | AK025623 | 10438197 | PTD009 protein (PTD009), mRNA/cds = (257, 918) | 1 | CCTGCCAAAGCAAGAAGAAGGCTTG GTCCCCAGAAACAAACAGTAGTCAT |
| 1066 | Table 3A | Hs.339696 | AK025643 | 10438224 | ribosomal protein S12 (RPS12), mRNA/cds = (80, 478) | 1 | GGAGTCTCAGGCCAAGGATGTCATT GAAGAGTATTTCAAATGCAAGAAAT |
| 1067 | Table 3A | Hs.339696 | AK025643 | 10438224 | ribosomal protein S12 (RPS12), mRNA/cds = (80, 478) | 1 | GGAGTCTCAGGCCAAGGATGTCATT GAAGAGTATTTCAAATGCAAGAAAT |
| 1068 | Table 3A | Hs.334489 | AK025645 | 10438227 | hypothetical protein FLJ21992 (FLJ21992), mRNA/cds = (60, 845) | 1 | TTTCATCTGAATCCAGAGGTGCATCA AATTAAATGACAGCTCCACTTGGC |
| 1069 | Table 3A | Hs.92414 | AK025683 | 10438280 | cDNA: FLJ22030 fis, clone HEP08669/cds = UNKNOWN | 1 | TTGACACGTTCCACTTCCTTTGCAATT ATTGTATTTAGTTGTGCACTAGT |
| 1070 | Table 3A | Hs.173705 | AK025703 | 10438305 | cDNA: FLJ22050 fis, clone HEP09454/cds = UNKNOWN | 1 | CCAAATCAACTGTGTGAACTGTTTCT GCACTGCTTGCTAATGGTTTCATC |
| 1071 | Table 3A | Hs.13277 | AK025707 | 10438310 | hypothetical protein FLJ22054 (FLJ22054), mRNA/cds = (144, 956) | 1 | ATTGAGACGGGAAAAACTCGCTGTAA AATAATGCCAACCTAGATAATGCT |
| 1072 | Table 3A | Hs.5798 | AK025729 | 10438338 | pelota (*Drosophila*) homolog (PELO), mRNA/cds = (259, 1416) | 1 | TGTTCTTGCATTGCATTTAATGATCCC TTTTCTCCCCACCTCCACACACT |

TABLE 8-continued

| SEQ ID | Origin | Unigene | Locus | GI | Nominal Description | Strand | Probe Sequence |
|---|---|---|---|---|---|---|---|
| 1073 | Table 3A | Hs.184542 | AK025730 | 10438339 | CGI-127 protein (LOC51648), mRNA/cds = (125, 490) | 1 | TGCAGATTCCTAGTAGCATGCCTTAC CTACAGCACTATGTGCATTTGCTG |
| 1074 | Table 3A | Hs.75811 | AK025732 | 10438341 | N-acylsphingosine amidohydrolase (acid ceramidase) (ASAH), mRNA/cds = (17, 1204) | 1 | GCAAGACCGTTTGTCCACTTCATTTT GTATAATCACAGTTGTGTTCCTGA |
| 1075 | Table 3A | Hs.77910 | AK025738 | 10438345 | cDNA: FLJ22083 fis, clone HEP14459, highly similar to HUM3H3M 3-hydroxy-3 methylglutaryl coenzyme A synthase mRNA/cds = UNKNOWN | 1 | AATTTAACTTTTGGGTGCCAGGAAAT GGGTTTTCTCAAAGTCCATTGCCG |
| 1076 | Table 3A | Hs.170298 | AK025743 | 10438355 | cDNA: FLJ22090 fis, clone HEP16084/cds = UNKNOWN | 1 | TCGTGGAAGGGAGAGCCATCAGCAG AAAGAGACCCTGAGATCTTCGCCTG |
| 1077 | Table 3A | NA | AK025767 | 10438384 | FLJ22114 fis, clone HEP18441 | 1 | AAACACACCAGGGAGACACCAT AAAACAGACCAAGACTAACTTAA AAACA |
| 1078 | Table 3A | Hs.34497 | AK025769 | 10438386 | hypothetical protein FLJ22116 (FLJ22116), mRNA/cds = (270, 3545) | 1 | AACCACAATCAAACATATAAATAAGC CTGGAAAACCAACTACAACCAGCA |
| 1079 | Table 3A | Hs.5822 | AK025773 | 10438391 | cDNA: FLJ22120 fis, clone HEP18874/cds = UNKNOWN | 1 | TTTCCTGATTATTTGATGCTAGCTGG AATTCAAGAAATGGCATTGACCTT |
| 1080 | Table 3A | Hs.264190 | AK025774 | 10438392 | cDNA: FLJ22121 fis, clone HEP18876, highly similar to AF191298 vacuolar sorting protein 35 (VPS35) mRNA/ cds = UNKNOWN | 1 | TCACCCCAAGTAGCATGACTGATCTG CAATTTAAAATTCCTGTGATCTGT |
| 1081 | Table 3A | Hs.12245 | AK025775 | 10438393 | cDNA: FLJ22122 fis, clone HEP19214/cds = UNKNOWN | 1 | TGAGAAGTGCGGAATAGGTTGCTTCT ACCACCTGTTCTTAATGTAACAGT |
| 1082 | Table 3A | Hs.26367 | AK025778 | 10438396 | PC3-96 protein (PC3-96), mRNA/cds = (119, 586) | 1 | TCGAATGAGTGGTCAGGTAGTCTTAA AGAGCCTCATGTTAAATAGACACA |
| 1083 | Table 3A | Hs.285833 | AK025788 | 10438408 | cDNA: FLJ22135 fis, clone HEP20858/cds = UNKNOWN | 1 | TGAAGTGCAAATAAAAGCACTGCTAC TATAAGACATTCTGGAATGGTTGT |
| 1084 | Table 3A | Hs.90421 | AK025800 | 10438421 | cDNA: FLJ22147 fis, clone HEP22163, highly similar to AF113020 clone FLB9138 mRNA sequence/cds = UNKNOWN | 1 | GCAGTCCCCAGATCCAGAACATGGG AAGTTAGGGAAAATGTGTGATTTTG |
| 1085 | Table 3A | Hs.289721 | AK025846 | 10438485 | cDNA: FLJ22193 fis, clone HRC01108/cds = UNKNOWN | 1 | AGGTATGACAGGAACTGTCTTCATGT CCTTACCCAAGCAAGTCATCCATG |
| 1086 | Table 3A | Hs.286194 | AK025886 | 10438538 | hypothetical protein FLJ22233 (FLJ22233), mRNA/cds = (35, 1204) | 1 | AATTTTGAATTTCTCCTTGCCACGTTA ATAAAGCCAAAAGCAGCGGGTGC |
| 1087 | Table 3A | Hs.279921 | AK025927 | 10438592 | HSPC035 protein (LOC51669), mRNA/cds = (16, 1035) | 1 | TGACTCTGTGCTGGCAAAAATGCTTG AAACCTCTATATTTCTTTCGTTCA |
| 1088 | Table 3A | Hs.105684 | AK025947 | 10438619 | hypothetical protein FLJ22294 (FLJ22294), mRNA/cds = (240, 602) | 1 | GCTCTCCCACAGAAACCTTTGTCCTT GCAACTTTATCCTTTGTCCCGATT |
| 1089 | Table 3A | Hs.55024 | AK026024 | 10438731 | hypothetical protein FLJ10307 (FLJ10307), mRNA/cds = (28, 462) | 1 | TTGCCTTAGCCAGTGTACCTCCTACC TCAGTCTATGTGAGAGGAAGAGAA |
| 1090 | Table 3A | Hs.289092 | AK026033 | 10438744 | *Homo sapiens*, coactosin-like protein, clone MGC:19733 IMAGE:3604770, mRNA, complete cds/cds = (158, 586) | 1 | ACTGTATTGGGATTGTAAAGAACATC TCTGCACTCAGACAGTTTACAGAA |
| 1091 | Table 3A | Hs.288555 | AK026078 | 10438812 | cDNA: FLJ22425 fis, clone HRC08686 | 1 | GTGTGTGTGCATGTGTGTGTTAGCAG AGGTATTTTACTCAGAAAATAGGT |
| 1092 | Table 3A | Hs.333500 | AK026091 | 10438829 | cDNA: FLJ22438 fis, clone HRC09232, highly similar to AF093250 P38IP (P38IP) mRNA/cds = UNKNOWN | 1 | GCCAGTCAAAAAGTAAAATGAA GAGAGGCACGCCAACCACTCCAA AATTT |
| 1093 | Table 3A | Hs.238707 | AK026110 | 10438854 | hypothetical protein FLJ22457 (FLJ22457), mRNA/cds = (56, 1462) | 1 | CACTTTGTGGTCGAAAGGCTCAGCCT CTCTACATGAAGTCTGTGGACATG |
| 1094 | Table 3A | Hs.77385 | AK026164 | 10438926 | cDNA: FLJ22511 fis, clone HRC11837, highly similar to HUMMYLCB non-muscle myosin alkali light chain mRNA/cds = UNKNOWN | 1 | AGGCTTTCTTGTCTCAGCAACTTTCC CATCTTGTCTCTCTTGGATGATGT |
| 1095 | Table 3A | Hs.13179 | AK026239 | 10439028 | cDNA: FLJ22586 fis, clone HSI02774/cds = UNKNOWN | 1 | TTTTTCTTTTTGAAGCATGGAAAACAA ATCTTTTATGCCACTCCAGCCAT |
| 1096 | Table 3A | Hs.27774 | AK026264 | 10439083 | 602386841F1 cDNA, 5' end /clone = IMAGE:4515730/ clone_end = 5' | 1 | CCATGATATAAGGAAGGGCCGTGCC TCATGGAAAAGCAACAGGTGGCCTC |
| 1097 | Table 3A | Hs.297666 | AK026270 | 10439073 | cDNA: FLJ22617 fis, clone HSI05379, highly similar to HSEWS EWS mRNA/cds = UNKNOWN | 1 | TAAAGGCGAGCACCGTCAGGAGCGC AGAGATCGGCCCTACTAGATGCAGA |

TABLE 8-continued

| SEQ ID | Origin | Unigene | Locus | GI | Nominal Description | Strand | Probe Sequence |
|---|---|---|---|---|---|---|---|
| 1098 | Table 3A | Hs.31137 | AK026334 | 10439167 | protein tyrosine phosphatase, receptor type, E (PTPRE), mRNA/cds = (51, 2153) | 1 | TGAGCCTGACACCTGTGTTTCAGCAT TTGGAGACATCCCCATGTTATTCT |
| 1099 | Table 3A | Hs.236744 | AK026359 | 10439200 | cDNA: FLJ22706 fis, clone HSI13163/cds = UNKNOWN | 1 | CTGAGCCACATCCAAGCCTGGTTTGC TGCACTCTATTGCCAAAGACTGAC |
| 1100 | Table 3A | Hs.288936 | AK026363 | 10439205 | mitochondrial ribosomal protein L9 (MRPL9), mRNA/cds = (14, 817) | 1 | ACTTGCCTCATTCTCATCATCCAAACT GAACATTTGTATCCCAAGCAGAA |
| 1101 | Table 3A | Hs.143631 | AK028372 | 10439218 | cDNA: FLJ22719 fis, clone HSI14307/cds = UNKNOWN | 1 | GTATGAAGAAGGAAGCCCAGCAGAG CAGGAGGCAGCAGCAACAATGAGAG |
| 1102 | Table 3A | Hs.157240 | AK026394 | 10439245 | hypothetical protein MGC4737 (MGC4737), mRNA/cds = (2350, 2985) | 1 | CTGTGTGTGTCCATGTCTGCAAGCAG TTCTTCAATAAATGGCCTGCCTCC |
| 1103 | Table 3A | Hs.112497 | AK026396 | 10439247 | cDNA: FLJ22743 fis, clone HUV00901/cds = UNKNOWN | 1 | TCAAAGCAGAGCACAGAGTTATTTGG TGTTTGCTGAAGACAGCCTTTGTG |
| 1104 | Table 3A | Hs.236449 | AK026410 | 10439266 | hypothetical protein FLJ22757 (FLJ22757), mRNA/cds = (92, 2473) | 1 | ACTTCCATCTCAGCTAATGCACCCAC CAGCTCAAACACACCAATAAAGCT |
| 1105 | Table 3A | Hs.89555 | AK026432 | 10439295 | hemopoietic cell kinase (HCK), mRNA/cds = (168, 1685) | 1 | TGCAATCCACAATCTGACATTCTCAG GAAGCCCCAAGTTGATATTCTA |
| 1106 | Table 3A | Hs.343522 | AK026443 | 10439309 | ATPase, Ca++ transporting, plasma membrane 4 (ATP2B4), mRNA/cds = (397, 4014) | 1 | CAGAAACCAATACTGCTGTGCACTGA GAATAAAAACTCATGCCCCCTTGT |
| 1107 | Table 3A | Hs.32148 | AK026455 | 10439325 | AD-015 protein (LOC558929), mRNA/cds = (30, 644) | 1 | CACCAGTGAGGATTACTGATGTGGAC AGTTGATGGGGTTTGTTTCTGTAT |
| 1108 | Table 3A | Hs.75415 | AK026463 | 10439333 | cDNA: FLJ22810 fis, clone KAIA2933, highly similar to AB021288 mRNA for beta 2-microglobulin/cds = UNKNOWN | 1 | AAAGTAAGGCATGGTTGTGGTTAATC TGGTTTATTTTTGTTCCACAAGTT |
| 1109 | Table 3A | Hs.118183 | AK026488 | 10439358 | hypothetical protein FLJ22833 (FLJ22833), mRNA/cds = (479, 883) | 1 | TAAGGGGTAGACAAGATACCGAATAA TCTCCACAAGTTTATTTGTGGTCT |
| 1110 | Table 3A | Hs.182979 | AK026491 | 10439364 | cDNA: FLJ22838 fis, clone KAIA4494, highly similar to HUML12A ribosomal protein L12 mRNA/cds = UNKNOWN | 1 | ACATCAACAGTGGTGCTGTGGAATGC CCAGCCAGTTAAGCACAAAGGAAA |
| 1111 | Table 3A | Hs.2795 | AK026515 | 10439391 | lactate dehydrogenase A (LDHA), mRNA/cds = (97, 1095) | 1 | ACAAACAATGCAACCAACTATCCAAG TGTTATACCAACTAAAACCCCCAA |
| 1112 | Table 3A | Hs.334807 | AK026528 | 10439405 | *Homo sapiens*, ribosomal protein L30, clone MGC:2797, mRNA, complete cds/cds = (29, 376) | 1 | TTCACCTACAAAATTTCACCTGCAAA CCTTAAACCTGCAAAATTTTCCTT |
| 1113 | Table 3A | Hs.239307 | AK026535 | 10439414 | tyrosyl-tRNA synthetase (YARS), mRNA/cds = (0, 1586) | 1 | GGGTACTTCTCCATAAGGCATCTCAG TCAAATCCCCATCACTGTCATAAA |
| 1114 | Table 3A | Hs.251653 | AK026594 | 10439481 | tubulin, beta, 2 (TUBB2), mRNA/cds = (0, 1337) | 1 | CTTGCTGTTTTCCCTGTCCACATCCA TGCTGTACAGACACCACCATTGAA |
| 1115 | Table 3A | Hs.277477 | AK026595 | 10439482 | major histocompatibility complex, class I, C (HLA-C), mRNA/cds = (0, 1100) | 1 | AAGTCAATTCCTGGAATTTGAAAGAG CAAATAAAGACCTGAGAACCTTCC |
| 1116 | Table 3A | Hs.334729 | AK026603 | 10439492 | cDNA FLJ20161 fis, clone COL09252, highly similar to L33930 CD24 signal transducer mRNA/cds = UNKNOWN | 1 | AAGCTACTGTGTGTGAATGAACAC TCTTGCTTTATTCCAGAATGCTGT |
| 1117 | Table 3A | Hs.334842 | AK026632 | 10439528 | tubulin, alpha, ubiquitous (K-ALPHA-1), mRNA/cds = (67, 1422) | 1 | TGTCATGCTCCCAGAATTTCAGCTTC AGCTTAACTGACAGATGTTAAAGC |
| 1118 | Table 3A | Hs.179668 | AK026642 | 10439539 | uncharactorized hypothalamus protein HSMNP1 (HSMNP1), mRNA/cds = (231, 1016) | 1 | AGGTGGTACTCAAGCCATGCTGCCTC CTTACATCCTTTTTGGAACAGAGC |
| 1119 | Table 3A | Hs.288036 | AK026850 | 10439548 | tRNA isopentenylpyrophosphate transferase (IPT), mRNA /cds = (60, 1040) | 1 | TGCATCGTAAAACCTTCAGAAGGAAA GGAGAATGTTTTGTGGACCACTTT |
| 1120 | Table 3A | Hs.301404 | AK026664 | 10439564 | RNA binding motif protein 3 (RBM3), mRNA/cds = (276, 749) | 1 | TGTGGTTAGGAAGCAATTTCCCAATG TACCTATAAGAAATGTGCATCAAG |
| 1121 | Table 3A | Hs.266940 | AK026669 | 10439570 | cDNA: FLJ23016 fis, clone LNG00874/cds = UNKNOWN | 1 | GCCTGCGTTGCCACTTGTCTTAACTC TGAATATTTCATTTCAAAGGTGCT |
| 1122 | Table 3A | Hs.288468 | IU00944 | 405046 | clone A9A2BRB6 (CAC)n/(GTG)n repeat-containing mRNA /cds = UNKNOWN | 1 | AGCTAATATTGCTGCAATGGCTGGCA GGAAACAGGTGATCAAGAGTGTCA |
| 1123 | Table 3A | Hs.242868 | AK026704 | 10439618 | cDNA: FLJ23051 fis, clone LNG02642/cds = UNKNOWN | 1 | TCGACCCCAGAGGTGAATGTATTGTT ATTATTGTTTTGTTGTTGTTGTGA |
| 1124 | Table 3A | Hs.334861 | AK026712 | 10439629 | hypothetical protein FLJ23059 (FLJ23059), mRNA/cds = (41, 1881) | 1 | TCCTTGGCAGCTGTATTCTGGAGTCT GGATGTTGCTCTCTAAAGACCTTT |
| 1125 | Table 3A | Hs.12969 | AK026747 | 10439670 | cDNA: FLJ23094 fis, clone LNG07379, highly similar to HST000007 mRNA full length | 1 | TTTGCCATGTCCAGTACAGAATAATTT GTACTTAGTATTTGCAGCAGGGT |

TABLE 8-continued

| SEQ ID | Origin | Unigene | Locus | GI | Nominal Description | Strand | Probe Sequence |
|---|---|---|---|---|---|---|---|
| | | | | | insert cDNA clone EUROIMAGE 293605/cds = UNKNOWN | | |
| 1126 | Table 3A | Hs.90077 | AK026766 | 10439693 | TGFB-induced factor (TALE family homeobox) (TGIF), mRNA/cds = (311, 1129) | 1 | TAGAGAACCTATAGCATCTTCTCATT CCCATGTGGAACAGGATGCCCACA |
| 1127 | Table 3A | Hs.287725 | AK026769 | 10439697 | cDNA: FLJ23116 fis, clone LNG07945, highly similar to HSU79240 serine/threonine kinase mRNA/cds = UNKNOWN | 1 | AACTCATGTGCAGGTTTGATAAACAC CAGAACAGAAGACAGTGATGCTGT |
| 1128 | Table 3A | Hs.124292 | AK026776 | 10439707 | cDNA: FLJ23123 fis, clone LNG08039/cds = UNKNOWN | 1 | TGGCCCTGACAGTATTCATTATTTCA GATAATTCCCTGTGATAGGACAAC |
| 1129 | Table 3A | Hs.20242 | AK026819 | 10439764 | hypothetical protein FLJ12788 (FLJ12788), mRNA/cds = (9, 866) | 1 | ACCTGGAGAGAGAAGGTATTGAAACA TCTCCTTTATGTGTGACTTTCCCA |
| 1130 | Table 3A | Hs.287995 | AK026834 | 10439781 | cDNA: FLJ23181 fis, clone LNG11094/cds = UNKNOWN | 1 | AGAAATACCCACTAACAAAGAACAAG CATTAGTTTTGGCTGTCATCAACT |
| 1131 | Table 3A | Hs.324060 | AK026836 | 10439784 | hypothetical protein FLJ23183 (FLJ23183), mRNA/cds = (226, 732) | 1 | ATGGGCAAATTCTTAGGTAAGACAAA AACACAGCCCCAAGGGCAGGTAGT |
| 1132 | Table 3A | Hs.6906 | AK028850 | 10439805 | cDNA: FLJ23197 fis, clone REC00917/cds = UNKNOWN | 1 | GCTGATGCCACTACCCGATTTGTTTA TTTGCAATTTGAGCCATTTAAAGA |
| 1133 | Table 3A | Hs.288455 | AK026923 | 10439895 | cDNA: FLJ23270 fis, clone COL10309, highly similar to HSU33271 normal keratinocyte mRNA/cds = UNKNOWN | 1 | CCTGTTCCCTTCAGCCAACCCGTTTC TGCAGTAAAATTAAGCCTGTCAAA |
| 1134 | Table 3A | Hs.286238 | AK026933 | 10439907 | mRNA for KIAA1856 protein, partial cds/cds = (0, 3404) | 1 | TGGCTTAAACCAGTGTTCAGTCTGGT GCCAAACTTCGAATGGAATACAAA |
| 1135 | Table 3A | Hs.91065 | AK026954 | 10439935 | cDNA: FLJ23301 fis, clone HEP11120/cds = (2, 1888) | 1 | TGTGAGTTGTGACCATGTAACATGAG AGGTTTTGCTAGGGCCTATTATTT |
| 1136 | Table 3A | Hs.88044 | AK026960 | 10439945 | cDNA: FLJ23307 fis, clone HEP11549, highly similar to AF041037 novel antagonist of FGF signaling (sprouty-1) mRNA/cds = UNKNOWN | 1 | AGCTGAGTAATTCTAATCTCTTCTGT GTTTTCCTTGCCTTAACCACAAAT |
| 1137 | Table 3A | Hs.298442 | AK026983 | 10439978 | adaptor-related protein complex 3, mu 1 subunit (AP3M1), mRNA/cds = (69, 1325) | 1 | AATTTGCTAGAATCCAGTAAATCATTT TGGTAGCTCTGGCTGTGCTATCA |
| 1138 | Table 3A | Hs.301732 | AK027018 | 10440025 | hypothetical protein MGC5306 (MGC5306), mRNA/cds = (206, 1042) | 1 | TGGCTCGAAGTTTCTCTAGTGTTTTC TGTGGAAGGAATAAAAATTTGAGT |
| 1139 | Table 3A | Hs.3382 | AK027064 | 10440089 | protein phosphatase 4, regulatory subunit 1 (PPP4R1), mRNA /cds = (93, 2894) | 1 | ACTCTTGGGAGTGCTGCAGTCTTTAA TCATGCTGTTTAAACTGTTGTGGC |
| 1140 | Table 3A | Hs.85567 | AK027067 | 10440093 | suppressor of variegation 3-9 (Drosophila) homolog 2: hypothetic (SUV39H2), mRNA/cds = (37, 1089) | 1 | TTTACATGATTGGACCCTCAGATTCT GTTAACCAAAATTGCAGAATGGGG |
| 1141 | Table 3A | Hs.48320 | AK027070 | 10440098 | mRNA for ring-IBR-ring domain containing protein Dorfin, complete cds/cds = (317, 2833) | 1 | TGAAATCAAAGCACGGTGCAGAACTT GTACCAAGTACAAAAGGTCCATGT |
| 1142 | Table 3A | Hs.115659 | AK027114 | 10440156 | hypothetical protein MGC5521 (MGC5521), mRNA/cds = (163, 708) | 1 | CCTTACTCTGTCCTTGATGGAGGGGA GAAGGGAGGGCAAAGAAGTTAAAT |
| 1143 | Table 3A | Hs.113205 | AK027136 | 10440188 | cDNA: FLJ23483 fis, clone KAIA04052/cds = UNKNOWN | 1 | CACCGCCATGCAACTCCATGCCTATT TACTGGAAACCTGTTATGCCAAAC |
| 1144 | Table 3A | Hs.289071 | AK027187 | 10440255 | cDNA: FLJ22245 fis, clone HRC02612/cds = UNKNOWN | 1 | CAAGAGAATGAAGGAGGCTAAGGAG AAGCGCCAGGAACAAATTGCAAGA |
| 1145 | Table 3A | Hs.240443 | AK027191 | 10440260 | cDNA: FLJ23538 fis, clone LNG08010, highly similar to BETA2 MEN1 region clone epsilon/beta mRNA/cds = UNKNOWN | 1 | AGTCTCGGGTATGCTGTTGTGAAATT GAAACTGTAAAAGTAGATGGTTGA |
| 1146 | Table 3A | Hs.323502 | AK027192 | 10440261 | nuclear RNA export factor 1 (NXF1), mRNA/cds = (0, 1679) | 1 | ACTAAACTACCCGAAGGACTTAGGTG CTTTGTGTACTTAACCCCAGGACC |
| 1147 | Table 3A | Hs.159483 | AK027194 | 10440263 | chromosome 1 open reading frame 7 (C1orf7), mRNA/cds = (46, 1590) | 1 | GCCACCACTGTCTGTTTGAGACTCCT TCATGAGCAAAGATTGATGTATGG |
| 1148 | Table 3A | Hs.334853 | AK027197 | 10440266 | hypothetical protein FLJ23544 (FLJ23544), mRNA/cds = (125, 517) | 1 | ATGAATTTGAAGACATGGTGGCTGAA AAGCGGCTCATCCCAGATGGTTGT |
| 1149 | Table 3A | Hs.91448 | AK027210 | 10440285 | MKP-1 like protein tyrosine phosphatase (MKP-L), mRNA/cds = (233, 829) | 1 | AGCTTCAGTCTCTACTGGATTAGCCC TACTCTTTCCTTTCCCCTCCATTA |
| 1150 | Table 3A | Hs.169854 | AK027212 | 10440288 | hypothetical protein SP192 (SP192), mRNA/cds = (179, 1603) | 1 | AGATGTGGTTATCACAAGTCTCGAGG GGGAAACTACTGCATAAAATAACT |
| 1151 | Table 3A | Hs.57209 | AK027232 | 10440314 | hypothetical protein DKFZp566J091 (DKFZP566J091), | 1 | TCAGTAAAAATGCCTGTTGTGAGATG AACCTCCTGTAACTTCTATCTGTT |

TABLE 8-continued

| SEQ ID | Origin | Unigene | Locus | GI | Nominal Description | Strand | Probe Sequence |
|---|---|---|---|---|---|---|---|
| 1152 | Table 3A | Hs.54890 | AK027243 | 10440328 | cDNA FLJ14739 fis, clone NT2RP3002402/cds = (156, 2048) | 1 | AGTTAACTGCGGAGCCAAGAGTTGG ACTATAATTAAATTACCTTCCTTGT |
| 1153 | Table 3A | Hs.279040 | AK027258 | 10440392 | HT001 protein (HT001), mRNA/cds = (241, 1203) | 1 | CCGGTTTGGGTTGTTAATGGTTGAAA ACTTAGAGGAACATAGTGAGGCCT |
| 1154 | Table 3A | Hs.279040 | AK027258 | 10440392 | HT001 protein (HT001), mRNA/cds = (241, 1203) | 1 | CCGGTTTGGGTTGTTAATGGTTGAAA ACTTAGAGGAACATAGTGAGGCCT |
| 1155 | Table 3A | Hs.152925 | AK027260 | 10440394 | mRNA for KIAA1268 protein, partial cds/cds = (0, 3071) | 1 | CCAGTGATTTGATTAACTCAGGGCAA GGCTGAATATCAGAGTGTATCGCA |
| 1156 | Table 3A | Hs.183454 | AK027789 | 14042727 | cDNA FLJ14883 fis, clone PLACE1003596, moderately similar to OLIGOSACCHARYL TRANSFERASE STT3 SUBUNIT/cds = (2, 882) | 1 | TTTTGACCCAGATGATGGTTCCTTTA CAGAACAATAAAATGGCTGAACAT |
| 1157 | Table 3A | Hs.122487 | AL040371 | 5409324 | 602365288F1 cDNA, 5' end /clone = IMAGE:4473836/ clone_end = 5' | 1 | ACTGGACATCGCCCTACGCAACCTCC TCGCCATGACTGATAAGTTCCTTT |
| 1158 | Table 3A | Hs.79709 | AL042370 | 5421708 | phosphotidylinositol transfer protein (PITPN), mRNA/cds = (216, 1028) | 1 | ACTGCTGGTAGCATTTATCTGACTTG GAAAGTTGGAGAAGAGGCATTCCT |
| 1159 | Table 3A | Hs.252721 | AL042376 | 5421714 | 602022214F1 cDNA, 5' end /clone = IMAGE:4157715/ clone_end = 5' | 1 | CTTCCGAAGAGAAGAGGCTGGGGCT GTAACTGGAAAGGGGAAGCGCACAG |
| 1160 | Table 3A | Hs.182278 | AL048016 | 5434110 | *Homo sapiens*, calmodulin 2 (phosphorylase kinase, delta), clone MGC:1447 IMAGE: 3504793, mRNA, complete cds/cds = (93, 542) | 1 | CCTGACCTTGAGCTCTAGTCTCCCCT TTAAATCTTACCTTGGCAGTAACA |
| 1161 | Table 3A | NA | AL047171 | 5936355 | (synonym: hute1) cDNA clone DKFZp588F2018 5' | 1 | TTGGTCCCACAGTTTTTATGTGTCCT ACTTGAAATTATGTTTGCTCCCGT |
| 1162 | Table 3A | Hs.168757 | AL049282 | 4500041 | *Homo sapiens*, clone MGC:5584, mRNA, complete cds/cds = (227, 304) | 1 | TGGAGGATTTTTGTTAAGTCAAGTGT CAATCGAAGTTAAAAAGCAAGGGT |
| 1163 | Table 3A | Hs.104918 | AL049305 | 4500074 | hypothetical protein FLJ21940 (FLJ21940), mRNA/cds = (92, 2107) | 1 | ATGGCTCTTTTCCTATTAGAGCAACTT GTGTTTCCCTGATAATGTGTACA |
| 1164 | Table 3A | Hs.99821 | AL049319 | 4500092 | hypothetical protein FLJ14547 (FLJ14547), mRNA/cds = (25, 711) | 1 | GTCGTGACTGACTTGGTGTGTTGCTA TTGTGTTTCTATATACTCCGTCCA |
| 1165 | Table 3A | Hs.77311 | AL049332 | 4500108 | mRNA; cDNA DKFZp564L176 (from clone DKFZp564L176) /cds = UNKNOWN | 1 | TTTAGTCCAGTGGTTTCCACAGCTGG CTAAGCCAGGAGTCACTTGGAGGC |
| 1166 | Table 3A | Hs.86405 | AL049340 | 4500124 | mRNA; cDNA DKFZp564P056 (from clone DKFZp564P056) /cds = UNKNOWN | 1 | TGGAAGACAGTAAAGAACAGCCCTCT GTAGTCAGTAAAGTTTCACCTTCT |
| 1167 | Table 3A | Hs.42915 | AL049358 | 4500146 | ARP2 (actin-related protein 2, yeast) homolog (ACTR2), mRNA/cds = (74, 1258) | 1 | TGGGTGGAGTATTATGTTTAACTGGA GTTGTCAAGTATGAGTCCCTCAGG |
| 1168 | Table 3A | Hs.184938 | AL049782 | 4902604 | Novel gene mapping to chomosome 13/cds = UNKNOWN | 1 | AAAGTAGTAAATCGGGCTGTCTTAAT AGTGCGCCTGTTACTAATGGAATT |
| 1169 | Table 3A | Hs.326248 | AK025724 | 10438333 | cDNA: FLJ22071 fis, clone HEP11691/cds = UNKNOWN | 1 | ATGTCAAGCTTTGGGTCTCTGGAGTA TAACTTTTTGTAACATTAGCCATT |
| 1170 | Table 3A | Hs.139240 | AL049942 | 4884185 | mRNA; cDNA DKFZp564F1422 (from clone DKFZp564F1422)/ cds = (0, 1491) | 1 | ATCTAGGACACCTCCATCAAACCTCC TCTTGCACTTTCCCTCTGGCTTCC |
| 1171 | Table 3A | Hs.22370 | AL049951 | 4884198 | mRNA; cDNA DKFZp564O0122 (from clone DKFZp564O0122)/ cds = UNKNOWN | 1 | TGTGATGGGAACAGTGTCTTAGGGA GATGCAGCTTGGACTTGAGGTAAAT |
| 1172 | Table 3A | Hs.150580 | AL050005 | 4884260 | mRNA; cDNA DKFZp564A153 (from clone DKFZp564A153)/ cds = UNKNOWN | 1 | AGAATGGGAGGCCAACCTTCTATCAG AGTTAAACTTTTGACAAGGGAACA |
| 1173 | Table 3A | Hs.14846 | AL050021 | 4884264 | mRNA; cDNA DKFZp564D016 (from clone DKFZp564D016)/ cds = UNKNOWN | 1 | AAAAATGTGAAACTGCCCTGCCTCCC CTTTTTGCTGACAACACTGTGTAC |
| 1174 | Table 3A | Hs.133130 | AL050035 | 4884276 | mRNA; cDNA DKFZp566H0124 (from clone DKFZp566H0124)/ cds = UNKNOWN | 1 | GGCCCCATTACAAAACTCCTTAGGAA CCTCGCCCTCTCTCTGCTGTAAGG |
| 1175 | Table 3A | Hs.27371 | AL050061 | 4884292 | mRNA; cDNA DKFZp566J123 (from clone DKFZp566J123)/ cds = UNKNOWN | 1 | GCTGCTGTCTAGATTTATGTGTGCTC TGACAAGAAATGTTTTGTGTAACA |
| 1176 | Table 3A | Hs.227429 | AL050131 | 4884338 | mRNA; cDNA DKFZp586I111 (from clone DKFZp586I111); partial cds/cds = (0, 617) | 1 | CCAGGCTGCGGTGAGAATGCCAAGA AGGCACTACCTCCCACCCACATCAC |
| 1177 | Table 3A | Hs.323463 | AL050141 | 4884352 | mRNA for KIAA1693 protein, partial cds/cds = (0, 2707) | 1 | CCAGTTGTCTTGAACAGCCTGACTCC TGCCAGCCCTATGGAAGTTCCTTT |

TABLE 8-continued

| SEQ ID | Origin | Unigene | Locus | GI | Nominal Description | Strand | Probe Sequence |
|---|---|---|---|---|---|---|---|
| 1178 | Table 3A | Hs.323463 | AL050141 | 4884352 | mRNA for KIAA1693 protein, partial cds/cds = (0, 2707) | 1 | CCAGTTGTCTTGAACAGCCTGACTCC TGCCAGCCCTATGGAAGTTCCTTT |
| 1179 | Table 3A | Hs.26295 | AL050166 | 4884381 | mRNA; cDNA DKFZp586D1122 (from clone DKFZp586D1122)/ cds = UNKNOWN | 1 | TCTTTAAGAAGACCACCACATAGAAT ACCCCTTCCTATCAGCTCGCTCTG |
| 1180 | Table 3A | Hs.80285 | AL050192 | 4884408 | mRNA; cDNA DKFZp586C1723 (from clone DKFZp586C1723)/ cds = UNKNOWN | 1 | TTTGACTTTCAGGATGTCATACTACTT CTGTACCTAGCATTTTCAGTCCT |
| 1181 | Table 3A | Hs.26613 | AL050205 | 4884444 | mRNA; cDNA DKFZp586F1323 (from clone DKFZp586F1323)/ cds = UNKNOWN | 1 | TGCTTAGATTTGTTCCTGTTGTCAAAA CTGTTACCCCCAAAATTGGTGTG |
| 1182 | Table 3A | Hs.15020 | AL050218 | 4884459 | DNA sequence from clone 51J12 on chromosome 6q26-27. Contains the 3' part of the alternatively spliced gene for the orthologs of mouse QKI-7 and QKI-7B (KH Domain RNA Binding proteins) and zebrafish ZKQ-1 (Quaking protein homolog). Contains ESTs, STSs and GSSs/cds = (0, 692) | 1 | AACAAGGTACATGCATTATGTGTCAC ATTACTGGGCAAACTGTTCAAGTA |
| 1183 | Table 3A | Hs.3842 | AL050268 | 4886442 | RAB1, member RAS oncogene family (RAB1), mRNA/cds = (50, 667) | 1 | AGCACAAGCAGTGTCTGTCACTTTCC ATGCATAAAGTTTAGTGAGATGTT |
| 1184 | Table 3A | Hs.12305 | AL050272 | 4886498 | DKFZP566B183 protein (DKFZP566B183), mRNA /cds = (351, 749) | 1 | AGTGACTAAATACTGGGAACCTATTT TCTCAATCTTCCTCCATGTTGTGT |
| 1185 | Table 3A | Hs.274170 | AL050353 | 4914574 | mRNA; cDNA DKFZp564C0482 (from clone DKFZp564C0482) /cds = UNKNOWN | 1 | CTTCAGGACTGTATGAGCCGAGCAGT TACAAGACACAAAGAAGTTAAAAA |
| 1186 | Table 3A | Hs.8128 | AL050371 | 4914606 | phosphatidylserine decarboxylase (PISD), mRNA/cds = (223, 1350) | 1 | AGGGCCAGATTTCATGTTGACCCTGG GGATGCTGTGAATTTCTCCTGCAG |
| 1187 | Table 3A | Hs.322645 | AL050376 | 4914609 | mRNA; cDNA DKFZp586J101 (from clone DKFZp586J101) /cds = UNKNOWN | 1 | AAATGCAGGTTTATTATCCAGCACTG AGAGAGTTAACAAGGACTGGAAAA |
| 1188 | Table 3A | Hs.322645 | AL050376 | 4914609 | mRNA; cDNA DKFZp586J101 (from clone DKFZp586J101) /cds = UNKNOWN | 1 | AAATGCAGGTTTATTATCCAGCACTG AGAGAGTTAACAAGGACTGGAAAA |
| 1189 | Table 3A | Hs.321247 | AL050391 | 4914591 | mRNA; cDNA DKFZp586A181 (from clone DKFZp586A181); partial cds/cds = (0, 314) | 1 | CCCTCCTTAATCAACTTCAAGGAGCA CCTTCATTAGTACAGCTTGCATAT |
| 1190 | Table 3A | Hs.12813 | AL080156 | 5282614 | mRNA; cDNA DKFZp434J214 (from clone DKFZp434J214); partial cds/cds = (0, 1081) | 1 | AAACCAGTGACTCCTAATCTTTTTCAA GTTAAGACACCTTACCATTGCTT |
| 1191 | Table 3A | Hs.52792 | AL080213 | 5262703 | mRNA; cDNA DKFZp586I1823 (from clone DKFZp586I1823) /cds = UNKNOWN | 1 | AAGGGAACACAAAACTGTGGTCCTGA CAATACTAATTCTACCCGTTTTCA |
| 1192 | Table 3A | Hs.111801 | AL096723 | 5419856 | mRNA; cDNA DKFZp564H2023 (from clone DKFZp564H2023) /cds = UNKNOWN | 1 | TTTTTGTACGATCAGCCTTACTGCTAA TAAAAGCACTTCCACAGGGAAAA |
| 1193 | Table 3A | Hs.306327 | AL098752 | 5419888 | mRNA; cDNA DKFZp434A012 (from clone DKFZp434A012) /cds = UNKNOWN | 1 | AAATTCTACAAAGGAGAGGTTGGGCG TTACAAAGGCATTGTGAATCTAAT |
| 1194 | Table 3A | Hs.308327 | AL096752 | 5419888 | mRNA; cDNA DKFZp434A012 (from clone DKFZp434A012) /cds = UNKNOWN | 1 | AAATTCTACAAAGGAGAGGTTGGGCG TTACAAAGGCATTGTGAATCTAAT |
| 1195 | Table 3A | Hs.172803 | AL109669 | 5689801 | mRNA full length insert cDNA clone EUROIMAGE 31839/ cds = UNKNOWN | 1 | TTCACCGAGGACATGAAACTCCACCT TGCGGGATAAAGAGAGAAAAACA |
| 1196 | Table 3A | Hs.119155 | AL109788 | 5725475 | mRNA full length insert cDNA clone EUROIMAGE 814975/ cds = UNKNOWN | 1 | TGTGCTCTTCAGTAGAGGATTTTCTG TGATCCTACAATGAAGGGAAAGCT |
| 1197 | Table 3A | Hs.75875 | AL110132 | 5817027 | ubiquitin-conjugating enzyme E2 variant 1 (UBE2V1), transcript variant 2, mRNA/cds = (69, 734) | 1 | TTTGTGTAAAACCACCTTTTGAAGCA GCAACTATCAAGTCTGAAAAGCAA |
| 1198 | Table 3A | Hs.128797 | AL110151 | 5817052 | mRNA; cDNA DKFZp586D0824 (from clone DKFZp586D0824); partial cds/cds = (0, 1080) | 1 | AGTGGGTGAATCACAGTAATTTCCCT GTAAAATGTGGTACCTGAAGTCAT |
| 1199 | Table 3A | Hs.193700 | AL110164 | 5817089 | cDNA: FLJ22008 fis, clone HEP06934/cds = UNKNOWN | 1 | TAGGCTCATAGCCTTGTATTTCGTTTT AGATTGTAAGCTCAATGGCAGGG |
| 1200 | Table 3A | Hs.73851 | AL110183 | 5817095 | ATP synthase, H+ transporting, mitochondrial F0 complex, subunit F6 (ATP5J), mRNA/cds = (1, 327) | 1 | GCTCAAGCAAATGTTTGGTAATGCAG ACATGAATACATTTCCCACCTTCA |
| 1201 | Table 3A | Hs.172089 | AL110202 | 5817121 | mRNA; cDNA DKFZp586I2022 (from clone DKFZp586I2022)/ | 1 | AAGTCATCATTTGCCTTGAAAGTTTC CTCTGCATTGGGTTTGAAGTAGTT |

TABLE 8-continued

| SEQ ID | Origin | Unigene | Locus | GI | Nominal Description | Strand | Probe Sequence |
|---|---|---|---|---|---|---|---|
| 1202 | Table 3A | Hs.193784 | AL110204 | 5817123 | mRNA; cDNA DKFZp586K1922 (from clone DKFZp586K1922)/cds = UNKNOWN | 1 | GAGCAGGGGTGGGAGTGGCTGTAAC TTCACAATCCTAATACAGTAAATGT |
| 1203 | Table 3A | Hs.321022 | AL110236 | 5817178 | mRNA; cDNA DKFZp566P1124 (from clone DKFZp566P1124)/cds = UNKNOWN | 1 | TTCTTAAGGAGTCTTAACTCGGTACT TGGGTTAACGCCAGAAATTACTTT |
| 1204 | Table 3A | Hs.187991 | AL110269 | 5817043 | DKFZP564A122 protein (DKFZP564A122), mRNA /cds = (2570, 2908) | 1 | TTGGTGAGTTGCCAAAGAAGCAATAC AGCATATCTGCTTTTGCCTTCTGT |
| 1205 | Table 3A | Hs.109727 | AL117407 | 5911992 | mRNA; cDNA DKFZp434D2050 (from clone DKFZp434D2050); partial cds/cds = (110, 1720) | 1 | AGGCCTTGTTTTTCAGCTTCATCTGC AGTTCTATGTGAAGATTGATAAAT |
| 1206 | Table 3A | Hs.26797 | AL117448 | 5911896 | mRNA; cDNA DKFZp586B1417 (from clone DKFZp586B1417); partial cds/cds = (0, 3878) | 1 | TGCAACTTAGAAACCAGCTACAGTAT GGCCCACTTAATAAAACACCTGAA |
| 1207 | Table 3A | Hs.7200 | AL117502 | 5912009 | hypothetical protein MGC16714 (MGC16714), mRNA/cds = (394, 990) | 1 | AGTTTATTGTTAGCCAGGTTGCTTGA AAGGTTGAGAGTGGAGTGGTTTGG |
| 1208 | Table 3A | Hs.22583 | AL117513 | 5912025 | mRNA; cDNA DKFZp434K2235 (from clone DKFZp434K2235); partial cds/cds = (0, 1086) | 1 | GCATAACTGCTCTAGCTTCTTGTTTA CCATAGTACTGTGGCTTCAGATTT |
| 1209 | Table 3A | Hs.303154 | AL117536 | 5912065 | popaye protein 3 (POP3), mRNA/cds = (147, 1022) | 1 | TGTATCTTTTCCTGTTAAACACACAGA CCCCTCCCCAATCTGGACATTGA |
| 1210 | Table 3A | Hs.6607 | AL117565 | 5912115 | URAX1 mRNA, complete cds /cds = (191, 1960) | 1 | GCCTTGCCAGCCTGTGTGCTTGTGG GAACACCTTGTACCTGAGCTTACAG |
| 1211 | Table 3A | Hs.154320 | AL117568 | 5912116 | ubiquitin-activating enzyme E1C (homologous to yeast UBA3) (UBE1C), mRNA/cds = (0, 1328) | 1 | GCATGAATGGGCAATATTTTCATCTG TTTACTTGTAGTGCCATAGAGGCC |
| 1212 | Table 3A | Hs.4055 | AL117595 | 5912159 | mRNA; cDNA DKFZp564C2063 (from clone DKFZp564C2063) /cds = UNKNOWN | 1 | GGCCTTCTATGTGCTTAGCCATAACA ATTCCATTAAGCAAGAAGGTAAGC |
| 1213 | Table 3A | Hs.180777 | AL117621 | 5912202 | mRNA; cDNA DKFZp564M0264 (from clone DKFZp564M0264) /cds = UNKNOWN | 1 | AATTGAACAATAACCATTGGTGACTG GAGCAGGTAATTATAGCCTGCAGA |
| 1214 | Table 3A | Hs.87794 | AL117637 | 5912225 | mRNA; cDNA DKFZp434I225 (from clone DKFZp434I225); partial cds/cds = (0, 1281) | 1 | AGGGGTCCCAAGAGCCTGTCCTCTTT TGTTCAAAATACATCTTGAAACGT |
| 1215 | Table 3A | Hs.79709 | AL117644 | 5912234 | phosphotidylinositol transfer protein (PITPN), mRNA/cds = (216, 1028) | 1 | CCTGCTGGGACTCCCTGACTTACTTT GGTTGGTTCCTAGTGCTACTTGTT |
| 1216 | Table 3A | NA | AL120453 | 5928352 | (synonym: hamy2) cDNA clone DKFZp761I208 5' | 1 | GGAAAGCTCGTCAGTTTAGTAGGCTC CGAAATAGAATAGCAGTTGTCACT |
| 1217 | Table 3A | Hs.6986 | AL121406 | 5927407 | glucose transporter pseudogene /cds = UNKNOWN | 1 | AGAAGGTAACTTTATAGAAGTAACAC CAATATCCTAGTCTGCTTGCCCCG |
| 1218 | Table 3A | Hs.274481 | AL121735 | 6012990 | cellular growth-regulating protein (LOC51038), mRNA/cds = (612, 785) | 1 | GCTGCTCCCTGGTTCCACTCTGGAGA GTAATCTGGGACATCTTAGTGTTT |
| 1219 | Table 3A | Hs.272307 | AL133015 | 6453493 | mRNA; cDNA DKFZp434O2417 (from clone DKFZp434O2417); partial cds/cds = (0, 724) | 1 | CTCTCCTCTTCCCACCTCTGTATCCC ACACAGGCATCTGGTGATGTTCTC |
| 1220 | Table 3A | Hs.75497 | AL133074 | 6453517 | p53DINP1 mRNA for p53DINP1b, complete cds/cds = (39, 533) | 1 | ACACCTGTTCTTTGTAATTGGGTTGT GGTGCATTTTGCACTACCTGGAGT |
| 1221 | Table 3A | Hs.76853 | AL133098 | 6453550 | mRNA; cDNA DKFZp434N1728 (from clone DKFZp434N1728) /cds = UNKNOWN | 1 | AGCCTAGGTGAAAATCTATTTATAAAT GGACCACAACTCTGGGGTGTCGT |
| 1222 | Table 3A | Hs.109150 | AL133111 | 6453598 | mRNA; cDNA DKFZp434H068 (from clone DKFZp434H068) /cds = UNKNOWN | 1 | CATGAAGCTCTCAAGTCCTGCATCCT GAGGATCCAGATGGATGACAAGGA |
| 1223 | Table 3A | Hs.199009 | AL133572 | 8599150 | PCCX2 mRNA for protein containing CXXC domain 2, partial cds/cds = (0, 2483) | 1 | GGTGGTGTTTCCTAGACCTTCCCTGA TGCGATTTTACCTTTGTTGAATTT |
| 1224 | Table 3A | Hs.25382 | AL133811 | 6599222 | mRNA; cDNA DKFZp434O1317 (from clone DKFZp434O1317) /cds = UNKNOWN | 1 | ACGATGCTGTTTGCTCTGGAATGTTC ATCTTTTAGACAGGTTTTGGCTCA |
| 1225 | Table 3A | Hs.224680 | AL133721 | 6601909 | DKFZp761H09121_r1 cDNA, 5' end/clone = DKFZp761H09121 /clone_end = 5' | 1 | TCCGAGGGATGAGATTAAGGCAGAG GCAAAAGTTTCACACAAAGTTTCTG |
| 1226 | Table 3A | Hs.306155 | AL133879 | 6602066 | chorionic somatomammotropin hormone 1 (placental lactogen) (CSH1), transcript variant 2, mRNA/cds = (116, 886) | 1 | GCCACAACTCCCATAGATGCCAATGT TTTGATAGCCTCAGTTTCTCAACG |
| 1227 | Table 3A | Hs.322456 | AL138542 | 12044472 | hypothetical protein DKFZp761D0211 (DKFZP761D0211), mRNA/ cds = (164, 1822) | 1 | TGACCCACCCACCAAGGAAGAAAGC AGAATAAACATTTTTGCACTGCCTG |

TABLE 8-continued

| SEQ ID | Origin | Unigene | Locus | GI | Nominal Description | Strand | Probe Sequence |
|---|---|---|---|---|---|---|---|
| 1228 | Table 3A | Hs.258503 | AL138549 | 6807648 | mRNA; cDNA DKFZp761I12121 (from clone DKFZp761I12121); complete cds/cds = (138, 3899) | 1 | CATGCTCTCCCATGACATCTCCATGC TGGTTTCTCCATAGCATAAATGAA |
| 1229 | Table 3A | Hs.177537 | AL136558 | 13276622 | hypothetical protein DKFZp761B1514 (DKFZp761B1514), mRNA/cds = (72, 1028) | 1 | GGTGCCGTGCATCACCAAATGAAAGT TTGTATTTAACGAGGAGGTGCTTT |
| 1230 | Table 3A | Hs.245798 | AL136607 | 12052739 | hypothetical protein DKFZp564I0422 (DKFZP564I0422), mRNA/cds = (510, 1196) | 1 | AAATCCTCTCTGCTGTTCACATTATCC TTTGTTTAACGTATGAACCAGGT |
| 1231 | Table 3A | Hs.4750 | AL136610 | 12052745 | hypothetical protein DKFZp564K0822 (DKFZP564K0822), mRNA/cds = (9, 527) | 1 | GTGTAGAATTCCCGGAGCGTCCGTG GTTCAGAGTAAACTTGAAGCAGATC |
| 1232 | Table 3A | Hs.108548 | AL136640 | 12052805 | mRNA; cDNA DKFZp564F163 (from clone DKFZp564F163); complete cds/cds = (149, 532) | 1 | TGGGTAGGTTAAGCTGCCATACGTGT TCAGTGTGAATAGTGTTTAAGTTG |
| 1233 | Table 3A | Hs.27181 | AL136656 | 12052835 | nuclear receptor binding factor-2 (NRBF-2), mRNA/cds = (179, 1042) | 1 | TGATGCAAGAGTGGACGTAATGCTAG TTGGCAGTATTTTATTGTAAGAAA |
| 1234 | Table 3A | Hs.57209 | AL136703 | 12052925 | hypothetical protein DKFZp566J091 (DKFZP566J091), mRNA/cds = (212, 529) | 1 | TCAGTAAAAATGCCTGTTGTGAGATG AACCTCCTGTAACTTCTATCTGTT |
| 1235 | Table 3A | Hs.168254 | AL136711 | 12052941 | hypothetical protein DKFZp566I133 (DKFZP566I133), mRNA/cds = (133, 1353) | 1 | GGGCCATTTTATGATGCATTGCACAC CCTCTGGGGAAATTGATCTTTAAA |
| 1236 | Table 3A | Hs.324275 | AL136739 | 12052996 | WW domain-containing protein 1 (WWP1), mRNA/cds = (10, 2778) | 1 | AAAATGCTGCTGGCTTTTCTGAAGAC AGGTGCTTGAACTTGTCAGTTTGT |
| 1237 | Table 3A | Hs.273294 | AL136797 | 12053106 | mRNA; cDNA DKFZp434N031 (from clone DKFZp434N031); complete cds/cds = (18, 3608) | 1 | CCGCCCAAAAGTCTGTTCTGATGGCA CTGAGTTTTCATTGTTCTGGATGT |
| 1238 | Table 3A | Hs.76698 | AL136807 | 12053124 | mRNA; cDNA DKFZp434L1621 (from clone DKFZp434L1621); complete cds/cds = (315, 515) | 1 | TGGTTGTGCTAAATTCATAGCAGGTG CCTTATTCTTTGCTTTTAGTCAAA |
| 1239 | Table 3A | Hs.238996 | AL136828 | 12053164 | hypothetical protein DKFZp434K0427 (DKFZP434K0427), mRNA/cds = (341, 1813) | 1 | TTTGCCAGGGTAATCTTCAGTTGGCC CTGATTCAATTAAATGGCCTTAAT |
| 1240 | Table 3A | Hs.146037 | AL136874 | 12053252 | hypothetical protein DKFZp434C135 (DKFZP434C135), mRNA/cds = (118, 1208) | 1 | ACACTCCTTAAGTTCCAAATGTTTTCC GCTAATAGTCTGTCCTAAAGCCT |
| 1241 | Table 3A | Hs.103378 | AL136885 | 12053268 | hypothetical protein MGC11034 (MGC11034), mRNA/cds = (245, 840) | 1 | AGGACTCTTGAACATCTGAGCAGTTT TGTGCTTTGAGCCACTTTTTGACA |
| 1242 | Table 3A | Hs.37892 | AL136932 | 12053358 | KIAA0922 protein (KIAA0922), mRNA/cds = (122, 3841) | 1 | CGCCTATATGAACCTGGACATATGGA CTACCACAGCGAATAGGAATGCAA |
| 1243 | Table 3A | Hs.37892 | AL136932 | 12053358 | KIAA0922 protein (KIAA0922), mRNA/cds = (122, 3841) | 1 | CGCCTATATGAACCTGGACATATGGA CTACCACAGCGAATAGGAATGCAA |
| 1244 | Table 3A | Hs.108338 | AL136941 | 12053376 | hypothetical protein DKFZp586C1924 (DKFZp586C1924), mRNA/cds = (105, 692) | 1 | TTTCCTATTTTGCTCCAGACTATGTTT TCAGCATACCTTGGGTCTGAACA |
| 1245 | Table 3A | Hs.194718 | AL136945 | 12053384 | mRNA; cDNA DKFZp586O012 (from clone DKFZp586O012)/cds = UNKNOWN | 1 | TTGTGCTTTCTGTATTTAAAACTTTGG CTGTACTAAGCAAATGCAAGGTT |
| 1246 | Table 3A | Hs.7392 | AL137423 | 6807979 | nucleolar protein GU2 (GU2), mRNA/cds = (107, 2320) | 1 | GGTCATCATAGTTGAGGTATGTGTCT GCTATTTGCAAAGAAGTTGGTCGT |
| 1247 | Table 3A | Hs.21015 | AL137576 | 6808287 | mRNA; cDNA DKFZp564L0864 (from clone DKFZp564L0864); partial cds/cds = (0, 568) | 1 | TTCAGGACCCTAGAGGAGAGCTTTAT ACAATTACCGATGTGAATTTCTCT |
| 1248 | Table 3A | Hs.122752 | AL137601 | 6808346 | TATA box binding protein (TBP)-associated factor, RNA polymerase II, B, 150 kD (TAF2B), mRNA/cds = (57, 3656) | 1 | TGTTTTGCTTAATGTGGACAATTTACA CACCCAACACATACTGTTTCCAA |
| 1249 | Table 3A | Hs.145612 | AL137608 | 6808357 | RNA helicase (RIG-I), mRNA/cds = (157, 2934) | 1 | GAGATCAACGGGATGAGGTGTTACA GCTGCCTCCCTCTTCATGCAATCTG |
| 1250 | Table 3A | Hs.173912 | AL137681 | 6807931 | eukaryotic translation initiation factor 4A, isoform 2 (EIF4A2), mRNA/cds = (15, 1238) | 1 | AGGTAGGGTTAATCCCCAGTAAAAT TGCCATATTGCACATGTCTTAATG |
| 1251 | Table 3A | Hs.306195 | AL137721 | 6808159 | over-expressed breast tumor protein (OBTP), mRNA/cds = (0, 224) | 1 | AGGGGGTGATTTTTGCTCTTGTCCTG AGAAATAACAGTGCTGTTTTAAAA |
| 1252 | Table 3A | Hs.12144 | AL137753 | 6808455 | mRNA; cDNA DKFZp434K1412 | 1 | ACTTGAGTGGGGTTTTCCTTTTCCCC |

TABLE 8-continued

| SEQ ID | Origin | Unigene | Locus | GI | Nominal Description | Strand | Probe Sequence |
|---|---|---|---|---|---|---|---|
| | | | | | (from clone DKFZp434K1412) /cds = UNKNOWN | | CAATTCTAAGAGAATATAATGTGT |
| 1253 | Table 3A | Hs.77646 | AL137938 | 6851002 | mRNA; cDNA DKFZp761M0223 (from clone DKFZp761M0223) /cds = UNKNOWN | 1 | GCGTCTGTTGTTAGCAAAGAATAGAT TCACACAGTCTAAGGTTTCCTTCC |
| 1254 | Table 3A | Hs.235390 | AL157426 | 7018455 | mRNA; cDNA DKFZp761B101 (from clone DKFZp761B101) /cds = UNKNOWN | 1 | CCCTCTTAGCCTATCCATCTTAAGCC CCAAGCTGAGTGTGGTTCTGGTAA |
| 1255 | Table 3A | Hs.66151 | AL157438 | 7018513 | mRNA; cDNA DKFZp434A115 (from clone DKFZp434A115) /cds = UNKNOWN | 1 | TAAGGAGAATTAGACTCCCAAGTAGA CACCAGAGTCACTGTTTGGTTGGT |
| 1256 | Table 3A | Hs.110702 | AL157477 | 7018497 | mRNA; cDNA DKFZp761E212 (from clone DKFZp761E212) /cds = UNKNOWN | 1 | ACGTGTTTTTGGGATATGTTTCCAAT CTTTAAATGACCTTGCCCTGTCCA |
| 1257 | Table 3A | Hs.250535 | AL157499 | 7018548 | mRNA; cDNA DKFZp434N2412 (from clone DKFZp434N2412) /cds = UNKNOWN | 1 | AACCATTTGTTAACTGTACTGAAGGT GTGTCCTCAAGAAGAAAGTGTTCA |
| 1258 | Table 3A | Hs.170171 | AL161952 | 7328002 | mRNA; cDNA DKFZp434M0813 (from clone DKFZp434M0813); partial cds/cds = (430, 768) | 1 | AAACAAACTGTGTAACTGCCCAAAGC AGCACTTATAAATCAGCCTAACAT |
| 1259 | Table 3A | Hs.71252 | AL161991 | 7328122 | mRNA; cDNA DKFZp761C169 (from clone DKFZp761C169); partial cds/cds = (996, 2474) | 1 | AAACTGATCACACTGACTGGATCTGT CCACGACATGGAAAATAAACTGGA |
| 1260 | Table 3A | Hs.99908 | AL162047 | 7328089 | nuclear receptor coactivator 4 (NCOA4), mRNA/cds = (140, 1984) | 1 | TTGCATTGATGAATTTTGTATCTGCTT CCATTAAAAGCATAACAGCCACA |
| 1261 | Table 3A | Hs.78829 | AL162049 | 7328093 | mRNA; cDNA DKFZp762E1712 (from clone DKFZp762E1712); partial cds/cds = (0, 2477) | 1 | ATCTCTCCTTCAGTCTGCTCTGTTTAA TTCTGCTGTCTGCTCTTCTAA |
| 1262 | Table 3A | Hs.302649 | AL162068 | 7328143 | HSP22-like protein interacting protein (LOC64165), mRNA/cds = (0, 155) | 1 | TTGAAGTTTTAAGGGACGTCAGTGTT TATGCCATTTTTCCAGTTCCAAAA |
| 1263 | Table 3A | Hs.17377 | AL162070 | 7328146 | mRNA; cDNA DKFZp762H186 (from clone DKFZp762H186); complete cds/cds = (0, 1489) | 1 | GGTCGGCTCTTATAGAGTGGCCATAG TGTTCTGTCAAAACACTTGCTTCC |
| 1264 | Table 3A | Hs.155191 | AL162086 | 7328174 | villin 2 (ezrin) (VIL2), mRNA/cds = (117, 1877) | 1 | TTCTCCTTCACAGCTAAGATGCCATG TGCAGGTGGATTCCATGCCGCAGA |
| 1265 | Table 3A | Hs.3576 | AL357536 | 8249879 | *Homo sapiens*, Similar to RIKEN cDNA 5730494N06 gene, clone MGC:13348 IMAGE:4132400, mRNA, complete cds/cds = (132, 494) | | CATGATTCCAAGGATCAGCCTGGATG CCTAGAGGACTAGATCACCTTAGT |
| 1266 | Table 3A | Hs.29797 | AL359585 | 8855645 | mRNA; cDNA DKFZp762B195 (from clone DKFZp762B195) /cds = UNKNOWN | 1 | AGTGAAGATCTGGCTGAACCAGTTCC ACAAGGTTACTGTATACATAGCCT |
| 1267 | Table 3A | Hs.252588 | AL359626 | 8655704 | mRNA; cDNA DKFZp564F172 (from clone DKFZp564F172) /cds = UNKNOWN | 1 | AGGCCATCATTCTATACCTCATTTAA GCCATTGTTATCAAGGGTTTACCC |
| 1268 | Table 3A | Hs.33758 | AL359654 | 8670873 | mRNA full length insert cDNA clone EUROIMAGE 196784 /cds = UNKNOWN | 1 | AGAGTACATGGAAAGTTAGGTGTTCA AATTCACATCTAATTTCCCTGGGA |
| 1269 | Table 3A | Hs.3840 | AL359940 | 8977897 | mRNA; cDNA DKFZp762P1915 (from clone DKFZp762P1915) /cds = UNKNOWN | 1 | GTTTTCAGTTTTCCCCTTTACAGTCTT CTCCCCTCACCTCCAGGACCCTC |
| 1270 | Table 3A | Hs.318501 | AL360190 | 8919391 | stimulated trans-acting factor (50 kDa) (STAF50), mRNA/cds = (122, 1450) | 1 | ATCCTTCAGAATGTGTTGGTTTACCA GTGACACCCCATATTCATCACAAA |
| 1271 | Table 3A | Hs.7104 | AL390127 | 9368821 | mRNA; cDNA DKFZp761P06121 (from clone DKFZp761P06121) /cds = UNKNOWN | 1 | GTCTGGCCTTGGCTTGCTCGGATAAA ACTTTGTATGTATTTTGTATGGCA |
| 1272 | Table 3A | Hs.49822 | AL390132 | 9368828 | mRNA; cDNA DKF2p547E107 (from clone DKFZp547E107) /cds = UNKNOWN | 1 | TGCTGAGCATGGGGAATGTGGCTGC TGCAGAGACGTTATGAAACACTTCT |
| 1273 | Table 3A | Hs.98026 | AL442083 | 10241762 | mRNA for KIAA1784 protein, partial cds/cds = (0, 3505) | 1 | TCTCCATCCTTGTGAATGTCCTCGTC TGTTTCAAATACAGTGCAGTCAGT |
| 1274 | Table 3A | Hs.77868 | AL513780 | 12777274 | ORF (LOC51035), mRNA /cds = (135, 1031) | 1 | TGGTTCTTCTGATGAGCAAGGGAACA ACACTGAGAATGAGGAGGAAGGAGT |
| 1275 | Table 3A | Hs.181309 | AL520892 | 12784385 | proteasome (prosome, macropain) subunit, alpha type, 2 (PSMA2), mRNA/cds = (0, 704) | 1 | TGAAGTTAAGGATTACTTGGCTGCCA TAGCATAACAATGAAGTGACTGAA |
| 1276 | Table 3A | Hs.16648 | AL523085 | 12786578 | AL523085 cDNA/clone = CS0DC001YF21-(5-prime) | 1 | GGCTTTCTTGTTTTGGTGTCTTGGAG TGCTGGGTAAGGTTCAGTGGATAT |
| 1277 | Table 3A | Hs.37617 | AL532303 | 12795796 | 602144947F1 cDNA, 5' end /clone = IMAGE:4308683/ clone_end = 5' | 1 | CTATCTACACCATCATGCGCTGGTTC CGGAGACACAAGGTGCGGGCTCAC |
| 1278 | Table 3A | Hs.83583 | AL532406 | 12795899 | actin related protein 2/3 complex, | 1 | GAAGCGGCTGGCAACTGAAGGCTGG |

TABLE 8-continued

| SEQ ID | Origin | Unigene | Locus | GI | Nominal Description | Strand | Probe Sequence |
|---|---|---|---|---|---|---|---|
| | | | | | subunit 2 (34 kD) (ARPC2), mRNA/cds = (84, 986) | | AACACTTGCTACTGGATAATCGTAG |
| 1279 | Table 3A | Hs.30120 | AL533737 | 12797230 | 602272333F1 cDNA, 5' end /clone = IMAGE:4360233/ clone_end = 5' | 1 | AAGCAAGAGATTGTAAACCGGGTACA GAATCCAAGAGATGAGAGAGGACC |
| 1280 | Table 3A | Hs.179999 | AL534564 | 12798057 | Homo sapiens, clone IMAGE: 3457003, mRNA/cds = UNKNOWN | 1 | AGACGAATGCTTGTCAGTTGTAGCTT TCCAGGATTCTGCTCCAATGAGGA |
| 1281 | Table 3A | Hs.159065 | AL538276 | 12801769 | AL538276 cDNA/clone = CS0DF027YC09-(5-prime) | 1 | CAAACTGATTGCGGGGCAGGGACTT GAGTATGGGGAGAGGCTGCAAAAGA |
| 1282 | Table 3A | Hs.285401 | AL540399 | 12870508 | colony stimulating factor 2 receptor, beta, low-affinity (granulocyte-macrophage) (CSF2RB), mRNA/cds = (28, 2721) | 1 | GAACATCAGGAGAGGAGTCCAGAGC CCACGTCTACTGCGGAAAAGTCAGG |
| 1283 | Table 3A | Hs.181400 | AL542592 | 12874788 | 602650370T1 cDNA, 3' end /clone = IMAGE:4761353/ clone_end = 3' | 1 | AGTTGGAGAGTTACTCGAACCTCAGG TGACAGTTGTAAGGCAGACATAGT |
| 1284 | Table 3A | Hs.271599 | AL550229 | 12886998 | cDNA FLJ12347 fis, clone MAMMA1002298/cds = UNKNOWN | 1 | CTCCTCCAGGCCTCTCGGATGCCTCT GTTGGGACAGCTAAGTTCCTCTTC |
| 1285 | Table 3A | NA | NC_001807 | 13959823 | Mitochondrial Sequence | 1 | TCCTCCATATATCCAAACAACAAAGC ATAATATTTCGCCCACTAAGCCAA |
| 1286 | Table 3A | Hs.218329 | AL556016 | 12898299 | mRNA for KIAA1245 protein, partial cds/cds = (701, 3379) | 1 | TGCTGTTGCAAAAGAAGAAGACATCT CTGCCTGAGTTTTAATTTTGTCCA |
| 1287 | Table 3A | Hs.250465 | AL556919 | 12900027 | mRNA; cDNA DKFZp434E2023 (from clone DKFZp434E2023) /cds = UNKNOWN | 1 | TTTCTGCTGGAGTCCCCTGTGTCCTC AGCCATCCCAAGAAGGGTTTGCTG |
| 1288 | Table 3A | Hs.90035 | AL558028 | 12902157 | AL558028 cDNA/clone = CS0DJ002YF02-(5-prime) | 1 | CTGGTTGGATCTGCATCTCACGCCCA CTGCACACCGTTCCTCTCCATCTG |
| 1289 | Table 3A | Hs.301756 | AL559029 | 12904124 | Homo sapiens, clone MGC:17544 IMAGE:3482146, mRNA, complete cds/cds = (256, 894) | 1 | ACCTGCGACTCCCTGGTGCTCTTTGCA GAGTTGGGCAGTGAAATTACCTTT |
| 1290 | Table 3A | Hs.119274 | AL559422 | 12904908 | RAS p21 protein activator (GTPase activating protein) 3 (Ins(1,3,4,5)P4-binding protein) (GAP1IP4BP), mRNA/cds = (46, 2550) | 1 | ATACACAGCACGACGTATCCTTGTAC CGACTTCTCCCGGTTCTTGTTTGA |
| 1291 | Table 3A | Hs.218329 | AL559555 | 12905153 | mRNA for KIAA1245 protein, partial cds/cds = (701, 3379) | 1 | GTACTTAGGAAGACACAGCTAGATGG ACAACAGCATTGGGAGGCTTAGCC |
| 1292 | Table 3A | Hs.33026 | AL561074 | 12908145 | mRNA for FLJ00037 protein, partial cds/cds = (3484, 3921) | 1 | CATCTCTGGTTGTGTCTGTGCCGACT CGGTGTTGAATCAAATCAGGTGTG |
| 1293 | Table 3A | Hs.335883 | BE262308 | 9135208 | 601462961T1 cDNA, 3' end /clone = IMAGE:3866222/ clone_end = 3' | 1 | CAACAATAGGAGGTGGAATGCTGCAA GGGGCTGCAAATGAGGGCAATGCA |
| 1294 | Table 3A | NA | NC_001807 | 13959823 | mitochondrial COX3 | 1 | ATATTTCACTTTACATCCAAACATCAC TTTGGCTTCGAAGCCGCCGCCTG |
| 1295 | Table 3A | Hs.287797 | AU117298 | 10932256 | mRNA for FLJ00043 protein, partial cds/cds = (0, 4248) | 1 | TGGCAAATTCTGCGAGTGTGATAATT TCAACTGTGATAGATCCAATGGCT |
| 1296 | Table 3A | Hs.1600 | AU118159 | 10933184 | Homo sapiens, clone IMAGE: 3543711, mRNA, partial cds/cds = (0, 1620) | 1 | TCTCACATGTCCATTTGAACCACCCA AACCAAAAACAAAGCATAAGCTGG |
| 1297 | Table 3A | Hs.181165 | AU120731 | 10935966 | eukaryotic translation elongation factor 1 alpha 1 (EEF1A1), mRNA/cds = (53, 1441) | 1 | TCCAGGATGTCTACAAAATTGGTGGT ATTGGTACTGTTCCTGTTGGCCGA |
| 1298 | Table 3A | Hs.172028 | AU135154 | 10995693 | a disintegrin and metalloproteinase domain 10 (ADAM10), mRNA /cds = (469, 2715) | 1 | TGGACATAGCAGCACATACTACTTCA GAGTTCATGATGTAGATGTCTGGT |
| 1299 | Table 3A | NA | AV686223 | 10288088 | AV886223 cDNA, 5' end /clone = GKCGXH11/clone_ | 1 | AACAGAAGACGAGGACACAGAGCGA GAATAAGCACAACTCAGACAACACA |
| 1300 | Table 3A | Hs.343475 | AV687530 | 10289393 | 601558208T1 cDNA, 3' end /clone = IMAGE:3826392/ clone_end = 3' | 1 | TGACCACTTATGCACTTTCTGAATTTG CTTTCCATGCTCAGAGTTCTGCT |
| 1301 | Table 3A | NA | AV689330 | 10291193 | cDNA clone GKCDJE03 5' | 1 | CTTTGACCCCACCTTGTGGAAACCCA GCTGTCTACTGGCAGACATTGGTG |
| 1302 | Table 3A | Hs.28739 | AV691642 | 10293505 | 602593745F1 cDNA, 5' end /clone = IMAGE:4721002/ clone_end = 5' | 1 | AAACACCAGTTTGCAGGAAGAA AGGAAGAGAATGGAAATTGCTTCT GGAA |
| 1303 | Table 3A | NA | AV693913 | 13959823 | mitochondrion, complete genome | 1 | CCCTACCATGAGCCCTACAAACAACT AACCTGCCACTAATAGTTATGTCA |
| 1304 | Table 3A | Hs.324602 | AW969923 | 8159767 | EST382001 cDNA | 1 | AGTCGTATTAGAGCCTTGGCGTAATC ATGGTCATAGCTGTTTCCTGTGTG |
| 1305 | Table 3A | Hs.301570 | AV702152 | 10718482 | 602585120F1 cDNA, 5' end /clone = IMAGE:4712861/ clone_end = 5' | 1 | TTGCTGCCTGATCTGACATACATGAT CCATCGGGTTTTGTTACAAGGAAC |
| 1306 | Table 3A | Hs.7312 | AV702692 | 10719022 | AV702692 cDNA, 5' end | 1 | CATGTTCATAGGTAATCTTTGTACTCT |

TABLE 8-continued

| SEQ ID | Origin | Unigene | Locus | GI | Nominal Description | Strand | Probe Sequence |
|---|---|---|---|---|---|---|---|
| | | | | | /clone = ADBBQC12/ clone_end = 5' | | GTGTGCAGCAGTATTTGGTTTGC |
| 1307 | Table 3A | NA | AV705900 | 10723195 | Partial Cloning Vector | 1 | AATTCGCCCTATAGTGAGTCGATTAC CAATCACTGCCCGCGTTTACAACG |
| 1308 | Table 3A | Hs.167130 | AV706014 | 10723303 | hypothetical protein (PRED22), mRNA/cds = (245, 1021) | 1 | ACAGGTAACTGAAGATCAAAGTAAAG CAACAGAGGAATGTACATCTACCT |
| 1309 | Table 3A | Hs.134829 | AV706481 | 10723761 | AV706481 cDNA, 5' end /clone = ADBBYF02/ clone_end = 5' | 1 | AACAGTTGGGCACCCTGAATGGCAAA TGGCAAATTTGGAGCGCTAATAAT |
| 1310 | Table 3A | NA | NC_001807 | 13959823 | mitochondrion, complete genome | 1 | GCCAATCACTTTATTGACTCCTAGCC GCAGACCTCCTCATTCTAACCTGA |
| 1311 | Table 3A | Hs.90960 | AV710415 | 10729044 | 602563938F1 cDNA, 5' end /clone = IMAGE:4688769/ clone_end = 5' | 1 | ATGTGGGAGGGGCATGGCAGCTATG AAGGACCTCCTACCTCTGGTTTCTG |
| 1312 | Table 3A | Hs.316785 | AV710763 | 10730069 | AV710763 cDNA, 5' end /clone = CuAAJH09/ clone_end = 5' | 1 | CATGGGACGGGGAGAAAAAGCAAAC CCTGGCACTTGGGAATACTTATACC |
| 1313 | Table 3A | Hs.135167 | AV712376 | 10731682 | AV712376 cDNA, 5' end /clone = DCAAND12/ clone_end = 5' | 1 | TTGTGCCCTTGACTGGGTATTTCTTG AAGCCCTTGGATCTACCTTTGGTC |
| 1314 | Table 3A | Hs.89104 | AV716500 | 10798017 | 602590917F1 cDNA, 5' end /clone = IMAGE:4717348/ clone_end = 5' | 1 | ACATAATACGGTTGTGCGAGCAGAGA ATCTACCTTTCCACTTCTAAGCCT |
| 1315 | Table 3A | Hs.237868 | AV716565 | 10813717 | interleukin 7 receptor (IL7R), mRNA/cds = (22, 1401) | 1 | CCAGCCTTTGCCTCTTCCTTCAATGT GGTTTCCATGGGAATTTGCTTCAG |
| 1316 | Table 3A | Hs.178703 | AV716627 | 10813779 | AV716627 cDNA, 5' end /clone = DCBBCH05/ clone_end = 5' | 1 | AAAACCTCGAGTCATGGTGAATGAGT GTCTCGGAGTTGCTCGTGTGTGTA |
| 1317 | Table 3A | Hs.17481 | AV716644 | 10813796 | mRNA; cDNA DKFZp434G2415 (from clone DKFZp434G2415) /cds = UNKNOWN | 1 | GTGAGCACGGACATGCGGCATCATC GAGTGAGACTGGTGTTCCAAGATTC |
| 1318 | Table 3A | Hs.256959 | AV719442 | 10816594 | AV719442 cDNA, 5' end /clone = GLCBNA01/ clone_end = 5' | 1 | CACCACAGTCTCAGTGCAGGGCTGG GAAGTGAAAGACGATTCACCAGACC |
| 1319 | Table 3A | NA | AV719659 | 10816811 | cDNA clone GLCGRA09 5' | 1 | TTTGTGGGTGGGTGATTAGTCGTTGC TGATGAGATATTTTGAGGGTGGGG |
| 1320 | Table 3A | Hs.127160 | AV719938 | 10817090 | AV659177 cDNA, 3' end /clone = GLCFUC08/ clone_end = 3' | 1 | ACCTTGTAAGTGCCTAAGAAATGAGA CTACAAGCTCCATTTCAGCAGGAC |
| 1321 | Table 3A | Hs.21536 | AV720984 | 10818136 | yl69a03.s1 cDNA, 3' end /clone = IMAGE:27414/ clone_end = 3' | 1 | GCCGAGATCTGCTCAGACTACATGG CTTCCACTATAGGGTTCTACAGTGT |
| 1322 | Table 3A | Hs.119908 | AV721008 | 10818160 | nucleolar protein NOP5/NOP58 (NOP5/NOP58), mRNA/cds = (0, 1589) | 1 | AAATCAGAATTCATTTAGCTCACCAC ATCTCTTGAATGTGATTGACCTAC |
| 1323 | Table 3A | Hs.247474 | AV723437 | 10826838 | hypothetical protein FLJ21032 (FLJ21032), mRNA/cds = (235, 1005) | 1 | AGGTGTTTAACAGTGTTATTTTGCCA CTGGTAATGTGTAAACTGTGAGTG |
| 1324 | Table 3A | Hs.76728 | AV724531 | 10829010 | 602570065F1 cDNA, 5' end /clone = IMAGE:4694321/ clone_end = 5' | 1 | TGGAGTTTCCAGGAGAAAAATAATCA CCTTTGAAGGTTTTTAGAGCATGT |
| 1325 | Table 3A | Hs.280261 | BE382869 | 9328234 | 601297762F1 cDNA, 5' end /clone = IMAGE:3627806/ clone_end = 5' | 1 | GGTAACAACATCCGTCTGAAAGGGTC GGACCTCGTCCAAAGGAGATAGGC |
| 1326 | Table 3A | Hs.21351 | AV724665 | 10829278 | qd15g09.x1 cDNA, 3' end /clone = IMAGE:1723840/ clone_end = 3' | 1 | ACATTTTGATTCTTCTCTCTGTGGG GTGGCAAGTTGAGGGAGCATTCTT |
| 1327 | Table 3A | Hs.44656 | AV726117 | 10832185 | AV726117 cDNA, 5' end /clone = HTCAXB05/ clone_end = 5' | 1 | CGTAAACCAATGTGGTACACTAGTTG GCCCGAACTTGGTATAAACCGCCT |
| 1328 | Table 3A | Hs.245798 | AV727063 | 10836484 | hypothetical protein DKFZp584I0422 (DKFZP584I0422), mRNA/cds = (510, 1196) | 1 | TCTTTAAGTCTGTCAAACCAGAACTC TTTGAAGCACTTTGAACAATGCCC |
| 1329 | Table 3A | Hs.316771 | AV729160 | 10838581 | AV729160 cDNA, 5' end /clone = HTCCAB04/ clone_end = 5' | 1 | AGCTGGCGTAATAGCGAAGAGGCCC GCACCGATCGCCTTTCCAACAAGTG |
| 1330 | Table 3A | Hs.22003 | AV730135 | 10839556 | solute carrier family 6 (neurotransmitter transporter, GABA), member 1 (SLC6A1), mRNA/cds = (234, 2033) | 1 | AGATGCATTTAAATGTCTATAAATGG TGTCATAACTAGAGCACGGGCGT |
| 1331 | Table 3A | Hs.175971 | AV734916 | 10852461 | AV734916 cDNA, 5' end /clone = cdAAHE11/ clone_end = 5' | 1 | ATTAAAACGCTTGGAAGAAAATCCCC TTTTGGCAGGTGGGGGAAAAAGCA |
| 1332 | Table 3A | NA | AV735258 | 10852803 | mitochondrion, complete genome | 1 | ATTCAACCAATAGCCCTTGCCGTACC GCCTACCCGTAACATTACTGGAGG |

TABLE 8-continued

| SEQ ID | Origin | Unigene | Locus | GI | Nominal Description | Strand | Probe Sequence |
|---|---|---|---|---|---|---|---|
| 1333 | Table 3A | NA | NC_001807 | 10855754 | Mitochondrial Sequence | 1 | CGCCTATAGCACTCGAATAATTCTTC TCACCCTAACAGGTCAACCTCGCT |
| 1334 | Table 3A | Hs.246798 | AV739961 | 10857542 | AV739961 cDNA, 5' end /clone = CBFBRA10/ clone_end = 5' | 1 | GTTGTGCATGATTCCCCACGTGTCTC TGTTTATCCAGATAAGAAAAGATA |
| 1335 | Table 3A | Hs.122431 | AV743635 | 10861216 | AV713062 cDNA, 5' end /clone = DCAADD12/ clone_end = 5' | 1 | TCTTTTAGGATTTGTCTTTTAGAATCT CCAGTCCTCACAGGAAAACCCCC |
| 1336 | Table 3A | Hs.42915 | AV745692 | 10865139 | ARP2 (actin-related protein 2, yeast) homolog (ACTR2), mRNA/cds = (74, 1258) | 1 | TGGGTGGAGTATTATGTTTAACTGGA GTTGTCAAGTATGAGTCCCTCAGG |
| 1337 | Table 3A | Hs.26670 | AV749844 | 10907692 | PAC clone RP3-515N1 from 22q11.2-q22/cds = (0, 791) | 1 | ACCTCATTCTGACACCTGCATATAGT GTGGGAAATTGCTCTGCATTTGAC |
| 1338 | Table 3A | Hs.31409 | AV752358 | 10910206 | 602685862F1 cDNA, 5' end /clone = IMAGE:4818566/ clone_end = 5' | 1 | GTTCTGGAGGACAGGAAGGGTGACC CACAGAGGATTATACCACCGGGGTG |
| 1339 | Table 3A | Hs.335863 | AV755117 | 10912965 | 601462961T1 cDNA, 3' end /clone = IMAGE:3866222/ clone_end = 3' | 1 | GCCGCAGACCTCCTCATTCTAACCTG AATCGAAGGACAACCAGTAAGCTA |
| 1340 | Table 3A | Hs.339696 | AV755367 | 10913215 | ribosomal protein S12 (RPS12), mRNA/cds = (80, 478) | 1 | TGAGTCGTATTACAATTCACTGGCCG TCGTTTTACAACGTCGTGACTGGG |
| 1341 | Table 3A | Hs.181165 | AV756188 | 10914036 | eukaryotic translation elongation factor 1 alpha 1 (EEF1A1), mRNA/cds = (53, 1441) | 1 | TAAGATTATCAACCTTGGGGTCGTTT TGTTGTTCGCGGATTGAGCACGGA |
| 1342 | Table 3A | Hs.58643 | AV760147 | 10917995 | 602438603F1 cDNA, 5' end /clone = IMAGE:4564968/ clone_end = 5' | 1 | CTGGGCTGAAGCCTATTCCTATGGG GCTCTGGAATGTTTGTGACTGAATG |
| 1343 | Table 3A | Hs.93194 | AV762642 | 10920490 | apolipoprotein A-I (APOA1), mRNA/cds = (38, 841) | 1 | TTGTCCATTTGGAACAGAGTCACTAT AAAGAACGGGCTCAACTGGGCACC |
| 1344 | Table 3A | Hs.301553 | AW021037 | 5874567 | karyopherin alpha 6 (importin alpha 7) (KPNA6), mRNA/cds = (55, 1665) | 1 | GCAGACATAGGCGAAGAAAACATGG CATTGAGTGTGCTGAGTCCAGACAA |
| 1345 | Table 3A | Hs.232400 | AW021551 | 5875081 | heterogeneous nuclear ribonucleoprotein A2/B1 (HNRPA2B1), transcript variant B1, mRNA/cds = (169, 1230) | 1 | CTTTTCCCACCCCCTCCCCCTCCATG TGAAGATTTGGGTGCTTAACATAT |
| 1346 | Table 3A | Hs.95835 | AW248322 | 6591315 | RST8356 cDNA | 1 | GGCACTGCCTCCTTACCTGTGAGGAA TGCAAAATAAAGCATGGATTAAGT |
| 1347 | Table 3A | Hs.340753 | AW362008 | 6866658 | tw50h12.x1 cDNA, 3' end /clone = IMAGE:2263175/ clone_end = 3' | 1 | AAACCACACCAGGAACTCCTTGCATG GCAAAAGCTGAACAGTACAAATCC |
| 1348 | Table 3A | Hs.127574 | BG436386 | 13342892 | 602509044F1 cDNA, 5' end /clone = IMAGE:4619579/ clone_end = 5' | 1 | ACACAGTCATCCCCATGCAGAAACCT CAGAAAACACCAATGTATTACACA |
| 1349 | Table 3A | Hs.8024 | AW390233 | 6894892 | IK cytokine, down-regulator of HLA II (IK), mRNA/ cds = (111, 1784) | 1 | GTCTGAACGAGACTCAATTCCTCTCC GAGGCTCCCCAAACAAATTGTAGC |
| 1350 | Table 3A | NA | AW402007 | 6920693 | UI-HF-BKD-aao-g-02-0-UI.r1 NIH_MGC_38 cDNA clone IMAGE:3054530 5' | 1 | GTGCAGTCCATCAGATCCAAGCCTGT CTCTTGAGGAACAACCGCGCAGAC |
| 1351 | Table 3A | Hs.181125 | AW405863 | 6924920 | *Homo sapiens*, clone MGC:12849 IMAGE:4308973, mRNA, complete cds/cds = (24, 725) | 1 | GACCCAGGCTATGGATGAGGCTGAC TATTACTGTCAGGCGTGGGACAGCA |
| 1352 | Table 3A | NA | AW499658 | 7111531 | UI-HF-BR0p-ajj-c-07-0-UI.r1 NIH_MGC_52 cDNA clone IMAGE:3074677 5' | 1 | TGGTGGCAAATCTGATTTTTGGAAAC GAGTATTGGAGGACTATAAAACAA |
| 1353 | Table 3A | NA | AW499828 | 7111870 | UI-HF-BN0-ake-c-06-0-UI.r1 NIH_MGC_50 cDNA clone IMAGE:3076819 5' | 1 | ACATTTCTTGTTGGCACTACAGCAAC CACATACAGTACAGACAACCTCCA |
| 1354 | Table 3A | Hs.181461 | AW499829 | 7111872 | ariadne (*Drosophila*) homolog, ubiquitin-conjugating enzyme E2-binding protein, I (ARIH1), mRNA/cds = (314, 1987) | 1 | TGGGATAAAGGTGTGTCGGTTTAGCA CCTCTGGAAGACCTATCTAGAGCT |
| 1355 | Table 3A | Hs.145668 | AW500534 | 7113240 | fmfc5 cDNA/clone = CR6-21 | 1 | CCTGGCACATGTTGTCTGGAGTCTGG CACACTGGTTATCAATAGCACATT |
| 1356 | Table 3A | Hs.304900 | AW501528 | 7115141 | 602288147F1 cDNA, 5' end /clone = IMAGE:4373963/ clone_end = 5' | 1 | GCATGTTCTCACCGTGAAGGAGAGT GATGCAGGGAGATACTACTGTGCAG |
| 1357 | Table 3A | Hs.37892 | AW504212 | 7141879 | KIAA0922 protein (KIAA0922), mRNA/cds = (122, 3841) | 1 | AAAGTGGGTGGAAGACTTCCTGGTG CAGGAGGCTCACTCCGATTTAAGGT |
| 1358 | Table 3A | Hs.120996 | AW504293 | 7141960 | serine/threonine kinase 17b (apoptosis-inducing) (STK17B), mRNA/cds = (261, 1379) | 1 | CTGTGGTCTGTTATATGAGAGAGATC CTTTAACTAGAGCAAAGAGGGAGT |
| 1359 | Table 3A | Hs.182937 | AW630825 | 7377615 | peptidylprolyl isomerase A (cyclophilin A) (PPIA), | 1 | GCTTGCTGTTCCTTAGAATTTTGCCTT GTAAGTTCTAGCTCAAGTTGGGG |

TABLE 8-continued

| SEQ ID | Origin | Unigene | Locus | GI | Nominal Description | Strand | Probe Sequence |
|---|---|---|---|---|---|---|---|
| 1360 | Table 3A | Hs.102647 | AW651682 | 7412932 | mRNA/cds = (44, 541) 602271538F1 cDNA, 5' end /clone = IMAGE:4359609/ clone_end = 5' | 1 | TTTCTCAGAGCTGGAGGTTGCTGGG CACCTAAATGATGTTTCATGATAGC |
| 1361 | Table 3A | NA | AW792856 | 7844778 | UM0001 cDNA | 1 | CTTTTTGTAAGTTACAACATTCCACTG GATCCTTATATTGCCTGTAGTGG |
| 1362 | Table 3A | NA | AW810442 | 7903438 | ST0125 cDNA | 1 | CTCATCTATGTCTTCTAAAGCTTTTCT GCATTCTTCCACCTGGGATTCAA |
| 1363 | Table 3A | NA | AW812896 | 7905890 | RC3-ST0186-250200-018-a11 cDNA/gb = AW812896 | 1 | CTGTCTTTGGAAGGAGACACAAGAAC CTGATAACATTGGTTGTCTTCGGG |
| 1364 | Table 3A | Hs.44577 | AW813133 | 7906127 | 602388170F1 cDNA, 5' end /clone = IMAGE:4517129/ clone_end = 5' | 1 | AAACAAGAACCCACTTAAACACAGCA TCAAACTCTACCATGAAATGAAGA |
| 1365 | Table 3A | Hs.23128 | AW819894 | 7912888 | Homo sapiens, Similar to RIKEN cDNA 4931428D14 gene, clone MGC:15407 IMAGE:4309613, mRNA, complete cds/cds = (123, 1151) | 1 | TTCTTCCTGGTCATATTCCTCTTTTGA TTTTCTAAGAACTTCCCTCAGGA |
| 1366 | Table 3A | Hs.165895 | AW850041 | 7945558 | IL3-CT0216-170300-097-C07 cDNA | 1 | ACACAAGATACTGCCACTTTCTCTAC ACAAAGACCCACCCAAACACCAGC |
| 1367 | Table 3A | Hs.301756 | AW866426 | 8000478 | Homo sapiens, clone MGC:17544 IMAGE:3482146, mRNA, complete cds/cds = (256, 894) | 1 | CTTTCTCAGGAAGTGGCTCTGCCAGG CAGGACTATGTGGGAAAGGGTTTT |
| 1368 | Table 3A | Hs.130729 | AW898615 | 8082820 | RC1-NN0073-090500-012-t02 cDNA | 1 | ATTACATGCTAACTCAAACTTACAAAA TCAAGCTCTCTGTGATCCTTGGTT |
| 1369 | Table 3A | Hs.166975 | AW949461 | 8139088 | splicing factor, arginine/serine-rich 5 (SFRS5), mRNA/cds = (218, 541) | 1 | GATTAAAGGCTTCCATCGATTGGGTA GTGTCCTTCAAGTGGGTGGCGAAG |
| 1370 | Table 3A | Hs.172028 | AW954112 | 8143795 | a disintegrin and metalloproteinase domain 10 (ADAM10), mRNA/cds = (469, 2715) | 1 | TGTATTAACAGGCTTATTGCTATGCA GGGAAATAGAAGGGGCATTACAAA |
| 1371 | Table 3A | Hs.76728 | AW954476 | 8144159 | 802570085F1 cDNA, 5' end /clone = IMAGE:4694321/ clone_end = 5' | 1 | TGGTGGATGGATGGAAACACATACCT CCTAATTAACCTGTTGGTGGAAAC |
| 1372 | Table 3A | Hs.292457 | AW954580 | 8144263 | Homo sapiens, clone MGC:16382 IMAGE:3927795, mRNA, complete cds/cds = (498, 635) | 1 | GCCTTGGAGTGTGACATTTCTGCGAG AATGCTTAAATACCGATTTCCCGC |
| 1373 | Table 3A | Hs.95835 | AW955265 | 8144948 | RST8356 cDNA | 1 | AGGGAGTCGTTTTACCAATTCACTGG CCCGTGTTTTACAAACGTCTGACT |
| 1374 | Table 3A | Hs.205353 | AW957139 | 8146822 | ectonucleoside triphosphate diphosphohydrolase 1 (ENTPD1), mRNA/cds = (67, 1599) | 1 | TGGAGAGCTTGGGACAAGGTCAGAA TGAAAACATACCAGTCAATCCTGCT |
| 1375 | Table 3A | Hs.289088 | AW958538 | 8148222 | heat shock 90 kD protein 1, alpha (HSPCA), mRNA/cds = (60, 2258) | 1 | ACCTGTGCTCTTTGGATACCTAATGC GACATTTAAGTTGTATTTGACAGT |
| 1376 | Table 3A | Hs.14453 | AW960484 | 8150168 | interferon consensus sequence binding protein 1 (ICSBP1), mRNA/cds = (47, 1327) | 1 | AGGCTGGGCACAAAGGAGAAAGGAG GACATGGAAAATCCGACAATTCGAA |
| 1377 | Table 3A | Hs.198427 | AW960593 | 8150277 | hexokinase 2 (HK2), mRNA/cds = (1490, 4243) | 1 | ATCTCAAATCCTTGAGCACTCAGTCT AGTGAAGATGTTGTCATTATGTACA |
| 1378 | Table 3A | Hs.237868 | AW963171 | 8153007 | interleukin 7 receptor (IL7R), mRNA/cds = (22, 1401) | 1 | GGGTCATAGGTTCATGGGTTTGTTGA GAATTGTGGCTCCTGGTTTCTGGT |
| 1379 | Table 3A | Hs.56205 | AW964218 | 8154054 | insulin induced gene 1 (INSIG1), mRNA/cds = (414, 1247) | 1 | GCCTTCTTTCTGCTGACTGGGGGCTT TCATTTAAAAGGAGTCTTTTTAAT |
| 1380 | Table 3A | Hs.30212 | AW985078 | 8154914 | thyroid receptor interacting protein 15 (TRIP15), mRNA/cds = (15, 1346) | 1 | TGTAAACAGTGGCAGGAGCGTGGAC TTAAAACAAGGCTTGCTTATTTGGT |
| 1381 | Table 3A | Hs.124764 | AW965490 | 8155326 | 602388504F1 cDNA, 5' end /clone = IMAGE:4515481/ clone_end = 5' | 1 | GCCCTTGGGTTAAGCCTTTACATTC ATGAAGACCCCTCCAGGGTAGAAT |
| 1382 | Table 3A | Hs.132739 | AW965967 | 8155823 | EST378080 cDNA/ | 1 | AAAAGGAAAACGAAAAGGAAA AGGTGGCCAATGTGGAAAAAGTTT CAAT |
| 1383 | Table 3A | Hs.293418 | AW966098 | 8155934 | EST385296 cDNA | 1 | ACTCTCAGGAGCCATGAAAGCTGCAC AGTTACTTTATATACCACGAGGCA |
| 1384 | Table 3A | Hs.25130 | AW967388 | 8157225 | cDNA FLJ14923 fis, clone PLACE1008244, weakly similar to VEGETATIBLE INCOMPATIBILITY PROTEIN HET-E-1/cds = UNKNOWN | 1 | TTATGTCACCAGAATGTTTGCCAACA CCCCGAAAAGGAACCAGAGGACTT |
| 1385 | Table 3A | Hs.343615 | AW968581 | 8158402 | 602621493F1 cDNA, 5' end /clone = IMAGE:4755166/ clone_end = 5' | 1 | AGGTTATTTGAGCACAGTGAAAGCAG AGTACTATGGTTGTCCAACACAGG |
| 1386 | Table 3A | Hs.82712 | AW969359 | 8159203 | fragile X mental retardation, autosomal homolog 1 (FXR1), mRNA/cds = (12, 1877) | 1 | GGCCTGCCATCCGAGGGACTGTGTT GTAGATTGTGATCAAGGTTGATTGG |

TABLE 8-continued

| SEQ ID | Origin | Unigene | Locus | GI | Nominal Description | Strand | Probe Sequence |
|---|---|---|---|---|---|---|---|
| 1387 | Table 3A | Hs.199160 | AW969548 | 8159390 | translocation T(4;11) of ALL-1 gene to chromosome 4/cds = UNKNOWN | 1 | ACAGGTAGTTGAATAATTGTTTCAAG AGCTCAACAGATGACAAGCTTCTT |
| 1388 | Table 3A | Hs.293744 | AW973953 | 8165038 | 602279577F1 cDNA, 5' end /clone = IMAGE:4387322/ clone_end = 5' | 1 | AATACACTTTGTGCCAAGGGAAGAAC ACTGCATGCCCTGGGTCTTCAGTC |
| 1389 | Table 3A | Hs.43148 | AW993524 | 8253690 | 602554063F1 cDNA, 5' end /clone = IMAGE:4663887/ clone_end = 5' | 1 | GGGAACTGGAGGTGAGAAGCATTAT AATAGCCTCTCTGCCTTTATCTACA |
| 1390 | Table 3A | Hs.238990 | AY004255 | 9652559 | Homo sapiens, Similar to cyclin-dependent kinase inhibitor 1B (p27, Kip1), clone MGC:5304 IMAGE:3458141, mRNA, complete cds/cds = (377, 973) | 1 | ACAAGCCAAAGTGGCATGTTTTGTGC ATTTGTAAATGCTGTGTTGGGTAG |
| 1391 | Table 3A | Hs.16773 | AY007106 | 9955998 | clone TCCCIA00427 mRNA sequence/cds = UNKNOWN | 1 | AACAGACTGTCGTAGAAAACTGTCTT TGCTTCCAAATCAGCAGAGGACCA |
| 1392 | Table 3A | Hs.285013 | AY007110 | 9956004 | putative HLA class II associated protein I (PHAP1), mRNA/cds = (148, 897) | 1 | GCCCCTCAGAAGAGCCAAACTTTGAG TTTTATGTCTGTTTGTCATTGATA |
| 1393 | Table 3A | Hs.24435 | AY007126 | 9956024 | clone CDABP0028 mRNA sequence/cds = UNKNOWN | 1 | CCTTGTGTCCAACGGGAATAGGAAGA ATTAGTTACTGACTTCACCTGAGA |
| 1394 | Table 3A | Hs.330838 | BE910568 | 10407295 | 601501121F1 cDNA, 5' end /clone = IMAGE:3903053/ clone_end = 5' | 1 | CCCACAATTGGACTGATAGGGGGAG AAAATCCAAAGAGACGGAGCAACTG |
| 1395 | Table 3A | Hs.250820 | AY007158 | 9956071 | hypothetical protein FLJ14827 (FLJ14827), mRNA/cds = (468, 1277) | 1 | AACGGCAACTGGGAGATTTGTGAGT GAACACTGTTTCATCTTAATATGCT |
| 1396 | Table 3A | Hs.173274 | AY007165 | 9956080 | integrin cytoplasmic domain-associated protein 1 (ICAP-1A), transcript variant 1, mRNA/cds = (168, 770) | 1 | ACATCTGAGAAACCCTGAATCCTGCA ATCAAGTAGAAGTCAACTTCATCT |
| 1397 | Table 3A | Hs.105484 | AY007243 | 12621025 | regenerating gene type IV (REG-IV), mRNA/cds = (181, 657) | 1 | GCCATAGGAAGGTTTACCAGTAGAAT CCTTGCTAGGTTGATGTGGGCCAT |
| 1398 | Table 3A | Hs.5298 | AY029066 | 14017398 | CGI-45 protein (LOC51094), mRNA/cds = (182, 1294) | 1 | TCATCTCAACTTAGTATTATACCCACA CCCACCCAAGAACAGGGTTTGTT |
| 1399 | Table 3A | Hs.79070 | BC000141 | 12652778 | v-myc avian myelocytomatosis viral oncogene homolog (MYC), mRNA/cds = (558, 1877) | 1 | GACTGAAAGATTTAGCCATAATGTAA ACTGCCTCAAATTGGACTTTGGGC |
| 1400 | Table 3A | Hs.334602 | BC000167 | 13096801 | cDNA FLJ14539 fis, clone NT2RM2001345, weakly similar to VEGETATIBLE INCOMPATIBILITY PROTEIN HET-E-1/ cds = (7, 1434) | 1 | GGCACTGTCTGTGTCCTTCCTTGAAC TGTCTACCCTGTTGCTTTTCACAA |
| 1401 | Table 3A | Hs.75458 | BC000374 | 12653212 | ribosomal protein L18 (RPL18), mRNA/cds = (15, 581) | 1 | GGCCAGCCGAGGCTACAAAAACTAA CCCTGGATCCTACTCTCTTATTAAA |
| 1402 | Table 3A | Hs.278544 | BC000408 | 12853278 | acetyl-Coenzyme A acetyltransferase 2 (acetoacetyl Coenzyme A thiolase) (ACAT2), mRNA/cds = (37, 1230) | 1 | ACTAGGTTGCAATATGTGAAATCAGA GGACCAAAGTACAGATGGAAACCA |
| 1403 | Table 3A | Hs.183704 | BC000449 | 12653358 | ubiquitin mRNA, complete cds /cds = (135, 2192) | 1 | CCCTGTCTGACTACAACATCCAGAAA GAGTCCACTCTGCACTTGGTCCTG |
| 1404 | Table 3A | Hs.151242 | BC000514 | 12653484 | serine (or cysteine) proteinase inhibitor, clade G (C1 inhibitor), member 1 (SERPING1), mRNA/cds = (60, 1562) | 1 | GGCATCGCCCATGCTCCTCACCTGTA TTTTGTAATCAGAAATAAATTGCT |
| 1405 | Table 3A | Hs.180450 | BC000523 | 12653502 | ribosomal protein S24 (RPS24), transcript variant 1, mRNA/cds = (37, 429) | 1 | AAAGCAACGAAAGGAACGCAAGAAC AGAATGAAGAAAGTCAGGGGGACTG |
| 1406 | Table 3A | Hs.272822 | BC000530 | 12653516 | RuvB (E. coli homolog)-like 1 (RUVBL1), mRNA/cds = (76, 1446) | 1 | TCCCACTTTGTCTGTACATACTGGCC TCTGTGATTACATAGATCAGCCAT |
| 1407 | Table 3A | Hs.83583 | BC000590 | 12653824 | actin related protein 2/3 complex, subunit 2 (34 kD) (ARPC2), mRNA/cds = (84, 986) | 1 | GAAGCGGCTGGCAACTGAAGGCTGG AACACTTGCTACTGGATAATCGTAG |
| 1408 | literature | Hs.153026 | BC000616 | 12653666 | mRNA for KIAA0640 protein, partial cds/cds = (0, 1812) | 1 | CAGTCACGTCAGTTATGTAGATACTG CATGGCAGGAGAGCTTTACGCTAA |
| 1409 | Table 3A | Hs.321677 | BC000627 | 12653884 | signal transducer and activator of transcription 3 (acute-phase response factor) (STAT3), mRNA/cds = (220, 2532) | 1 | GCCACCCCTCACACAGCCAAACCCC AGATCATCTGAAACTACTAACTTTG |
| 1410 | Table 3A | Hs.5662 | BC000672 | 12653772 | guanine nucleotide binding protein (G protein), beta polypeptide 2-like 1 (GNB2L1), mRNA/cds = (95, 1048) | 1 | GCAGGTGACCATTGGCACACGCTAG AAGTTTATGGCAGAGCTTTACAAAT |

TABLE 8-continued

| SEQ ID | Origin | Unigene | Locus | GI | Nominal Description | Strand | Probe Sequence |
|---|---|---|---|---|---|---|---|
| 1411 | Table 3A | Hs.4147 | BC000687 | 12853796 | Homo sapiens, translocating chain-associating membrane protein, clone MGC:784 IMAGE:3347823, mRNA, complete cds/cds = (91, 1215) | 1 | TGCCATGCTGCTAGGAAATTGTCCTT TTTCTTTCTAGCTGTTAACCTACT |
| 1412 | Table 3A | Hs.44468 | BC000758 | 12653928 | Homo sapiens, clone MGC:2698 IMAGE:2820737, mRNA, complete cds/cds = (168, 266) | 1 | AACTTATTCCAGTGTTGATCGCAAGC TGTTGATGCACAGGCGTCTTGTGG |
| 1413 | Table 3A | Hs.101514 | BC000764 | 12653940 | hypothetical protein FLJ10342 (FLJ10342), mRNA/cds = (533, 1144) | 1 | TGAAAAGGATTAAAGCTGGTATTCTA GAACATGCCCTTCACTGGTTGTGT |
| 1414 | Table 3A | Hs.85844 | BC000771 | 12653954 | neurotrophic tyrosine kinase, receptor, type 1 (NTRK1), mRNA/cds = (0, 2390) | 1 | GGTAAGGTTTCTAGGAGGTCTGTTAG GTGTACATCCTGCAGCTTATTGGC |
| 1415 | Table 3A | Hs.195870 | BC000987 | 13111833 | chronic myelogenous leukemia tumor antigen 66 mRNA, complete cds, alternatively spliced/cds = (232, 1983) | 1 | TGATTCTGTAAAGCTGTGGAATGAAG CTGCAGATTTAGAGAACATTGGCT |
| 1416 | Table 3A | Hs.299214 | BC001077 | 12654494 | Homo sapiens, clone IMAGE:2822295, mRNA, partial cds/cds = (0, 661) | 1 | CGATTTTACACGGCTGGGTAGAATTT GTAGAAAAGATCCACAGGGCAAGC |
| 1417 | Table 3A | Hs.82193 | BC001169 | 12654662 | cDNA FLJ11763 fis, clone HEMBA1005679/cds = UNKNOWN | 1 | GCTACTACTTCATTGCAACCTTTATTA CTGACCACATCAGACATCATGCT |
| 1418 | Table 3A | Hs.240770 | BC001255 | 12654824 | Homo sapiens, nuclear cap binding protein subunit 2, 20 kD, clone MGC:4991 IMAGE:3458927, mRNA, complete cds/cds = (26, 496) | 1 | GGGCTGAAGTACCTAAGTGTGAATGT CTCTCCCGTTAAACTGAGTGTAGA |
| 1419 | Table 3A | Hs.73957 | BC001267 | 12654846 | Homo sapiens, RAB5A, member RAS oncogene family, clone MGC:5048 IMAGE:3483669, mRNA, complete cds/cds = (165, 812) | 1 | AGGAAAACGGTTCACCAGTGTTTAGT TTTATATTGAGGTGCTCAGGTTGG |
| 1420 | Table 3A | Hs.73965 | BC001303 | 12654914 | splicing factor, arginine/serine-rich 2 (SFRS2), mRNA/cds = (155, 820) | 1 | CCGGGCCTTGCATATAAATAACGGAG CATACAGTGAGCACATCTAGCTGA |
| 1421 | Table 3A | Hs.62954 | BC001399 | 12655094 | ferritin, heavy polypeptide 1 (FTH1), mRNA/cds = (91, 663) | 1 | ATAATGAAAGCTAAGCCTCGGGCTAA TTTCCCCATAGCCGTGGGGTGACT |
| 1422 | Table 3A | Hs.288038 | BC001412 | 12655120 | tRNA isopentenylpyrophosphate transferase (IPT), mRNA/cds = (60, 1040) | 1 | TGCATCGTAAAACCTTCAGAAGGAAA GGAGAATGTTTTGTGGACCACTTT |
| 1423 | Table 3A | Hs.3459 | BC001413 | 13937593 | cDNA: FLJ22003 fis, clone HEP06764/cds = UNKNOWN | 1 | TGCTCTGTTCTGGTTTCTGTTTTCAAA TCAAATGCCTGTTTGGGAGGAGA |
| 1424 | Table 3A | Hs.51299 | BC001632 | 12804450 | NADH dehydrogenase (ubiquinone) flavoprotein 2 (24 kD) (NDUFV2), mRNA/cds = (18, 767) | 1 | CAAAATCCCAAAACCAGGGCCAAGG AGTGGACGCTTCTCTTGTGAGCCAG |
| 1425 | Table 3A | Hs.155101 | BC001637 | 12804460 | mRNA for KIAA1578 protein, partial cds/cds = (0, 3608) | 1 | ACAAATTTCTTGGCTGGATTTGAAGC TTAAACTCCTGTGGATTCACATCA |
| 1426 | Table 3A | Hs.318069 | BC001646 | 12804476 | cDNA FLJ20350 fis, clone HEP13972, highly similar to Z184_ZINC FINGER PROTEIN 184/cds = UNKNOWN | 1 | TCCACGGTTGTGCCTTATTGTTCCAT TAAAATTGTATCTTCGATCCATCA |
| 1427 | Table 3A | Hs.8297 | BC001660 | 12804498 | cDNA FLJ10907 fis, clone OVARC1000060/cds = (319, 696) | 1 | GGTCTGAGAGTCTGTGAAGATGGCC CAGTCTTCTATCCCCACCTAAAAA |
| 1428 | Table 3A | Hs.17279 | BC001697 | 12804560 | tyrosylprotein sulfotransferase 1 (TPST1), mRNA/cds = (81, 1193) | 1 | ACACACAGGAGGGAAAATCCTGGGA TTCTTTTTCTAGGGATGTAATACAT |
| 1429 | Table 3A | Hs.284291 | BC001798 | 12804732 | sorting nexin 6 (SNX6), mRNA/cds = (497, 1369) | 1 | CTGTTTGAACTGTTGAGTTTCCGTTG CTGGCTGAGTGCGTTTTGTCCTTC |
| 1430 | Table 3A | Hs.8297 | BC001819 | 12804758 | cDNA FLJ10907 fis, clone OVARC1000060/cds = (319, 696) | 1 | GGTCTGAGAGTCTGTGAAGATGGCC CAGTCTTCTATCCCCACCTAAAAA |
| 1431 | Table 3A | Hs.77502 | BC001854 | 12804818 | Homo sapiens, methionine adenosyltransferase II, alpha, clone MGC:4537 IMAGE:3010820, mRNA, complete cds/cds = (116, 1303) | 1 | GGTACAGAGAAGCCAGCTTGTTTACA TGCTTATTCCATGACTGCTTGCCC |
| 1432 | Table 3A | Hs.77502 | BC001854 | 12804818 | Homo sapiens, methionine adenosyltransferase II, alpha, clone MGC:4537 IMAGE:3010820, mRNA, complete cds/cds = (116, 1303) | 1 | GGTACAGAGAAGCCAGCTTGTTTACA TGCTTATTCCATGACTGCTTGCCC |
| 1433 | Table 3A | Hs.13580 | BC001909 | 12804912 | Homo sapiens, clone IMAGE:3537447, mRNA, partial cds/cds = (0, 790) | 1 | GGGAGAATGAATGTGCAACGTGGCT GAAATCTATTTTGTGTAATAAAAGG |
| 1434 | Table 3A | Hs.157236 | BC001913 | 12804920 | Homo sapiens, clone | 1 | CCCCACCACCCCATTACCACAGCTGC |

TABLE 8-continued

| SEQ ID | Origin | Unigene | Locus | GI | Nominal Description | Strand | Probe Sequence |
|---|---|---|---|---|---|---|---|
| | | | | | MGC:3015 IMAGE:3162543, mRNA, complete cds/cds = (332, 1234) | | CTTTGTGTGTTTGTGTCAATAAAA |
| 1435 | Table 3A | Hs.318885 | BC001980 | 12805046 | superoxide dismutase 2, mitochondrial (SOD2), mRNA/cds = (4, 672) | 1 | CCAGCAAGATAATGTCCTGTCTTCTA AGATGTGCATCAAGCCTGGTACAT |
| 1436 | Table 3A | Hs.288061 | BC002409 | 12803202 | actin, beta (ACTB), mRNA/cds = (73, 1200) | 1 | CCAACTTGAGATGTATGAAGGCTTTT GGTCTCCCTGGGAGTGGGTGGAGG |
| 1437 | Table 3A | Hs.284214 | BC002435 | 12803242 | putative zinc finger protein (LOC55818), mRNA/cds = (299, 3937) | 1 | GCTACTAGAGAGCAAGGGGCTTTCTT ACCACCAGTGCTGAGGAGAAAAGT |
| 1438 | Table 3A | Hs.334822 | 12803270 | 12803270 | *Homo sapiens*, Similar to ribosomal protein L4, clone MGC:2966 IMAGE:3139805, mRNA, complete cds/cds = (1616, 2617) | 1 | ACCAAGAAACCAGCCCCTGAAA AGAAGCCTGCAGAGAAGAAACCTA CTAC |
| 1439 | Table 3A | Hs.104879 | BC002538 | 12803428 | *Homo sapiens*, serine (or cysteine) proteinase inhibitor, clade B (ovalbumin), member 9, clone MGC:2131 IMAGE:3140427, mRNA, complete cds/cds = (92, 1222) | 1 | TTTCCTCATCTATGAATTGTCATTCAC ACACCTACTTTTCTGCTTCGTTT |
| 1440 | Table 3A | Hs.104879 | BC002538 | 12803428 | *Homo sapiens*, serine (or cysteine) proteinase inhibitor, clade B (ovalbumin), member 9, clone MGC:2131 IMAGE:3140427, mRNA, complete cds/cds = (92, 1222) | 1 | TTTCCTCATCTATGAATTGTCATTCAC ACACCTACTTTTCTGCTTCGTTT |
| 1441 | Table 3A | Hs.146409 | BC002711 | 12803746 | cell division cycle 42 (GTP-binding protein, 25 kD) (CDC42), mRNA/cds = (69, 644) | 1 | AATAATGACAAATGCCCTGCACCTAC CCACATGCACTCGTGTGAGACAAG |
| 1442 | Table 3A | Hs.322824 | BC002746 | 12803812 | *Homo sapiens*, Similar to dodecenoyl-Coenzyme A delta isomerase (3.2 trans enoyl-Coenzyme A isomerase), clone MGC:3903 IMAGE:3830566, mRNA, complete cds/cds = (15, 872) | 1 | GTGCCCCTGTGGGTCCCAGGGAGGT CTTAAACAAGGTATTTTTCAACTTA |
| 1443 | Table 3A | Hs.46448 | BC002796 | 12803898 | lymphoblastic leukemia derived sequence 1 (LYL1), mRNA/cds = (0, 803) | 1 | CAGTGAAGACGTCAGGGGCAAGGTC TCGGGGGTCCGGAAGGGTGATCATC |
| 1444 | Table 3A | Hs.322404 | BC002837 | 12803976 | hypothetical protein MGC4175 (MGC4175), mRNA/cds = (221, 577) | 1 | TGCAAGGGAGACATATCCTAGATCAC TTTGCTTTTTCTTTAAGGAGCTGA |
| 1445 | Table 3A | Hs.288036 | BC002845 | 12803990 | tRNA isopentenylpyrophosphate transferase (IPT), mRNA/cds = (60, 1040) | 1 | TGCATCGTAAAACCTTCAGAAGGAAA GGAGAATGTTTTGTGGACCACTTT |
| 1446 | Table 3A | Hs.318693 | BC002887 | 12804028 | *Homo sapiens*, clone IMAGE:3940519, mRNA, partial cds/cds = (0, 902) | 1 | TTGGGGGAGGTTAGGGACTTATCCT GTGCTTGTAAATAAATAAGGTCATG |
| 1447 | Table 3A | Hs.181309 | BC002900 | 12804094 | proteasome (prosome, macropain) subunit, alpha type, 2 (PSMA2), mRNA/cds = (0, 704) | 1 | ACTTGGCTGCCATAGCATAACAATGA AGTGACTGAAAAATCCAGAATTTC |
| 1448 | Table 3A | Hs.96757 | 12804148 | 12804148 | suppressor of Ty (*S. cerevisiae*) 3 homolog (SUPT3H), mRNA/cds = (71, 1024) | 1 | AAAATATTAAACACAAACTACCACCTA CCTCCCTCACCAAAGCCCATAAA |
| 1449 | Table 3A | Hs.1600 | BC002971 | 12804224 | *Homo sapiens*, clone IMAGE:3543711, mRNA, partial cds/cds = (0, 1620) | 1 | AGCTGTTTGGTAACCATAGTTTCACT TGTTCAAAGCTGTGTAATCGTGGG |
| 1450 | Table 3A | Hs.1600 | BC002971 | 12804224 | *Homo sapiens*, clone IMAGE:3543711, mRNA, partial cds/cds = (0, 1620) | 1 | AGCTGTTTGGTAACCATAGTTTCACT TGTTCAAAGCTGTGTAATCGTGGG |
| 1451 | Table 3A | Hs.75193 | BC003090 | 13111846 | COP9 homolog (COP9), mRNA/cds = (49, 678) | 1 | TGTCGCCTTTTAGAAGGAGAAACTTA AGTGTGGAATGCATTATATGGGCA |
| 1452 | Table 3A | Hs.334861 | BC003137 | 13111932 | hypothetical protein FLJ23059 (FLJ23059), mRNA/cds = (41, 1681) | 1 | TCCTTGGCAGCTGTATTCTGGAGTCT GGATGTTGCTCTCTAAAGACCTTT |
| 1453 | Table 3A | Hs.326456 | BC003352 | 13097158 | hypothetical protein FLJ20030 (FLJ20030), mRNA/cds = (1, 1239) | 1 | TTTGGAGTGGAGGCATTGTTTTAAG AAAAACATGTCATGTAGGTTGTCT |
| 1454 | Table 3A | Hs.77091 | NM_006730 | 5803006 | deoxyribonuclease I-like 1 (DNASE1L1), mRNA/cds = (794, 1702) | 1 | TGGCTGGGACGCTAGAAGGGTCATG TGTTAACTATAATCACATTTATGGT |
| 1455 | Table 3A | Hs.24697 | BC003406 | 13097305 | cDNA FLJ20709 fis, clone KAIA1124, highly similar to | 1 | ATTCTGGTTAACCGCTCACATGCATA ACAATAATGCTAGAAATTCAGGAA |

TABLE 8-continued

| SEQ ID | Origin | Unigene | Locus | GI | Nominal Description | Strand | Probe Sequence |
|---|---|---|---|---|---|---|---|
| 1456 | Table 3A | Hs.42712 | BC003525 | 13097617 | D86324 mRNA for CMP-N-acetylneuraminic acid/cds = UNKNOWN *Homo sapiens*, Similar to Max, clone MGC:10775 IMAGE:3807261, mRNA, complete cds/cds = (115, 570) | 1 | TGCTGATTTCTAGTGTATACTCTGTA GTCTCAGTTCGTGTTTGATTCCAT |
| 1457 | Table 3A | Hs.5322 | BC003583 | 13097716 | guanine nucleotide binding protein (G protein), gamma 5 (GNG5), mRNA/cds = (333, 539) | 1 | AAATGAATCTTTCAAAGGTTTC CCAAACCACTCCTTATGATCCAG TGATA |
| 1458 | Table 3A | Hs.334861 | BC003577 | 13097758 | hypothetical protein FLJ23059 (FLJ23059), mRNA/cds = (41, 1681) | 1 | TCCTTGGCAGCTGTATTCTGGAGTCT GGATGTTGCTCTCTAAAGACCTTT |
| 1459 | Table 3A | Hs.56851 | BC003581 | 13097767 | hypothetical protein MGC2668 (MGC2668), mRNA/cds = (20, 325) | 1 | TGCGTGTGCCTCAGTTTCCTCCTCCA CAACTGAATATTTATAGTGGCTGA |
| 1460 | Table 3A | Hs.188757 | BC003897 | 13277575 | *Homo sapiens*, clone MGC:5564, mRNA, complete cds/cds = (227, 304) | 1 | GGGATGTGGAGGATTTTTGTTAAGTG TCAATCGAAGTTAAAAAGCAAGGG |
| 1461 | Table 3A | Hs.215595 | BC004186 | 13278842 | guanine nucleotide binding protein (G protein), beta polypeptide 1 (GNB1), mRNA/cds = (280, 1302) | 1 | AGCTCTCTGCACCCTTACCCCTTTCC ACCTTTTGTATTTAATTTTAAAGT |
| 1462 | Table 3A | Hs.111334 | BC004245 | 13279004 | PRO2760 mRNA, complete cds /cds = UNKNOWN | 1 | CCCTCCAGCCAATAGGCAGCTTTCTT AACTATCCTAACAAGCCTTGGACC |
| 1463 | Table 3A | Hs.70333 | BC004258 | 13279043 | mRNA for KIAA1844 protein, partial cds/cds = (0, 1105) | 1 | CGTGGTTGTGGGAGGGGAAAGAGGA AACAGAGCTAGTCAGATGTGAATTG |
| 1464 | Table 3A | Hs.9788 | BC004317 | 13279217 | hypothetical protein MGC10924 similar to Nedd4 WW-binding protein 5 (MGC10924), mRNA/cds = (104, 769) | 1 | ACAATGTGTTAGCAGAAACCAGTGGG TTATAATGTAGAATGATGTGCTTT |
| 1465 | Table 3A | Hs.254105 | BC004458 | 13325288 | enolase 1, (alpha) (ENO1), mRNA/cds = (94, 1398) | 1 | GCTAGATCCCCGGTGGTTTTGTGCTC AAAATAAAAAGCCTCAGTGACCCA |
| 1466 | Table 3A | Hs.155101 | BC004521 | 13325447 | mRNA for KIAA1578 protein, partial cds/cds = (0, 3608) | 1 | ACAAATTTCTTGGCTGGATTTGAAGC TTAAACTCCTGTGGATTCACATCA |
| 1467 | Table 3A | Hs.17132 | BC004805 | 13937690 | 602326876F1 cDNA, 5' end /clone = IMAGE:4427970/ clone_end = 5' | 1 | GCTGTGGTTGGTTGCATTACATGACA CAGAAAACTGTCCTCTACCTCACG |
| 1468 | Table 3A | Hs.103378 | BC004872 | 13438100 | hypothetical protein MGC11034 (MGC11034), mRNA/cds = (245, 840) | 1 | GCCCTGGTAGGCTCCTTTAGAAGGA CCATTTCTGTTCCTAGAGCTTAACT |
| 1469 | Table 3A | Hs.151242 | BC004900 | 13438172 | serine (or cysteine) proteinase inhibitor, clade G (C1 inhibitor), member 1 (SERPING1), mRNA/cds = (60, 1582) | 1 | GGCATCGCCCATGCTCCTCACCTGTA TTTTGTAATCAGAAATAAATTGCT |
| 1470 | Table 3A | Hs.74335 | BC004928 | 13436256 | heat shock 90 kD protein 1, beta (HSPCB), mRNA/cds = (0, 2174) | 1 | TTTCCCTCTCCTGTCCTTGTGTTGAA GGCAGTAAACTAAGGGTGTCAAGC |
| 1471 | Table 3A | Hs.336916 | BC004994 | 13436445 | death-associated protein 6 (DAXX), mRNA/cds = (147, 2369) | 1 | AGACTGGAAATGGGGATGAGGGTGT AAATTGTATTGAAAAAGATCGCGAA |
| 1472 | Table 3A | Hs.60377 | BC005101 | 13937700 | mRNA for KIAA1298 protein, partial cds/cds = (55, 2271) | 1 | CCATGAGTTGTTTGGTTTTCCAGAAG CTGCCAGTGGGTTCCCGTGAATTG |
| 1473 | Table 3A | Hs.99858 | BC005128 | 13477308 | ribosomal protein L7a (RPL7A), mRNA/cds = (31, 831) | 1 | GATACGATGAGATCCGCCGTCACTG GGGTGGCAATGTCCTGGGTCCTAAG |
| 1474 | Table 3A | Hs.177507 | BC005187 | 13528770 | hypothetical protein (HSPC155), mRNA/cds = (240, 743) | 1 | AGTCTTTCTGGTTTCTGGAGATAACC CATCAATAAAGCTGCTTCCTCTGG |
| 1475 | Table 3A | Hs.251531 | BC005361 | 13529190 | proteasome (prosome, macropain) subunit, alpha type, 4 (PSMA4), mRNA/cds = (59, 844) | 1 | CGATGATGGTTACCCTTCATGGACGT CTTAATCTTCCACACACATCCCCT |
| 1476 | Table 3A | Hs.100000 | BC005928 | 13543538 | S100 calcium-binding protein A8 (calgranulin A) (S100A8), mRNA/cds = (55, 339) | 1 | GGCCCCTGGACATGTACCTGCAGAA TAATAAAGTCATCAATACCTAAAAA |
| 1477 | Table 3A | Hs.334573 | BC006008 | 13937718 | clone IMAGE:4285740, mRNA/cds = UNKNOWN | 1 | GCAAACCTGCAGATTCCCAAGATGTT CACGAGCTTGTGCTTTCTAAAGAA |
| 1478 | Table 3A | Hs.101150 | BC006176 | 13544094 | clone IMAGE:4054158. | 1 | TCCCCATTGTGCCGCCTTTATCAATT GCCTGTTTTGTTTTGTTTGTTTTT |
| 1479 | Table 3A | Hs.108824 | BC006282 | 13623362 | hypothetical protein MGC10540 (MGC10540), mRNA/cds = (49, 579) | 1 | CTTTAGCTGCTGTTGCCTCCCTTCTC AGGCTGGTGCTGGATCCTTCCTAG |
| 1480 | Table 3A | Hs.239884 | BC008464 | 13623874 | H2B histone family, member L (H2BFL), mRNA/cds = (0, 380) | 1 | CTGCTTATGGCACAATTTGCCTCAAA ATCCATTCCAAGTTGTATATTTGT |
| 1481 | Table 3A | Hs.19574 | BC006849 | 13905123 | hypothetical protein MGC5469 (MGC5469), mRNA/cds = (69, 1124) | 1 | CTGCTTCTGGGTGCATGGTAGACTTT GTGGCATTTGATACAACTTGGACA |
| 1482 | Table 3A | Hs.252716 | BC007004 | 13937807 | oxysterol-binding protein-related | 1 | CTTATAGTATTTATCCACCCAAACCC |

TABLE 8-continued

| SEQ ID | Origin | Unigene | Locus | GI | Nominal Description | Strand | Probe Sequence |
|---|---|---|---|---|---|---|---|
| | | | | | protein 1 (FLJ10217), mRNA/cds = (174, 3026) | | CAGACTGAGATACTGCTCCCAGGG |
| 1483 | Table 3A | Hs.180909 | BC007063 | 13937906 | peroxiredoxin 1 (PRDX1), mRNA/cds = (60, 659) | 1 | GAGAGACCAGCCTTTCTTCCTTTGGT AGGAATGGCCTGAGTTGGCGTTGT |
| 1484 | Table 3A | Hs.238730 | BC007203 | 13938171 | hypothetical protein MGC10823 (MGC10823), mRNA/cds = (63, 1235) | 1 | CAGAGGTGGGAGTAACTGCTGGTAG TGCCTTCTTTGGTTGTGTTGCTCAG |
| 1485 | Table 3A | Hs.334837 | BC007277 | 13938298 | hypothetical protein MGC15619 (MGC15619), mRNA/cds = (744, 1454) | 1 | CTGTGTGCCCCAGCTGCATCAGCCA GCTTCTAGGTGGCTCCATTGTTTTC |
| 1486 | Table 3A | Hs.298262 | BE250027 | 9120132 | ribosomal protein S19 (RPS19), mRNA/cds = (69, 506) | 1 | AGAGCAGAATAGCAATATAAGAGCAC AGACGAACATAGACACGACAGCGA |
| 1487 | Table 3A | Hs.297095 | BE253125 | 9123276 | 601116648F1 cDNA, 5' end /clone = IMAGE:3357178/ clone_end = 5' | 1 | CTATTAGGACCCAGTGATTATGCTAC CTTGGCACGGTTAGGGTACTGCGG |
| 1488 | Table 3A | NA | BE253338 | 9123402 | cDNA clone IMAGE:3357826 5' | 1 | AAAGAAGCATGCACACTTATCACAAA CAACTCTCTCAGGTGGCCAGTCTG |
| 1489 | Table 3A | Hs.75313 | BE254064 | 9124489 | aldo-keto reductase family 1, member B1 (aldose reductase) (AKR1B1), mRNA/cds = (45, 995) | 1 | TGCTGCCTATATGAAGTCTTTGAGAA AGCCCCTCTTGGAGTCTGTGCCTT |
| 1490 | Table 3A | Hs.314898 | BE255377 | 9125816 | 601115405F1 cDNA, 5' end /clone = IMAGE:3355872/ clone_end = 5' | 1 | GATATACGAGGACAAAACCCATCTAC CAGGCAGCTAACAAACCGCCGCCA |
| 1491 | Table 3A | Hs.296183 | BE259480 | 9129918 | 601106571F1 cDNA, 5' end /clone = IMAGE:3342929/ clone_end = 5' | 1 | GCCACTTTATTAGTAATGGTCGATAG TCCGAATCGATGGCTAGGGTGACT |
| 1492 | Table 3A | Hs.301809 | BE260041 | 9131017 | 601150579F1 cDNA, 5' end /clone = IMAGE:3503419/ clone_end = 5' | 1 | TAATCTGGCGGGTTATACCCCCGTGT TCTCCGGATTATATTTCGGGACAC |
| 1493 | Table 3A | Hs.308154 | BE264584 | 9138121 | 601192330F1 cDNA, 5' end /clone = IMAGE:3536383/ clone_end = 5' | 1 | GCTGGATTTGTGGGTATGGGGGCGG TTTTTGGGCGAAGGTTGGTTGTTAC |
| 1494 | Table 3A | Hs.279429 | BE279328 | 9154319 | 601157666F1 cDNA, 5' end /clone = IMAGE:3504328/ clone_end = 5' | 1 | CCACATCATCGGGGGCGAAATAGAA GCCCAGAGAGAGGCTAGGTGTAGGA |
| 1495 | Table 3A | Hs.95835 | BE292793 | 9175433 | RST8356 cDNA | 1 | AGGGAGACTCTCAGCCTTCAGCTTCC TAAATTCTGTGTCTGTGACTTTCG |
| 1496 | Table 3A | Hs.142737 | BE293343 | 9176482 | 601143758F1 cDNA, 5' end /clone = IMAGE:3051493/ clone_end = 5' | 1 | TTGTCAAGCTGCTGCTGTCTTCAAGA TCTACCTGGTCAGAATCTCCTGCT |
| 1497 | Table 3A | Hs.337988 | BE297329 | 9180903 | *Homo sapiens*, clone MGC:17431 IMAGE:2984883, mRNA, complete cds/cds = (1338, 1494) | 1 | GGCCAGTCTCTATGTGTCTTAATCCC TTGTCCTTCATTAAAAGCAAAACT |
| 1498 | Table 3A | Hs.192755 | BE298181 | 9181768 | 601118566F1 cDNA, 5' end /clone = IMAGE:3028193/ clone_end = 5' | 1 | TCTCTCACATTCTGTCTTTCCCCTCCT CCTTCACCTTCCCTCCGTCCCTC |
| 1499 | Table 3A | Hs.336628 | BE311727 | 9148186 | ribosomal protein L36a (RPL36A), mRNA/cds = (30, 350) | 1 | ACACGAGACTATAGAGAATGCAGCAC ACAGATGAGAGCAGAGCAAATAGA |
| 1500 | Table 3A | Hs.129872 | BE379820 | 9325198 | sperm associated antigen 9 (SPAG9), mRNA/cds = (110, 2410) | 1 | GCATCCAGATGGTGGTTTACTCTGCA ACAGTCTAATGTTCTTCACTTCCA |
| 1501 | Table 3A | Hs.231510 | BE407125 | 9343575 | 601301818F1 cDNA, 5' end /clone = IMAGE:3636412/ clone_end = 5' | 1 | GGGGTTTTCACCCTACCTAAAGATGC TTTAATTGCTGTTTTCCAAATTGT |
| 1502 | Table 3A | Hs.315263 | BE410105 | 9346555 | 601302278F1 cDNA, 5' end /clone = IMAGE:3837002/ clone_end = 5' | 1 | ATGCCTAACAAGCAACATGATCCTAT AAATCCACCCCAAGCCAATCTGGT |
| 1503 | Table 3A | Hs.258494 | BE531180 | 9759916 | *Homo sapiens*, Similar to hypothetical protein FLJ22376, clone MGC:16044 IMAGE:3610443, mRNA, complete cds/cds = (478, 1776) | 1 | CCACCATCTGGTACGTTTTTACTTCC TCACCCGCGTGTACTCCGATTACC |
| 1504 | Table 3A | Hs.13328 | BE537908 | 9766464 | 602268829F1 cDNA, 5' end /clone = IMAGE:4356968/ clone_end = 5' | 1 | GAGTATATTCCCCCAGTTATTTGCTC TTCCCCACACAGGGTGGTAGTACC |
| 1505 | Table 3A | Hs.125819 | BE538333 | 9766978 | putative dimethyladenosine transferase (HSA9761), mRNA/cds = (78, 1019) | 1 | CAAAGGAAGGGGCGTGAAGGGGTGA GAAAAATATGGGACCCAAATTGTGG |
| 1506 | Table 3A | Hs.5122 | BE539096 | 9767741 | 602293015F1 cDNA, 5' end /clone = IMAGE:4387778/ clone_end = 5' | 1 | TTTCCTTACAGGCGGTAACACCGGTC CACACAGTTCTTGCCAAAACAAAG |
| 1507 | Table 3A | Hs.180549 | BE540238 | 9768883 | 601059809F1 cDNA, 5' end /clone = IMAGE:3448283/ clone_end = 5' | 1 | AATTTTCTCTCACCTCATCACTCGGG ACCTCCCCAGTGATAATAACCCGG |
| 1508 | Table 3A | Hs.155101 | BE547584 | 9776229 | mRNA for KIAA1578 protein, | 1 | GCGGGTGTAAGGGGATATCTTGATAA |

TABLE 8-continued

| SEQ ID | Origin | Unigene | Locus | GI | Nominal Description | Strand | Probe Sequence |
|---|---|---|---|---|---|---|---|
| 1509 | Table 3A | Hs.74861 | BE549137 | 9777782 | partial cds/cds = (0, 3608) activated RNA polymerase II transcription cofactor 4 (PC4), mRNA/cds = (0, 383) | 1 | ACTGGAGCCCAGGAAGATTACAAA ACGCCGACAATCAAGAAAATGTGAGT TATAACGGACAAGGTTGTATTATG |
| 1510 | Table 3A | NA | BE569141 | 9812861 | cDNA clone IMAGE:3681180 5' | 1 | GATATTGGTAGTAAAGGGGTTACCTG TGAACTTCCAAAATTCCTTGGGGC |
| 1511 | Table 3A | NA | BE612847 | 9894444 | 601452239F1 5' end /clone = IMAGE:3856304 | 1 | TAAAGATGTCCGGGTACACTTCGCCA AGGGTTAGCGTCTTTGGGCATTTC |
| 1512 | Table 3A | Hs.194362 | BE618004 | 9888942 | DNA sequence from clone RP11-248N6 on chromosome 13 Contains ESTs, STSs and GSSs. Contains two olfactory receptor pseudogenes, an NPM1 (nucleophosmin, nucleolar phosphoprotein B23, numatrin) pseudogene and a BCR (breakpoint cluster region) pseudogene/cds = (0, 887) | 1 | TCCTAATTTCTTCTGTGAACCTTCTCA AATCCCCCAGCATGCGTGTAGTG |
| 1513 | Table 3A | Hs.294309 | BE821121 | 9892059 | 601493943F1 cDNA, 5' end /clone = IMAGE:3896051/ clone_end = 5' | 1 | CTGCATGATGTCATCAACCTGCTGTA GTGCGGAAACGACCACAACACACA |
| 1514 | Table 3A | Hs.184582 | BE730026 | 10144018 | ribosomal protein L24 (RPL24), mRNA/cds = (39, 512) | 1 | AAAGACGAACGAGACACGAAAGCAA CGAACGAACACAGAGCACGCCGCAC |
| 1515 | Table 3A | Hs.76572 | BE730376 | 10144368 | ATP synthase, H+ transporting, mitochondrial F1 complex, O subunit (oligomycin sensitivity conferring protein) (ATP5O), mRNA/cds = (38, 677) | 1 | TTTCAACACGCATCCCTTATGGGCGA ACTGTCCTCAAACAACAACAAGTG |
| 1516 | Table 3A | Hs.77496 | BE737248 | 10151226 | small nuclear ribonucleoprotein polypeptide G (SNRPG), mRNA/cds = (83, 313) | 1 | TAGGACGAGAAACGAAGAAGGACAG AGCGAGAACAAGTAAGCAGGGACAC |
| 1517 | Table 3A | Hs.271272 | BE737348 | 10151340 | DKFZp434K1715_r1 cDNA, 5' end/clone = DKFZp434K1715/ clone_end = 5' | 1 | GGTGGAGAATCAAAACGACCCCGCA AATAAACATGGCGATTTGGCTTGGG |
| 1518 | Table 3A | Hs.58066 | BE739287 | 10153279 | 602389077F1 cDNA, 5' end /clone = IMAGE:4517875/ clone_end = 5' | 1 | TGGCCTTTTAAATAACTGGGCTTCTC ACAACCATAGTGAACAGAAACAGC |
| 1519 | Table 3A | Hs.127951 | BE745645 | 10159837 | hypothetical protein FLJ14503 (FLJ14503), mRNA/cds = (19, 2217) | 1 | ATTGTGACATGGTGATGCCTCATTGC TGATATGGTCCTGTGGTTATGTGC |
| 1520 | Table 3A | Hs.276718 | BE747210 | 10161202 | 601473284T1 cDNA, 3' end /clone = IMAGE:3876165/ clone_end = 3' | 1 | GGAAGAGATAACACCACAAC GAAAGAGCAGGCAAGAGAGACCAA AGCACA |
| 1521 | Table 3A | Hs.285647 | BE747224 | 10161216 | cDNA FLJ14704 fis, clone NT2RP3000526/cds = UNKNOWN | 1 | GGTAAAAGGCGTTACTCTCCGCCCTC TTCAAGGAACGGCCAAGAGTATAA |
| 1522 | Table 3A | Hs.293842 | BE748123 | 10162115 | 601571679F1 cDNA, 5' end /clone = IMAGE:3838875/ clone_end = 5' | 1 | ACCCAAGGGTCTCGCCAGTGGGGTT AAGTCACAATATTACTACACAAGGG |
| 1523 | Table 3A | Hs.283874 | BE778549 | 10199747 | hypothetical protein MGC2495 (MGC2495), mRNA/cds = (0, 416) | 1 | ACAGTACACAATCACCTGCAAGGGAC ATAGCACACAAACCGCTAAAGAGG |
| 1524 | Table 3A | Hs.61472 | BE779284 | 10200482 | 601464557F1 cDNA, 5' end/ clone = IMAGE:3867566/clone_end = 5' | 1 | TCTCACAGCGAGAGGAGGAGACGGG ATGACCGAGAGGTAGACGATTATAC |
| 1525 | Table 3A | Hs.43273 | BE781009 | 10202207 | 602642428F1 cDNA, 5' end/ clone = IMAGE:4773534/clone_end = 5' | 1 | CGCTGGTGTTGTCCCCAAGTGATTA TTCTACTGGAGTGCCTGGTGTCTT |
| 1526 | Table 3A | Hs.102558 | BE781611 | 10202895 | 601467463F1 cDNA, 5' end/ clone = IMAGE:3870902/clone_end = 5' | 1 | TTCCGGCTTTTAACAAACACACACCA CACTAACACAACAACACAAACAAA |
| 1527 | Table 3A | Hs.40334 | BE782824 | 10204022 | 602557448F1 cDNA, 5' end/ clone = IMAGE:4686562/clone_end = 5' | 1 | AAGACTTGCCTCTTTAAAATTGCTTTG TTTTCTGCAGTACTATCTGTGGT |
| 1528 | Table 3A | Hs.79914 | BE783628 | 10204826 | lumican (LUM), mRNA/cds = (84, 1100) | 1 | GAACTCGTCCACTCTTCTCGGGCCAC TATTCTGGTTCAGGGAATCTTGGG |
| 1529 | Table 3A | Hs.135056 | BE786820 | 10208018 | DNA sequence from clone RP5-850E9 on chromosome 20. Contains part of the gene for a novel C2H2 type zinc finger protein similar to Drosophila Scratch (Scrt), Slug and Xenopus Snail, a novel gene similar to Drosophila CG6762, STSs, GSSs and five CpG islands/cds = (0, 397) | 1 | AGCAATAAACCGAAGCAGCTAGACAG CGAAGAAGTACAGCAAAGAGACGA |
| 1530 | Table 3A | Hs.11355 | BE788546 | 10209744 | thymopoietin (TMPO), mRNA/ | 1 | CGCCCATACTAGAGAAGTTTGCCCTC |

TABLE 8-continued

| SEQ ID | Origin | Unigene | Locus | GI | Nominal Description | Strand | Probe Sequence |
|---|---|---|---|---|---|---|---|
| 1531 | Table 3A | Hs.75458 | BE790474 | 10211672 | ribosomal protein L18 (RPL18), mRNA/cds = (15, 581) | 1 | TATTGTCTCTCACACCACAATGAG CACAGACATCCACGGACACAAAAGG CGGGGACCACCACCACAATGAACAC |
| 1532 | Table 3A | Hs.20225 | BE792125 | 10213323 | tuftelin-interacting protein (TIP39), mRNA/cds = (263, 2776) | 1 | GCGTCGATTGATATCAGACAGCATCG TCTCTGCGAGCACAAAGATCTGTT |
| 1533 | Table 3A | Hs.11607 | BE794595 | 10215793 | 602429913F1 cDNA, 5' end/clone = IMAGE:4547787/clone_end = 5' | 1 | GGAACAGGGTTAATGGCCAGGCCCT TTGCCGCCCCTTTTAAAGGGAATCC |
| 1534 | Table 3A | Hs.58297 | BE867841 | 10316617 | CLLL8 protein (CLLD8), mRNA/cds = (825, 2984) | 1 | ACAGAGTAACATGGGATATGGGTATG AGTGGGATGTGCTGAGAAGGAACT |
| 1535 | Table 3A | Hs.179703 | BE868349 | 10317165 | tripartite motif protein 13 (TRIM14), mRNA/cds = (10, 1230) | 1 | GGGGGCAAAGAAAGTACATTGGGTG AAAATTTAAAAAGGTATGGAGCATT |
| 1536 | Table 3A | NA | BE871962 | 10320738 | 601448005F1 cDNA, 5' end/clone = IMAGE:3852001 | 1 | CAAACGAACAGCGAAGACAA CAACTCACGATGCTGCACAACGCGA CCAAC |
| 1537 | Table 3A | Hs.31314 | BE872245 | 10321021 | retinoblastoma-binding protein 7 (RBBP7), mRNA/cds = (287, 1584) | 1 | ACATTTTATAAGGCATTTGTGTTAGCC ACTCAGTCATCTTTGGGTGCTGC |
| 1538 | Table 3A | Hs.47334 | BE872760 | 10321536 | hypothetical protein FLJ14495 (FLJ14495), mRNA/cds = (83, 1141) | 1 | GTCACAGCAACGTGTCGCTCCCCAG ATCATTTATTAGCGTCGATTGTTGT |
| 1539 | Table 3A | Hs.8820 | BE875609 | 10324385 | 602418418F1 cDNA, 5' end/clone = IMAGE:4525397/clone_end = 5' | 1 | ATTCCAAACGGGATCTGCTGAGACCT CACAGAGGTGGGCCGCGATTATAA |
| 1540 | Table 3A | Hs.158164 | BE876375 | 10325061 | transporter 1, ATP-binding cassette, sub-family B (MDR/TAP) (TAP1), mRNA/cds = (30, 2456) | 1 | CCTAGGGTGAAACACGTGACAGAAG AATAAAGACTATTGAATAGTCCTCT |
| 1541 | Table 3A | Hs.237868 | BE877115 | 10325891 | interleukin 7 receptor (IL7R), mRNA/cds = (22, 1401) | 1 | CCAGCCTTTGCCTCTTCCTTCAATGT GGTTTCCATGGGAATTTGCTTCAG |
| 1542 | Table 3A | Hs.24181 | BE877357 | 10326133 | 601485590F1 cDNA, 5' end/clone = IMAGE:3887951/clone_end = 5' | 1 | CCCCTTGTTTACTCTGTCTGTATGTAT GTCAAAAGCGTGGCAAAACCTCT |
| 1543 | Table 3A | Hs.237868 | BE878973 | 10327749 | interleukin 7 receptor (IL7R), mRNA/cds = (22, 1401) | 1 | CATGATCTCAGAGGAAACTGTCGCTG ACCCTGGACATGGGTACGTTTGAC |
| 1544 | Table 3A | NA | BE879482 | 13959823 | mitochondrion, complete genome | 1 | CCTCTACCTGCACGACAATACATAAT GACCCAACCAATCACATGCCTATCA |
| 1545 | Table 3A | NA | BE881113 | 10329889 | cDNA clone IMAGE:3894308 5' | 1 | ATTTGGAAGCGCCACCCTAGCAAATA TACAAACCATTAAACCTTCCCTCT |
| 1546 | Table 3A | Hs.323950 | BE881351 | 10330127 | zinc finger protein 6 (CMPX1) (ZNF6), mRNA/cds = (1265, 3361) | 1 | TTTACCAATGATTTTCAGGTGACCTG GGCTAAGTCATTTAAACTGGGATT |
| 1547 | Table 3A | Hs.111554 | BE882335 | 10331111 | ADP-ribosylation factor-like 7 (ARL7), mRNA/cds = (14, 592) | 1 | AGTTTACATCGACAGCATATCCAC TGATTTCTAAATGGGCTGGTCCCA |
| 1548 | Table 3A | NA | BE884898 | 10333674 | cDNA clone IMAGE:3908551 5' | 1 | ATCTGGAGTGGGACCCTTCAAACCAT GTCTGTGCTTATGCGGGAAACAAT |
| 1549 | Table 3A | Hs.142838 | BE886127 | 10340315 | nucleolar protein interacting with the FHA domain of pKi-67 (NIFK), mRNA/cds = (54, 935) | 1 | GCGGAGAGAAGAAGAGGTAGATATG AGAACAGTGTGTGGTATATGATAGT |
| 1550 | Table 3A | Hs.301488 | BE886472 | 10340792 | 601509888F1 cDNA, 5' end/clone = IMAGE:3911301/clone_end = 5' | 1 | GAAATCCCACCGGCAAGTTAAGGTCA CGGAGCAAGTGAATAAACGCGGAG |
| 1551 | Table 3A | Hs.250824 | BE887646 | 10343176 | cDNA: FLJ23435 fis, clone HRC12631/cds = UNKNOWN | 1 | GTGATCAAACAAATTCACAGCACAGA CACCGCGCAACAACGCAACTTCTC |
| 1552 | Table 3A | Hs.320836 | BE888304 | 10344472 | 60154033F1 cDNA, 5' end/clone = IMAGE:3915177/clone_end = 5' | 1 | GGTATTTGTGTTGTTGAGTATTGTGT CTGGGTGTGGGTATTTGATTCTTT |
| 1553 | Table 3A | Hs.169274 | BE888744 | 10345354 | AL528777 cDNA/clone = CS0DD001YG24-(3-prime) | 1 | GGGGTTCGTCCAGGGCTGCGCTAAAT TATTCTCAATGATTTGTCTCTTTGC |
| 1554 | Table 3A | Hs.71941 | BE889075 | 10346019 | hypothetical protein MGC15677 (MGC15677), mRNA/cds = (298, 807) | 1 | CAATGACGCAGTCGGACCCTCGGAT CCAAGTCCTGCTTTGGGTGTGGACC |
| 1555 | Table 3A | Hs.188757 | BE891242 | 10350376 | Homo sapiens, clone MGC:5564, mRNA, complete cds/cds = (227, 304) | 1 | GGGTTATAATAGATGGACGGGTCTTT CACGGTGGTGACAGCACCCTTTCC |
| 1556 | Table 3A | Hs.171802 | BE891269 | 10350433 | RST31551 cDNA | 1 | TCCGCTGCAATTTGAGTTTAGCTTTA CAGATTGTGCCGGGTGTTTAACCT |
| 1557 | Table 3A | Hs.4055 | BE891928 | 10351744 | mRNA, cDNA DKFZp564C2063 (from clone DKFZp564C2063)/cds = UNKNOWN | 1 | CTCCTTCCCAAAGACTTGAGTGGAAC TTCCCTTTCATGTGCGTATCGGTC |
| 1558 | Table 3A | Hs.3297 | BE895166 | 10358288 | ribosomal protein S27a (RPS27A), mRNA/cds = (38, 508) | 1 | AAATTAGTCGCCTTCGTCGAGAGTGC CCTTCTGATGAATGTGGTGCTGGG |
| 1559 | Table 3A | NA | BE896691 | 10361375 | cDNA clone IMAGE:3925062 5' | 1 | GACAGTACTCCTAAGACCCCTGTGTG TGTCCCGATGAGATCATGACTGGG |
| 1560 | Table 3A | NA | NC_001807 | 13959823 | COX2 gene of mitochondria | 1 | CATGCCCATCGTCCTAGAATTAATTC CCCTAAAAATCTTTGAAATAGGGC |
| 1561 | Table 3A | NA | BE899595 | 10367264 | cDNA clone IMAGE:3952215 5' | 1 | GGCGTATCATCAACTGGTGAGCCCG AAGGGATATTATTTCTAAGGCCTCT |
| 1562 | Table 3A | Hs.285122 | BE901218 | 10390179 | Homo sapiens, hypothetical protein FLJ21839, clone MGC:2851 IMAGE:2967512, mRNA, complete cds/cds = (444, 2618) | 1 | CCAGAATCGTAAGGGGGCTGACGGA GGATGAGAGGGGGCACCCAGAGATC |

TABLE 8-continued

| SEQ ID | Origin | Unigene | Locus | GI | Nominal Description | Strand | Probe Sequence |
|---|---|---|---|---|---|---|---|
| 1563 | Table 3A | Hs.293515 | BE905040 | 10397924 | 602286727T1 cDNA, 3' end/ clone = IMAGE:4375662/clone_end = 3' | 1 | CGGTGTTTTCTGATCGGTTTTTGTTTT CTGCTTACATATGATGTACTTGT |
| 1564 | Table 3A | Hs.278704 | BE973840 | 10567176 | RST30930 cDNA | 1 | ACAGAATGCAGCGGTGCAACACCGG CAAGGTTCCACACGCCACAAAGAAA |
| 1565 | Table 3A | Hs.217493 | D00017 | 219909 | annexin A2 (ANXA2), mRNA/ cds = (49, 1068) | 1 | TGGAAGTGAAGTCTATGATGTGAAAC ACTTTGCCTCCTGTGTACTGTGTC |
| 1566 | Table 3A | Hs.25 | D00022 | 219653 | Homo sapiens, Similar to ATP synthase, H+ transporting, mitochondrial F1 complex, beta polypeptide, clone MGC:19754 IMAGE:3629237, mRNA, complete cds/cds = (12, 1601) | 1 | CCAAAAAGCTTCATTTTTCTATATAGG CTGCACAAGAGCCTTGATTGAAG |
| 1567 | Table 3A | Hs.76549 | D00099 | 219941 | mRNA for Na, K-ATPase alpha-subunit, complete cds/cds = (318, 3389) | 1 | TCACAAGACAGTCATCAGAACCAGTA AATATCCGTCTGCCAGTTCGATCA |
| 1568 | Table 3A | Hs.76549 | D00099 | 219941 | mRNA for Na, K-ATPase alpha-subunit, complete cds/cds = (318, 3389) | 1 | TCACAAGACAGTCATCAGAACCAGTA AATATCCGTCTGCCAGTTCGATCA |
| 1569 | Table 3A | Hs.154890 | D10040 | 219899 | fatty-acid-Coenzyme A ligase, long-chain 2 (FACL2), mRNA/ cds = (13, 2109) | 1 | GCTGTCATTTGTACATTTAAAGCAGC TGTTTTGGGGTCTGTGAGAGTACA |
| 1570 | Table 3A | Hs.46 | D10202 | 219975 | platelet-activating factor receptor (PTAFR), mRNA/cds = (25, 1053) | 1 | TATCCTGAGTCCCTTAATCTTATGGG GCCGGAAGGAATGTCAGGGCCAGG |
| 1571 | Table 3A | Hs.155342 | D10495 | 520586 | protein kinase C, delta (PRKCD), mRNA/cds = (58, 2088) | 1 | CTCTGCCTTCGGAGGGAAATTGTAAA TCCTGTGTTTCATTACTTGAATGT |
| 1572 | Table 3A | Hs.330716 | D10522 | 219893 | cDNA FLJ14368 fis, clone HEMBA 1001122/cds = UNKNOWN | 1 | AAACTCCTGCTTAAGGTGTTCTAATTT TCTGTGAGCACACTAAAAGCGAA |
| 1573 | Table 3A | Hs.137555 | D10923 | 219866 | putative chemokine receptor, GTP-binding protein (HM74), mRNA/ cds = (60, 1223) | 1 | GGGTGCACGTTCCTCCTGGTTCCTTC GCTTGTGTTTCTGTACTTACCAAA |
| 1574 | Table 3A | Hs.301921 | D10925 | 219882 | chemokine (C—C motif) receptor 1 (CCR1), mRNA/cds = (52, 1129) | 1 | GGGGTTGGGAGGAAGTGTCTACTAG GAGGGTGGGTGAGATCTGTGTTGAT |
| 1575 | Table 3A | Hs.238893 | D11086 | 303611 | od15g01.s1 cDNA/ clone = IMAGE:1368048 | 1 | ATCTACCCTCCGATTGTTCCTGAACC GATGAGAAATAAAGTTTCTGTTGA |
| 1576 | Table 3A | Hs.61153 | D11094 | 219930 | proteasome (prosome, macropain) 26S subunit, ATPase, 2 (PSMC2), mRNA/cds = (66, 1387) | 1 | AAGTCTTATGCCAAATTCAGTGCTAC TCCTCGTTACATGACATACAACTG |
| 1577 | Table 3A | Hs.38 | D12614 | 219911 | lymphotoxin alpha (TNF superfamily, member 1) (LTA), mRNA/ cds = (140, 757) | 1 | CACACGGAGGCATCTGCACCCTCGA TGAAGCCCAATAAACCTCTTTTCTC |
| 1578 | Table 3A | Hs.333114 | D13316 | 286022 | AV713318 cDNA, 5' end/ clone = DCAAAC09/clone_end = 5' | 1 | ACAACGTCGTGACTGGGAAAACCCT GGCGTTACCCAACTTAATCGCCTTG |
| 1579 | Table 3A | Hs.15071 | D13627 | 286010 | chaperonin containing TCP1, subunit 8 (theta) (CCT8), mRNA/cds = (28, 1674) | 1 | CCAAGCCTCCAAGTGGGAAGAAAGA CTGGGATGATGACCAAAATGATTGA |
| 1580 | Table 3A | Hs.195614 | D13842 | 285998 | splicing factor 3b, subunit 3, 130 kD (SF3B3), mRNA/cds = (156, 3809) | 1 | CAACTACTTGTGGCATGCATTGGCAC TCGGAATAAAGCGCACTATTGTCA |
| 1581 | Table 3A | Hs.2471 | D13645 | 286008 | KIAA0020 gene product (KIAA0020), mRNA/cds = (418, 1944) | 1 | GAAGGGGTAGGGTCCACCATACTGG TAATTGGGGTACTCTGTATATGTGT |
| 1582 | Table 3A | Hs.278573 | D14041 | 2326266 | H-2K binding factor-2 (LOC51580), mRNA/cds = (238, 1500) | 1 | GCTCAGTTCCATATTTCATCCGTGAA AAACTTGCAATACGAGCAGTTTCA |
| 1583 | Table 3A | Hs.43910 | D14043 | 219924 | CD164 antigen, sialomucin (CD164), mRNA/cds = (79, 648) | 1 | AATTGTCATTTACCTGGGTATGAATTC CCTGACACACATTCATGTCAACA |
| 1584 | Table 3A | Hs.111894 | D14696 | 285962 | lysosomal-associated protein transmembrane 4 alpha (LAPTM4A), mRNA/cds = (148, 849) | 1 | GTGACTTGACTGTGGAAGATGATGGT TGCATGTTTCTAGTTTGTATATGT |
| 1585 | Table 3A | Hs.232068 | D15050 | 457560 | transcription factor 8 (represses interleukin 2 expression) (TCF8), cds = (66, 1358) | 1 | CAGTGCTGTAATACAGACGGCAATGC AATAGCCTATTTAAAGAACTACGT |
| 1586 | Table 3A | Hs.279607 | D16217 | 303598 | calpastatin (CAST), mRNA/ cds = (66, 1358) | 1 | AGCTGGTGGATGGTGACTTTTGAAGA ACAAAAGGCTTTGGCAACAGAAAA |
| 1587 | Table 3A | Hs.146812 | D16481 | 473711 | hydroxyacyl-Coenzyme A dehydrogenase/3-ketoacyl-Coenzyme A thiolase/enoyl-Coenzyme A hydratase (trifunctional protein), beta subunit (HADHB), mRNA/ cds = (46, 1470) | 1 | TCTGTTGTCACTAAAGACTAAATGAG GGTTTGCAGTTGGGAAAGAGGTCA |
| 1588 | Table 3A | Hs.50651 | D17042 | 598768 | Janus kinase 1 (a protein tyrosine kinase) (JAK1), mRNA/cds = (75, 3503) | 1 | GCGGAGTTGACCAAAATAATATCTGA GGATGATTGCTTTTCCCTGCTGCC |
| 1589 | Table 3A | Hs.180828 | D17391 | 440365 | collagen, type IV, alpha 4 (COL4A4), mRNA/cds = (208, 5280) | 1 | CATCTTGAACTTGGCCTGAGAACATT TTCTGGGAAGAGGTAAGGGTGACA |
| 1590 | Table 3A | Hs.176658 | D21090 | 498147 | RAD23 (S. cerevisiae) homolog B (RAD23B), mRNA/cds = (313, 1542) | 1 | TCTGTGGAATCTCCTTCATTGGCATT GTTATTAATCATAAACGGGGCAG |
| 1591 | Table 3A | Hs.75337 | D21262 | 434764 | mRNA for KIAA0035 gene, partial cds/ cds = (0, 2125) | 1 | TGTACTGTTCATGCTGACACAGATAT TTCAGTCTGCATGGTAAAAGTTCT |
| 1592 | Table 3A | Hs.79768 | D21853 | 434770 | KIAA0111 gene product (KIAA0111), | 1 | TAATGGGGTTTATATGGACTTTCTTCT |

TABLE 8-continued

| SEQ ID | Origin | Unigene | Locus | GI | Nominal Description | Strand | Probe Sequence |
|---|---|---|---|---|---|---|---|
| 1593 | Table 3A | Hs.334822 | D23660 | 432358 | Homo sapiens, Similar to ribosomal protein L4, clone MGC:2966 IMAGE:3139805, mRNA, complete cds/cds = (1816, 2617) | 1 | CATAAATGGCCTGCCGTCTCCCT ACCAAGAAACCAGCCCCTGAAAA GAAGCCTGCAGAGAAGAAACCTA CTAC |
| 1594 | Table 3A | Hs.75512 | D23662 | 432362 | neural precursor cell expressed, developmentally down-regulated 8 (NEDD8), mRNA/cds = (99, 344) | 1 | AGTCCTGTGTGCTTCCCTCTCTTATG ACTGTGTCCCTGGTTGTCAATAAA |
| 1595 | Table 3A | Hs.35804 | D25215 | 517114 | hect domain and RLD 3 (HERC3), mRNA/cds = (166, 3318) | 1 | ACCCACCACCTCTTGCACTCTCGCTT TTGGAGCAAGTTGCATTAACTATT |
| 1596 | Table 3A | Hs.173737 | D25274 | 464185 | ras-related C3 botulinum toxin substrate 1 (rho family, small GTP binding protein Rac1) (RAC1), transcript variant Rac1b, mRNA/cds = (0, 635) | 1 | TGACAGTTGCAGAATTGTGGAGTGTT TTTACATTGATCTTTTGCTAATGC |
| 1597 | Table 3A | Hs.172199 | D25538 | 436217 | adenylate cyclase 7 (ADCY7), mRNA/cds = (265, 3507) | 1 | ATGACAGACACACGTATCTAACAAAC AAACAAACAGTGACCTTCTCCATG |
| 1598 | Table 3A | Hs.82502 | D26018 | 436221 | mRNA for KIAA0039 gene, partial cds/cds = (0, 1475) | 1 | GCAAGGGATAATACAAATCCTATGAT CTCTATGCCCAATATGCTGCCTCA |
| 1599 | Table 3A | Hs.169303 | D26121 | 785998 | mRNA for ZFM1 protein alternatively spliced product, complete cds/cds = (382, 624) | 1 | AGTACTTTTCACAGCGTGGCCTTTCA CCATAATTTTATATTTCTCCCCCT |
| 1600 | Table 3A | Hs.90315 | D26488 | 452522 | mRNA for KIAA0007 gene, partical cds/cds = (0, 2062) | 1 | TCTTAAGAGCCAGAGCCATATAAGCA TCTTGGGAAAGCAAGTTTGAACCA |
| 1601 | Table 3A | Hs.17719 | D28589 | 460714 | EBP50-PDZ interactor of 64 kD (EPI64), mRNA/cds = (24, 1550) | 1 | AAGCCGTGCTCATGAGATTATATGTGGT AAAGTTAATTGACTAACAACCCCA |
| 1602 | Table 3A | Hs.196246 | D29605 | 474986 | UDP-Gat.betaGlcNAc beta 1,4-galactosyltransferase, polypeptide 1 (B4GALT1), mRNA/cds = (72, 1268) | 1 | AGGGGGCTGTGTCTGATCTTGGTGTT CAAAACAGAACTGTATTTTTGCCT |
| 1603 | Table 3A | Hs.79709 | D30036 | 1060902 | phosphotidylinositol transfer protein (PITPN), mRNA/cds = (216, 1028) | 1 | GTTCATAGCTTCCTGCAACTTGACAG AGCCTGAGTTTGCCTCTTAGTGGG |
| 1604 | Table 3A | Hs.115263 | D30783 | 2381480 | epiregulin (EREG), mRNA/cds = (166, 675) | 1 | CATATGGGAGAAGGGGGAGTAATGA CTTGTACAAACAGTATTTCTGGTGT |
| 1605 | Table 3A | Hs.75416 | D31767 | 505091 | DAZ associated protein 2 (DAZAP2), mRNA/cds = (69, 575) | 1 | ACATGTGATGTTTGACTGTACCATTG ACTGTTATGGAAGTTCAGCGTTGT |
| 1606 | Table 3A | Hs.3094 | D31884 | 505095 | KIAA0063 gene product (KIAA0063), mRNA/cds = (279, 867) | 1 | TCTTGCCTTTTATTCCTTTTTGTTGTTG GCCTTGTGCTGCGTTTGTTTACA |
| 1607 | Table 3A | Hs.75249 | D31885 | 505097 | mRNA for KIAA0069 gene, partial cds = (0, 680) | 1 | AGTGTTTGTTTTCTCCTCTTTAATATTG CTGTGAACAGTGGTGCCCATTGT |
| 1608 | Table 3A | Hs.3100 | D32053 | 2366751 | lysyl-tRNA synthetase (KARS), mRNA/cds = (40, 1833) | 1 | AATTCTTGTGTGCTGCTTTCCATTTGA CACCGCAGTTCTGTTCAGCCATC |
| 1609 | Table 3A | Hs.181244 | D32129 | 699597 | major histocompatibility complex, class I, A (HLA-A), mRNA/cds = (0, 1097) | 1 | GAGGTGTCTCCATCTCTGCCTCAACT TCATGGTGCACTGAGCTGTAACTT |
| 1610 | Table 3A | Hs.89887 | D38081 | 533325 | thromboxane A2 receptor (TBXA2R), mRNA/cds = (991, 2022) | 1 | TGAACCTCCAACAGGGAAGGCTCTGT CCAGAAAGGATTGAATGTGAAACG |
| 1611 | Table 3A | Hs.138593 | D38524 | 633070 | 5'-nucleotidase (purine), cytosolic type B (NT5B), mRNA/cds = (83, 1768) | 1 | TATTTTCTTCCATTCTTGTCATTGGTC AATAGGGGAGGGTAGATTAGCTG |
| 1612 | Table 3A | Hs.77257 | D38549 | 559702 | Homo sapiens. Similar to selective hybridizing clone, clone MGC:13167 IMAGE:3163591, mRNA, complete cds = (52, 3813) | 1 | TCCCCTGCTTCCACTAAATCCAGTTG TGACAAAATCTAACGTGACATCAG |
| 1613 | Table 3A | Hs.81848 | D38551 | 1531549 | RAD21 (S. pombe) homolog (RAD21), mRNA/cds = (184, 2079) | 1 | ACCTGGTCAACTTAGCTTTTAAGCAG ACGATGCTGTAAAAACTAACGGCT |
| 1614 | Table 3A | Hs.81964 | D38555 | 559716 | SEC24 (S. cerevisiae) related gene family, member C (SEC24C), mRNA/cds = (114, 3491) | 1 | ACCTGGGATGCCCCTGCTCTGGACC TCTCATTTCTCTTCATTGGTTTATT |
| 1615 | Table 3A | Hs.78871 | D42039 | 577290 | mRNA for KIAA0081 gene, partial cds/cds = (0, 702) | 1 | ATCTATCCTTGCCAGCCTTGGGCATC ACATTTACCAGTTAATAGATTGT |
| 1616 | Table 3A | Hs.75243 | D42040 | 577292 | bromodomain-containing 2 (BRD2), mRNA/cds = (1701, 4106) | 1 | GCCCTGATCTGGAGTTACCTGAGGC CATAGCTGCCCTATTCACTTCTAAG |
| 1617 | Table 3A | Hs.79123 | D42043 | 577298 | mRNA for KIAA0084 gene, partial cds/cds = (0, 1946) | 1 | CTTGACCAAACCCACAGCCTGTCTCT TCTCTTGTTTAGTTACTTACGGCA |
| 1618 | literature | Hs.1560 | D42045 | 577302 | mRNA for KIAA0086 gene, complete cds/cds = (918, 4040) | 1 | CCTTAGAAGAGGAAGCAAAGGCAGA TTCAGGGACCAAAAGGATTAATGAT |
| 1619 | Table 3A | Hs.151791 | D42054 | 577310 | KIAA0092 gene product (KIAA0092), mRNA/cds = (53, 1477) | 1 | ATGTGTCAACCACCATTTCAGCTATT AAAAACTCCTGTTATCTCCTTGTT |
| 1620 | Table 3A | Hs.129914 | D43968 | 966996 | AML1 mRNA for AML1b protein (alternatively spliced product), complete cds/cds = (1576, 2939) | 1 | AGCCACCAGAGCCTTCCTCTCTTTGT ACCACAGTTTCTTCTGTAAATCCA |
| 1621 | Table 3A | Hs.163706 | D44640 | 1572115 | HUMSUPY040 cDNA/clone = 035-00-1 | 1 | ACATGAAATATAGTTGCATATATGGA CACCGACTTGGGAGGACAGGTCCT |
| 1622 | Table 3A | Hs.1119 | D49728 | 1813881 | nuclear receptor subfamily 4, group A, member 1 (NR4A1), mRNA/cds = (110, 1906) | 1 | CTTTCCAGCCTCCTGCTGGGCTCTCT CTTCCTACCCTCCTTCCACATGTA |
| 1623 | Table 3A | Hs.83077 | D49950 | 1405316 | Interleukin 1B (interferon-gamma-inducing factor) (IL18), mRNA/ | 1 | AGATAGCCAGCCTAGAGGTATGGCT GTAACTATCTCTGTGAAGTGTGAGA |

TABLE 8-continued

| SEQ ID | Origin | Unigene | Locus | GI | Nominal Description | Strand | Probe Sequence |
|---|---|---|---|---|---|---|---|
| 1624 | Table 3A | Hs.155543 | D50063 | 971269 | proteasome (prosome, macropain) 26S subunit, non-ATPase, 7 (Mov34 homolog) (PSMD7), mRNA/ cds = (177, 758) | 1 | TGGCATCCTCAGGGGTTGTGATCCA GCTCCATATATTGTTTACCTTCAAA |
| 1625 | Table 3A | Hs.182255 | D50420 | 2618577 | non-histone chromosome protein 2 (S. cerevisiae)-like 1 (NHP2L1), mRNA/ cds = (83, 1057) | 1 | CATGAGGAGAGTGCTAGTTCATGTGT TCTCCATTCTTGTGAGCATCCTAA |
| 1626 | Table 3A | Hs.699 | D50525 | 1167502 | peptidylprolyl isomerase B (cyclophilin B) (PPIB), mRNA/cds = (94, 480) | 1 | CAGCAAATCCATCTGAACTGTGGAGG AGAAGCTCTCTTTACTGAGGGTGC |
| 1627 | Table 3A | Hs.82028 | D50683 | 1827474 | mRNA for TGF-betaIIR alpha, complete cds/cds = (21, 671) | 1 | TCAGCATAAACTGGAATGTAGTGTCA GAGGATACTGTGGCTTGTTTTGTT, |
| 1628 | Table 3A | Hs.90998 | D50918 | 1469178 | mRNA for KIAA0128 gene, partial cds/ cds = (1572, 3275) | 1 | TGGTGAAACAAAACCAGTCATTAGAA ATGGTCTGTGCTTTTATTTTCCCA |
| 1629 | Table 3A | Hs.70359 | D50926 | 1469194 | genomic DNA, chromosome 21q22.2, PCR fragment from BAC clone:KB739C11, CBR1-HLCS region/ cds = (0, 2854) | 1 | ACTATGCTTTATTGGTCCCATGTTTTG TGCAATTTTAAAGAGATGGCTTT |
| 1630 | Table 3A | Hs.198899 | D50929 | 1469200 | eukaryotic translation initiation factor 3, subunit 10 (theta, 150/170 kD) (EIF3S10), mRNA/cds = (113, 4261) | 1 | AAAGATGAACTATTTGGTCTCATTGA AGCCAACACAGAACTTGCTGCTGT |
| 1631 | Table 3A | Hs.77152 | D55716 | 1255616 | minichromosome maintenance deficient (S. cerevisiae) 7 (MCM7), mRNA/cds = (544, 2175) | 1 | GGAGCCCCTCTTTCTCCCATGCTGCA CTTACTCCTTTTGCTAATAAAAGT |
| 1632 | Table 3A | Hs.181418 | D63486 | 1469885 | KIAA0152 gene product (KIAA0152), mRNA/cds = (128, 1006) | 1 | CCTTCCATGTCCCACCCCACTCCCAC CAAAAAGTACAAAATCAGGATGTT |
| 1633 | Table 3A | Hs.3195 | D63789 | 1754608 | small inducible cytokine subfamily C, member 1 (lymphotactin) (SCYC1), mRNA/cds = (20, 364) | 1 | TGATGGTAACCATAATGGAAGAGATT CTGGCTAGTGTCTATCAGAGGTGA |
| 1634 | Table 3A | Hs.274472 | D63874 | 968887 | high-mobility group (nonhistone chromosomal) protein 1 (HMG1), mRNA/cds = (52, 699) | 1 | GTCCTGGTGGTATCTTCAATAGCCAC TAACCCTGCCTGGTACAGTATGGG |
| 1635 | Table 3A | Hs.87726 | D63876 | 961443 | ADP-ribosylation factor-binding protein GGA3 (GGA3), mRNA/cds = (8, 2080) | 1 | CCCAGCTCTGCTGCCCTTGTTTTGCT GCATGTTAAATAAAACCATTTTCA |
| 1636 | Table 3A | Hs.155595 | D63878 | 961447 | neural precursor cell expressed, developmentally down-regulated 5 (NEDD5), mRNA/cds = (258, 1343) | 1 | CCCACACTGCTACACTTCTGATCCCC TTTGGTTTTACTACCCAAATCTAA |
| 1637 | Table 3A | Hs.182741 | D64015 | 2281005 | TIA1 cytotoxic granule-associated RNA-binding protein-like 1 (TIAL1), transcript variant 2, mRNA/ cds = (157, 954) | 1 | CTGTAATACCTCCTCCTAACCAAGCC GGATATGGTATGGCAAGTTACCAA |
| 1638 | Table 3A | Hs.75232 | D67029 | 1669538 | SEC14 (S. cerevisiae)-like 1 (SEC14L1), mRNA/cds = (303, 2450) | 1 | CCCTTGTAAGGGAATTCTGGGGCAG CTATGGTTTGAGTATGCAGTTTGCA |
| 1639 | Table 3A | Hs.155968 | D76444 | 1945614 | zinc finger protein homologous to Zfp103 in mouse (ZFP103), mRNA/ cds = (922, 2979) | 1 | ACCATCTCTGTCCAGCACCTCTTGGT TAAATAATGTATGCTGTGAGACAT |
| 1640 | Table 3A | Hs.80905 | D79990 | 1136395 | Ras association (RalGDS/AF-6) domain family 2 (RASSF2), mRNA/ cds = (196, 1176) | 1 | ACAGGGCCTCAGCAAGGGAGCCATA CATTTTTGTAACATTTTGATATGTT |
| 1641 | Table 3A | Hs.76666 | D80005 | 1136425 | mRNA for KIAA0183 gene, partial cds/ cds = (0, 3190) | 1 | TTGACTGTCGATGGATTGTGGTGTGG TGTATCTGAAGGCTATTGAATGCA |
| 1642 | Table 3A | Hs.322903 | D80006 | 1136427 | mRNA for KIAA0184 gene, partial cds/ cds = (0, 2591) | 1 | TTCTGTTCCAAACAAGTATTCTGTAGA TCCAAATGGATTACCAGTGTGCT |
| 1643 | Table 3A | Hs.79389 | D83018 | 1827484 | nel (chicken)-like 2 (NELL2), mRNA/ cds = (96, 2546) | 1 | ATCTTCAGAATCAGTTAGGTTCCTCA CTGCAAGAAATAAAATGTCAGGCA |
| 1644 | Table 3A | Hs.89385 | D83243 | 1304113 | nuclear protein, ataxia-telangiectasia locus (NPAT), mRNA/cds = (34, 4317) | 1 | TGAACCTTACTGCAAAAACTTGTGAT GTAAGAAATTTGTATGGTGTGGCA |
| 1645 | Table 3A | Hs.12413 | D83776 | 1228034 | mRNA for KIAA0191 gene, particl cds/ cds = (0, 4552) | 1 | GCTGTCTCAAGGGTATCCGTACCTCA ATGTCAGTTACATTCAGCAGAAAA |
| 1646 | Table 3A | Hs.22559 | D83781 | 1228044 | mRNA for KIAA0197 gene, partial cds/ cds = (0, 3945) | 1 | TTGGTCAGATTTAGAAGCATTCATGC TCACAAGTTTTGGGAAAGTGAAAA |
| 1647 | Table 3A | Hs.343517 | D84224 | 7804467 | methionine-tRNA synthetase (MARS), mRNA/cds = (23, 2725) | 1 | CCCTAAAGGCAAGAAGAAAAAG-TAAA AGACCTTGGCTCATAGAAAGTCAC |
| 1648 | Table 3A | Hs.21899 | D84454 | 1526437 | protein translocase, JM26 protein, UDP-galactose translocator, pim-2 protononcogene homolog pim-2h, and shal-type potassium channel genes, complete cds; JM12 protein and transcription factor IGHM enhancer 3 genes, partial cds; and unknown gene/ cds = (323, 1504) | 1 | GTGTGTGCATGGAAGATGCCTGGGC TGTCTTTGCTATATGTAAATAGAGC |
| 1649 | Table 3A | Hs.300391 | D85429 | 1816451 | Ul-H-Bl4-aoq-d-01-0-Ul.s1 cDNA, 3' end/clone = IMAGE:3085848/ clone_end = 3' | 1 | GCCTTGGCTTTATTTGCAGGCTACTA AAGCTGCTTTTACTTTGTAACTTT |
| 1650 | Table 3A | Hs.75842 | D86550 | 1772437 | mRNA for serine/threonine protein | 1 | ACAGTTTGGTTACAGGACTTCTGTGC |

TABLE 8-continued

| SEQ ID | Origin | Unigene | Locus | GI | Nominal Description | Strand | Probe Sequence |
|---|---|---|---|---|---|---|---|
| 1651 | Table 3A | Hs.36927 | D86956 | 1503985 | kinase, complete cds/cds = (1473, 3737) heat shock 105 kD (HSP105B), mRNA/ cds = (313, 2757) | 1 | ATTGTAAACATAAACAGCATGGAA TGTGAAAGTGTGGAATGGAAGAAATG TCGATCCTGTTGTAACTGATTGTG |
| 1652 | Table 3A | Hs.17211 | D86964 | 1504001 | mRNA for KIAA0209 gene, partial cds/ cds = (0, 5530) | 1 | ACAACCAACCAGTTTCTTTTCTAGCC AATCATCTCTGAAGAGTTGCTGTT |
| 1653 | Table 3A | Hs.154332 | D86967 | 1504007 | KIAA0212 gene product (KIAA0212), mRNA/cds = (58, 2031) | 1 | GAACTCCCTGATTCTATACCCTCTTC CTTCTTTCTGCAAGGCAGAGGAAT |
| 1654 | Table 3A | Hs.110613 | D86974 | 1504021 | PI-3-kinase-related kinase SMG-1 (SMG1), mRNA/cds = (132, 9227) | 1 | CACCCTCAGCTCCACCCTCAGCAGAT GATAATATCAAGACACCTGCCGAG |
| 1655 | Table 3A | Hs.199243 | D86984 | 1504041 | mRNA for KIAA0231 gene, partial cds/ cds = (0, 1430) | 1 | TTGGCCCTCAGGTTTACTGTGTAAAT CTGCATTTTTGGTGGTAAATCCCT |
| 1656 | Table 3A | Hs.79276 | D86985 | 6634002 | mRNA for KIAA0232 protein, partial cds/cds = (0, 3836) | 1 | GCATTTCCATAGCACTGAAGTACCAG TTTCCATTCCTGGGCTGAGATTGT |
| 1657 | Table 3A | Hs.10315 | D87432 | 1565758 | solute carrier family 8 (cationic amino acid transporter, y+ system), member 6 (SLC7A6), mRNA/cds = (261, 1808) | 1 | CTCCTTTTAAFCGTGTTATTGACA AACCTCCCCAAAAGAATATGCAA TTGT |
| 1658 | Table 3A | Hs.75912 | D87446 | 1665780 | mRNA for KIAA0257 gene, partial cds/ cds = (0, 5418) | 1 | AACATTCAGTTGAGACCATATGCATT TTCTGTGCTGTTTGTACTTGAGGT |
| 1659 | Table 3A | Hs.154978 | D87450 | 1665788 | mRNA for KIAA0261 gene, partial cds/ cds = (0, 3865) | 1 | TTAACCCTCAGAGAACTCTGCATTTT AGGGTACTTGAGGCTGACTTAACT |
| 1660 | Table 3A | Hs.192968 | D87454 | 1665796 | mRNA for KIAA0265 gene, partial cds/ cds = (0, 1205) | 1 | AGCGACCTCTTCTCTAGTCCGGTGTT ACGAACAGAAGTTCTGAGTTGTGC |
| 1661 | Table 3A | Hs.40888 | D87468 | 1944419 | mRNA for KIAA0278 gene, partial cds/ cds = (0, 1383) | 1 | TAAATGTCGGTCCAGGCCCTGTGCAC CTTACCCCAGAGACAGACTCTTTT |
| 1662 | Table 3A | Hs.77495 | D87684 | 1663703 | mRNA for KIAA0242 protein, partial cds/cds = (0, 1590) | 1 | ATAAGGCTGTAAAATGAGAATTCTGC CCCCTCACCTCTTACCCCAGTACT |
| 1663 | Table 3A | Hs.75789 | D87953 | 1596166 | N-myc downstream regulated (NDRG1), mRNA/cds = (110, 1294) | 1 | AAAAGTCGGGGATCGGGGCAAGAGA GGCTGAGTACGGATGGGAAACTATT |
| 1664 | Table 3A | Hs.75367 | D89077 | 1694681 | Src-like-adapter (SLA), mRNA/ cds = (41, 871) | 1 | GAGCACCCAGAGGGATTTTTCAGTG GGAAGCATTACACTTTGCTAAATCA |
| 1665 | Table 3A | Hs.170311 | D89678 | 3218539 | heterogeneous nuclear ribonucleoprotein D-like (HNRPDL), transcript variant 1, mRNA/ cds = (580, 1842) | 1 | TGATTAGGTGACGAGTTGACATTGAG ATTGTCCTTTTCCCCTGATCAAAA |
| 1666 | Table 3A | Hs.121102 | D89974 | 5541649 | vanin 2 (VNN2), mRNA/ cds = (11, 1573) | 1 | TGTATGTATGGGAGTGAGGAGTTTCA GGGCCATTGCAAACATAGCTGTGC |
| 1667 | Table 3A | Hs.73817 | D90144 | 219905 | gene for LD78 alpha precursor, complete cds | 1 | ACAGAGTTATCCACTTTACAACGGAG ACACAGTTCTGGAACATTGAAACT |
| 1668 | Table 3A | Hs.218387 | H03298 | 866231 | tc88c11.x1 cDNA, 3' end/ clone = IMAGE:2073236/clone_end = 3' | 1 | ATACGGGACAATAAAATCTGCCTTTT GCTCTGGAGGGAGATACTACCTCT |
| 1669 | Table 3A | Hs.70258 | H06786 | 870318 | yl83g05.r1 cDNA, 5' end/ clone = IMAGE:44737/clone_end = 5' | 1 | GGGCAAACAACTTTAGGAATACTAGT TACTCACTTAACATGGAGGGCGGG |
| 1670 | Table 3A | Hs.32149 | H14103 | 878951 | ym62a02.r1 cDNA, 5' end/ clone = IMAGE:163466/clone_end = 5' | 1 | AAAGGCCGCGCAGATTGTTTAATTCT GGAAAGTCAATCCCCGGATTTAGC |
| 1671 | Table 3A | Hs.94881 | H51796 | 991637 | 602387588F1 cDNA, 5' end clone = IMAGE:4516388/clone_end = 5' | 1 | GGGACTCCATGGGAATATTTGCCCAG TAATGGTAAGGAAATCTTTCGGGT |
| 1672 | Table 3A | Hs.178703 | H56344 | 1004988 | AV716627 cDNA, 5' end/ clone = DCBBCH05/clone_end = 5' | 1 | CCAGAAAGGTGATGAATGAATAGGAC TGAGAGTCACAGTGAATGTGGCAT |
| 1673 | Table 3A | Hs.270192 | H57221 | 1010503 | ESTs | 1 | TCCCAAGGTTGTTAGTGACTGATAAG CTTCCAAACTACAGTACAGTTTTT |
| 1674 | Table 3A | Hs.237146 | H88841 | 1068420 | mRNA for zinc finger protein RINZF (RINZF gene)/cds = (598, 3141) | 1 | GTTTTCTTGTAGTTGCGGGTCCCTCG CGAAAGTTCATTCATGGCCCCACT |
| 1675 | Table 3A | Hs.76807 | J00194 | 188231 | major histocompatibility complex, class II, DR alpha (HLA-DRA), mRNA/cds = (26, 790) | 1 | CATGGGGCTCTCTTGTGTACTTATTG TTTAAGGTTTCCTCAAACTGTGAT |
| 1676 | Table 3A | Hs.251064 | J02621 | 184229 | high-mobility group (nonhistone chromosomal) protein 14 (HMG14), mRNA/cds = (150, 452) | 1 | ACAAATTGAAATGTCTGTACTGATCC TCAACCAATAAAATCTCAGCCGAA |
| 1677 | Table 3A | Hs.62192 | J02931 | 339501 | coagulation factor III (thromboplastin, tissue factor) (F3), mRNA/ cds = (123, 1010) | 1 | TGCAGGAGACATTGGTATTCTGGGCA GCTTCCTAATATGCTTTACAATCT |
| 1678 | Table 3A | Hs.1513 | J03171 | 184645 | interferon (alpha, beta and omega) receptor 1 (IFNAR1), mRNA/ cds = (78, 1751) | 1 | TCATCCCGAGAACATTGGCTTCCACA TCACAGTATCTACCCTTACATGGT |
| 1679 | Table 3A | Hs.317 | J03250 | 339805 | topoisomerase (DNA) 1 (TOP1), mRNA/cds = (247, 2544) | 1 | GGCATTGTTAGTTTAGTGTGTGTGCA GAGTCCATTTCCCACATCTTTCCT |
| 1680 | Table 3A | Hs.81118 | J03459 | 187172 | leukotriene A4 hydrolase (LTA4H), mRNA/cds = (68, 1903) | 1 | GACTGCAATGCTGGTGGGAAAGAC TTAAAAGTGGATTAAAGACCTGCGT |
| 1681 | Table 3A | Hs.177766 | J03473 | 337423 | ADP-ribosyltransferase (NAD+; poly (ADP-ribose) polymerase) (ADPRT), mRNA/cds = (159, 3203) | 1 | GCTTTCCTTCTCCAGGAATACTGAAC ATGGGAGCTCTTGAAATATGTAGT |
| 1682 | Table 3A | Hs.73792 | J03565 | 181919 | complement component (3d/Epstein Barr virus) receptor 2 (CR2), mRNA/ cds = (69, 3170) | 1 | TGGGAATCAAGATTTAATCCTAGAGA TTTGGTGTACAATTCAGGCTTTGG |

TABLE 8-continued

| SEQ ID | Origin | Unigene | Locus | GI | Nominal Description | Strand | Probe Sequence |
|---|---|---|---|---|---|---|---|
| 1683 | Table 3A | Hs.727 | J03634 | 181946 | inhibin. beta A (activin A, activin AB alpha polypeptide) (INHBA), mRNA/cds = (85, 1365) | 1 | GCAGTAGTGTGGACTAGAACAACCCA AATAGCATCTAGAAAGCCATGAGT |
| 1684 | Table 3A | Hs.86948 | J03798 | 338264 | small nuclear ribonucleoprotein D1 polypeptide (16 kD) (SNRPD1), mRNA/cds = (150, 509) | 1 | TGTGTAATGTACCTGTCAGTGCCTCC TTTATTAAGGGGTTCTTTGAGAAT |
| 1685 | Table 3A | Hs.75703 | J04130 | 178017 | small inducible cytokine A4 (homologous to mouse Mip-1b) (SCYA4), mRNA/cds = (108, 386) | 1 | CCACTGTCACTGTTTCTCTGCTGTTG CAAATACATGGATAACACATTTGA |
| 1686 | Table 3A | Hs.1799 | J04142 | 619799 | CD1D antigen, d polypeptide (CD1D), mRNA/cds = (164, 1171) | 1 | AGTTTGCCCTGGATGTCATATTGGCA GTTGGAGGACACAGTTTCTATTGT |
| 1687 | Table 3A | Hs.298469 | J04144 | 178285 | dipeptidyl carboxypeptidase 1 (angiotensin 1 converting enzyme) (ACE), mRNA/cds = (22, 3942) | 1 | CCAAGTTCCACATTCCTTCTAGCGTG CCTTACATCAGGTACTTTGTCAGC |
| 1688 | Table 3A | Hs.176663 | J04162 | 183036 | leukocyte IgG receptor (Fc-gamma-R) mRNA, complete cds/cds = (17, 718) | 1 | AGCTGTCTCCTGTTTTGTAAGCTTTC AGTGCAACATTTCTTGGTTCCAAT |
| 1689 | Table 3A | Hs.82954 | J04755 | 182512 | ferritin, heavy polypeptide 1 (FTH1), mRNA/cds = (91, 663) | 1 | TGCATGTTGGGGTTTCCTTTACCTTTT CTATAAGTTGTACCAAAACATCC |
| 1690 | Table 3A | Hs.288156 | J05016 | 181507 | cDNA: FLJ21819 fis, clone HEP01185/cds = UNKNOWN | 1 | GGGTTTGTGCTATACACTGGGATGTC TAATTGCAGCAATAAAGCCTTTCT |
| 1691 | Table 3A | Hs.80758 | J05032 | 179101 | aspartyl-tRNA synthetase (DARS), mRNA/cds = (93, 1595) | 1 | GCCACACTTATTCTTTTCAGTAACCT GCTAGTGCACAGGCTGTACTTTAG |
| 1692 | Table 3A | Hs.850 | J05272 | 186393 | IMP (inosine monophosphate) dehydrogenase 1 (IMPDH1), mRNA/cds = (600, 2144) | 1 | CAGTCGAAGGCTTTAACTTTGCACAC TTGGGATCACAGTTGCGTCATTGT |
| 1693 | Table 3A | Hs.84298 | K01144 | 188469 | CD74 antigen (invariant polypeptide of major histocompatibility complex, class II antigen-associated) (CD74), mRNA/cds = (7, 705) | 1 | TTCCCTTTCCCCAGCATCACTCCCCA AGGAAGAGCCAATGTTTTCCACCC |
| 1694 | Table 3A | Hs.79070 | K02276 | 188927 | v-myc avian myelocytomatosis viral oncogene homolog (MYC), mRNA/cds = (558, 1877) | 1 | AGCCATAATGTAAACTGCCTCAAATT GGACTTTGGGCATAAAAGAACTTT |
| 1695 | Table 3A | Hs.1290 | K02766 | 179725 | complement component 9 (C9), mRNA/cds = (4, 1683) | 1 | TTGCTTTTACTAGTCTTAGCTCTACGA TTTAAATCCATGTGTCCAAGGGG |
| 1696 | Table 3A | Hs.303157 | K02885 | 338928 | mRNA for T-cell specific protein/cds = (37, 975) | 1 | CACACCTGCACACTCACGGCTGAAAT CTCCCTAACCCAGGGGGACCTTAG |
| 1697 | Table 3A | Hs.21595 | L03428 | 340386 | DNA segment on chromosome X and Y (unique) 155 expressed sequence (DXYS155E), mRNA/cds = (168, 1323) | 1 | AGCTGTAACGTTCGCGTTAGGAAAGA TGGTGTTTATTCCAGTTTGCATTT |
| 1698 | Table 3A | Hs.199160 | L04731 | 339921 | translocation T(4:11) of ALL-1 gene to chromosome 4/cds = UNKNOWN | 1 | AGGGGTTCCACTAGTGTCTGCTTTCC TTTATTATTGCACTGTGTGAGGTT |
| 1699 | Table 3A | Hs.234569 | L05148 | 340038 | protein tyrosine kinase related mRNA/sequence/cds = UNKNOWN | 1 | CATCCTCAGGTGGTCAGGCGTAGAT CACCAGAATAAACCCAGCTTCCCTC |
| 1700 | Table 3A | Hs.75528 | L05425 | 179284 | nucleolar GTPase (HUMAUANTIG), mRNA/cds = (79, 2274) | 1 | ACACACAACGTGAAAAATAGGAA CAGGAACAAAAAGAAGACCAATG ACTC |
| 1701 | Table 3A | Hs.284192 | L06132 | 340198 | clone HQ0072/cds = UNKNOWN | 1 | TTTAGAGTCTTCCATTTTGTTGGAATT AGATCCTCCCCTTCAAATGCTGT |
| 1702 | Table 3A | Hs.1845 | L06175 | 189448 | MHC class I region ORF (P5-1), mRNA/cds = (304, 735) | 1 | CTAATTTCAGTGCTTGTGCTTGGTTG TTCAGGGCCATTTCAGGTTTGGGT |
| 1703 | Table 3A | Hs.75348 | L07833 | 186512 | proteasome (prosome, macropain) activator subunit 1 (PA28 alpha) (PSME1), mRNA/cds = (92, 841) | 1 | CCAGATTTTCCCCAAACTTGCTTCTG TTGAGATTTTTCCCTCACCTTGCC |
| 1704 | Table 3A | Hs.324278 | L08048 | 184250 | mRNA; cDNA DKFZp566M063 (from clone DKFZp566M063)/cds = UNKNOWN | 1 | TGGGGGTTGTAAATTGGCATGGAAAT TTAAAGCAGGTTCTTGTTGGTGCA |
| 1705 | Table 3A | Hs.94 | L08069 | 306713 | heat shock protein, DNAJ-like 2 (HSJ2), mRNA/cds = (82, 1275) | 1 | AGGTGGTGTTCAGTGTCAGACCTCTT AATGGCCAGTGAATAACACTCACT |
| 1706 | Table 3A | Hs.99899 | L08096 | 307127 | tumor necrosis factor (ligand) superfamily, member 7 (TNSF7), mRNA/cds = (137, 718) | 1 | GGGGGTAGTTTGTGGCAGGACAAGA GAAGGCATTGAGCTTTTCTTTCAT |
| 1707 | Table 3A | Hs.1652 | L08176 | 183484 | chemokine (C—C motif) receptor 7 (CCR7), mRNA/cds = (66, 1202) | 1 | TCGTTAAGAGAGCAACATTTTACCCA CACACAGATAAAGTTTTCCCTTGA |
| 1708 | Table 3A | Hs.211576 | L10717 | 307507 | IL2-inducible T-cell kinase (ITK), mRNA/cds = (2021, 3883) | 1 | CCCTATCCCGCAAAATGGGCTTCCTG CCTGGGTTTTTCTCTTCTCACATT |
| 1709 | Table 3A | Hs.3069 | L11066 | 307322 | heat shock 70 kD protein 9B (mortalin-2) (HSPA9B), mRNA/cds = (29, 2068) | 1 | AAACAAGGTAGGAATGAGGCTAGAC CTTTAACTTCCCTAAGGCATACTTT |
| 1710 | Table 3A | Hs.3446 | L11284 | 307183 | mitogen-activated protein kinase kinase 1 (MAP2K1), mRNA/cds = (72, 1253) | 1 | TTCCCCATATCCAAGTACCAATGCTG TTGTAAACAACGTGTATAGTGCCT |
| 1711 | Table 3A | Hs.1183 | L11329 | 559539 | dual specificity phosphatase 2 (DUSP2), mRNA/cds = (85, 1029) | 1 | TGAGCCTTTCACACCTGTGCTGGCGC TGGAAAATTATTTGTGCTCAGCTG |
| 1712 | Table 3A | Hs.220 | L11695 | 431034 | transforming growth factor, beta receptor I (activin A receptor type II-like kinase, 53 kD) (TGFBR1), mRNA/ | 1 | TGGGATTGTACTATACCAGTAAGTGC CACTTCTGTGTCTTTCTAATGGAA |

TABLE 8-continued

| SEQ ID | Origin | Unigene | Locus | GI | Nominal Description | Strand | Probe Sequence |
|---|---|---|---|---|---|---|---|
| 1713 | Table 3A | Hs.150395 | L12052 | 179892 | cAMP phosphodiesterase PDE7 (PDE7A1) mRNA, complete cds/cds = (76, 1587) cds = (50, 1498) | 1 | TTTTTCCTCACAGGAGCGGAAGAACT AGGGGGAGCAGGAGCTGCAATGCG |
| 1714 | Table 3A | Hs.104125 | L12168 | 178083 | adenylyl cyclase-associated protein (CAP), mRNA/cds = (62, 1489) | 1 | TCTACCCATTTCCTGAGGCCTGTGGA AATAAACCTTTATGTACTTAAAGT |
| 1715 | Table 3A | Hs.78944 | L13463 | 292054 | regulator of G-protein signalling 2, 24 kD (RGS2), mRNA/cds = (32, 667) | 1 | GTGTCCGTTATGAGTGCCAAAAATCT GTCTTGAAGGCAGCTACACTTTGA |
| 1716 | Table 3A | Hs.258850 | L14542 | 292360 | killer cell lectin-like receptor subfamily C, member 3 (KLRC3), transcript variant NKG2-E, mRNA/cds = (45, 767) | 1 | CTGTGCAATGCTACATGTACGTGGAC TTATATCAGACCAGTGTGGATCTT |
| 1717 | Table 3A | Hs.161125 | L21961 | 405227 | Homo sapiens, clone MGC:12849 IMAGE:4308973, mRNA, complete cds/cds = (24, 725) | 1 | AGTCCCCTGTCCTGGTCATCTATCAA GATAACAAGCGGCCCTCAGGGATC |
| 1718 | Table 3A | Hs.247824 | NM_005214 | 291928 | cytotoxic T-lymphocyte-associated protein 4 (CTLA4), mRNA/cds = (0, 671) | 1 | GGGTCTATGTGAAAATGCCCCCAACA GAGCCAGAATGTGAAAAGCAATTT |
| 1719 | Table 3A | Hs.179881 | L20298 | 388306 | core-binding factor, beta subunit (CBFB), transcript variant 2, mRNA/cds = (11, 559) | 1 | CTTGCCTTAAGCTACCAGATTGCTTT TGCCACCATTGGCCATACTGTGTG |
| 1720 | Table 3A | Hs.83658 | L20688 | 404044 | Rho GDP dissociation inhibitor (GDI) beta (ARHGDIB), mRNA/cds = (152, 757) | 1 | CCCCTGCCAGAGGGAGTTCTTCTTTT GTGAGAGACACTGTAAACGACACA |
| 1721 | Table 3A | Hs.89582 | L20814 | 493133 | glutamate receptor, ionotropic, AMPA 2 (GRIA2), mRNA/cds = (160, 2811) | 1 | TGCAGCCACTATTGTTAGTCTCTTGA TTCATAATGACTTAAGCACACTTG |
| 1722 | Table 3A | Hs.161125 | L22009 | 347313 | Homo sapiens, clone MGC:12849 IMAGE:4308973, mRNA, complete cds/cds = (24, 725) | 1 | TGACTATTACTGTCAGGCGTGGGACA CCAACACTGCGGTATTCGGCGGAG |
| 1723 | Table 3A | Hs.245710 | L23332 | 408689 | heterogeneous nuclear ribonucleoprotein H1 (H) (HNRPH1), mRNA/cds = (72, 1421) | 1 | TTTGAGACGCAATACCAATACTTAGG ATTTTGGTCTTGGTGTTTGTATGA |
| 1724 | Table 3A | Hs.79117 | L23320 | 410217 | mRNA for corticotrophin releasing factor receptor/cds = (226, 1473) | 1 | TCCTTCCAGGGCTTCTTTGTGTCTGT GTTCTACTGTTTCCTCAATAGTGA |
| 1725 | Table 3A | Hs.79117 | L24498 | 403127 | mRNA for corticotrophin releasing factor receptor/cds = (226, 1473) | 1 | CCATGTCCATCCCCACCTCCCCAACC CGTGTCAGCTTTCACAGCATCAAG |
| 1726 | db mining | Hs.80409 | NM_021998 | 11527399 | gadd45 gene, complete cds/cds = (2327, 2824) | 1 | TGCCCTCAAGTAAAAGAAAAGCCGAA AGGGTTAATCATATTTGAAAACCA |
| 1727 | Table 3A | Hs.326801 | l25124 | 435049 | DNA sequence from PAC 75N13 on chromosome Xq21.1. Contains ZNF6 like gene, ESTs, STSs and CpG islands/cds = (587, 2882) | 1 | ATGCTACTTGGGAGAAAACTCTCACT AACTGTCTCACCGGGTTTCAAAGC |
| 1728 | Table 3A | Hs.199248 | L25080 | 407696 | prostaglandin E receptor 4 (subtype EP4) (PTGER4), mRNA/cds = (388, 1854) | 1 | GGACTTTGCGAATATCAGAGACCTCA GACTCTTCACAGGGTCAGGACTCA |
| 1729 | Table 3A | Hs.199248 | L25851 | 4406707 | prostaglandin E receptor 4 (subtype EP4) (PTGER4), mRNA/cds = (388, 1854) | 1 | AGCTCCCTGCAAGTCACATTTCCCAG TGAAACACTGAACTTATCAGAAAA |
| 1730 | Table 3A | Hs.241545 | L25931 | 438638 | Homo sapiens. Similar to hypothetical protein, clone MGC:1824 IMAGE:3509518, mRNA, complete cds/cds = (533, 1504) | 1 | TTCCTTCAGGATGATCTAGAGCAGCA TGGAGCTGTTGGTAGAATATTAGT |
| 1731 | Table 3A | Hs.152931 | L29218 | 632967 | lamin B receptor (LBR), mRNA/cds = (75, 1922) | 1 | GGGGAGGAAGGAAGGACATTAAATT CTTTCCCTGGTAATGAAAAGAGCCC |
| 1732 | Table 3A | Hs.73986 | L26953 | 537529 | CDC-like kinase 2 (CLK2), transcript variant phclk2, mRNA/cds = (129, 1628) | 1 | GCCTTGTACATAATACTATTCCATCCA CACAGTTTCCACCCTCACCTGCC |
| 1733 | Table 3A | Hs.29877 | L27071 | 951045 | TXK tyrosine kinase (TXK), mRNA/cds = (86, 1669) | 1 | AGCAAGATAGCCAAATGTGACATCAA GCTCCATTGTTTCGGAAATCCAGG |
| 1734 | Table 3A | Hs.73986 | L42572 | 1160962 | CDC-like kinase 2 (CLK2), transcript variant phclk2, mRNA/cds = (129, 1628) | 1 | GCCGAGTGAGGTAACCAGGTGGCAT CTACCCCATGTTTTATAAGGAATTT |
| 1735 | Table 3A | Hs.78504 | L29348 | 460282 | inner membrane protein, mitochondrial (mitofilin) (IMMT), mRNA/cds = (92, 2368) | 1 | TTCTTTCCATTTGCTATCATGTCAGTG AACGCCAGGAGTGCTTTCTTTGC |
| 1736 | Table 3A | Hs.1742 | L33075 | 536843 | IQ motif containing GTPase activating protein 1 (IQGAP1), mRNA/cds = (467, 5440) | 1 | TGAATTTACTTCCTCCCAAGAGTTTG GACTGCCCGTCAGATTGTTTCTGC |
| 1737 | Table 3A | Hs.137232 | L33842 | 602457 | yq19a04.r1 cDNA, 5' end/clone = IMAGE:274063/clone_end = 5' | 1 | ACCCTCATTTCCAGGGGGAGCCTCA GGCCCCGAGATAAATGTGCTCCATG |
| 1738 | Table 3A | Hs.1697 | L35249 | 522192 | ATPase, H+ transporting, lysosomal (vacuolar proton pump), beta polypeptide,56/58 kD, isoform 2 (ATP6B2), mRNA/cds = (25, 1560) | 1 | TTCTCTGAGGGCTGGGGGTTGGGGG AGTCAGCATGATTATATTTTAATGT |
| 1739 | Table 3A | Hs.79107 | L35263 | 603916 | mitogen-activated protein kinase 14 (MAPK14), mRNA/cds = (362, 1444) | 1 | ACTTGGCTGTAATCAGTTATGCCGTA TAGGATGTCAGACAATACCACTGG |

TABLE 8-continued

| SEQ ID | Origin | Unigene | Locus | GI | Nominal Description | Strand | Probe Sequence |
|---|---|---|---|---|---|---|---|
| 1740 | Table 3A | Hs.75217 | L36870 | 685175 | mitogen-activated protein kinase kinase 4 (MAP2K4), mRNA/cds = (9, 1208) | 1 | TGGAGCTCAGTAACATAACTGCTTCT TGGAGCTTTGGAATATTTTATCCT |
| 1741 | Table 3A | Hs.83086 | L38935 | 1008845 | GT212 mRNA/cds = UNKNOWN | 1 | AAATTTCACAAGCAATACTTTGGACC ACTGGGGTTCAGGCCCCAAGAAAT |
| 1742 | Table 3A | Hs.180446 | L38951 | 893287 | importin beta subunit mRNA, complete cds/cds = (337, 2967) | 1 | ACACACAAAACAGCAAACTTCAGGTA ACTATTTTGGATTGCAAACAGGAT |
| 1743 | Table 3A | Hs.41726 | L40377 | 1160926 | serine (or cysteine) proteinase inhibitor, clade B (ovalbumin), member 8 (SERPINB8), mRNA/cds = (83, 1207) | 1 | TCTTGCCTTAATTAACATTCCCTGTGA CCTAGTTGGTGCAGTGGCTTGAA |
| 1744 | Table 3A | Hs.155079 | L42373 | 1000887 | protein phosphatase 2, regulatory subunit B (B56), alpha isoform (PPP2R5A), mRNA/cds = (571, 2031) | 1 | ACTTGCAGTTGTGTGGAAAACTGTTT TGTAATGAAAGATCTTCATTGGGG |
| 1745 | Table 3A | Hs.78504 | L78440 | 1479978 | inner membrane protein, mitochondrial (mitofilin) (IMMT), mRNA/cds = (92, 2368) | 1 | TGTGATCTCTACTACTGTTGATTTTGC CCTCGGAGCAAACTGAATAAAGC |
| 1746 | Table 3A | Hs.80642 | L47345 | 992562 | signal transducer and activator of transcription 4 (STAT4), mRNA/cds = (81, 2327) | 1 | TAGGAAATGTTTGACATCTGAAGCTC TCTTCACACTCCCGTGGCACTCCT |
| 1747 | Table 3A | Hs.75678 | L49169 | 1082037 | FBJ murine osteosarcoma viral oncogene homolog B | 1 | CGTCCCCTCTCCCCTTGGTTCTGCAC TGTTGCCAATAAAAAGCTCTTAAA |
| 1748 | Table 3A | Hs.80642 | M11353 | 184092 | signal transducer and activator of transcription 4 (STAT4), mRNA/cds = (81, 2327) | 1 | GGGAGTGTTGTGACTGAAATGCTTGA AACCAAAGCTTCAGATAAACTTGC |
| 1749 | Table 3A | Hs.181307 | M10901 | 183032 | H3 histone, family 3A (H3F3A), mRNA/cds = (374, 784) | 1 | AGGGGACAGAAATCAGGTATTGGCA GTTTTTCCATTTTCATTTGTGTGTG |
| 1750 | Table 3A | Hs.198253 | M11124 | 188109 | major histocompatibility complex, class II, DQ alpha 1 (HLA-DQA1), mRNA/cds = (43, 810) | 1 | AGCCGCCCAGCTACCTAATTCCTCAG TAACATCGATCTAAAATCTCCATG |
| 1751 | Table 3A | Hs.181307 | M12679 | 187911 | H3 histone, family 3A (H3F3A), mRNA/cds = (374, 784) | 1 | ACATGCAAGTACATGTTTTTAATGTTG TCTGTCTTCTGTGCTGTTCCTGT |
| 1752 | Table 3A | Hs.277477 | M11717 | 184416 | major histocompatibility complex, class I, C (HLA-C), mRNA/cds = (0, 1100) | 1 | CCTGTGTGGGACTGAGATGCAGGAT TTCTTCACACCTCTCCTTTGTGACT |
| 1753 | Table 3A | Hs.277477 | M12824 | 339426 | major histocompatibility complex, class I, C (HLA-C), mRNA/cds = (0, 1100) | 1 | GGCATCTGAATGTGTCTGCGTTCCTG TTAGCATAATGTGAGGAGGTGGAG |
| 1754 | Table 3A | Hs.85258 | M14328 | 182113 | CD8 antigen, alpha polypeptide (p32) (CD8A), mRNA/cds = (65, 772) | 1 | CTGAGAGCCCAAACTGCTGTCCCAAA CATGCACTTCCTTGCTTAAGGTAT |
| 1755 | Table 3A | Hs.254105 | M12824 | 339426 | enolase 1, (alpha) (ENO1), mRNA/cds = (94, 1398) | 1 | AAGCTCCCTGGAGCCCTGTTGGCAG CTCTAGCTTTGCAGTCGTGTAATG |
| 1756 | Table 3A | Hs.122007 | M12888 | 338836 | qn52b08.x1 cDNA, 3' end/clone = IMAGE:1901847/clone_end = 3' | 1 | AGCCCTCTTTCTCTCCACCCAATGCT GCTTTCTCCTGTTCATCCTGATGG |
| 1757 | Table 3A | Hs.82085 | M14083 | 189566 | serine (or cysteine) proteinase inhibitor, clade E (nexin, plasminogen activator inhibitor type 1), member 1 (SERPINE1), mRNA/cds = (75, 1283) | 1 | TCCACAGGGGTGGTGTCAAATGCTAT TGAAATTGTGTTGAATTGTATGCT |
| 1758 | Table 3A | Hs.254105 | M15182 | 183232 | enolase 1, (alpha) (ENO1), mRNA/cds = (94, 1398) | 1 | GCTAGATCCCCGGTGGTTTTGTGCTC AAAATAAAAAGCCTCAGTGACCCA |
| 1759 | Table 3A | Hs.183868 | M14648 | 340306 | glucuronidase, beta (GUSB), mRNA/cds = (26, 1981) | 1 | GACTTCCACAGCAGCAGAACAAGTG CCTCCTGGACTGTTCACGGCAGACC |
| 1760 | Table 3A | Hs.1416 | M15059 | 182447 | Fc fragment of IgE, low affinity II, receptor for (CD23A) (FCER2), mRNA/cds = (213, 1178) | 1 | TATCCCCAGCTCAGGTGGTGAGTCCT CCTGTCCAGCCTGCATCAATAAAA |
| 1761 | Table 3A | Hs.183868 | M15330 | 186283 | glucuronidase, beta (GUSB), mRNA/cds = (26, 1981) | 1 | CTGGGTTTTGTGGTCATCTATTCTAG CAGGGAACACTAAAGGTGGAAATA |
| 1762 | Table 3A | Hs.126256 | M15353 | 306486 | interleukin 1, beta (IL1B), mRNA/cds = (86, 895) | 1 | AGCTATGGAATCAATTCAATTTGGAC TGGTGTGCTCTCTTTAAATCAAGT |
| 1763 | Table 3A | Hs.79306 | M16342 | 184266 | eukaryotic translation initiation factor 4E (EIF4E), mRNA/cds = (18, 671) | 1 | TGGCTCAAGTAGAAAAGCAGTCCCAT TCATATTAAGACAGTGTACAAAAC |
| 1764 | Table 3A | Hs.182447 | M15796 | 181271 | heterogeneous nuclear ribonucleoprotein C (C1/C2) (HNRPC), transcript variant 1, mRNA/cds = (191, 1102) | 1 | AGCTCTTGAAAGCAGCTTTGAGTTAG AAGTATGTGTGTTACACCCTCACA |
| 1765 | Table 3A | Hs.80887 | M16038 | 187268 | v-yes-1 Yamaguchi sarcoma viral related oncogene homolog (LYN), mRNA/cds = (297, 1835) | 1 | AACCGGATATATACATAGCATGACAT TTCTTTGTGCTTTGGCTTACTTGT |
| 1766 | Table 3A | Hs.89476 | M16336 | 180093 | CD2 antigen (p50), sheep red blood cell receptor (CD2), mRNA/cds = (6, 1061) | 1 | AGCCTATCTGCTTAAGAGACTCTGGA GTTTCTTATGTGCCCTGGTGGACA |
| 1767 | Table 3A | Hs.182447 | M16342 | 188352 | heterogeneous nuclear ribonucleoprotein C (C1/C2) (HNRPC), transcript variant 1, mRNA/cds = (191, 1102) | 1 | AAAGTTGATACTGTGGGATTTTTGTG AACAGCCTGATGTTTGGGACCTTT |
| 1768 | Table 3A | Hs.318720 | M16660 | 184420 | Homo sapiens, clone MGC:12387 IMAGE:3933019, mRNA, complete | 1 | CTTCCTTAGCTCCTGTTCTTGGCCTG AAGCCTCACAGCTTTGATGGCAGT |

TABLE 8-continued

| SEQ ID | Origin | Unigene | Locus | GI | Nominal Description | Strand | Probe Sequence |
|---|---|---|---|---|---|---|---|
| 1769 | Table 3A | Hs.318720 | M16942 | 188352 | Homo sapiens, clone MGC:12387 IMAGE:3933019, mRNA, complete cds/cds = (63, 863) | 1 | TTTGTGCTTCCCTTTACCTAAACTGTC CTGCCTCCCATGCATCTGTACCC |
| 1770 | Table 3A | Hs.318720 | M16942 | 188437 | Homo sapiens, clone MGC:12387 IMAGE:3933019, mRNA, complete cds/cds = (63, 863) | 1 | TTTGTGCTTCCCTTTACCTAAACTGTC CTGCCTCCCATGCATCTGTACCC |
| 1771 | Table 3A | Hs.308026 | M16967 | 182411 | major histocompatibility complex, class II, DR beta 5 (HLA-DRB5), mRNA/cds = (29, 829) | 1 | CTTGTGGCTTCCTCAGCTCCTGCCCT TGGCCTGAAGTCCCAGCATTGATG |
| 1772 | Table 3A | Hs.75709 | M16985 | 187282 | mannose-6-phosphate receptor (cation dependent) (M6PR), mRNA/cds = (170, 1003) | 1 | ATTTGTTTGCATCCCTCCCCCACACC CTGGTGTTTTAAAATGAAGAAAAA |
| 1773 | Table 3A | Hs.21858 | M17783 | 183063 | trinucleotide repeat containing 3 (TNRC3), mRNA/cds = (517, 1356) | 1 | CATCCGACATAATCCTACAGGTGCTG TGTTATTCATGGGGCAGATAAACA |
| 1774 | Table 3A | Hs.694 | M20137 | 186328 | interleukin 3 (colony-stimulating factor, multiple) (IL3), mRNA/cds = (9, 467) | 1 | AGTGGGGTGGGGAGCATGTTCATTT GTACCTCGAGTTTTAAACTGGTTCC |
| 1775 | Table 3A | Hs.308026 | M20430 | 187182 | major histocompatibility complex, class II, DR beta 5 (HLA-DRB5), mRNA/cds = (29, 829) | 1 | CCTAAACCGTATGGCCTCCCGTGCAT CTGTATTCACCCTGTATGACAAAC |
| 1776 | Table 3A | Hs.62848 | M20661 | 183684 | selectin L (lymphocyte adhesion molecule 1) (SELL), mRNA/cds = (88, 1206) | 1 | TTTCATCTCAGGCCTCCCTCAACCCC ACCACTTCTTTTATAACTAGTCCT |
| 1777 | Table 3A | Hs.237519 | M20867 | 183059 | yz35c09.s1 cDNA, 3' end/clone = IMAGE:285040/clone_end = 3' | 1 | GCATGGCTTAACCTGGTGATAAAAGC AGTTATTAAAAGTCTACGTTTTCC |
| 1778 | Table 3A | Hs.241392 | M21121 | 339420 | small inducible cytokine A5 (RANTES) (SCYA5), mRNA/cds = (26, 301) | 1 | AGCTTCCGCCGTCTCAACCCCTCACA GGAGCTTACTGGCAAACATGAAAA |
| 1779 | literature | Hs.76422 | M22430 | 190888 | phospholipase A2, group IIA (platelets, synovial fluid) (PLA2G2A), nuclear gene encoding mitochondrial protein, mRNA/cds = (135, 569) | 1 | TCTCCTCCACCTCAACTCCGTGCTTA ACCAAAGAAGCTGTACTCCGGGGG |
| 1780 | db mining | Hs.51299 | M22538 | 986883 | NADH dehydrogenase (ubiquinone) flavoprotein 2 (24 kD) (NDUFV2), mRNA/cds = (18, 767) | 1 | ACCCAAGGGACCTGGATTTGGTGTAC AAGCAGGCCTTTAATTTATATTGA |
| 1781 | Table 3A | Hs.82848 | M25280 | 188555 | selectin L (lymphocyte adhesion molecule I) (SELL), mRNA/cds = (88, 1206) | 1 | AGCTCCTCTTCCTGGCTTCTTACTGA AAGGTTACCCTGTAACATGCAATT |
| 1782 | Table 3A | Hs.73798 | M25393 | 190740 | macrophage migration inhibitory factor (glycosylation-inhibiting factor) (MIF), mRNA/cds = (97, 444) | 1 | GTCTACATCAACTATTACGACATGAA CGCGGCCAATGTGGGCTGGAACAA |
| 1783 | Table 3A | Hs.73798 | M25639 | 188627 | macrophage migration inhibitory factor (glycosylation-inhibiting factor) (MIF), mRNA/cds = (97, 444) | 1 | CCACCCCAACCTTCTGGTGGGGAGA AATAAACGGTTTAGAGACAGCTCTG |
| 1784 | db mining | Hs.624 | M26383 | 184641 | interleukin 8 (IL8), mRNA/cds = (74, 373) | 1 | GCCAAGGGCCAAGAGAATATCCGAA CTTTAATTTCAGGAATTGAATGGGT |
| 1785 | Table 3A | Hs.303649 | M26683 | 186289 | small inducible cytokine A2 (monocyte chemotactic protein 1, homologous to mouse Sig-je) (SCYA2), mRNA/cds = (53, 352) | 1 | GAAATTGCTTTTCCTCTTGAACCACA GTTCTACCCCTGGGATGTTTTGAG |
| 1786 | Table 3A | Hs.82112 | M26880 | 340067 | interleukin 1 receptor, type I (IL1R1), mRNA/cds = (82, 1791) | 1 | CCGGTTGTTAAAACTGGTTTAGCACA ATTTATATTTTCCCTCTCTTGCCT |
| 1787 | Table 3A | Hs.82112 | M27492 | 180035 | interleukin 1 receptor, I (IL1R1), mRNA/cds = (82, 1791) | 1 | ATTAAAGCACCAAATTCATGTACAGC ATGCATCACGGATCAATAGACTGT |
| 1788 | Table 3A | Hs.1309 | M28170 | 862622 | thymocyte antigen CD1a mRNA, complete cds/cds = (533, 1516) | 1 | TAGCCGTACTTTGCTAACTGTGCTCC TCACTTCCTCTTCTTCATTGCAGT |
| 1789 | Table 3A | Hs.78146 | M28526 | 189775 | platelet/endothelial cell adhesion molecule (CD31 antigen) (PECAM1), mRNA/cds = (141, 2357) | 1 | AGGCTAAGCTGCCGGTTCTTAAATCC ATCCTGCTAAGTTAATGTTGGGTA |
| 1790 | Table 3A | Hs.1309 | M28825 | 186279 | thymocyte antigen CD1a mRNA, complete cds/cds = (533, 1516) | 1 | AATATATGCATCCCTGGTGAAGGATC TTGCCTGCATGAAACATGTTCTCA |
| 1791 | Table 3A | Hs.1722 | M28983 | 186365 | interleukin 1, alpha (IL1A), mRNA/cds = (36, 581) | 1 | ACCTGGGCATTCTTGTTTCATTCAATT CCACCTGCAATCAAGTCCTACAA |
| 1792 | Table 3A | Hs.237868 | M29064 | 337452 | interleukin 7 receptor (IL7R), mRNA/cds = (22, 1401) | 1 | CTCCCTCACAGCACAGAGAAGACAAA ATTAGCAAAACCCCACTACACAGT |
| 1793 | Table 3A | Hs.237868 | M29696 | 180259 | interleukin 7 receptor (IL7R), mRNA/cds = (22, 1401) | 1 | GTTCAGTGGCACTCAACATGAGTCAA GAGCATCCTGCTTCTACCATGTGG |
| 1794 | Table 3A | Hs.89538 | M30142 | 181464 | cholesteryl ester transfer protein, plasma (CETP), mRNA/cds = (130, 1611) | 1 | CTTGAGCTAGAAGTCTCCAAGGAGGT CGGGATGGGGCTTGTAGCAGAAGG |
| 1795 | Table 3A | Hs.89538 | M30185 | 179039 | cholesteryl ester transfer protein, plasma (CETP), mRNA/cds = (130, 1611) | 1 | CTCCCAACTCCTCCCTATCCTAAAGG CCCACTGGCATTAAAGTGCTGTAT |
| 1796 | db mining | Hs.270833 | M30704 | 339994 | amphiregulin (schwannoma-derived growth factor) (AREG), mRNA/cds = (209, 967) | 1 | TCGGTCCTCTTTCCAGTGGATCATAA GACAATGGACCCTTTTGTTATGA |
| 1797 | Table 3A | Hs.29352 | M31165 | 184485 | tumor necrosis factor, alpha-induced | 1 | AACACACAGTGTTTATGTTGGAATCT |

TABLE 8-continued

| SEQ ID | Origin | Unigene | Locus | GI | Nominal Description | Strand | Probe Sequence |
|---|---|---|---|---|---|---|---|
| | | | | | protein 6 (TNFAIP6), mRNA/ cds = (68, 901) | | TTTGGAACTCCTTTGATCTCACTG |
| 1798 | Table 3A | Hs.149923 | M31210 | 181948 | X-box binding protein 1 (XBP1), mRNA/cds = (48, 833) | 1 | GGGGCTCTTTCCCTCATGTATACTTC AAGTAAGATCAAGAATCTTTTGTG |
| 1799 | Table 3A | Hs.1012 | M31452 | 190501 | complement component 4-binding protein, alpha (C4BPA), mRNA/ cds = (138, 1931) | 1 | TCATCCTCTGTGTGGCTCATGTTTTT GCTTTTCAACACACAAAGCACAAA |
| 1800 | Table 3A | Hs.101047 | M31523 | 339477 | transcription factor (E2A) mRNA, complete cds/cds = (30, 1994) | 1 | TGGATGATTGGGACTTTAAAACGACC CTCTTTCAGGTGGATTCAGAGACC |
| 1801 | db mining | Hs.149923 | M31827 | 182473 | X-box binding protein 1 (XBP1), mRNA/cds = (48, 833) | 1 | TGTAGCTTCTGAAAGGTGCTTTCTCC ATTTATTTAAAAACTACCCATGCA |
| 1802 | Table 3A | Hs.78864 | M31932 | 188194 | Fc fragment of IgG, low affinity IIa, receptor for (CD32) (FCGR2A), mRNA/cds = (11, 958) | 1 | TGTAGCAACATGAGAAACGCTTATGT TACAGGTTACATGAGAGCAATCAT |
| 1803 | Table 3A | Hs.73931 | M32011 | 189267 | major histocompatibility complex, class II, DQ beta 1 (HLA-DQB1), mRNA/ cds = (57, 842) | 1 | CTGATGGCTGTGACCCTGCTTCCTGC ACTGACCCAGAGCCTCTGCCTGTG |
| 1804 | Table 3A | Hs.256278 | M32315 | 189185 | tumor necrosis factor receptor superfamily, member 1B (TNFRSF1B), mRNA/cds = (89, 1474) | 1 | TGTGTGTTGATCCCAAGACAATGAAA GTTTGCACTGTATGCTGGACGGCA |
| 1805 | Table 3A | Hs.73931 | M32577 | 183628 | major histocompatibility complex, class II, DQ beta 1 (HLA-DQB1), mRNA/ cds = (57, 842) | 1 | CTCTCCTCAGACTGCTCAAGAGAAGC ACATGAAAACCATTACCTGACTTT |
| 1806 | Table 3A | Hs.75765 | M33336 | 1526989 | GRO2 oncogene (GRO2), mRNA/ cds = (74, 397) | 1 | GCCAGTAAGATCAATGTGACGGCAG GGAAATGTATGTGTGTCTATTTTAT |
| 1807 | Table 3A | Hs.198253 | M33906 | 184194 | major histocompatibility complex, class II, DQ alpha 1 (HLA-DQA1), mRNA/ cds = (43, 810) | 1 | GCAACAATGAAGTTAATGGATACCCT CTGCCTTTGGCTCAGAAATGTTAT |
| 1808 | Table 3A | Hs.87773 | M34181 | 189982 | protein kinase, cAMP-dependent, catalytic, beta (PRKACB), mRNA/ cds = (47, 1102) | 1 | TGTCTTTCGGTTATCAAGTGTTTCTG CATGGTAATGTCATGTAAATGCTG |
| 1809 | Table 3A | Hs.26045 | M34888 | 190738 | protein tyrosine phosphatase, receptor type, A (PTPRA), mRNA/ cds = (695, 3103) | 1 | TATCATGGGGAGTAATAGGACCAGAG CGGTATCTCTGGCACCACACTAGC |
| 1810 | Table 3A | Hs.119663 | M34671 | 180152 | CD59 antigen p18–20 (antigen identified by monoclonal antibodies 16.3A5, EJ16, EJ30, EL32 and G344) (CD59), mRNA/cds = (29, 415) | 1 | TGATCTTGGCTGTATTTAATGGCATA GGCTGACTTTTGCAGATGGAGGAA |
| 1811 | Table 3A | Hs.250811 | M35416 | 190851 | v-ral simian leukemia viral oncogene homolog B (ras related: GTP binding protein) (RALB), mRNA/cds = (170, 790) | 1 | AGTACTGAGAAAAATCCCTTCAGCTC TAAGAACACTGAAAAATCCACCGA |
| 1812 | Table 3A | Hs.87149 | M35999 | 183532 | integrin, beta 3 (platelet glycoprotein IIIa, antigen CD61) (ITGB3), mRNA/ cds = (16, 2382) | 1 | ACTTTGCACACATTTGCATCCACATAT TAGGGAAGGAATAAGTAGCTGCA |
| 1813 | Table 3A | Hs.75765 | M36820 | 183628 | GRO2 oncogene (GRO2), mRNA/ cds = (74, 397) | 1 | ATGCAGTGTTTCCCTCTGTGTTAGAG CAGAGAGGTTTCGATATTTATTGA |
| 1814 | Table 3A | Hs.89690 | M38821 | 183632 | GRO3 oncogene (GRO3), mRNA/ cds = (77, 397) | 1 | TGCTGAAGTTTCCCTTAGACATTTTAT GTCTTGCTTGTAGGGCATAATGC |
| 1815 | Table 3A | Hs.82212 | M37033 | 184059 | CD53 antigen (CD53), mRNA/ cds = (93, 752) | 1 | CACTGGACCATTGTCACAACCCTCTG TTTCTCTTTGACTAAGTGCCCTGG |
| 1816 | Table 3A | Hs.119192 | M37583 | 179968 | H2A histone family, member Z (H2AFZ), mRNA/cds = (106, 492) | 1 | AAGTGTTACTGTGGCTTCAAAGAAGC TATTGATTCTGAAGTAGTGGGTTT |
| 1817 | Table 3A | Hs.173894 | NM_000757 | 4503074 | macrophage-specific colony- stimulating factor (CSF-1) mRNA, complete cds/cds = (105, 1769) | 1 | GCTGCTTATATATTTAATAATAAAAGA AGTGCACAAGCTGCCGTTGACGT |
| 1818 | Table 3A | Hs.119192 | M37583 | 189988 | H2A histone family, member Z (H2AFZ), mRNA/cds = (106, 492) | 1 | AACAAACATTTGGTTTTGTTCAGACCT TATTTCCACTCTGGTGGATAAGT |
| 1819 | Table 3A | Hs.315366 | M55284 | 189988 | protein kinase C, eta (PRKCH), mRNA/ cds = (166, 2214) | 1 | GAGAGAGGGCACGAGAACCCAAAGG AATAGAGATTCTCCAGGAATTTCCT |
| 1820 | Table 3A | Hs.315366 | M55284 | 189988 | protein kinase C, eta (PRKCH), mRNA/ cds = (166, 2214) | 1 | TTCCCAGCATCAGCCTTAGAACAAGA ACCTTACCTTCAAGGAGCAAGTGA |
| 1821 | Table 3A | Hs.171862 | M55543 | 829176 | guanylate binding protein 2, interferon- inducible (GBP2), mRNA/ cds = (156, 1931) | 1 | CTGTCCAGCTCCCTCTCCCCAAGAAA CAACATGAATGAGCAACTTCAGAG |
| 1822 | Table 3A | Hs.2055 | M58028 | 340071 | ubiquitin-activating enzyme E1 (A1S9T and BN75 temperature sensitivity complementing) (UBE1), mRNA/ cds = (32, 3208) | 1 | CTGTAACGACGAGAGCGGCGAGGAT GTCGAGGTTCCCTATGTCCGATACA |
| 1823 | Table 3A | NA | M55674 | 189870 | one single clone, artifact? | 1 | ACCTAGTCATCAGGACACTGAGCCAG GGCTGCAACCACTCCATGAGTTTG |
| 1824 | Table 3A | Hs.72918 | M57506 | 184505 | small inducible cytokine A1 (1-309, homologous to mouse Tca-3) (SCYA1), mRNA/cds = (72, 362) | 1 | CCCCAACCCTCTGGGCTCTTGGATTT CAGAGTGAAAACTTGATGGCATTG |
| 1825 | Table 3A | Hs.193717 | M57627 | 186270 | interleukin 10 (IL10), mRNA/ cds = (30, 566) | 1 | TCAATTCCTCTGGGAATGTTACATTG TTTGTCTGTCTTCATAGCAGATTT |

TABLE 8-continued

| SEQ ID | Origin | Unigene | Locus | GI | Nominal Description | Strand | Probe Sequence |
|---|---|---|---|---|---|---|---|
| 1826 | Table 3A | Hs.1051 | M57888 | 183154 | granzyme B (granzyme 2, cytotoxic T-lymphocyte-associated serine esterase 1) (GZMB), mRNA/cds = (33, 776) | 1 | ACCAGTTTCTTTCCCTTCTAGATCAC CCTGTTCTGAAGCCAGCCTCTCTC |
| 1827 | Table 3A | Hs.2055 | M58028 | 189177 | ubiquitin-activating enzyme E1 (A1S9T and BN75 temperature sensitivity complementing) (UBE1), mRNA/cds = (32, 3208) | 1 | CTACCTGAACCCCTCTTGCCACTGCC TTCTACCTTGTTTGAAACCTGAAT |
| 1828 | Table 3A | Hs.83426 | M58597 | 182070 | nuclear factor of kappa light polypeptide gene enhancer in B-cells 1 (p105) (NFKB1), mRNA/cds = (397, 3303) | 1 | AACTCGAGACCTTTTCAACTTGGCTT CCTTTCTTGGTTCATAAATGAATT |
| 1829 | Table 3A | Hs.83428 | M58603 | 186496 | nuclear factor of kappa light polypeptide gene enhancer in B-cells 1 (p105) (NFKB1), mRNA/cds = (397, 3303) | 1 | AGCTGCTGCTGGATCACAGCTGCTTT CTGTTGTCATTGCTGTTGTCCCTC |
| 1830 | Table 3A | Hs.265829 | M59465 | 177865 | integrin, alpha 3 (antigen CD49C, alpha 3 subunit of VLA-3 receptor) (ITGA3), transcript, variant a, mRNA/cds = (73, 3228) | 1 | GGCTGTGTCCTAAGGCCCATTTGAGA AGCTGAGGCTAGTTCCAAAAACCT |
| 1831 | Table 3A | Hs.2175 | M59820 | 183048 | colony stimulating factor 3 receptor (granulocyte) (CSF3R), mRNA/cds = (169, 2679) | 1 | ATCCAGCCCCACCCAATGGCCTTTTG TGCTTGTTTCCTATAACTTCAGTA |
| 1832 | Table 3A | Hs.265829 | M60278 | 183866 | integrin, alpha 3 (antigen CD49C, alpha 3 subunit of VLA-3 receptor) (ITGA3), transcript variant a, mRNA/cds = (73, 3228) | 1 | CCTTCTTTGTATATAGGCTTCTCACC GCGACCAATAAACAGCTCCCAGTT |
| 1833 | Table 3A | Hs.799 | M60724 | 189507 | diphtheria toxin receptor (heparin-binding epidermal growth factor-like growth factor) (DTR), mRNA/cds = (261, 887) | 1 | AAAACGATGAAGGTATGCTGTCATGG TCCTTTCTGGAAGTTTCTGGTGCC |
| 1834 | Table 3A | Hs.86658 | M60826 | 182882 | ribosomal protein S6 kinase, 70 kD, polypeptide 1 (RPS6KB1), mRNA/cds = (27, 1604) | 1 | AATGCGAAATTATTGGTTGGTGTGAA GAAAGCCAGACAACTTCTGTTTCT |
| 1835 | Table 3A | Hs.88858 | M61906 | 189424 | ribosomal protein S6 kinase, 70 kD, polypeptide 1 (RPS6KB1), mRNA/cds = (27, 1604) | 1 | CTGTGGCTCGTTTGAGGGATTGGGG TGGACCTGGGGTTTATTTTCAGTAA |
| 1836 | Table 3A | Hs.6241 | M61199 | 181122 | P13-kinase associated p85 mRNA sequence/cds = UNKNOWN | 1 | GCTTCCCCACCCCAGTTTTTGTTGCT TGAAAATATTGTTGTCCCGGATTT |
| 1837 | Table 3A | Hs.6241 | M61906 | 190734 | P13-kinase associated p85 mRNA sequence/cds = UNKNOWN | 1 | TGGACTGTTTTGTTGGGCAGTGCCTG ATAAGCTTCAAAGCTGCTTTATTC |
| 1838 | Table 3A | Hs.50651 | M63180 | 339679 | Janus kinase 1 (a protein tyrosine kinase) (JAK1), mRNA/cds = (75, 3503) | 1 | CCTGCCGTGCCCACCTAACTGTCCA GATGAGGTTTATCAGCTTATGAGAA |
| 1839 | Table 3A | Hs.84318 | M63488 | 337488 | replication protein A1 (70 kD) (RPA1), mRNA/cds = (69, 1919) | 1 | CGAGCTGAGAAGCGGTCATGAGCAC CTGGGGATTTAGTAAGTGTGTCTT |
| 1840 | Table 3A | Hs.50651 | M64174 | 190446 | Janus kinase 1 (a protein tyrosine kinase) (JAK1), mRNA/cds = (75, 3503) | 1 | ACCATCCAATCGGACAAGCTTTCAGA ACCTTATTGAAGGATTTGAAGCAC |
| 1841 | Table 3A | Hs.82159 | M64992 | 178996 | proteasome (prosome, macropain) subunit, alpha type, 1 (PSMA1), mRNA/cds = (105, 896) | 1 | TGCTGATGAACCTGCAGAAAAGGCTG ATGAACCAATGGAACATTAAGTGA |
| 1842 | Table 3A | Hs.11482 | M69043 | 167290 | splicing factor, arginine/serine-rich 11 (SFRS11), mRNA/cds = (83, 1537) | 1 | TCTTATGCACACGGTGATTTCATGTT ATATATGCAAAGTAGGCAACTGTT |
| 1843 | Table 3A | Hs.155160 | M72709 | 179073 | Homo sapiens. Similar to splicing factor, arginine/serine-rich 2 (SC-35), clone, MGC:2622 IMAGE:3501687, mRNA, complete cds/cds = (30, 878) | 1 | AACATAGGAGTGGATTCCTGCCCCAA CCAAACCGCATTCGTGTGGATTTT |
| 1844 | Table 3A | Hs.1117 | M73047 | 339879 | tripeptidyl peptidase II (TPP2), mRNA/cds = (23, 3772) | 1 | AATAAATTTGCAAAACCAAGATCACA GTACACCATATGCACTCTGGTACC |
| 1845 | Table 3A | Hs.178112 | M73547 | 190161 | polyposis locus (DP1 gene) mRNA, complete cds/cds = (82, 639) | 1 | AAATGACCTCATGTTGTGGTTTAAAC AGCAACTGCACCCACTAGCACAGC |
| 1846 | Table 3A | Hs.11482 | M74002 | 184045 | splicing factor, arginine/serine-rich 11 (SFRS11), mRNA/cds = (83, 1537) | 1 | TGTGCAGTAGAAACAAAAGTAGGCTA CAGTCGTGCCATGTTGATGTACA |
| 1847 | Table 3A | Hs.811 | M74525 | 189511 | ubiquitin-conjugating enzyme E2B (RAD6 homolog) (UBE2B), mRNA/cds = (421, 879) | 1 | CTGTTTATTCTGGGAAATGTTTTAATG CCAGGGCCTGCTGAGTTGCTTCT |
| 1848 | Table 3A | Hs.172766 | M80359 | 182353 | MAP/microtubule affinity-regulating kinase 3 (MARK3), mRNA/cds = (171, 2312) | 1 | CCTTAAGACCAGTTCATAGTTAATAC AGGTTTACAGTTCATGCCTGTGGT |
| 1849 | Table 3A | Hs.153179 | M81601 | 339442 | fatty acid binding protein 5 (psoriasis-associated) (FABP5), mRNA/cds = (48, 455) | 1 | TCATCACTTTGGACAGGAGTTAATTA AGAGAATGACCAAGCTCAGTTCAA |
| 1850 | Table 3A | Hs.119537 | M88108 | 189499 | GAP-associated tyrosine phosphoprotein p62 (Sam68) (SAM68), mRNA/cds = (106, 1437) | 1 | AGTCTGCCTAAATAGGTAGCTTAAAC TTATGTCAAAATGTCTGCAGCAGT |
| 1851 | Table 3A | Hs.89575 | M89957 | 179311 | CD79B antigen (immunoglobulin- | 1 | CTGGCCTCCAGTGCCTTCCCCCGTG |

TABLE 8-continued

| SEQ ID | Origin | Unigene | Locus | GI | Nominal Description | Strand | Probe Sequence |
|---|---|---|---|---|---|---|---|
| | | | | | associated beta) (CD79B), transcript variant 1, mRNA/cds = (94, 783) | | GAATAAACGGTGTGTCCTGAGAAAC |
| 1852 | Table 3A | Hs.181967 | M90356 | 179575 | BTF3 protein homologue gene, complete cds | 1 | AGCTAATTAAGCTGCAGAACGTGGGA AATAAAGTTCGAAACAAAGGTTAA |
| 1853 | Table 3A | Hs.82127 | M90391 | 4153827 | putative IL-16 protein precursor, mRNA, complete cds/cds = (303, 2198) | 1 | GGACAGGTGTGCCGACAGAAGGAAC CAGCGTGTATATGAGGGTATCAAAT |
| 1854 | Table 3A | Hs.73722 | M92444 | 183779 | apurinic/apyrimidinic endonuclease (HAP1) gene, complete cds | 1 | CCCTTCGTGGGGCTACACATTCTCTT CCTCATATTTTCATGCACACAAGT |
| 1855 | Table 3A | Hs.145279 | M93651 | 338038 | SET translocation (myeloid leukemia-associated) (SET), mRNA/cds = (3, 836) | 1 | TTCTGCACAGGTCTCTGTTTAGTAAA TACATCACTGTATACCGATCAGGA |
| 1856 | Table 3A | Hs.7647 | M94046 | 187393 | MYC-associated zinc finger protein (purine-binding transcription factor) (MAZ), mRNA/cds = (91, 1584) | 1 | CACCCTCCACCCCTTCCTTTTGCGCG GACCCCATTACAATAAATTTTAAA |
| 1857 | Table 3A | Hs.153179 | M95585 | 184223 | fatty acid binding protein 5 (psoriasis-associated) (FABP5), mRNA/cds = (48, 455) | 1 | CATGCAGCTATTTCAAAGTGTGTTGG ATTAATTAGGATCATCCCTTTGGT |
| 1858 | Table 3A | Hs.250692 | M95585 | 337810 | hepatic leukemia factor (HLF) mRNA, complete cds/cds = (322, 1209) | 1 | TGGAGAATTGTGGAAGGATTGTAACA TGGACCATCCAAATTTATGGCCGT |
| 1859 | Table 3A | Hs.74592 | M98982 | 338262 | special AT-rich sequence binding protein 1 (binds to nuclear matrix/scaffold-associating DNA's) (SATB1), mRNA/cds = (214, 2505) | 1 | TTCACGGGATGCACCAAAGTGTGTAC CCCGTAAGCATGAAACCAGTGTTT |
| 1860 | Table 3A | Hs.296381 | M96995 | 181975 | growth factor receptor-bound protein 2 (GRB2), mRNA/cds = (78, 731) | 1 | TCTGTCCATCAGTGCATGACGTTTAA GGCCACGTATAGTCCTAGCTGACG |
| 1861 | Table 3A | Hs.74592 | M97856 | 184432 | special AT-rich sequence binding protein 1 (binds to nuclear matrix/scaffold-associating DNA's) (SATB1), mRNA/cds = (214, 2505) | 1 | TCCTATAATTATTTCTGTAGCACTCCA CACTGATCTTTGGAAACTTGCCC |
| 1862 | Table 3A | Hs.243886 | M97935 | 2281070 | nuclear autoantigenic sperm protein (histone-binding) (NASP), mRNA/cds = (85, 2446) | 1 | GGGACACTGGAGGCTGGAGCTACAG TTGAAAGCACTGCATGTTAAGAGGG |
| 1863 | Table 3A | Hs.21486 | M98399 | 180112 | signal transducer and activator of transcription 1, 91 kD (STAT1), mRNA/cds = (196, 2448) | 1 | TGCTACCACAACTATATTATCATGCAA ATGCTGTATTCTTCTTTGGTGGA |
| 1864 | Table 3A | Hs.75613 | N27575 | 1142056 | CD36 antigen (collagen type I receptor, thrombospondin receptor) (CD36), mRNA/cds = (132, 1550) | 1 | GCAACTTACGCTTGGCATCTTCAGAA TGCTTTTCTAGCATTAAGAGATGT |
| 1865 | Table 3A | Hs.198427 | N25486 | 1139799 | hexokinase 2 (HK2), mRNA/cds = (1490, 4243) | 1 | TTTACAAGAATTGTCCATGTGCTTCC CTAGGCTGAGCTGGCATTGGTCTG |
| 1866 | Table 3A | Hs.198427 | N99577 | 1271009 | hexokinase 2 (HK2), mRNA/CDS = (1490, 4243) | 1 | AAAACTTCCCACCCTACTTTTCCAAG AGTGCCAGTTGGATTCTGAATCTG |
| 1867 | Table 3A | Hs.73965 | N28843 | 1147079 | splicing factor, arginine/serine-rich 2 (SFRS2), mRNA/cds = (155, 820) | 1 | TAGACCAATTCTCTGATCTCGAGTTG TTTTTGTTTGGATACAGCCCTTTT |
| 1868 | Table 3A | Hs.5122 | N31700 | 1152099 | 602293015F1 cDNA, 5' end/clone = IMAGE:4387778/clone_end = 5' | 1 | AACATTCTACATAGCACAGGAGCTTA AGAGTGGCATTATCTTCTCGCCTT |
| 1869 | Table 3A | Hs.66151 | N3426 | 1155403 | mRNA; cDNA DKFZp434A115 (from clone DKFZp434A115)/cds = UNKNOWN | 1 | AGATACGCAGACATTGTGGCATCTGG GTAGAAGAATACTGTATTGTGTGT |
| 1870 | Table 3A | Hs.73965 | Z22642 | 296907 | splicing factor, arginine/serine-rich 2 (SFRS2), mRNA/cds = (155, 820) | 1 | TTTGACCAGAAGCCCTTAGTAAGTAC GTGCCTGAAACTGAAACCATGTGC |
| 1871 | Table 3A | Hs.166563 | L14922 | 307337 | DNA-binding protein (PO-GA) mRNA, complete cds/cds = (393, 3836) | 1 | ACACCTGGCTTGGAGTCAGATTTAGT TAACAATAATGAGCCTGGAGCAGT |
| 1872 | literature | Hs.75772 | M10901 | 183032 | nuclear receptor subfamily 3, group C, member 1 (NR3C1), mRNA/cds = (132, 2465) | 1 | TCTAATAGCGGGTTACTTTCACATAC AGCCCTCCCCCAGCAGTTGAATGA |
| 1873 | literature | Hs.74561 | NM_000014 | 6226959 | alpha-2-macroglobulin (A2M), mRNA/cds = (43, 4467) | 1 | CTGAAAAGTGCTTTGCTGGAGTCCTG TTCTCTGAGCTCCACAGAAGACAC |
| 1874 | db mining | Hs.172670 | NM_000020 | 4557242 | activin A receptor type II-like 1 (ACVRL1), mRNA/cds = (282, 1793) | 1 | AAGCCTAAAGTGATTCAATAGCCCAG GAGCACCTGATTCCTTTCTGCCTG |
| 1875 | Table 3A | Hs.1217 | NM_000022 | 4557248 | adenosine diaminase (ADA), mRNA/cds = (95, 1186) | 1 | TGGGCATGGTTGAATCTGAAACCCTC CTTCTGTGGCAACTTGTACTGAAA |
| 1876 | Table 3A | Hs.99931 | NM_000023 | 4506910 | sarcoglycan, alpha (50 kD dystrophin-associated glycoprotein) (SGCA), mRNA/cds = (11, 1174) | 1 | GGGGTGGGGTGGGGTGAGAGTGTGT GGAGTAAGGACATTCAGAATAAATA |
| 1877 | literature | Hs.207776 | NM_000027 | 4557272 | aspartylglucosaminidase (AGA), mRNA/cds = (170, 1210) | 1 | AGAAGTTGTGCGCGTGCTTTCTCAGC AGCATTTTTCCTTCAAAATCATCT |
| 1878 | Table 3A | Hs.159548 | NM_000033 | 7262392 | ATP-binding cassette, sub-family D (ALD), member 1 (ABCD1), mRNA/cds = (386, 2623) | 1 | CTTGCCAGCCAGGAGTGCGGACACC ATGTTCCCAGCTCAGTGCCAAAGAG |
| 1879 | Table 3A | Hs.75081 | NM_000038 | 4557318 | adenomatosis polyposis coli (APC), mRNA/cds = (38, 8569) | 1 | ATTTGGGGAGAGAAAACCTTTTTAAG CATGGTGGGGCACTCAGATAGGAG |
| 1880 | literature | Hs.36820 | NM_000057 | 4557364 | Bloom syndrome (BLM), mRNA/cds = (74, 4327) | 1 | ACCCTCTTTCTTGTTTGTCAGCATCT GACCATCTGTGACTATAAAGCTGT |
| 1881 | literature | Hs.34012 | NM_000059 | 4502450 | breast cancer 2, early onset (BRCA2), | 1 | TGGTCATCCAAACTCAAACTTGAGAA |

TABLE 8-continued

| SEQ ID | Origin | Unigene | Locus | GI | Nominal Description | Strand | Probe Sequence |
|---|---|---|---|---|---|---|---|
| 1882 | Table 3A | Hs.159494 | NM_000061 | 4557376 | Bruton agammaglobulinemia tyrosine kinase (BTK), mRNA/cds = (163, 2142) | 1 | AATATCTTGCTTTCAAATTGACAC ACCGAATTTGGCAAGAATGAAATGGT GTCATAAAGATGGGAGGGGAGGGT |
| 1883 | Table 3A | Hs.1282 | NM_000085 | 4559405 | complement component 6 (C6), mRNA/cds = (155, 2959) | 1 | AGCCTGTGACATTAAGCATTCTCACA ATTAGAAATAAGAATAAAACCCAT |
| 1884 | Table 3A | Hs.2259 | NM_000073 | 4557428 | CD3G antigen, gamma polypeptide (TiT3 complex) (CD3G), mRNA/cds = (37, 585) | 1 | AAAAATAAAAACAAATACTGT GTTTCAGAAGCGCCACCTATTGGG GAAAA |
| 1885 | Table 3A | Hs.36508 | NM_000081 | 4502838 | Chediak-Higashi syndrome 1 (CHS1), mRNA/cds = (189, 11594) | 1 | TTATCACAAGCTCTGTTACCTTTATAT ACGCTGCCTCTTCAATTTGGAAA |
| 1886 | literature | Hs.32967 | NM_000082 | 4557466 | Cockayne syndrome 1 (classical) (CKN1), mRNA/cds = (36, 1226) | 1 | GCAGAAAATATCCTGGCAGGGAATCT GGCTAAACATGAAATGCTGTAAT |
| 1887 | Table 3A | Hs.154654 | NM_000104 | 13325059 | cytochrome P450, subfamily 1 (dioxin-inducible), polypeptide 1 (glaucoma 3, primary infantile) (CYP1B1), mRNA/cds = (372, 2003) | 1 | TGTGTGCATAATAGCTACAGTGCATA GTTGTAGACAAAGTACATTCTGGG |
| 1888 | literature | Hs.77602 | NM_000107 | 4557514 | damage-specific DNA binding protein 2 (48 kD) (DDB2), mRNA/cds = (175, 1458) | 1 | TCTCAGTGGGTGGTAGCAGAGGGAT CAAGCAGTTATTTGATTTGTGCTCT |
| 1889 | Table 3A | Hs.74635 | NM_000108 | 5016092 | dihydrolipoamide dehydrogenase (E3 component of pyruvate dehydrogenase complex, 2-oxo-glutarate complex, branched chain keto acid dehydrogenase complex) (DLD), mRNA/cds = (82, 1611) | 1 | GTCTATTTACGGAACTCAAATACGTG GGCATTCAAATGTATTACAGTGGG |
| 1890 | Table 3A | Hs.1602 | NM_000110 | 455874 | dihydropyrimidine dehydrogenase (DPYD), mRNA/cds = (101, 3178) | 1 | TGCACTTTTAGAAATGCATATTTGCCA CAAAACCTGTATTACTGAATAAT |
| 1891 | Table 3A | Hs.2985 | NM_000117 | 4557552 | emerin (Emery-Dreifuss muscular dystrophy) (EMD), mRNA/cds = (58, 822) | 1 | GGGAGGGGATTAACCAAAGGCCACC CTGACTTTGTTTTTGTGGACACACA |
| 1892 | Table 3A | Hs.76753 | NM_000118 | 4557554 | endoglin (Osier-Rendu-Weber syndrome 1) (ENG), mRNA/cds = (350, 2227) | 1 | GCCTGCCCCTGTGTATTCACCACCAA TAAATCAGACCATGAAACCTGAAA |
| 1893 | Table 3A | Hs.77929 | NM_000122 | 4557562 | excision repair cross-complementing rodent repair deficiency, complementation group 3 (xeroderma pigmentosum group B complementing) (ERCC3), mRNA/cds = (95, 2443) | 1 | AGGTGTATTTATGTTACCGTTCTGAAT AAACAGAATGGACCATTGAACCA |
| 1894 | literature | Hs.48576 | NM_000123 | 4503600 | excision repair cross-complementing rodent repair deficiency, complementation group 5 (xeroderma pigmentosum, complementation group G (Cockayne syndrome)) (ERCC5), mRNA/cds = (197, 3757) | 1 | TGTAATGAATTTGTCGCAAAGACGTA ATAAAATTAACTGGTGGCACGGTC |
| 1895 | literature | Hs.99924 | NM_000124 | 4557564 | excision repair cross-complementing rodent repair deficiency, complementation group 6 (ERCC6), mRNA/cds = (79, 3757) | 1 | TGTCAATGGAAGTTGGCTGCACTTGA TGTTTGTTTGCATGATGTCTACCT |
| 1896 | db mining | Hs.1657 | NM_000125 | 4503602 | estrogen receptor 1 (ESR1), mRNA/cds = (360, 2147) | 1 | TCGAGCACCTGTAAACAATTTTCTCA ACCTATTTGATGTTCAAATAAAGA |
| 1897 | Table 3A | Hs.80424 | NM_000129 | 9961355 | coagulation factor XIII, A1 polypeptide (F13A1), mRNA/cds = (101, 2299) | 1 | AACTTTACTAAGTAATCTCACAGCATT TGCCAAGTCTCCCAATATCCAAT |
| 1898 | literature | Hs.284153 | NM_000135 | 4503654 | Fanconi anemia, complementation group A (FANCA), mRNA/cds = (31, 4398) | 1 | TAAGATCTTTAAACTGCTTTATACACT GTCACGTGGCTTCATCAGCTGTG |
| 1899 | literature | Hs.37953 | NM_000136 | 4557588 | Fanconi anemia, complementation group C (FANCC), mRNA/cds = (255, 1928) | 1 | AAAACCACTACCCTCAGAGAGAGCCA AAAATACAGAAGAGGCGGAGAGCG |
| 1900 | Table 3A | Hs.1437 | NM_000152 | 11496988 | glucosidase, alpha; acid (Pompe disease, glycogen storage disease type II) (GAA), mRNA/cds = (441, 3299) | 1 | CGAGCAAGCCTGGGAACTCAGGAAA ATTCACAGGACTTGGAGATTCTAA |
| 1901 | Table 3A | Hs.273 | NM_000153 | 4557612 | galatosylceramidase (Krabbe disease) (GALC), mRNA/cds = (263, 2272) | 1 | GGCTTAGCTACAGTGAAGTTTTGCAT TGCTTTTGAAGACAAGAAAAGTGC |
| 1902 | Table 3A | Hs.66724 | NM_000161 | 4503948 | GTP cyclohydrolase 1 (dopa-responsive dystonia) (GCH1), mRNA/cds = (148, 900) | 1 | ACTTCAAAATTACCTTTTCATATCCAT GATCTTGAGTCCATTTGGGGGAT |
| 1903 | Table 3A | Hs.1466 | NM_000167 | 4504006 | glycerol kinase (GK), mRNA/cds = (66, 1640) | 1 | CAAACACTTTTGGGCCAGGATTTGAG TCTCTGCATGACATATACTTGATT |
| 1904 | Table 3A | Hs.1144 | NM_000174 | 4504076 | glycoprotein IX (platelet) (GP9), mRNA/cds = (222, 755) | 1 | CAGACTCCACCAAGCCTGGTCAGCC CAAACCACCAGAAGCCCAGAATAAA |
| 1905 | Table 3A | Hs.75772 | NM_000176 | 4504132 | nuclear receptor subfamily 3, group C, member 1 (NR3C1), mRNA/cds = (132, 2465) | 1 | AGTGCAGAATCTCATAGGTTGCCAAT AATACACTAATTCCTTTCTATCCT |
| 1906 | literature | Hs.3248 | NM_000179 | 4504190 | mutS (E. coli) homolog 6 (MSH6), | 1 | AGACTGACTACATTGGAAGCTTTGAG |

TABLE 8-continued

| SEQ ID | Origin | Unigene | Locus | GI | Nominal Description | Strand | Probe Sequence |
|---|---|---|---|---|---|---|---|
| 1907 | Table 3A | Hs.183868 | NM_000181 | 4504222 | glucuronidase, beta (GUSB), mRNA/ cds = (26, 1981) | 1 | TTGACTTCTGACCAAAGGTGGTAA CTGGGTTTTGTGGTCATCTATTCTAG CAGGGAACACTAAAGGTGGAAATA |
| 1908 | literature | Hs.75860 | NM_000182 | 4504324 | hydroxyacyl-Coenzyme A dehydrogenase/3-ketoacyl-Coenzyme A thiolase/enoyl-Coenzyme A hydratase (trifunctional protein), alpha subunit (HADHA), mRNA/ cds = (27, 2318) | 1 | GTGGTGAGGGCAGTTCTGCACCCAG CCAAACACATAACAATAAAAACCAA |
| 1909 | Table 3A | Hs.146812 | NM_000183 | 4504326 | hydroxyacyl-Coenzyme A dehydrogenase/3-ketoacyl-Coenzyme A thiolase/enoyl-Coenzyme A hydratase (trifunctional protein), beta subunit (HADHB), mRNA/ cds = (46, 1470) | 1 | TCTGTGTCCTAAAGATGTGTTCTCTAT AAAATACAAACCAACGTGCCTAA |
| 1910 | Table 3A | Hs.198427 | NM_000189 | 4504392 | hexokinase 2 (HK2), mRNA/ cds = (1490, 4243) | 1 | CTAGTCATAGAAATACCTCATTCGCC TGTGGGAAGAGAAGGGAAGCCTCT |
| 1911 | Table 3A | Hs.83951 | NM_000195 | 4504484 | Hermansky-Pudlak syndrome (HPS), mRNA/cds = (206, 2308) | 1 | AGCAGCGGCTGGATGTGATATGTCTA GTTTAACCAGTCCCCTTGATCTTT |
| 1912 | Table 3A | Hs.168383 | NM_000201 | 4557877 | intercellular adhesion molecule 1 (CD54), rhinovirus receptor (ICAM1). mRNA/cds = (57, 1655) | 1 | TATTGGAGGACTCCCTCCCAGCTTTG GAAGGGTCATCCGCGTGTGTGTGT |
| 1913 | Table 3A | Hs.172458 | NM_000202 | 5360215 | iduronate 2-sulfatase (Hunter syndrome) (IDS), transcript variant 1, mRNA/cds = (331, 1983) | 1 | ATACAAAGCAAACAAACTCAAGTTAT GTCATACCTTTGGATACGAAGACC |
| 1914 | Table 3A | Hs.238893 | NM_000206 | 4557881 | od15g01.s1 cDNA/ clone = IMAGE:1388048 | 1 | ATCTACCCTCCGATTGTTCCTGAACC GATGAGAAATAAAGTTTCTGTTGA |
| 1915 | Table 3A | Hs.83968 | NM_000211 | 4557885 | integrin, beta 2 (antigen CD18 (p95), lymphocyte function-associated antigen 1; macrophage antigen 1 (mac-1) beta subunit) (ITGB2), mRNA/ cds = (72, 2381) | 1 | CATGGAGACTTGAGGAGGGCTTGAG GTTGGTGAGGTTAGGTGCGTGTTTC |
| 1916 | literature | Hs.99877 | NM_000215 | 4557680 | Janus kinase 3 (a protein tyrosine kinase, leukocyte) (JAK3), mRNA/ cds = (95, 3489) | 1 | GCCCAAAGAAGCAAGGAACCAAATTT AAGACTCTCGCATCTTCCCAACCC |
| 1917 | literature | Hs.1770 | NM_000234 | 4557718 | ligase I, DNA, ATP-dependent (LIG1), mRNA/cds = (120, 2879) | 1 | CCGGAGTCTGGGATTCATCCCGTCAT TTCTTTCAATAAATAATTATTGGA |
| 1918 | db mining | Hs.3076 | NM_000246 | 4557748 | MHC class II transactivator (MHC2TA), mRNA/cds = (138, 3530) | 1 | GCAATGGCAGCCTTGGCAAACGCTA AATGAAATCGTGACAACACTTGTG |
| 1919 | literature | Hs.57301 | NM_000249 | 4557756 | mutL (E. coli) homolog 1 (colon cancer, nonpolyposis type 2) (MLH1), mRNA/cds = (21, 2291) | 1 | AGTGTTGGTAGCACTTAAGACTTATA CTTGCCTTCTGATAGTATTCCTTT |
| 1920 | literature | Hs.78934 | NM_000251 | 4557760 | mutS (E. coli) homolog 2 (colon cancer, nonpolyposis type 1) (MSH2), mRNA/cds = (66, 2672) | 1 | AACTGAGGACTGTTTGCAATTGACAT AGGCAATAATAAGTGATGTGCTGA |
| 1921 | Table 3A | Hs.75514 | NM_000270 | 4557800 | nucleoside phosphorylase (NP), mRNA/cds = (109, 978) | 1 | GGGCTCAGTTCTGCCTTATCTAAATC ACCAGAGACCAAACAAGGACTAAT |
| 1922 | Table 3A | Hs.76918 | NM_000271 | 4557802 | Niemann-Pick disease, type C1 (NPC1), mRNA/cds = (123, 3959) | 1 | GGCATGAAATGAGGGACAAAGAAAG CATCTCGTAGGTGTGTCTACTGGGT |
| 1923 | Table 3A | Hs.1023 | NM_000284 | 4505684 | pyruvate dehydrogenase (lipoamide) alpha 1 (PDHA1), mRNA/ cds = (105, 1277) | 1 | TCTTGGAAACTTCCATTAAGTGTGTA GATTGAGCAGGTAGTAATTGCATG |
| 1924 | Table 3A | Hs.78771 | NM_000291 | 4505762 | phosphoglycerate kinase 1 (PGK1), mRNA/cds = (79, 1332) | 1 | ACTACTCAGCATGGAAACAAGATGAA ATTCCATTTGTAGGTAGTGAGACA |
| 1925 | Table 3A | Hs.196177 | NM_000294 | 4505784 | phosphorylase kinase, gamma 2 (testis) (PHKG2), mRNA/ cds = (93, 1313) | 1 | CACTAATGATCCTGCTACCCTCTTGA AGACCAGCCCGGTACCTCTCTCCC |
| 1926 | Table 3A | Hs.169857 | NM_000305 | 4505952 | paraoxonase 2 (PON2), mRNA/ cds = (32, 1096) | 1 | GTGACCTCACTTCTGGCACTGTGACT ACTATGGCTGTTTAGAACTACTGA |
| 1927 | Table 3A | Hs.3873 | NM_000310 | 4506030 | palmitoyl-protein thioesterase 1 (ceroid-lipofuscinosis, neuronal 1, infantile) (PPT1), mRNA/cds = (13, 933) | 1 | AAGCCTTATTCTTCAACTAAAAGATGA GGATTAAGAGCAAGAAGTTGGGG |
| 1928 | Table 3A | Hs.74621 | NM_000311 | 4506112 | prion protein (p27–30) (Creutzfeld-Jakob disease, Gerstmann-Strausler-Scheinker syndrome, fatal familial insomnia) (PRNP), mRNA/ cds = (49, 810) | 1 | GCACTGAATCGTTTCATGTAAGAATC CAAAGTGGACACCATTAACAGGTC |
| 1929 | Table 3A | Hs.288986 | NM_000344 | 13259515 | survival of motor neuron 1, telomeric (SMN1), transcript variant d, mRNA/ cds = (163, 1047) | 1 | GGTGCTCACATTCCTTAAATTAAGGA GAAATGCTGGCATAGAGCAGCACT |
| 1930 | Table 3A | Hs.2316 | NM_000346 | 4557852 | SRY (sex determining region Y)-box 9 (campomelic dysplasia, autosomal sex-reversal) (SOX9) | 1 | CTTTTGTTCTCTCCGTGAAACTTACCT TTCCCTTTTTCTTTCTCTTTTTT |
| 1931 | Table 3A | Hs.118787 | NM_000358 | 4507466 | transforming growth factor, beta-induced, 68 kD (TGFBI), mRNA/ cds = (47, 2098) | 1 | TGGTATGTAGAGCTTAGATTTCCCTA TTGTGACAGAGCCATGGTGTGTTT |

TABLE 8-continued

| SEQ ID | Origin | Unigene | Locus | GI | Nominal Description | Strand | Probe Sequence |
|---|---|---|---|---|---|---|---|
| 1932 | literature | Hs.2030 | NM_000361 | 4507482 | Thrombomodulin | 1 | TGGAGATAATCTAGAACACAGGCAAA ATCCTTGCTTATGACATCACTTGT |
| 1933 | Table 3A | Hs.83848 | NM_000365 | 4507644 | triosephosphate isomerase 1 (TPI1), mRNA/cds = (34, 783) | 1 | GTGCCTCTGTGCTGTGTATGTGAACC ACCCATGTGAGGGAATAAACCTAG |
| 1934 | db mining | Hs.123078 | NM_000369 | 4507700 | thyroid stimulating hormone receptor (TSHR), mRNA/cds = (100, 2394) | 1 | TGCAAACGGTTTTGTAAGTTAACACT ACACTACTCACAATGGTAGGGGAA |
| 1935 | literature | Hs.75593 | NM_000375 | 4557872 | uroporphyrinogen III synthase (congenital erythropoietic porphyria) (UROS), mRNA/cds = (198, 993) | 1 | CCTGTGCCCAGCAGGAAGGAAGTCA AATAAACCACACTGACTACCTGTGC |
| 1936 | db mining | Hs.2157 | NM_000377 | 4507908 | Wiskott-Aldrich syndrome (eczema-thrombocytopenia) (WAS), mRNA/cds = (34, 1542) | 1 | CCCAACAATCCCAAGGCCCTTTTTAT ACAAAAATTCTCAGTTCTCTTCAC |
| 1937 | Table 3A | Hs.250 | NM_000379 | 9257259 | xanthene dehydrogenase (XDH), mRNA/cds = (81, 4082) | 1 | TGTCTGTTTTAATCATGTATCTGGAAT AGGGTCGGGAAGGGTTTGTGCTA |
| 1938 | literature | Hs.192803 | NM_000380 | 4507936 | xeroderma pigmentosum, complementation group A (XPA), mRNA/cds = (26, 847) | 1 | CACGATGGTGGAAACAGTGGGGAAC TACTGCTGGAAAAAGCCCTAATAGC |
| 1939 | Table 3A | Hs.179665 | NM_000389 | 11386202 | cyclin-dependent kinase inhibitor 1A (p21, Cip1) (CDKN1A), mRNA/cds = (75, 569) | 1 | CCCTGGAGGCACTGAAGTGCTTAGT GTACTTGGAGTATTGGGGTCTGACC |
| 1940 | Table 3A | Hs.83942 | NM_000396 | 4503150 | cathepsin K (pyenodysostosis) (CTSK), mRNA/cds = (129, 1118) | 1 | ACAAGTTTACATGATAAAAA GAAATGTGATTTGTCTTCCCTTCTT TGCAC |
| 1941 | Table 3A | Hs.88974 | NM_000397 | 6996020 | cytochrome b-245, beta polypeptide (chronic granulomatous disease) (CYBB), mRNA/cds = (14, 1726) | 1 | TTGTATGTGAATAATTCTAGCGGGGG ACCTGGGAGATAATTCTACGGGGA |
| 1942 | Table 3A | Hs.1395 | NM_000399 | 9845523 | early growth response 2 (Krox-20 (Drosophila) homolog) (EGR2), mRNA/cds = (337, 1768) | 1 | ATCTATTCTAACGCAAAACCACTAACT GAAGTTCAGATATAATGGATGGT |
| 1943 | Table 3A | Hs.180866 | NM_000416 | 4557879 | interferon gamma receptor 1 (IFNGR1), mRNA/cds = (43, 1512) | 1 | GTAACGGAACATATCCAGTACTCCTG GTTCCTAGGTGAGCAGGTGATGCC |
| 1944 | Table 3A | Hs.1724 | NM_000417 | 4557666 | interleukin 2 receptor, alpha (IL2RA), mRNA/cds = (159, 977) | 1 | ACTAATTTGATGTTTACAGGTGGACA CACAAGGTGCAAATCAATGCGTAC |
| 1945 | Table 3A | Hs.75545 | NM_000418 | 4557668 | interleukin 4 receptor (IL4R), mRNA/cds = (175, 2652) | 1 | TGTGTGTTTTACTTTCATCACCTGTTA TCTGTGTTTGCTGAGGAGAGTGG |
| 1946 | Table 3A | Hs.785 | NM_000419 | 6006009 | integrin, alpha 2b (platelet glycoprotein IIb of IIb/IIIa complex, antigen CD41B) (ITGA2B), mRNA/cds = (32, 3151) | 1 | TTGGAGCTGTTCCATTGGGTCCTCTT GGTGTCGTTTCCCTCCCAACAGAG |
| 1947 | Table 3A | Hs.77318 | NM_000430 | 5031206 | platelet-activating factor acetylhydrolase, isoform Ib, alpha subunit (45 kD) (PAFAH1B1), mRNA/cds = (555, 1787) | 1 | ATTTGTTGCTCTCAGACTGTGTAAAA CAAAATTTATTCATGTTTTCTGCA |
| 1948 | Table 3A | Hs.949 | NM_000433 | 6557786 | neutrophil cytosolic factor 2 (65 kD, chronic granulomalous disease. autosomal 2) (NCF2), mRNA/cds = (67, 1647) | 1 | CTGAACCATTACTGTAATTGGCTCTT AAGGCTTGAAGTAACCTTATAGGT |
| 1949 | Table 3A | Hs.78146 | NM_000442 | 4505706 | platelet/endothelial cell adhesion molecule (CD31 antigen) (PECAM1), mRNA/cds = (141, 2357) | 1 | GCTAAGCTGCCGGTTCTTAAATCCAT CCTGCTAAGTTAATGTTGGGTAGA |
| 1950 | db mining | Hs.166891 | NM_000449 | 4557842 | regulatory factor X, 5 (influences HLA class II expression) (RFX5), mRNA/cds = (161, 2011) | 1 | TGTAACCAATAAATCTGTAGTGACCT TACCTGTATTCCCTGTGCTATCCT |
| 1951 | Table 3A | Hs.75428 | NM_000454 | 4507148 | superoxide dismutase 1, soluble (amyotrophic lateral sclerosis 1 (adult)) (SOD1), mRNA/cds = (0, 464) | 1 | ACATTCCCTTGGATGTAGTCTGAGGC CCCTTAACTCATCTGTTATCCTGC |
| 1952 | Table 3A | Hs.83918 | NM_000480 | 4502078 | adenosine monophosphate deaminase (isoform E) (AMPD3), mRNA/cds = (344, 2674) | 1 | ATTTCTCCCTTATCTACTGTGATGACT TCAGAAGATACAATGGTCCCAGG |
| 1953 | Table 3A | Hs.88251 | NM_000487 | 7262293 | arylsulfatase A (ARSA), mRNA/cds = (375, 1898) | 1 | TGTCTGGAGGGGGTTTGTGCCTGATA ACGTAATAACACCAGTGGAGACTT |
| 1954 | Table 3A | Hs.663 | NM_000492 | 6995995 | cystic fibrosis transmembrane conductance regulator. ATP-binding cassette (sub-family C, member 7) (CFTR), mRNA/cds = (132, 4574) | 1 | ACACTGCCTTCTCAACTCCAAACTGA CTCTTAAGAAGACTGCATTATATT |
| 1955 | Table 3A | Hs.273385 | NM_000516 | 8659565 | guanine nucleotide binding protein (G protein), alpha stimulating activity polypeptide 1 (GNAS1), mRNA/cds = (68, 1252) | 1 | AGATGTTCCAAATTTAGAAAGCTTAA GGCGGCCTACAGAAAAAGGAAAAA |
| 1956 | Table 3A | Hs.155376 | NM_000518 | 13788565 | hemoglobin, beta (HBB), mRNA/cds = (50, 493) | 1 | AAGTCCAACTACTAAACTGGGGGATA TTATGAAGGGCCTTGAGCATCTGG |
| 1957 | Table 3A | Hs.119403 | NM_000520 | 13128865 | hexosaminidase A (alpha polypeptide) (HEXA), mRNA/cds = (26, 1815) | 1 | ATCCACCTCCCTCCCCTAGAGCTATT CTCCTTTGGGTTTCTTGCTGCTGC |
| 1958 | Table 3A | Hs.51043 | NM_000521 | 13128866 | hexosaminidase B (beta polypeptide) (HEXB), mRNA/cds = (75, 1745) | 1 | AAAAGGCCACAGCAATCTGTACTACA ATCAACTTTATTTTGAAATCATGT |
| 1959 | literature | Hs.111749 | NM_000534 | 11496979 | postmeiotic segregation increased (S. cerevisiae) 1 (PMS1), mRNA/ | 1 | GATTAGTTACCATTGAAATTGGTTCT GTCATAAAACAGCATGAGTCTGGT |

TABLE 8-continued

| SEQ ID | Origin | Unigene | Locus | GI | Nominal Description | Strand | Probe Sequence |
|---|---|---|---|---|---|---|---|
| 1960 | literature | Hs.177548 | NM_000535 | 11125773 | postmeiotic segregation increased (*S. cerevisiae*) 2 (PMS2), mRNA/cds = (24, 2612) | 1 | AAAAATACACATCACACCCATTTAAAA GTGATCTTGAGAACCTTTTCAAA |
| 1961 | db mining | Hs.301461 | NM_000538 | 4506500 | 601845227F1 cDNA, 5' end/clone = IMAGE:4070407/clone_end = 5' | 1 | ACAGCAACAGCTATTAAATCAGCAAG TTTTGGAGCAAAGACAACAGCAGT |
| 1962 | literature | Hs.150477 | NM_000553 | 5739523 | Werner syndrome (WRN), mRNA/cds = (231, 4529) | 1 | TGACCAGGGCAGTGAAAATGAAACC GCATTTTGGGTGCCATTAAATAGGG |
| 1963 | Table 3A | Hs.82212 | NM_000560 | 10834971 | CD53 antigen (CD53), mRNA/cds = (93, 752) | 1 | CAATTTCTTTATTAGAGGGCCTTATTG ATGTGTTCTAAGTCTTTCCAGAA |
| 1964 | Table 3A | Hs.77424 | NM_000566 | 10835132 | Fc fragment of IgG, high affinity Ia, receptor for (CD64) (FCGR1A), mRNA/cds = (0, 1124) | 1 | AGAGCTGAAATGTCAGGAA-CAAAAAG AAGAACAGCTGCAGGAAGGGGTGC |
| 1965 | literature | Hs.334687 | NM_000569 | 12056966 | Fc fragment of IgG, high affinity IIIa, receptor for (CD16) (FCGR3A), mRNA/cds = (33, 797) | 1 | GGTAATAAGAGCAGTAGCAGCAGCAT CTCTGAACATTTCTCTGGATTTGC |
| 1966 | Table 3A | Hs.1369 | NM_000574 | 10835142 | decay accelerating factor for complement (CD55, Cromer blood group system) (DAF), mRNA/cds = (65, 1210) | 1 | AGAGTTTGGAAAAAGCCTGTG AAAGGTGTCTTCTTTGACTTAATG TCTTT |
| 1967 | Table 3A | Hs.1722 | NM_000575 | 13238493 | interleukin 1, alpha (IL1A), mRNA/cds = (36, 851) | 1 | GTATGGTAGATTCAAATGAACCACTG AAAAGGCATTTAGTTTCTTGTCCC |
| 1968 | Table 3A | Hs.126256 | NM_000576 | 10835144 | interleukin 1, beta (1L1B), mRNA/cds = (86, 895) | 1 | AGCTATGGAATCAATTCAATTTGGAC TGGTGTGCTCTCTTTAAATCAAGT |
| 1969 | literature | Hs.54443 | NM_000579 | 4502638 | chemokine (C—C motif) receptor 5 (CCR5), mRNA/cds = (357, 1415) | 1 | GCTCTTAAGTTGTGGAGAGTGCAACA GTAGCATAGGACCCTACCCTCTGG |
| 1970 | Table 3A | Hs.313 | NM_000582 | 4759165 | secreted phosphoprotein 1 (osteopontin, bone sialoprotein I, early T-lymphocyte activation 1) (SPP1), mRNA/cds = (87, 989) | 1 | GAATTTGGTGGTGTCAATTGCTTATTT GTTTTCCCACGGTTGTCCAGCAA |
| 1971 | Table 3A | Hs.624 | NM_000584 | 10834977 | interleukin 8 (IL8), mRNA/cds = (74, 373) | 1 | AAAACAGCCAAAACTCCACAGTCAAT ATTAGTAATTTCTTGCTGGTTGAA |
| 1972 | Table 3A | Hs.168132 | NM_000585 | 10835152 | interleukin 15 (IL15), mRNA/cds = (316, 804) | 1 | TAGCATTTGTTTAAGGGTGATAGTCA AATTATGTATTGGTGGGCTGGGT |
| 1973 | Table 3A | Hs.89679 | NM_000586 | 10835148 | interleukin 2 (IL2), mRNA/cds = (47, 517) | 1 | GCAGATGAGACAGCAACCATTGTAGA ATTTCTGAACAGATGGATTACCTT |
| 1974 | Table 3A | Hs.694 | NM_000588 | 4504666 | interleukin 3 (colony-stimulating factor, multiple) (IL3), mRNA/cds = (9, 467) | 1 | TCTAATTTCTGAAATGTGCAGCTCCC ATTTGGCCTTGTGCCGGTTGTGTTC |
| 1975 | literature | Hs.73917 | NM_000589 | 4504668 | interleukin 4 (IL4), mRNA/cds = (65, 526) | 1 | ACCAGAGTACGTTGGAAAACTTCTTG GAAAGGCTAAAGACGATCATGAGA |
| 1976 | Table 3A | Hs.75627 | NM_000591 | 4557416 | CD14 antigen (CD14), mRNA/cds = (119, 1246) | 1 | TGAGGACTTTTCGACCAATTCAACCC TTTGCCCCACCTTTATTAAAATCT |
| 1977 | Table 3A | Hs.158164 | NM_000593 | 9665247 | transporter 1, ATP-binding cassette, sub-family B (MDR/TAP) (TAP1), mRNA/cds = (30, 2456) | 1 | GCTGGCCCATAAACACCCTGTAGGTT CTTGATATTTATAATAAAATTGGT |
| 1978 | Table 3A | Hs.241570 | NM_000594 | 10835154 | tumor necrosis factor (TNF superfamily, member 2) (TNF), mRNA/cds = (65, 786) | 1 | CCCAGGGAGTTGTGTCTGTAATCGG CCTACTATTCAGTGGCGAGAAATAA |
| 1979 | Table 3A | Hs.119663 | NM_000611 | 10835164 | CD59 antigen p18–20 (antigen identified by monoclonal antibodies 16.3A5, EJ16, EJ30, EL32 and G344) (CD59), mRNA/cds = (29, 415) | 1 | TGATCTTGGCTGTATTTAATGGCATA GGCTGACTTTTGCAGATGGAGGAA |
| 1980 | Table 3A | Hs.856 | NM_000619 | 10835170 | interferon, gamma (IFNG), mRNA/cds = (108, 608) | 1 | TTGTTGACAACTGTGACTGTACCCAA ATGGAAAGTAACTCATTTGTTAAA |
| 1981 | Table 3A | Hs.172631 | NM_000632 | 6006013 | integrin, alpha M (complement component receptor 3, alpha: also known as CD11b (p170), macrophage antigen alpha polypeptide) (ITGAM), mRNA/cds = (75, 3533) | 1 | GTCAAGATTGTGTTTGAGGTTTCCT TCAGACAGATTCCAGGCGATGTGC |
| 1982 | Table 3A | Hs.194778 | NM_000634 | 4504680 | interleukin 8 receptor, alpha (IL8RA), mRNA/cds = (100, 1152) | 1 | TCACCAGTCCCTCCCCAAATGCTTTC CATGAGTTGCAGTTTTTTCCTAGT |
| 1983 | Table 3A | Hs.318885 | NM_000636 | 10835186 | superoxide dismutase 2, mitochondrial (SOD2), mRNA/cds = (4, 672) | 1 | TACTTTGGGGACTTGTAGGGATGCCT TTCTAGTCCTATTCTATTGCAGTT |
| 1984 | Table 3A | Hs.2007 | NM_000639 | 4557328 | tumor necrosis factor (ligand) superfamily, member 6 (TNFSF6), mRNA/cds = (157, 1002) | 1 | CCATCGGTGAAACTAACAGATAAGCA AGAGAGATGTTTGGGGACTCATT |
| 1985 | Table 3A | Hs.82846 | NM_000655 | 5713320 | selectin L (lymphocyte adhesion molecule 1) (SELL), mRNA/cds = (88, 1206) | 1 | AGCTCCTCTTCCTGGCTTCTTACTGA AAGGTTACCCTGTAACATGCAATT |
| 1986 | Table 3A | Hs.1103 | NM_000660 | 10863872 | transforming growth factor, beta 1 (TGFB1), mRNA/cds = (841, 2016) | 1 | CACCAGGAACCTGCTTTAGTGGGGG ATAGTGAAGAAGACAATAAAAGATA |
| 1987 | Table 3A | Hs.157850 | NM_000661 | 4506664 | *Homo sapiens*, clone MGC:15545 IMAGE:3050745, mRNA, complete cds/cds = (1045, 1623) | 1 | GGCTACAGAAAGAAGATGCCAGATG ACATTAAGACCTACTTGTGATATT |

TABLE 8-continued

| SEQ ID | Origin | Unigene | Locus | GI | Nominal Description | Strand | Probe Sequence |
|---|---|---|---|---|---|---|---|
| 1988 | Table 3A | Hs.89499 | NM_000698 | 4502056 | arachidonate 5-lipoxygenase (ALOX5), mRNA/cds = (44, 2068) | 1 | GCATTTCCACACCAAGCAGCAACAGC AAATCACGACCACTGATAGATGTC |
| 1989 | Table 3A | Hs.78225 | NM_000700 | 4502100 | annexin A1 (ANXA1), mRNA/cds = (74, 1114) | 1 | TCCCCAAACCATAAAACCCTATACAA GTTGTTCTAGTAACAATACATGAG |
| 1990 | db mining | Hs.89485 | NM_000717 | 9951925 | carbonic anhydrase IV (CA4), mRNA/cds = (46, 984) | 1 | GCTTCCGGTCCTTAGCCTTCCCAGGT GGGACTTTAGGCATGATTAAAATA |
| 1991 | Table 3A | Hs.97087 | NM_000734 | 4557430 | CD3Z antigen, zeta polypeptide (TiT3 complex) (CD3Z), mRNA/cds = (178, 669) | 1 | TGCTATTGCCTTCCTATTTTGCATAAT AAATGCTTCAGTGAAAATGCAGC |
| 1992 | db mining | Hs.28408 | NM_000752 | 4505032 | leukotriene b4 receptor (chemokine receptor-like 1) (LTB4R), mRNA/cds = (1717, 2775) | 1 | GGAAGAAGAGGGAGAGATGGAGCAA AGTGAGGGCCGAGTGAGAGCGTGCT |
| 1993 | Table 3A | Hs.2175 | NM_000760 | 4503080 | colony stimulating factor 3 receptor (granulocyte) (CSF3R), mRNA/cds = (169, 2679) | 1 | ATCCAGCCCCACCCAATGGCCTTTTG TGCTTGTTTCCTATAACTTCAGTA |
| 1994 | literature | Hs.82568 | NM_000784 | 13904863 | cytochrome P450, subfamily XXVIIA (steroid 27-hydroxylase, cerebrotendinous xanthomalosis), polypeptide 1 (CYP27A1), mitochondrial protein encoded by nuclear gene, mRNA/cds = (201, 1796) | 1 | CTCAGCTAAAAGGCCACCCCTTTATC GCATTGCTGTCCTTGGGTAGAATA |
| 1995 | Table 3A | Hs.709 | NM_000788 | 4503268 | deoxycytidine kinase (DCK), mRNA/cds = (159, 941) | 1 | ACCTTATGAACTACAGTGGAGCTACA CTCATTGAAATGTAATTTCAGTTC |
| 1996 | Table 3A | Hs.150403 | NM_000790 | 4503280 | dopa decarboxylase (aromatic L-amino acid decarboxylase) (DDC), mRNA/cds = (69, 1511) | 1 | TCCAGGGCAATCAATGTTCACGCAAC TTGAAATTATATCTGTGGTCTTCA |
| 1997 | Table 3A | Hs.83765 | NM_000791 | 7262376 | dihydrofolate reductase (DHFR), mRNA/cds = (479, 1042) | | GCCAGATTTGGGGCATTTGGAAAGAA GTTCATTGAAGATAAAGCAAAAGT |
| 1998 | Table 3A | Hs.179661 | NM_000801 | 4503724 | Homo sapiens, tubulin, beta 5, clone MGC:4029 IMAGE:3617988, mRNA, complete cds/cds = (1705, 3039) | 1 | CTGCACCCTTCCCCCAGCACCATTTA TGAGTCTCAAGTTTTATTATTGCA |
| 1999 | Table 3A | Hs.324784 | NM_000817 | 4503872 | glutamate decarboxylase 1 (brain, 67 kD) (GAD1), transcript variant GAD67, mRNA/cds = (550, 2334) | 1 | TTTTGAAGAAGGGAAATTCACACTGT GCGTTTTGAGTATGCAAGAAGAAT |
| 2000 | Table 3A | Hs.11899 | NM_000859 | 4557642 | 3-hydroxy-3-methylglutaryl-Coenzyme A reductase (HMGCR), mRNA/cds = (50, 2716) | 1 | TGTTGTGACTTTTTAGCCAGTGACTTT TTCTGAGCTTTTCATGGAAGTGG |
| 2001 | literature | Hs.1570 | NM_000861 | 13435403 | histamine receptor H1 (HRH1), mRNA/cds = (178, 1641) | 1 | ACTTCACACAGACAAGTGGCTAAGTG TCCATTATTTACCTTGAACAATCA |
| 2002 | Table 3A | Hs.83733 | NM_000873 | 10433041 | cDNA FLJ11724 fis, clone HEMBA 1005331/cds = UNKNOWN | 1 | ACAGCCAACTGGAAAGATATAAAAGT TTGGGTCTGTCTCCTCTCCTTCAG |
| 2003 | Table 3A | Hs.82112 | NM_000877 | 4504658 | interleukin 1 receptor, type I (IL1R1), mRNA/cds = (82, 1791) | 1 | ATTAAAGCACCAAATTCATGTACAGC ATGCATCACGGATCAATAGACTGT |
| 2004 | Table 3A | Hs.75596 | NM_000878 | 4504664 | interleukin 2 receptor, beta (IL2RB), mRNA/cds = (131, 1786) | 1 | ATGGAAATTGTATTTGCCTTCTCCACT TTGGGAGGCTCCCACTTCTTGGG |
| 2005 | Table 3A | Hs.2247 | NM_000879 | 4504670 | interleukin 5 (colony-stimulating factor, eosinophil) (IL5), mRNA/cds = (44, 448) | 1 | TCAGAGGGAAAGTAAATATTTCAGGC ATACTGACACTTTGCCAGAAAGCA |
| 2006 | db mining | Hs.72927 | NM_000880 | 4504676 | interleukin 7 (IL7), mRNA/cds = (384, 917) | 1 | GTGTAACACAGTGCCTTCAATAAATG GTATAGCAAATGTTTTGACATGAA |
| 2007 | literature | Hs.673 | NM_000882 | 4504638 | interleukin 12A (natural killer cell stimulatory factor 1, cytotoxic lymphocyte maturation factor 1, p35) (IL12A), mRNA/cds = (169, 828) | 1 | TGGGACTATTACATCCACATGATACC TCTGATCAAGTATTTTTGACATTT |
| 2008 | Table 3A | Hs.75432 | NM_000884 | 4504688 | IMP (inosine monophosphate) dehydrogenase 2 (IMPDH2), mRNA/cds = (47, 1591) | 1 | CATTCGTATGAGAAGCGGCTTTTCTG AAAAGGGATCCAGCACACCTCCTC |
| 2009 | Table 3A | Hs.40034 | NM_000885 | 6006032 | integrin, alpha 4 (antigen CD49D, alpha 4 subunit of VLA-4 receptor) (ITGA4), mRNA/cds = (1151, 4267) | 1 | CTTCAGACTGAACATGTACACCT GGTTTGAGCTTAGTGAAATGACTT CCGG |
| 2010 | Table 3A | Hs.51077 | NM_000887 | 6006014 | integrin, alpha X (antigen CD11C (p150), alpha polypeptide) (ITGAX), mRNA/cds = (56, 3549) | 1 | TTTAAATGTTTGTGTTAATACACATTA AAACATCGCACAAAAACGATGCA |
| 2011 | Table 3A | Hs.1741 | NM_00889 | 4504776 | integrin, beta 7 (ITGB7), mRNA/cds = (151, 2547) | 1 | GCAACCTTGCATCCATCTGGGCTACC CCACCCAAGTATACAATAAAGTCT |
| 2012 | Table 3A | Hs.81118 | NM_000895 | 4505028 | leukotriene A4 hydrolase (LTA4H), mRNA/cds = (68, 1903) | 1 | TGCTGGTGGGGAAAGACTTAAAAGTG GATTAAAGACCTGCGTATTGATGA |
| 2013 | literature | Hs.456 | NM_000897 | 4505040 | leukotriene C4 synthase (LTC4S), mRNA/cds = (96, 548) | 1 | AGGGGCGCTCGCCTTCCGCATCCTAG TCTCTATCATTAAAGTTCTAGTGAC |
| 2014 | Table 3A | Hs.171880 | NM_000937 | 14589948 | polymerase (RNA) II (DNA directed) polypeptide A (220 kD) (POLR2A), mRNA/cds = (386, 6298) | 1 | AGCTGATCCTCGGGAAGAACAAAGCT AAAGCTGCCTTTTGTCTGTTATTT |
| 2015 | Table 3A | Hs.183842 | NM_000942 | 4758949 | ubiquitin B (UBB), mRNA/cds = (94, 783) | 1 | CACAGGCCCATGGACTCACTTTTGTA ACAAACTCCTACCAACACTGACCA |
| 2016 | Table 3A | Hs.74519 | NM_000947 | 4506052 | primase, polypeptide 2A (58 kD) (PRIM2A), mRNA/cds = (87, 1616) | 1 | AGGAGGAGTTTCTATTAAAATCTGTC ACTTGAGTGATGTCATTTAAGTCC |

TABLE 8-continued

| SEQ ID | Origin | Unigene | Locus | GI | Nominal Description | Strand | Probe Sequence |
|---|---|---|---|---|---|---|---|
| 2017 | Table 3A | Hs.199248 | NM_000958 | 4506258 | prostaglandin E receptor 4 (subtype EP4) (PTGER4), mRNA/cds = (388, 1854) | 1 | CCTGTGCAATAGACACATACATGTCA CATTTAGCTGTGCTCAGAAGGGCT |
| 2018 | Table 3A | Hs.199248 | NM_000958 | 4506258 | prostaglandin E receptor 4 (subtype EP4) (PTGER4), mRNA/cds = (388, 1854) | 1 | CCTGTGCAATAGACACATACATGTCA CATTTAGCTGTGCTCAGAAGGGCT |
| 2019 | Table 3A | Hs.250505 | NM_000964 | 4506418 | retinoic acid receptor, alpha (RARA), mRNA/cds = (102, 1490) | 1 | TGCACCTGTTACTGTTGGGCTTTCCA CTGAGATCTACTGGATAAAGAATA |
| 2020 | Table 3A | Hs.119598 | NM_000967 | 4506648 | ribosomal protein L3 (RPL3), mRNA/cds = (6, 1217) | 1 | AAGAAGGAGCTTAATGCCAGGAACA GATTTTGCAGTTGGTGGGGTCTCAA |
| 2021 | Table 3A | Hs.174131 | NM_000970 | 4506656 | ribosomal protein L6 (RPL6), mRNA/cds = (26, 892) | 1 | AGGGCTACCTGCGATCTGTGTTTGCT CTGACGAATGGAATTTATCCTCAC |
| 2022 | Table 3A | Hs.153 | NM_000971 | 4506658 | ribosomal protein L7 (RPL7), mRNA/cds = (10, 756) | 1 | CCATGATTATTTTTCTAAGCTGGTTG GTTAATAAACAGTACCTGCTCTCA |
| 2023 | Table 3A | Hs.99858 | NM_000972 | 4506660 | ribosomal protein L7a (RPL7A), mRNA/cds = (31, 831) | 1 | AAAGGCTAAAGAACTTGCCACTAAAC TGGGTTAAATGTACACTGTTGAGT |
| 2024 | Table 3A | Hs.178551 | NM_000973 | 4506662 | ribosomal protein L8 (RPL8), mRNA/cds = (43, 816) | 1 | GGAACCAAGACTGTGCAGGAGAAAG AGAACTAGTGCTGAGGGCCTCAATA |
| 2025 | Table 3A | Hs.179943 | NM_000975 | 4508594 | ribosomal protein L11 (RPL11), mRNA/cds = (0, 536) | 1 | TGGTTCCAGCAGAAGTATGATGGGAT CATCCTTCCTGGCAAATAAATTCC |
| 2026 | Table 3A | Hs.180842 | NM_000977 | 4506598 | ribosomal protein L13 (RPL13), mRNA/cds = (51, 686) | 1 | TTGGTTGTTTGGTTAGTGACTGATGT AAAACGGTTTTCTTGTGGGGAGGT |
| 2027 | Table 3A | Hs.234518 | NM_000978 | 14591907 | ribosomoal protein L23 (RPL23) | 1 | ATGCTGGCAGCATTGCATGATTCTCC AGTATATTTGTAAAAAATAAAAAA |
| 2028 | Table 3A | Hs.75458 | NM_000979 | 4506606 | ribosomal protein L18 (RPL18), mRNA/cds = (15, 581) | 1 | CGGGCCAGCCGAGGCTACAAAAACT AACCCTGGATCCTACTCTCTTATTA |
| 2029 | Table 3A | Hs.272822 | NM_000981 | 4506608 | RuvB (E. coli homolog)-like 1 (RUVBL1), mRNA/cds = (76, 1446) | 1 | ACCTCCCACTTTGTCTGTACATACTG GCCTCTGTGATTACATAGATCAGC |
| 2030 | Table 3A | Hs.184108 | NM_000982 | 4506610 | ribosomal protein L21 (gene or pseudogene) (RPL21), mRNA/cds = (33, 515) | 1 | TTCAACTAAAGCGCCACCTGCTCCAC CCAGAGAAGCACACTTTGTGAGAA |
| 2031 | Table 3A | Hs.326249 | NM_000983 | 4506612 | ribosomal protein L22 (RPL22), mRNA/cds = (51, 437) | 1 | TTGGAAATCATAGTCAAAGGGCTTCC TTGGTTCGCCACTCATTTATTTGT |
| 2032 | Table 3A | Hs.326249 | NM_000983 | 4506612 | ribosomal protein L22 (RPL22), mRNA/cds = (51, 437) | 1 | TTGGAAATCATAGTCAAAGGGCTTCC TTGGTTCGCCACTCATTTATTTGT |
| 2033 | Table 3A | Hs.184776 | NM_000984 | 4506614 | ribosomal protein L23a (RPL23A), mRNA/cds = (23, 493) | 1 | CCTGATGGAGAGAAGAAGGCATATGT TCGACTGGCTCCTGATTACGATGC |
| 2034 | Table 3A | Hs.82202 | NM_000985 | 14591906 | ribosomal protein L17 (RPL17), mRNA/cds = (286, 840) | 1 | CAGAAGAAACTGAAGAAACAA AAACTTATGGCACGGGAGTAAATT CAGCA |
| 2035 | Table 3A | Hs.184582 | NM_000986 | 4506618 | ribosomal protein L24 (RPL24), mRNA/cds = (39, 512) | 1 | GTTTCAGCTCCCCGAGTTGGTGGAAA ACGCTAAACTGGCAGATTAGATTT |
| 2036 | Table 3A | Hs.192760 | NM_000987 | 4506620 | kinesin family member 5A (KIF5A), mRNA/cds = (148, 3246) | 1 | CTCCTGTTGGGTAAGGGTGTTGAGTG TGACTTGTGCTGAAAACCTGGTTC |
| 2037 | Table 3A | Hs.111611 | NM_000988 | 4506622 | ribosomal protein L27 (RPL27), mRNA/cds = (17, 427) | 1 | GAACAAGTGGTTCTTCCAGAAACTGC GGTTTTAGATGCTTTGTTTTGATC |
| 2038 | Table 3A | Hs.76064 | NM_000990 | 14141189 | ribosomal protein L27a (RPL27A), mRNA/cds = (22, 468) | 1 | GGCTTGAAGCCACATGGAGGGAGTT TCATTAAATGCTAACTACTTTTAAA |
| 2039 | Table 3A | Hs.184014 | NM_000993 | 4506632 | ribosomal protein L31 (RPL31), mRNA/cds = (7, 384) | 1 | ATCTACAGACAGTCAATGTGGATGAG AACTAATCGCTGATCAAATAACGT |
| 2040 | Table 3A | Hs.169793 | NM_000994 | 4506634 | ribosomal protein L32 (RPL32), mRNA/cds = (34, 441) | 1 | GCGCAGTGAAGAAAATGAGTAGGCA GCTCATGTGCACGTTTTCTGTTTAA |
| 2041 | Table 3A | Hs.289093 | NM_000996 | 4506638 | cDNA FLJ11509 fis, clone HEMBA1002166/cds = UNKNOWN | 1 | CAATCTTCCTGCTAAGGCCATTGGAC ACAGAATCCGAGTGATGCTGTACC |
| 2042 | Table 3A | Hs.179779 | NM_000997 | 4506640 | ribosomal protein L37 (RPL37), mRNA/cds = (28, 321) | 1 | GGCAGCTGTTGCAGCATCCAGTTCAT CTTAAGAATGTCAACGATTAGTCA |
| 2043 | Table 3A | Hs.5566 | NM_000998 | 4506642 | ribosomal protein L37a (RPL37A), mRNA/cds = (17, 295) | 1 | AGACGCTCCTCTACCTCTTTGGA GACATCACTGGCCTATAATAAAT GGGTT |
| 2044 | Table 3A | Hs.300141 | NM_001000 | 4506648 | cDNA FLJ14163 fis, clone NT2RP1000409/cds = UNKNOWN | 1 | TCTGTTATGAACACGTTGGTTGGCTG GATTCAGTAATAAATATGTAAGGC |
| 2045 | Table 3A | Hs.119500 | NM_001004 | 4506670 | ribosomal protein, large P2 (RPLP2), mRNA/cds = (74, 421) | 1 | TGAGAAGAAGGAGGAGTCTGAAGAG TCAGATGATGACATGGGATTTGCC |
| 2046 | Table 3A | Hs.155101 | NM_001006 | 4506722 | mRNA for KIAA1578 protein, partial cds/cds = (0, 3608) | 1 | GCTAAAGTTGAACGAGCTGATGGATA TGAACCACCAGTCCAAGAATCTGT |
| 2047 | Table 3A | Hs.180911 | NM_001008 | 4506726 | ribosomal protein S4, Y-linked (RPS4Y), mRNA/cds = (12, 603) | 1 | GCTGGCCACCAAACAGAGCAGTGGC TAAATTGCAGTAGCAGCATATCTTT |
| 2048 | Table 3A | Hs.76194 | NM_001009 | 13904869 | ribosomal protein S5 (RPS5), mRNA/cds = (53, 667) | 1 | GCCAAGTCCAACCGCTGATTTTCCCA GCTGCTGCCCAATAAACCTGTCTG |
| 2049 | Table 3A | Hs.301547 | NM_001011 | 4506740 | ribosomal protein S7 (RPS7), mRNA/cds = (81, 665) | 1 | TGGTGTCTATAAGAAGCTCACGGGCA AGGATGTTAATTTTGAATTCCCAG |
| 2050 | Table 3A | Hs.182740 | NM_001015 | 14277698 | ribosomal protein S11 (RPS11), mRNA/cds = (33, 509) | 1 | AGGCTGGACATCGGCCCGCTCCCCA CAATGAAATAAAGTTATTTCTCAT |
| 2051 | Table 3A | Hs.165590 | NM_001017 | 14591910 | ribosomal protein S13 (RPS13), mRNA/cds = (32, 487) | 1 | CATCTACAGCCTCTGCCCTGGTCGCA TAAATTTGTCTGTGTACTCAAGCA |
| 2052 | Table 3A | Hs.80617 | NM_001020 | 14591912 | ribosomal protein S16 (RPS16), | 1 | CTACCAGAAATCCTACCGATAAGCCC |

TABLE 8-continued

| SEQ ID | Origin | Unigene | Locus | GI | Nominal Description | Strand | Probe Sequence |
|---|---|---|---|---|---|---|---|
| 2053 | Table 3A | Hs.5174 | NM_001021 | 14591913 | ribosomal protein S17 (RPS17), mRNA/cds = (52, 492) | 1 | ATCGTGACTCAAAACTCACTTGTA CTCGGGGACCTGTTTGAATTTTTCT GTAGTGCTGTATTATTTTCAATAA |
| 2054 | Table 3A | Hs.298262 | NM_001022 | 14591914 | ribosomal protein S19 (RPS19), mRNA/cds = (25, 432) | 1 | GCTGCCAACAAGAAGCATTAGAACAA ACCATGCTGGGTTAATAAATTGCC |
| 2055 | Table 3A | Hs.182979 | NM_001024 | 14670385 | cDNA: FLJ22838 fis, clone KAIA4494, highly similar to HUML12A ribosomal protein L12 mRNA/cds = UNKNOWN | 1 | GATGGCATCGTCTCAAAGAACTTTTG ACTGGAGAGAATCACAGATGTGGA |
| 2056 | Table 3A | Hs.182979 | NM_001024 | 14670385 | cDNA: FLJ22838 fis, clone4 KAIA4494, highly similar to HUML12A ribosomal protein L12 mRNA/cds = UNKNOWN | 1 | GATGGCATCGTCTCAAAGAACTTTTG ACTGGAGAGAATCACAGATGTGGA |
| 2057 | Table 3A | Hs.215664 | NM_001025 | 14790142 | DNA for insulin-like growth factor II (IGF-2); exon 7 and additional ORF cds = (0, 233) | 1 | CCAATGTTTCTCTTTTGGCCCTATACA AAGGCAAGAAGGAAAGACCAAGA |
| 2058 | Table 3A | Hs.180450 | NM_001026 | 14916502 | ribosomal protein S24 (RPS24), transcript variant 1, mRNA/ cds = (37, 429) | 1 | CTGGCAAAAAGCCGAAGGAGTAAAG GTGCTGCAATGATGTTAGCTGTGGC |
| 2059 | Table 3A | Hs.113029 | NM_001028 | 1451918 | ribosomal protein S25 (RPS25), mRNA/cds = (63, 440) | 1 | TGGTGAAGATGCATGAATAGGTCCAA CCAGCTGTACATTTGGAAAAATAA |
| 2060 | Table 3A | Hs.539 | NM_001032 | 13904868 | ribosomal protein S29 (RPS29), mRNA/cds = (30, 200) | 1 | GCCAGTGTTTCCGTCAGTACGCGAA GGATATCGGTTTCATTAAGTTGGAC |
| 2061 | Table 3A | Hs.2934 | NM_001033 | 4506748 | ribonucleotide reductase M1 polypeptide (RRM1), mRNA/ cds = (187, 2565) | 1 | GAGTGATAACTCATGAGAAGTACTGA TAGGACCTTTATCTGGATATGGTC |
| 2062 | Table 3A | Hs.172129 | NM_001046 | 4506974 | cDNA: RLJ21409 fis, clone COL03924 cds = UNKNOWN | 1 | GGTGATTCTTCTCTGTTGAACTGAAG TTTGTGAGAGTAGTTTTCCTTTGC |
| 2063 | Table 3A | Hs.256278 | NM_001066 | 4507576 | tumor necrosis factor receptor superfamily, member 1B (TNFRSF1B), mRNA/cds = (89, 1474) | 1 | TGTGTGTTGATCCCAAGACAATGAAA GTTTGCACTGTATGCTGGACGGCA |
| 2064 | literature | Hs.156346 | NM_001067 | 4507632 | topoisomerase (DNA) II alpha (170 kD) (TOP2A), mRNA/cds = (36, 4631) | 1 | GGGGAAGGTGTTTTAGTACAAGACA TCAAAGTGAAGTAAAGCCCAAGTG |
| 2065 | Table 3A | Hs.75248 | NM_001068 | 11225253 | topoisomerase (DNA) II beta (180 kD) (TOP2B), mRNA/cds = (0, 4865) | 1 | AGGAAAACATCCAAAACAACAAG CAAGAAACCGAAGAAGACATCTT TTGA |
| 2066 | Table 3A | Hs.174140 | NM_001096 | 4501864 | ATP citrate lyase (ACLY), mRNA/ cds = (84, 3401) | 1 | AGCTGCCACCTCAGTCTCTTCTCTGT ATTATCATAGTCTGGTTTAAATAA |
| 2067 | Table 3A | Hs.288061 | NM_001101 | 5016088 | actin, beta (ACTB), mRNA/ cds = (73, 1200) | 1 | GGAGGCACCCAGGGCTTACCTGTAC ACTGACTTGAGACCAGTTGAATAAA |
| 2068 | db mining | Hs.150402 | NM_001105 | 10862690 | activin A receptor, type I (ACVR1), mRNA/cds = (340, 1869) | 1 | AGCAAAGATTTCAGTAGAATTTTAGT CCTGAACGCTACGGGGAAAATGCA |
| 2069 | Table 3A | Hs.172028 | NM_001110 | 4557250 | a disintegrin and metalloproteinase domain 10 (ADAM10), mRNA/ cds = (469, 2715) | 1 | TGGTGGTATTCAGTGGTCCAGGATTC TGTAATGCTTTACACAGGCAGTTT |
| 2070 | Table 3A | Hs.7957 | NM_001111 | 7669471 | adenosine deaminase, RNA-specific (ADAR), transcript variant ADAR-a, mRNA/cds = (187, 3867) | 1 | TGCTTTTATGTGTCCCTTGATAACAGT GACTTAACAATATACATTCCTCA |
| 2071 | Table 3A | Hs.172199 | NM_001114 | 4557254 | adenylate cyclase 7 (ADCY7), mRNA/ cds = (265, 3507) | 1 | TTGTTTCAAAATGCTGTTTCATTTTA TAAAGTACCAGTGTTTAGCTGCT |
| 2072 | Table 3A | Hs.3416 | NM_001122 | 4557260 | adipose differentiation-related protein (ADFP), mRNA/cds = (0, 1313) | 1 | AGAGATGGACAAGAGCAGCCAGGAG ACCCAGCGATCTGAGCATAAAACTC |
| 2073 | literature | Hs.394 | NM_001124 | 4501944 | adrenomedulin (ADM), mRNA/ cds = (156, 713) | 1 | TGAAAGAGAAAGACTGATTACCTCCT GTGTGGAAGAAGGAAACACCGAGT |
| 2074 | literature | Hs.278398 | NM_001151 | 4502096 | DNA sequence from clone RP1-202D23 on chromosome 6q14.1-15 Contains part of the gene for N-acetylglucosamine-phosphate mutase. part of a gene for a novel protein, ESTs, STSs and GSSs/cds = (0, 5916) | 1 | GGAATACCTCCAGAAGAGATGCT TCATTGAGTGTTCATTAAACCACA CATG |
| 2075 | Table 3A | Hs.300711 | NM_001154 | 4809273 | annexin A5 (ANXA5), mRNA/ cds = (192, 1154) | 1 | ACCATGATACTTTAATTAGAAGCTTAG CCTTGAAATTGTGAACTCTTGGA |
| 2076 | Table 3A | Hs.300711 | NM_001154 | 4809273 | annexin A5 (ANXA5), mRNA/ cds = (192, 1154) | 1 | ACCATGATACTTTAATTAGAAGCTTAG CCTTGAAATTGTGAACTCTTGGA |
| 2077 | Table 3A | Hs.118796 | NM_001155 | 4809274 | annexin A6 (ANXA6), transcript variant 1, mRNA/cds = (170, 2191) | 1 | GCCTCTGCCCTGGTTTGGCTATGTCA GATCCAATAAACATCCTGAACCTC |
| 2078 | Table 3A | Hs.75510 | NM_001157 | 4557316 | annexin A11 (ANXA11), mRNA/ cds = (178, 1695) | 1 | TGCCTTTTCTACCCCATCCCTCACAG CCTCTTGCTGCTAAAATAGATGTT |
| 2079 | Table 3A | Hs.14142 | NM_001161 | 4502124 | nudix (nucleoside diphosphate linked moiety X)-type motif 2 (NUDT2), mRNA/cds = (174, 617) | 1 | GGCCAGGCCCAAGTAAGTGTACCTT GTACTTTATAAATAAACCTCAAGCA |
| 2080 | Table 3A | Hs.289107 | NM_001166 | 10880127 | baculoviral IAP repeat containing 2 (BIRC2), mRNA/cds = (1159, 3015) | 1 | GCCGAATTGTCTTTGGTGCTTTTCAC TTGTGTTTTAAAATAAGGATTTTT |
| 2081 | Table 3A | Hs.83656 | NM_001175 | 10835001 | Rho GDP dissociation inhibitor (GDI) beta (ARHGDIB), mRNA/ cds = (152, 757) | 1 | CCCCTGCCAGAGGGAGTTCTTCTTTT GTGAGAGACACTGTAAACGACACA |
| 2082 | Table 3A | Hs.74515 | NM_001178 | 4502232 | aryl hydrocarbon receptor nuclear | 1 | AGAAGTCCCCCATGTGGATATTCTT |

TABLE 8-continued

| SEQ ID | Origin | Unigene | Locus | GI | Nominal Description | Strand | Probe Sequence |
|---|---|---|---|---|---|---|---|
| | | | | | translocator-like (ARNTL), mRNA/ cds = (145, 1896) | 1 | ATACTAATTGTATCATAAAGCCGT |
| 2083 | Table 3A | Hs.6551 | NM_001183 | 4557340 | ATPase, H+ transporting, lysosomal (vacuolar proton pump), subunit 1 (ATP6S1), mRNA/cds = (1353, 2198) | 1 | GGGCAGGAGCATGGGGTGCTTGGTT GTTTCCTTCCTAATAAAATAAACGC |
| 2084 | literature | Hs.77613 | NM_001184 | 4502324 | ataxia telangiectasia and Rad3 related (ATR), mRNA/cds = (79, 8013) | 1 | ATGCATTTGGTATGAATCTGTGGTTG TATCTGTTCAATTCTAAAGTACAA |
| 2085 | literature | Hs.2556 | NM_001192 | 4507572 | tumor necrosis factor receptor superfamily, member 17 (TNFRSF17), mRNA/cds = (218, 772) | 1 | TTCTCTAGGTTACTGTTGGGAGCTTA ATGGTAGAAACTTCCTTGGTTTCA |
| 2086 | literature | Hs.158303 | NM_001198 | 4557362 | PR domain containing 1, with ZNF domain (PRDM1), mRNA/ cds = (223, 2592) | 1 | CCTCCCAGCAACCCACTACCTCTGGT ACCTGTAAAGGTCAAACAAGAAAC |
| 2087 | db mining | Hs.87223 | NM_001203 | 4502430 | bone morphogenetic protein receptor, type IB (BMPR1B), mRNA/ cds = (273, 1781) | 1 | CCGTGTCTGTTTGTAGGCGGAGAAAC CGTTGGGTAACTTGTTCAAGATAT |
| 2088 | Table 3A | Hs.53250 | NM_001204 | 4755129 | bone morphogenetic protein receptor, type II (serine/threonine kinase) (BMPR2), mRNA/cds = (408, 3524) | 1 | TGAGGGTGAGGGCAGGCTGAGGCAA CGAGTGGGAGGTTCAAACAAGAGTG |
| 2089 | Table 3A | Hs.101025 | NM_001207 | 4502464 | basic transcription factor 3 (BTF3), mRNA/cds = (0, 476) | 1 | CCCAAACAATCTGTGGATGGAAAAGC ACCACTTGCTACTGGAGAGGATGA |
| 2090 | Table 3A | Hs.321247 | NM_001225 | 4502576 | mRNA: cDNA DKFZp586A181 (from clone DKFZp586A181): partial cds/ cds = (0, 314) | 1 | AATCAACTTCAAGGAGCACCTTCATT AGTACAGCTTGCATATTTAACATT |
| 2091 | db mining | Hs.19949 | NM_001228 | 4502582 | mRNA for MACH-alpha-1 protein cds = (291, 1730) | 1 | AGGCGATGATATTCTCACCATCCTGA CTGAAGTGAACTATGAAGTAAGCA |
| 2092 | literature | Hs.514 | NM_001239 | 4502622 | cyclin H (CCNH), mRNA/ cds = (60, 1031) | 1 | TGACGACCTGGTAGAATCTCTCTAAC CATTTGAAGTTGATTCTCAATGC |
| 2093 | Table 3A | Hs.180841 | NM_001242 | 4507586 | tumor necrosis factor receptor superfamily, member 7 (TNFRSF7), mRNA/cds = (100, 882) | 1 | GCTGCGAAAGACCCACATGCTACAA GACGGGCAAAATAAAGTGACAGATG |
| 2094 | Table 3A | Hs.1314 | NM_001243 | 4507588 | tumor necrosis factor receptor superfamily, member 8 (TNFRSF8), mRNA/cds = (222, 2009) | 1 | CGCCCATGATGGGAGGGATTGACAT GTTTCAACAAAATAATGCACTTCCT |
| 2095 | literature | Hs.1313 | NM_001244 | 4507606 | tumor necrosis factor (ligand) superfamily, member 8 (TNFSF8), mRNA/cds = (114, 818) | 1 | TCTTTCAGATAGCAGGCAGGGAAGCA ATGTAGTGTGGTGGGCAGAGCCCC |
| 2096 | db mining | Hs.25648 | NM_001250 | 4507580 | tumor necrosis factor receptor superfamily, member 5 (TNFSF5), mRNA/cds = (47, 880) | 1 | CAGGAGGATGGCAAAGAGAGTCGCA TCTCAGTGCAGGAGAGACAGTGAGG |
| 2097 | Table 3A | Hs.99899 | NM_001252 | 4507604 | tumor necrosis factor (ligand) superfamily, member 7 (TNFSF7), mRNA/cds = (137, 718) | 1 | GGGGGTAGTGGTGGCAGGACAAGAG AAGGCATTGAGCTTTTCTTTCATT |
| 2098 | db mining | Hs.76688 | NM_001266 | 7262373 | carboxylesterase 1 (monocyte.macrophage serine esterase 1) (CES1), mRNA/ cds = (67, 1767) | 1 | GCCATGAAGGAGCAAGTTTTGTATTT GTGACCTCAGCTTTGGGAATAAAG |
| 2099 | Table 3A | Hs.22670 | NM_001270 | 4557446 | chromodomain helicase DNA binding protein 1 (CHD1), mRNA/ cds = (163, 5292) | 1 | GCTACTTGTTTACATTGTACACTGCG ACCACCTTGCCGCTTTTCATCACA |
| 2100 | literature | Hs.20295 | NM_001274 | 4502802 | CHK1 (checkpoint, S. pombe) homolog (CHEK1), mRNA/cds = (34, 1464) | 1 | ACCAAGTTTCAGGGGACATGAGTTTT CCAGCTTTTATACACACGTATCTC |
| 2101 | db mining | Hs.306440 | NM_001278 | 4502642 | mRNA; cDNA DKFZp566L084 (from clone DKFZp566L084)/ cds = UNKNOWN | 1 | GGCAAATGAGGAACAGGGCAATAGT ATGATGAATCTTGATTGGAGTTGGT |
| 2102 | Table 3A | Hs.301921 | NM_001295 | 4502630 | chemokine (C—C motif) receptor 1 (CCR1), mRNA/cds = (62, 1129) | 1 | TGTTCTTCATCTAAGCCTTCTGGTTTT ATGGGTCAGAGTTCCGACTGCCA |
| 2103 | Table 3A | Hs.285313 | NM_001300 | 9961348 | core promoter element binding protein (COPEB) | 1 | TATACCATGAGATGAGATGACCACCA ATCATTTCCTTGGGGGGAGGGGGT |
| 2104 | Table 3A | Hs.90073 | NM_001316 | 4503072 | chromosome segregation 1 (yeast homolog)-like (CSE1L), mRNA/ cds = (123, 3038) | 1 | CCTAGGAAATCACAGGCTTCTGAGCA CAGCTGCATTAAAACAAAGGAAGT |
| 2105 | Table 3A | Hs.82890 | NM_001344 | 4503252 | defender against cell death 1 (DAD1), mRNA/cds = (66, 407) | 1 | AAATGTAACCTTTTGCTTTCCAAATTA AAGAACTCCATGCCACTCCTCAA |
| 2106 | Table 3A | Hs.172690 | NM_001345 | 11415023 | diacylglycerol kinase, alpha (80 kD) (DGKA), mRNA/cds = (103, 2310) | 1 | ACACACATACACACACCCCAAAACAC ATACATTGAAAGTGCCTCATCTGA |
| 2107 | Table 3A | Hs.301305 | NM_001352 | 4503262 | Homo sapiens, clone MGC:13202 IMAGE:3877838, mRNA, complete cds/cds = (366, 2330) | 1 | GACCCTATCCTCCCACCGCCTCCGTT AACACGATCCTGAATAAATCTTGA |
| 2108 | Table 3A | Hs.306098 | NM_001353 | 5453542 | aldo-keto reductase family 1, member C1 (dihydrodiol dehydrogenase 1: 20-alpha (3-alpha)-hydroxysteroid dehydrogenase) (AKR1C1), mRNA/ cds = (6, 977) | 1 | ACAGCAAAGCCCATTGGCCAGAAAG GAAAGACAATAATTTTGTTTTTTCA |
| 2109 | Table 3A | Hs.74578 | NM_001357 | 13514819 | DEAD/H (Asp-Glu-Ala-Asp/His) box polypeptide 9 (RNA helicase A, nuclear | 1 | AAGGAGTAAAGATTTGCCTTTAAATA ACTTGGTATTTTCCTGGCTTTCGT |

TABLE 8-continued

| SEQ ID | Origin | Unigene | Locus | GI | Nominal Description | Strand | Probe Sequence |
|---|---|---|---|---|---|---|---|
| | | | | | DNA helicase II; leukophysin) (DDX9), transcript variant 1, mRNA/cds = (80, 3919) | | |
| 2110 | Table 3A | Hs.4747 | NM_001383 | 4503336 | dyskeratosis congenita 1, dyskerin (DKC1), mRNA/cds = (92, 1636) | 1 | GGCCTCGTTTACTTTTAAAAAATGAAA TTGTTCATTGCTGGGAGAAGAAT |
| 2111 | Table 3A | Hs.77462 | NM_001379 | 4503350 | DNA (cytosine-5-)methyltransferase 1 (DNMT1), mRNA/cds = (237, 5087) | 1 | TCAACTAATGATTTAGTGATCAAATTG TGCAGTACTTTGTGCATTCTGGA |
| 2112 | Table 3A | Hs.154210 | NM_001400 | 13027635 | endothelial differentiation, sphingolipid G-protein-coupled receptor, 1 (EDG1), mRNA/cds = (243, 1391) | 1 | TAGGTTTCTGACTTTTGTGGATCATTT TGCACATAGCTTTATCAACTTTT |
| 2113 | Table 3A | Hs.274488 | NM_001403 | 4503472 | eukaryotic translation elongation factor 1 alpha 1-like 14 (EEF1A1L14), mRNA/cds = (620, 1816) | 1 | AAATCAGTACTTTTAATGGAAACAAC TTGACCCCCAAATTTGTCACAGA |
| 2114 | Table 3A | Hs.2186 | NM_001404 | 4503480 | *Homo sapiens*, eukaryotic translation elongation factor 1 gamma, clone MGC:4501 IMAGE:2964823, mRNA, complete cds/cds = (2278, 3231) | 1 | AGATCTTCAAGTGAACATCTCTTGCC ATCACCTAGCTGCCTGCACCTGCC |
| 2115 | Table 3A | Hs.129673 | NM_001416 | 4503528 | eukaryotic translation initiation factor 4A, isoform 1 (EIF4A1), mRNA/cds = (16, 1236) | 1 | CAGGAGGGGGAGGGAAGGGAGCC AAGGGATGGACATCTTGTCATTTTTT |
| 2116 | Table 3A | Hs.93379 | NM_001417 | 4503532 | eukaryotic translation initiation factor 4B (EIF4B), mRNA/cds = (0, 1835) | 1 | GCAAGTATGCTGCTCTCTCTGTTGAT GGTGAAGATGAAAATGAGGGAGAA |
| 2117 | Table 3A | Hs.183684 | NM_001418 | 4503538 | eukaryotic translation initiation factor 4 gamma, 2 (EIF4G2), mRNA/cds = (306, 3029) | 1 | TTGTGGGTGTGAAACAAATGGTGAGA ATTTGAATTGGTCCCTCCTATTAT |
| 2118 | Table 3A | Hs.229533 | NM_001420 | 5231299 | ol06d12.s1 cDNA, 3' end/clone = IMAGE:1522679/clone_end = 3' | 1 | AAAGGGAAAAAGACCTCGTGGA GAATTTTTACTGGGGATTCTTGAA CTTG |
| 2119 | Table 3A | Hs.151139 | NM_001421 | 4503554 | E74-like factor 4 (els domain transcription factor) (ELF4), mRNA/cds = (382, 2373) | 1 | AAATGTATTTACTATGCGTGTTTCCAG CAGTTGGCATTAAAGTGCCTTTT |
| 2120 | Table 3A | Hs.79368 | NM_001423 | 4503558 | epithelial membrane protein 1 (EMP1), mRNA/cds = (218, 691) | 1 | ATTTGCATTACTCTGGTGGATTGTTCT AGTACTGTATTGGGCTTCTTCGT |
| 2121 | Table 3A | Hs.9999 | NM_001425 | 4503562 | epithelial membrane protein 3 (EMP3), mRNA/cds = (241, 732) | 1 | GAGGAGGTCTCTTCTATGCCACCGG CCTCTGCCAGCTTTGCACCAGCGTG |
| 2122 | Table 3A | Hs.254105 | NM_001428 | 4503570 | enolase 1, (alpha) (ENO1), mRNA/cds = (94, 1398) | 1 | GCTAGATCCCCGGTGGTTTTGTGCTC AAAATAAAAAGCCTCAGTGACCCA |
| 2123 | Table 3A | Hs.115263 | NM_001432 | 4557566 | epiregulin (EREG), mRNA/cds = (166, 675) | 1 | TTTGAAGAGCCATTTTGGTAAACGGT TTTTATTAAAGATGCTATGGAACA |
| 2124 | Table 3A | Hs.99853 | NM_001436 | 12056464 | fibrillarin (FBL), mRNA/cds = (59, 1024) | 1 | GTCAGGATTGCGAGAGATGTGTGTTG ATACTGTTGCACGTGTGTTTTCT |
| 2125 | Table 3A | Hs.153179 | NM_001444 | 4557580 | fatty acid binding protein 5 (psoriasis-associated) (FABP5), mRNA/cds = (48, 455) | 1 | CATGCAGCTATTTCAAAGTGTGTTGG ATTAATTAGGATCATCCCTTTGGT |
| 2126 | Table 3A | Hs.14845 | NM_001455 | 4503738 | forkhead box O3A (FOXO3A), mRNA/cds = (924, 2945) | 1 | TAATGGCCCCTTACCCTGGGTGAAGC ACTTACCCTTGGAACAGAACTCTA |
| 2127 | Table 3A | Hs.428 | NM_001459 | 4503750 | fms-related tyrosine kinase 3 ligand (FLT3LG), mRNA/cds = (92, 799) | 1 | AAGGCCTCATCCTGGGGAGGATACG TAGGCACACAGAGGGGAGTCACCAG |
| 2128 | Table 3A | Hs.99855 | NM_001462 | 4503780 | formyl peptide receptor-like 1 (FPRL1), mRNA/cds = (772, 1827) | 1 | TGGGGTAAGTGGAGTTGGGAAATAC AAGAAGAGAAAGACCAGTGGGGATT |
| 2129 | Table 3A | Hs.58435 | NM_001465 | 4503820 | FYN-binding protein (FYB-120/130) (FYB), mRNA/cds = (30, 2381) | 1 | ACCTAGCGGACAATGATGGAGAGAT CTATGATGATATTGCTGATGGCTGC |
| 2130 | Table 3A | Hs.197345 | NM_001469 | 4503840 | thyroid autoantigen 70 kD (Ku antigen) (G22P1), mRNA/cds = (17, 1846) | 1 | GTGATGGTGTAGCCCTCCCACTTTGC TGTTCCTTACTTTACTGCCTGAAT |
| 2131 | Table 3A | Hs.56845 | NM_001494 | 6598322 | GDP dissociation inhibitor 2 (GDI2), mRNA/cds = (152, 1489) | 1 | GCCTCTACTTCTGTCTCAAAATGGCT CCAAATGATTTCTGTACTGCAAAA |
| 2132 | Table 3A | Hs.272529 | NM_001503 | 4504088 | glycosylphosphatidylinositol specific phospholipase D1 (GPLD1), mRNA/cds = (32, 2557) | 1 | TCTCCTTCCACAGTTTATTTCCTGCT TCCTTTGCATCTAAACCTTTCTT |
| 2133 | literature | Hs.191356 | NM_001515 | 6681761 | general transcription factor IIH, polypeptide 2 (44 kD subunit) (GTF2H2), mRNA/cds = (0, 1187) | 1 | ACACTGTTGCCCTGGCTGTATTCATA AGATTCCAGCTCCTTCAGGTGTTT |
| 2134 | literature | Hs.90304 | NM_001516 | 4504198 | general transcription factor IIH, polypeptide 3 (34 kD subunit) (GTF2H3), mRNA/cds = (0, 911) | 1 | GTCAATATTCTGCAATTTCAGCCCCA TTTGTACTACGTGCGAGACAGCCT |
| 2135 | literature | Hs.102910 | NM_001517 | 4504200 | general transcription factor IIH, polypeptide 4 (52 kD subunit) (GTF2H4), mRNA/cds = (127, 1515) | 1 | GGCGGGACTGGGCGGGGCGGGGCA TCAGAACTCAGGTGTTTTTTATTTAC |
| 2136 | Table 3A | Hs.187540 | NM_001530 | 4504384 | hypoxia-inducible factor 1, alpha subunit (basic helix-loop-helix transcription factor) (HIF1A), mRNA/cds = (264, 2744) | 1 | TTCCTTTTGCTCTTTGTGGTTGGATCT AACACTAACTGTATTGTTTTGTT |
| 2137 | Table 3A | Hs.235887 | NM_001535 | 4504494 | HMT1 (hnRNP methyltransferase, *S. cerevisiae*)-like 1 (HRMT1L1), mRNA/cds = 165, 1466) | 1 | ACGTCTTCCAAATAAATTATGTGTTG GTGCCATCGCACATGCTCAATAAA |
| 2138 | Table 3A | Hs.94 | NM_001539 | 4504510 | heat shock protein, DNAJ-like 2 | 1 | AGGTGGTGTTCAGTGTCACACCTCTT |

TABLE 8-continued

| SEQ ID | Origin | Unigene | Locus | GI | Nominal Description | Strand | Probe Sequence |
|---|---|---|---|---|---|---|---|
| 2139 | Table 3A | Hs.20315 | NM_001548 | 4504584 | (HSJ2), mRNA/cds = (82, 1275) interferon-induced protein with tetratricopeptide repeats 1 (IFIT1), mRNA/cds = (64, 1500) | 1 | AATGGCCAGTGAATAACACTCACT CTGAGACTGGCTGCTGACTTTGAGAA CTCTGTGAGACAAGGTCCTTAGGC |
| 2140 | Table 3A | Hs.181874 | NM_001549 | 4504588 | interferon-induced protein with tetratricopeptide repeats 4 (IFIT4), mRNA/cds = (61, 1533) | 1 | GCAGGGAAGCTTTGCATGTTGCTCTA AGGTACATTTTTAAAGAGTTGTTT |
| 2141 | Table 3A | Hs.7879 | NM_001550 | 4504606 | interferon-related developmental regulator 1 (IFRD1), mRNA/cds = (219, 1580) | 1 | CGAACCAAAGCTAGAAGCAAATGTCG AGATAAGAGAGCAGATGTTGGAGA |
| 2142 | Table 3A | Hs.239189 | NM_001551 | 4557882 | glutaminase (GLS), mRNA/cds = (19, 2028) | 1 | GGAAGGAAAAGAGTGCTGAGAAATG GCTCTGTATAATCTATGGCTATCCG |
| 2143 | db mining | Hs.846 | NM_001557 | 4504682 | interleukin 8 receptor, beta (IL8RB), mRNA/cds = (408, 1490) | 1 | ACCAAGGCTAGAACCACCTGCCTATA TTTTTTGTTAAATGATTTCATTCA |
| 2144 | Table 3A | Hs.327 | NM_001558 | 4504632 | interleukin 10 receptor, alpha (IL10RA), mRNA/cds = (61, 1797) | 1 | CCTCTGCCAAAGTACTCTTAGGTGCC AGTCTGGTAACTGAACTCCCTCTG |
| 2145 | literature | Hs.73895 | NM_001561 | 5730094 | tumor necrosis factor receptor superfamily, member 9 (TNFRSF9), mRNA/cds = (139, 906) | 1 | AAAATAATGCACCACTTTTAACAGAA CAGACAGATGAGGACAGAGCTGGT |
| 2146 | Table 3A | Hs.83077 | NM_001562 | 4504652 | interleukin 18 (interferon-gamma-inducing factor) (IL18), mRNA/cds = (177, 758) | 1 | GAATTGGGGGATAGATCTATAATGTT CACTGTTCAAAACGAAGACTAGCT |
| 2147 | Table 3A | Hs.107153 | NM_001564 | 4504694 | inhibitor of growth family, member 1-like (ING1L), mRNA/cds = (91, 933) | 1 | CCGTTTGCTTTCAGAAAATGTTTTAG GGTAAATGCATAAGACTATGCAAT |
| 2148 | Table 3A | Hs.2248 | NM_001565 | 4504700 | small inducible cytokine subfamily B (Cys-X-Cys), member 10 (SCYBI0), mRNA/cds = (66, 362) | 1 | CCCAAATTCTTTCAGTGGCTACCTAC ATACAATTCCAAACACATACAGGA |
| 2149 | Table 3A | Hs.32944 | NM_001566 | 4504704 | inositol polyphosphate-4-phosphatase, type I, 107 kD (INPP4A), transcript variant b. mRNA/cds = (294, 3158) | 1 | AAATTAATAAGTCACAAGAAAAA CAAAAGTGCCAGAAGATGTCCAG CCAC |
| 2150 | Table 3A | Hs.106673 | NM_001568 | 4503520 | eukaryotic translation initiation factor 3, subunit 6 (48 kD) (EIF3S6), mRNA/cds = (22, 1359) | 1 | AGAGGCTCCTAACTGGGCAACTCAA GATTCTGGCTTCTACTGAAGAACCA |
| 2151 | Table 3A | Hs.14376 | NM_001614 | 11038618 | actin, gamma 1 (ACTG1), mRNA/cds = (74, 1201) | 1 | GGTTTTCTACTGTTATGTGAGAACATT AGGCCCCAGCAACACGTCATTGT |
| 2152 | Table 3A | Hs.83636 | NM_001619 | 6138971 | adrenergic, beta, receptor kinase 1 (ADRBK1), mRNA/cds = (85, 2154) | 1 | CAGCTTCTGCCACTTCCCAGGTAAGC AGGAGGAGGTGCCAACAGTGTTAG |
| 2153 | Table 3A | Hs.170087 | NM_001621 | 5016091 | aryl hydrocarbon receptor (AHR), mRNA/cds = (643, 3189) | 1 | ACCATTTTTGTTACTCCTCTTCCA CATGTTACTGGATAAATTGTTTA GTGG |
| 2154 | Table 3A | Hs.75313 | NM_001628 | 4502048 | aldo-keto reductase family 1, member B1 (aldose reductase) (AKR1B1), mRNA/cds = (45, 995) | 1 | GTGCCACTAACGGTTGAGTTTTGACT GCTTGGAACTGGAATCCTTTCAGC |
| 2155 | Table 3A | Hs.100194 | NM_001629 | 4502058 | arachidonate 5-lipoxygenase-activating protein (ALOX5AP), mRNA/cds = (30, 515) | 1 | TCTCCACCACCATCTCCCCTCTACTT CTCATTTCCTAACTCTCTGCTGAA |
| 2156 | Table 3A | Hs.262476 | NM_001634 | 5209326 | S-adenosylmethionine decarboxylase 1 (AMD1), mRNA/cds = (320, 1324) | 1 | GGTGTTGGACTTAAATCAGTTGAAAT GTATTTCTGTACCACAATTTACGC |
| 2157 | Table 3A | Hs.82542 | NM_001637 | 4502114 | acyloxyacyl hydrolase (neutrophil) (AOAH), mRNA/cds = (274, 2001) | 1 | CCCTTCCGCTGTTCCTGAAATAACCT TTCATAAAGTGCTTTGGGTGCCAT |
| 2158 | Table 3A | Hs.73722 | NM_001641 | 4502136 | APEX nuclease (multifunctional DNA repair enzyme) (APEX), mRNA/cds = (205, 1161) | 1 | TTCTCATGTATAAAACTAGGAATCCTC CAACCAGGCTCCTGTGATAGAGT |
| 2159 | literature | Hs.288850 | NM_001650 | 4755123 | aquaporin 4 (AQP4), transcript variant a. mRNA/cds = (39, 1010) | 1 | AGACACGTCTATCAGCTTATTCCTTC TCTACTGGAATATTGGTATAGTCA |
| 2160 | Table 3A | Hs.792 | NM_001656 | 4502196 | ADP-ribosylation factor domain protein 1, 64 kD (ARFD1), mRNA/cds = (22, 1746) | 1 | TGTCTGGTAACAAGATGTGACTTTTT GGTAGCACTGTTGTGGTTCATTCT |
| 2161 | Table 3A | Hs.270833 | NM_001657 | 4502198 | amphiregulin (schwannoma-derived growth factor) (AREG), mRNA/cds = (209, 967) | 1 | TCCTCTTTCCAGTGGATCATAAGACA ATGGACCCTTTTTGTTATGATGGT |
| 2162 | literature | Hs.74571 | NM_001658 | 6995997 | ADP-ribosylation factor 1 (ARF1), mRNA/cds = (75, 620) | 1 | ACTGTTTTGTATACTTGTTTTCAGTTT TCATTTCGACAAACAAGCACTGT |
| 2163 | literature | Hs.183153 | NM_001661 | 4502206 | ADP-ribosylation factor 4-like (ARF4L), mRNA/cds = (158, 761) | 1 | ACATAGTTTTTATTTTTGTGTCTGTGA AAGTGCCAAGAACCCCTCCCCAC |
| 2164 | Table 3A | Hs.77273 | NM_001664 | 10835048 | ras homolog gene family, member A (ARHA), mRNA/cds = (151, 732) | 1 | TCACCTGGACTTAAGCGTCTGGCTCT AATTCACAGTGCTCTTTCTCCTCA |
| 2165 | Table 3A | Hs.3109 | NM_001666 | 11386132 | Rho GTPase activating protein 4 (ARHGAP4), mRNA/cds = (42, 2882) | 1 | AGATGCCTGGCAGGGCTGGGTGGCG ATTCATAAAGACCTCGTGTTGATTC |
| 2166 | Table 3A | Hs.181243 | NM_001675 | 4502264 | activating transcription factor 4 (tax-responsive enhancer element B67) (ATF4), mRNA/cds = (881, 1936) | 1 | GGATAGTCAGGAGCGTCAATGTGCTT GTACATAGAGTGCTGTAGCTGTGT |
| 2167 | Table 3A | Hs.76941 | NM_001679 | 4502280 | ATPase, Na+/K+ transporting, beta 3 polypeptide (ATP1B3), mRNA/cds = (0, 839) | 1 | TTGTGAAATATCTTGTTACTGCTTTTA TTTAGCAGACTGTGGACTGTAAT |
| 2168 | Table 3A | Hs.73851 | NM_001685 | 4502292 | ATP synthase, H+ transporting, | 1 | CTGGAGGACCTGTTGATGCTAGTTCA |

TABLE 8-continued

| SEQ ID | Origin | Unigene | Locus | GI | Nominal Description | Strand | Probe Sequence |
|---|---|---|---|---|---|---|---|
| | | | | | mitochondrial F0 complex, subunit F6 (ATP5J), mRNA/cds = (1, 327) | | GAGTATCACCAAGAGCTGGAGAGG |
| 2169 | Table 3A | Hs.8110 | NM_001686 | 4502294 | L-3-hydroxyacyl-Coenzyme A dehydrogenase, short chain (HADHSC), mRNA/cds = (87, 1031) | 1 | GCTGCACAAGAGCCTTGATTGAAGAT ATATTCTTTCTGAACAGTATTTAA |
| 2170 | Table 3A | Hs.81634 | NM_001688 | 4502298 | ATP synthase, H+ transporting, mitochondrial F0 complex, subunit b, isoform 1 (ATP5F1), mRNA/cds = (32, 802) | 1 | TTGCCTTTATAAAAACTTGCTGCCTG ACTAAAGATTAACAGGTTATAGTT |
| 2171 | Table 3A | Hs.1697 | NM_001693 | 4502310 | ATPase, H+ transporting, lysosomal (vacuolar proton pump), beta polypeptide, 56/58 kD, isoform 2 (ATP6B2), mRNA/cds = (25, 1560) | 1 | TGGTTCTGCTTTTTGACCTCTCTCTAC CTTTTCAGGGTAATCTTTGTGGC |
| 2172 | Table 3A | Hs.86905 | NM_001695 | 4502314 | ATPase, H+ transporting, lysosomal (vacuolar proton pump) 42 kD (ATP6C), mRNA/cds = (166, 1314) | 1 | CCTGTCCTTGTGTTTGTGTGTGCTAA CAGAAATAAGTTGCAGTATGGTCG |
| 2173 | Table 3A | Hs.76572 | NM_001697 | 4502302 | ATP synthase, H+ transporting, mitochondrial F1 complex, O subunit (oligomycin sensitivity conferring protein) (ATP5O), mRNA/cds = (36, 677) | 1 | AAAAGTGTTGGTTTTCTGCCATCAGT GAAAATTCTTAAACTTGGAGCAAC |
| 2174 | db mining | Hs.155024 | NM_001706 | 4502382 | B-cell CLL/lymphoma 6 (zinc finger protein 51) (BCL6), mRNA/cds = (327, 2447) | 1 | AGGGTTTGGCTGTGTCTAAACTGCAT TACCGCGTTGTAAAAAAATAGCTGT |
| 2175 | literature | Hs.2243 | NM_001715 | 4502412 | B lymphoid tyrosine kinase (BLK), mRNA/cds = (222, 1739) | 1 | CCTAGGCTGCGCTCCAGCACTGCGG GGCTTTTCTGCAATAAAGTCACGAG |
| 2176 | literature | Hs.113916 | NM_001716 | 14589867 | Burkitt lymphoma receptor 1, GTP-binding protein (BLR1), transcript variant 2, mRNA/cds = (268, 1271) | 1 | GGCAGCACAGAGACCCCCGGAACAA GCCTAAAAATTGTTTCAAAATAAAA |
| 2177 | Table 3A | Hs.77054 | NM_001731 | 4502472 | B-cell translocation gene 1, anti-proliferative (BTG1), mRNA/cds = (308, 823) | 1 | AAGTCTTTTCCACAAACCACCATCTAT TTTGTGAACTTTGTTTAGTCATCT |
| 2178 | db mining | Hs.263812 | NM_001736 | 4502508 | nuclear distribution gene C (A. nidulans) homolog (NUDC), mRNA/cds = (90, 1085) | 1 | TGGCAAGTTGGAAAATATGTAACTGG AATCTCAAAAGTTCTTTGGGACAA |
| 2179 | Table 3A | Hs.182278 | NM_001743 | 4502548 | Homo sapiens, calmodulin 2 (phosphorylase kinase, delta), clone MGC:1447 IMAGE:3504793, mRNA, complete cds/cds = (93, 542) | 1 | TCTGCTTATGGCACAATTTGCCTCAA ATCCATTCCAAGTTGTATATTTGT |
| 2180 | Table 3A | Hs.155560 | NM_001746 | 10716562 | calnexin (CANX), mRNA/cds = (89, 1867) | 1 | CCATTGTTGTCAAATGCCCAGTGTCC ATCAGATGTGTTCCTCCATTTTCT |
| 2181 | Table 3A | Hs.76288 | NM_001748 | 12408845 | calpain 2, (m/II) large subunit (CAPN2), mRNA/cds = (14, 2244) | 1 | GCTGCCTCTGTAAATTCATGTATTCA AAGGCAAAAGACACCTTGCCTATAA |
| 2182 | Table 3A | Hs.279607 | NM_001750 | 5729759 | calpastatin (CAST), mRNA/cds = (66, 1358) | 1 | TCAAGTCAGCAACAGAGCAAAATAAA GGTTAGATAAGTCCTTGTGTAGCA |
| 2183 | Table 3A | Hs.179881 | NM_001755 | 13124872 | core-binding factor, beta subunit (CBFB), transcript variant 2, mRNA/cds = (11, 559) | 1 | CTTGCCTTAAGCTACCAGATTGCTTT TGCCACCATTGGCCATACTGTGTG |
| 2184 | Table 3A | Hs.75586 | NM_001759 | 4502616 | cyclin D2 (CCND2), mRNA/cds = (269, 1138) | 1 | TGGTTTTGAATGCAATTAGGTTATGC TATTTGGACAATAAACTCACCTTG |
| 2185 | Table 3A | Hs.83173 | NM_001760 | 4502618 | cyclin D3 (CCND3), mRNA/cds = (165, 1043) | 1 | TGCAAGGTTTAGGCTGGTGGCCCAG GACCATCATCCTACTGTAATAAAGA |
| 2186 | Table 3A | Hs.1973 | NM_001761 | 4502620 | cyclin F (CCNF), mRNA/cds = (43, 2403) | 1 | GTGTGGTCGGGGTGAGAACCCAAGC GTTGGAACTGTAGACCCGTCCTGTC |
| 2187 | literature | Hs.343474 | NM_001762 | 4502642 | 601885667F1 cDNA, 5' end/clone = IMAGE:4104184/clone_end = 5' | 1 | AGCAGCAGTGACATAAAATTCCATGT TAGATAAGCATATGTTACTTACCT |
| 2188 | Table 3A | Hs.66052 | NM_001775 | 4502664 | CD38 antigen (p45) (CD38), mRNA/cds = (69, 971) | 1 | CTCCACAATAAGGTCAATGCCAGAGA CGGAAGCCTTTTTCCCCAAAGTCT |
| 2189 | literature | Hs.205353 | NM_001776 | 4502666 | ectonucleoside triphosphate diphosphohydrolase 1 (ENTPD1), mRNA/cds = (67, 1599) | 1 | TGGAGGTATTCAATATCCTTTGCCTC AAGGACTTCGGCAGATACTGTCTC |
| 2190 | Table 3A | Hs.901 | NM_001778 | 4502674 | CD48 antigen (B-cell membrane protein) (CD48), mRNA/cds = (36, 767) | 1 | GGTGCCCACCATTCTTGGCCTGTTAC TTACCTGAGATGAGCTCTTTTAAC |
| 2191 | Table 3A | Hs.287995 | NM_001779 | 4502676 | cDNA: FLJ23181 fis, clone LNG11094 cds = UNKNOWN | 1 | TTAAGAAGAAATACCCACTAACAAAG AACAAGCATTAGTTTTGGCTGTCA |
| 2192 | Table 3A | Hs.82401 | NM_001781 | 4502680 | CD69 antigen (p60, early T-cell activation antigen) (CD69), mRNA/cds = (81, 680) | 1 | GCAAGACATAGAATAGTGTTGGAAAA TGTGCAATATGTGATGTGGCAAAT |
| 2193 | Table 3A | Hs.116481 | NM_001782 | 4502682 | CD72 antigen (CD72), mRNA/cds = (108, 1187) | 1 | GGGCGGCCCGGAGCCAGCCAGGCA GTTTTATTGAAATCTTTTAAATAAT |
| 2194 | Table 3A | Hs.79830 | NM_001783 | 4502684 | CD79A antigen (immunoglobulin-associated alpha) (CD79A), transcript variant 1, mRNA/cds = (36, 716) | 1 | CTGATTGTAGCAGCCTCGTTAGTGTC ACCCCCTCCTCCCTGATCTGTCAG |
| 2195 | literature | Hs.184298 | NM_001799 | 4502742 | cyclin-dependent kinase 7 (homolog of | 1 | AGAGAACACTGGACAACATTTACTA |

TABLE 8-continued

| SEQ ID | Origin | Unigene | Locus | GI | Nominal Description | Strand | Probe Sequence |
|---|---|---|---|---|---|---|---|
| | | | | | Xenopus MO15 cdk-activating kinase) (CDK7), mRNA/cds = (34, 1074) | | CTGAGGGAAATAGCCAAAAAGGCA |
| 2196 | Table 3A | Hs.276770 | NM_001803 | 4502760 | CDW52 antigen (CAMPATH-1 antigen) (CDW52), mRNA/ cds = (24, 209) | 1 | CATGGGGGCAACAGCCAAAATAGGG GGGTAATGATGTAGGGGCCAAGCAG |
| 2197 | Table 3A | Hs.10029 | NM_001814 | 4503140 | cathepsin C (CTSC), mRNA/ cds = (33, 1424) | 1 | TTCTGGAAGATGGTCAGCTATGAAGT AATAGAGTTTGCTTAATCATTTGT |
| 2198 | literature | Hs.41 | NM_001816 | 4502794 | carcinoembryonic antigen-related cell adhesion molecule 8 (CEACAM8), mRNA/cds = (32, 1081) | 1 | GGGTGGCTCTGATATAGTAGCTCTGG TGTAGTTTCTGCATTTCAAGAAGA |
| 2199 | Table 3A | Hs.83758 | NM_001827 | 4502858 | CDC28 protein kinase 2 (CKS2), mRNA/cds = (95, 334) | 1 | TTCCAGTCAGTTTTTCTCTTAAGTGCC TGTTTGAGTTTACTGAAACAGTT |
| 2200 | literature | Hs.158324 | NM_001837 | 4502636 | chemokine (C—C motif) receptor 3 (CCR3), mRNA/cds = (31, 1098) | 1 | AAGGACCAAGGAGATGAAGCAAACA CATTAAGCCTTCCACACTCACCTCT |
| 2201 | Table 3A | Hs.3462 | NM_001867 | 4502992 | cytochrome c oxidase subunit VIIc (COX7C), mRNA/cds = (18, 209) | 1 | AGGTGCAGCCTCTGGAAGTGGATCA AACTAGAACTCATATGCCATACTAG |
| 2202 | Table 3A | Hs.75360 | NM_001873 | 4503008 | carboxypeptidase E (CPE), mRNA/ cds = (290, 1720) | 1 | ACTTAAAAGTTTAGGGTTTTCTCTTGG TTGTAGAGTGGCCCAGAATTGCA |
| 2203 | Table 3A | Hs.1940 | NM_001885 | 4503056 | crystallin, alpha B (CRYAB), mRNA/ cds = (25, 552) | 1 | GTCTTGTGACTAGTGCTGAAGCTTAT TAATGCTAAGGGCAGGCCCAAATT |
| 2204 | Table 3A | Hs.19904 | NM_001902 | 4503124 | cystathionase (cystathionine gamma-lyase) (CTH), mRNA/cds = (33, 1250) | 1 | CCAGAGCTGCTATTAGAAGCTGCTTC CTGTGAAGATCAATCTTCCTGAGT |
| 2205 | literature | Hs.178452 | NM_001903 | 4503126 | catenin (cadherin-associated protein), alpha 1 (102 kD) (CTNNA1), mRNA/ cds = (4, 2727) | 1 | TCCTCTTTCTCCCAGCTTCAAATGCA CAATTCATCATTGGGCTCACTTCT |
| 2206 | Table 3A | Hs.297939 | NM_001908 | 4503138 | cathepsin B (CTSB), mRNA/ cds = (177, 1196) | 1 | CAGCTTCACCCTGTCAAGTTAACAAG GAATGCCTGTGCCAATAAAAGGTT |
| 2207 | Table 3A | Hs.78056 | NM_001912 | 4503154 | cathepsin L (CTSL), mRNA/ cds = (288, 1289) | 1 | CTCGAATCATTGAAGATCCGAGTGTG ATTTGAATTCTGTGATATTTTCAC |
| 2208 | literature | Hs.289271 | NM_001916 | 4503184 | cytochrome c-1 (CYC1), mRNA/ cds = (8, 985) | 1 | CTTCATCTGGAAGAAGAGGCAAGGG GGCAGGAGACCAGGCTCTAGCTCTG |
| 2209 | Table 3A | Hs.77494 | NM_001929 | 4503318 | deoxyguanosine kinase (DGUOK), mRNA/cds = (11, 793) | 1 | AGACTTTGCCATTGTTGCCATTGTTT CTTTTGTACCTGAAGCATTTGA |
| 2210 | db mining | Hs.334626 | NM_032332 | 14150113 | hypothetical protein MGC4238 (MGC4238), mRNA/cds = (30, 977) | 1 | AAAAGTAGGGGAGGGGCTGGGTCTG CAAATTAATAAATAGAAGAGGGGGT |
| 2211 | Table 3A | Hs.180383 | NM_001946 | 4503418 | dual specificity phosphatase 6 (DUSP6), transcript variant 1, mRNA/ cds = (351, 1496) | 1 | GTCGCAAAGGGGATAATCTGGGAAA GACACCAAATCATGGGCTCACTTTA |
| 2212 | Table 3A | Hs.82113 | NM_001948 | 4503422 | dUTP pyrophosphatase (DUT), mRNA/ cds = (29, 523) | 1 | TCAGTAAACAAATTCTTTCACAAGGTA CAAAATCTTGCATAAGCTGAACT |
| 2213 | Table 3A | Hs.42287 | NM_001952 | 12669917 | E2F transcription factor 6 (E2F6), mRNA/cds = (0, 845) | 1 | GTTTTACTTAGGACAAGTTGTACCTT GCCCTCTCTCCAGCTCTGCTCCCA |
| 2214 | literature | Hs.2271 | NM_001955 | 4503460 | endothelin 1 (EDN1), mRNA/ cds = (336, 974) | 1 | ACTGGCTTCCATCAGTGGTAACTGCT TTGGTCTCTTCTTTCATCTGGGGA |
| 2215 | Table 3A | Hs.275959 | NM_001959 | 4503476 | eukaryotic translation elongation factor 1 beta 2 (EEF1B2), mRNA/ cds = (235, 912) | 1 | TGGATGTGGCTGCTTCAACAAGATC TAAAATCCATCCTGGATCATGGCA |
| 2216 | Table 3A | Hs.326035 | NM_001964 | 4503492 | early growth response 1 (EGR1), mRNA/cds = (270, 1901) | 1 | TGTGGTGTATATCCTTCCAAAAAATTA AAACGAAAATAAAGTAGCTGCGA |
| 2217 | Table 3A | Hs.79306 | NM_001968 | 4503534 | eukaryotic translation initiation factor 4E (EIF4E), mRNA/cds = (18, 671) | 1 | GTCTTCCATGTGAACAGCATAAGTTT GGAGCACTAGTTTGATTATTATGT |
| 2218 | literature | Hs.99863 | NM_001972 | 4503548 | elastase 2, neutrophil (ELA2), mRNA/ cds = (38, 841) | 1 | GCCCACACCCACACTCTCCAGCATCT GGCACAATAAACATTCTCTGTTTT |
| 2219 | db mining | Hs.211956 | NM_012099 | 6912245 | CD3-epsilon-associated protein; antisense to ERCC-1 (ASE-1), mRNA/ cds = (488, 2020) | 1 | AGCTGTTTCCTGGGTAAATCTAGAGT GGGGTTTTGGTTCTTTATTTTCCC |
| 2220 | Table 3A | Hs.62192 | NM_001993 | 10518499 | coagulation factor III (thromboplastin, tissue factor) (F3), mRNA/ cds = (123, 1010) | 1 | GCAGGAGACATTGGTATTCTGGGCA GCTTCCTAATATGCTTTACAATCTG |
| 2221 | Table 3A | Hs.278333 | NM_001995 | 4503650 | fatty-acid-Coenzyme A ligase, long-chain 1 (FACL1), nuclear gene encoding mitochondrial protein, mRNA/ cds = (73, 2172) | 1 | TGGTTTTCATATCAAAAGATCATGTTG GGATTAACTTGCCTTTTTCCCCA |
| 2222 | Table 3A | Hs.77393 | NM_002004 | 4503684 | farnesyl diphosphate synthase (farnesyl pyrophosphate synthetase, dimethylallyltranstransferase, geranyltranstransferase) (FDPS), mRNA/cds = (114, 1373) | 1 | ATCTACAAGCGGAGAAAGTGACCTAG AGATTGCAAGGGCGGGGAGAGGAG |
| 2223 | Table 3A | Hs.170133 | NM_002015 | 9257221 | forkhead box O1A (rhabdomyosarcoma) (FOXO1A), mRNA/cds = (385, 2352) | 1 | TGTTTAAATGGCTTGGTGTCTTTCTTT TCTAATTATGCAGAATAAGCTCT |
| 2224 | Table 3A | Hs.89764 | NM_002024 | 4503764 | fragile X mental retardation 1 (FMR1), mRNA/cds = (219, 2117) | 1 | AAAACTGTACTTTGATTCACATGTTTT CAAATGGAGTTGGAGTTCATTCA |
| 2225 | Table 3A | Hs.138381 | NM_002027 | 4503770 | farnesyltransferase, CAAX box, alpha (FNTA), mRNA/cds = (6, 1145) | 1 | TCCATCAGAGCTGGTCTGCACACTCA CATTATCTTGCTATCACTGTAACC |
| 2226 | Table 3A | Hs.753 | NM_002029 | 4503778 | formyl peptide receptor 1 (FPR1), | 1 | GACACTTTCGAGCTCCCAGCTCCAGC |

TABLE 8-continued

| SEQ ID | Origin | Unigene | Locus | GI | Nominal Description | Strand | Probe Sequence |
|---|---|---|---|---|---|---|---|
| 2227 | Table 3A | Hs.82954 | NM_002032 | 4503794 | ferritin, heavy polypeptide 1 (FTH1), mRNA/cds = (91, 663) | 1 | TTCGTCTCACCTTGAGTTAGGCTG TGTTGGGGTTTCCTTTACCTTTTCTAT AAGTTGTACCAAAACATCCACTT |
| 2228 | Table 3A | Hs.278238 | NM_002041 | 8051596 | GA-binding protein transcription factor, beta subunit 2 (47 kD) (GABPB2), transcript variant gamma, mRNA/cds = (169, 1251) | 1 | AGGAGTCTTTTACCCGGTGTGCTTTG CCGCAGTCATCCAAAATAAATTCA |
| 2229 | Table 3A | Hs.169476 | NM_002046 | 7669491 | Homo sapiens, glyceraldehyde-3-phosphate dehydrogenase, clone MGC:10926 IMAGE:3628129, mRNA/complete cds/cds = (2306, 3313) | 1 | TAGGGAGCCGCACCTTGTCATGTACC ATCAATAAAGTACCCTGTGCTCAA |
| 2230 | db mining | Hs.334695 | NM_002050 | 4503926 | GATA-binding protein 2 (GATA2), mRNA/cds = (193, 1617) | 1 | GCTGTATATAAACGTGTCCCGAGCTT AGATTCTGTATGCGGTGACGGCGG |
| 2231 | Table 3A | Hs.62661 | NM_002053 | 4503938 | guanylate binding protein 1, interferon-inducible, 67 kD (GBP1), mRNA/cds = (68, 1846) | 1 | TGTCTTATGTGTCAAAAGTCCTAGGA AAGTGGTTGATGTTTTCTTATAGCA |
| 2232 | Table 3A | Hs.1674 | NM_002056 | 4503980 | glutamine-fructose-6-phosphate transaminase 1 (GFPT1), mRNA/cds = (122, 2167) | 1 | GCTGAATGACATATTTTATCTTGTTCT TTAAAATCACAACACAGAGCTGC |
| 2233 | Table 3A | Hs.296261 | NM_002072 | 4504044 | guanine nucleotide binding protein (G protein), q polypeptide (GNAQ), mRNA/cds = (220, 1299) | 1 | TGTCTCTCTCTCTTTTTCTTTTCTATG GAGCAAAACAAAGCTGATTTCCC |
| 2234 | Table 3A | Hs.215595 | NM_002074 | 11321584 | guanine nucleotide binding protein (G protein), beta polypeptide 1 (GNB1), mRNA/cds = (280, 1302) | 1 | CAGTGTACTGCAAGGAAGCTGGATG CAAGATAGATACTATATTAAACTGT |
| 2235 | Table 3A | Hs.183773 | NM_002078 | 6715599 | golgi autoantigen, golgin subfamily a. 4 (GOLGA4), mRNA/cds = (285, 6977) | 1 | TGTATTGTATGCAAATCTGTGATTGTT GGCAGTGTCATCTCTGAGAAACA |
| 2236 | Table 3A | Hs.180577 | NM_002087 | 4504150 | granulin (GRN), mRNA/cds = (62, 1843) | 1 | GGGGTGTTTGTGTGTGTGCGCGTGT GCGTTTCAATAAAGTTTGTACACTT |
| 2237 | Table 3A | Hs.2707 | NM_002094 | 4504166 | G1 to S phase transition 1 (GSPT1), mRNA/cds = (648, 2147) | 1 | TTTAGTATTTTTCCCCCAGGCCAGAT CATTCGTGAGTGTGCGAGTGTGTG |
| 2238 | Table 3A | Hs.75113 | NM_002097 | 4753158 | general transcription factor IIIA (GTF3A), mRNA/cds = (19, 1290) | 1 | TGCTTTGTTTAAAGGACTGCAGACCA AGGAGTCGAGCTTTCTCTCAGAGC |
| 2239 | Table 3A | Hs.119192 | NM_002106 | 4504254 | H2A histone family, member Z (H2AFZ), mRNA/cds = (106, 492) | 1 | ACCTTATTTCCACTCTGGTGGATAAG TTCAATAAAGGTCATATCCCAAAC |
| 2240 | Table 3A | Hs.181307 | NM_002107 | 4504278 | H3 histone, family 3A (H3F3A), mRNA/cds = (374, 784) | 1 | AATGTTGTCTGTCTTCTGTGCTGTTC CTGTAAGTTTGCTATTAAAATACA |
| 2241 | Table 3A | Hs.263435 | NM_002108 | 4809282 | histidine ammonia-lyase (HAL), mRNA/cds = (297, 2270) | 1 | ACCTTCCTCATTTCACAGATAAGGAA TCTTTGGGGATTAACCAACCTCCT |
| 2242 | literature | Hs.77798 | NM_002109 | 6996013 | histidyl-tRNA synthetase (HARS), mRNA/cds = (455, 1984) | 1 | AGATACCTCCCCACCACCAATTGCCA AAGGTCCAATAAAATGCCTCAACC |
| 2243 | Table 3A | Hs.89555 | NM_002110 | 4504356 | hemopoietic cell kinase (HCK), mRNA/cds = (168, 1685) | 1 | GCAATCCACAATCTGACATTCTCAGG AAGCCCCCAAGTTGATATTTCTAT |
| 2244 | db mining | Hs.277477 | NM_002117 | 11321588 | major histocompatibility complex, class I, C (HLA-C), mRNA/cds = (0, 1100) | 1 | TCTCAGGCTGCGTGCAGCAACAGTG CCCAGGGCTCTGATGAGTCTCTCAT |
| 2245 | Table 3A | Hs.814 | NM_002121 | 4504404 | major histocompatibility complex, class II, DP beta 1 (HLA-DPB1), mRNA/cds = (19, 795) | 1 1 | GCCTCCAACCATGTTCCCTTCTTCTT AGCACCACAAATAATCAAAACCCA |
| 2246 | Table 3A | Hs.308026 | NM_002125 | 4504412 | major histocompatibility complex, class II, DR beta 5 (HLA-DRB5), mRNA/cds = (29, 829) | 1 | CTCATCTTCAACTTTTGTGCTCCCCTT TGCCTAAACCCTATGGCCTCCTG |
| 2247 | Table 3A | Hs.324278 | NM_002128 | 4504424 | mRNA; cDNA DKFZp566M063 (from clone DKFZp566M063)/cds = UNKNOWN | 1 | TGGGGGTTGTAAATTGGCATGGAAAT TTAAAGCAGGTTCTTGTTGGTGCA |
| 2248 | Table 3A | Hs.80684 | NM_002129 | 14141173 | high-mobility group (nonhistone chromosomal) protein 2 (HMG2), mRNA/cds = (190, 819) | 1 | TGTGTGTATGGTAGCACAGCAAACTT GTAGGAATTAGTATCAATAGTAAA |
| 2249 | Table 3A | Hs.1119 | NM_002135 | 4504440 | nuclear receptor subfamily 4, group A, member 1 (NR4A1), mRNA/cds = (110, 1906) | 1 | CCTGCCTGGCTCTCTCTTCCTACCCT CCTTCCACATGTACATAAACTGTC |
| 2250 | Table 3A | Hs.249495 | NM_002136 | 4504444 | heterogeneous nuclear ribonucleoprotein A1 (HNRPA1), transcript variant 2, mRNA/cds = (104, 1222) | 1 | AGATGGGAATGAAGCTTGTGTATCCA TTATCATGTGTAATCAATAAACGA |
| 2251 | Table 3A | Hs.232400 | NM_002137 | 14043073 | heterogeneous nuclear ribonucleoprotein A2/B1 (HNRPA2B1), transcript variant B1, mRNA/cds = (169, 1230) | 1 | TTAAGATTTTTCTCAAAGTTTTGAAAA GCTATTAGCCAGGATCATGGTGT |
| 2252 | Table 3A | Hs.303827 | NM_002138 | 14110413 | heterogenous nuclear ribonucleoprotein D (AU-rich element RNA-binding protein 1, 37 kD) (HNRPD), transcript variant 1, mRNA/cds = (285, 1352) | 1 | TGCGGCTAGTTCAGAGAGATTTTTAG AGCTGTGGTGGACTTCATAGATGA |
| 2253 | Table 3A | Hs.146381 | NM_002139 | 4504450 | RNA binding motif protein, X chromosome (RBMX), mRNA/cds = (11, 1186) | 1 | CCATTTTGCCTTTCTGACATTTCCTTG GGAATCTGCAAGAACCTCCCCTT |

TABLE 8-continued

| SEQ ID | Origin | Unigene | Locus | GI | Nominal Description | Strand | Probe Sequence |
|---|---|---|---|---|---|---|---|
| 2254 | Table 3A | Hs.2733 | NM_002145 | 4504464 | homeo box B2 (HOXB2), mRNA/cds = (78, 1148) | 1 | TTCCGTTTGGTAGACTCCTTCCAATG AAATCTCAGGAATAATTAAACTCT |
| 2255 | Table 3A | Hs.3268 | NM_002155 | 4504514 | heat shock 70 kD protein 6 (HSP70B*) (HSPA6), mRNA/cds = (0, 1931) | 1 | GGCAGAGAAGGAGGAGTATGAGCAT CAGAAGAGGGAGCTGGAGCAAATCT |
| 2256 | Table 3A | Hs.79037 | NM_002156 | 4504520 | Homo sapiens, heat shock 60 kD protein 1 (chaperonin), clone MGC:19755 IMAGE:3630225, mRNA/complete cds/cds = (1705, 3396) | 1 | AGCAGCCTTTCTGTGGAGAGTGAGAA TAATTGTGTACAAAGTAGAGAAGT |
| 2257 | Table 3A | Hs.1197 | NM_002157 | 4504522 | heat shock 10 kD protein 1 (chaperonin 10) (HSPE1), mRNA/cds = (41, 349) | 1 | AATGATAACTAATGACATCCAGTGTC TCCAAAATTGTTTCCTTGTACTGA |
| 2258 | db mining | Hs.93177 | NM_002176 | 4504602 | interferon, beta 1, fibroblast (IFNB1), mRNA/cds = (0, 563) | 1 | TCCCTCTGGGACTGGACAATTGCTTC AAGCATTCTTCAACCAGCAGATGC |
| 2259 | Table 3A | Hs.82065 | NM_002184 | 4504674 | interleukin 6 signal transducer (gp130, oncostatin M receptor) (IL6ST), mRNA/cds = (255, 3011) | 1 | CGGCTACATGCCTCAGTGAAGGACTA GTAGTTCCTGCTACAACTTCAGCA |
| 2260 | Table 3A | Hs.237888 | NM_002185 | 4504678 | interleukin 7 receptor (IL7R), mRNA/cds = (22, 1401) | 1 | CATGAGTCAAGAGCATCCTGCTTCTA CCATGTGGATTTGGTCACAAGGTT |
| 2261 | db mining | Hs.1702 | NM_002186 | 4504684 | interleukin 9 receptor precursor (IL9R) gene, complete cds/cds = (214, 1779) | 1 | GTCAGAGGTCCTGTCTGGATGGAGG CTGGAGGCTCCCCCCTCAACCCCTC |
| 2262 | db mining | Hs.674 | NM_002187 | 4504640 | interleukin 12B (natural killer cell stimulatory factor 2, cytotoxic lymphocyte maturation factor 2, p40) (IL12B), mRNA/cds = (13, 999) | 1 | CCTGATACACAATTATGACCAGAAAA TATGGCTCCATGAAGGTGCTACTT |
| 2263 | Table 3A | Hs.41724 | NM_002190 | 4504650 | interleukin 17 (cytotoxic T-lymphocyte-associated serine esterase 8) (IL17), mRNA/cds = (53, 520) | 1 | ATTCAATTCCAGAGTAGTTTCAAGTTT CACATCGTAACCATTTTCGCCCG |
| 2264 | Table 3A | Hs.80645 | NM_002198 | 4504720 | interferon regulatory factor 1 (IRF1), mRNA/cds = (197, 1174) | 1 | TGGAAATGTCATCTAACCATTAAGTC ATGTGTGAACACATAAGGACGTGT |
| 2265 | Table 3A | Hs.83795 | NM_002199 | 4755144 | interferon regulatory factor 2 (IRF2), mRNA/cds = (177, 1226) | 1 | AATTCCCAGATTTGAAGACAAAAATA CTCTAATTCTAACCAGAGCAAGCT |
| 2266 | Table 3A | Hs.334450 | NM_002200 | 4504726 | interferon regulatory factor 5 (IRF5), transcript variant 1, mRNA/cds = (102, 1616) | 1 | TGGCAGCTACCCCCTTCTTGAGAGTC CAAGAACCTGGAGCAGAAATAATT |
| 2267 | Table 3A | Hs.241545 | NM_002208 | 6007850 | Homo sapiens, Similar to hypothetical protein, clone MGC:1824 IMAGE:3509518, mRNA, complete cds/cds = (533, 1504) | 1 | TTCCTTCAGGATGATCTAGAGCAGCA TGGAGCTGTTGGTAGAATATTAGT |
| 2268 | Table 3A | Hs.174103 | NM_002209 | 4504756 | integrin, alpha L (antigen CD11A (p180), lymphocyte function-associated antigen 1: alpha polypeptide) (ITGAL), mRNA/cds = (88, 3600) | 1 | TGCCAAGCACAGTGCCTGCATGTATT TATCCAATAAATGTGAAATTCTGT |
| 2269 | Table 3A | Hs.287797 | NM_002211 | 4504766 | mRNA for FLJ00043 protein, partial cds/cds = (0, 4248) | 1 | ACCACTGTATGTTTACTTCTCACCATT TGAGTTGCCCATCTTGTTTCACA |
| 2270 | Table 3A | Hs.5215 | NM_002212 | 4504770 | integrin beta 4 binding protein (ITGB4BP), mRNA/cds = (70, 807) | 1 | GGCTGAGGGTTCTGCTGTCCTGTGC CACCCCATTAAAGTGCAGTTCCTCC |
| 2271 | Table 3A | Hs.50651 | NM_002227 | 4504802 | Janus kinase 1 (a protein tyrosine kinase) (JAK1), mRNA/cds = (75, 3503) | 1 | ACCATCCAATCGGACAAGCTTTCAGA ACCTTATTGAAGGATTTGAAGCAC |
| 2272 | Table 3A | Hs.198951 | NM_002229 | 4504808 | jun B proto-oncogene (JUNB) | 1 | AGTCTCTAAAGAGTTTATTTTAAGACG TGTTTGTGTTTGTGTGTGTTTGT |
| 2273 | Table 3A | Hs.3886 | NM_002267 | 4504898 | karyopherin alpha 3 (importin alpha 4) (KPNA3), mRNA/cds = (91, 1656) | 1 | TGGAAGACTAAAGAGGTGCAATGTGA TCTGAGCCTCCATCATTGTCCTCC |
| 2274 | Table 3A | Hs.74011 | NM_002286 | 11693297 | lymphocyte-activation gene 3 (LAG3), mRNA/cds = (349, 1938) | 1 | GCAGCCAGCAGATCTCAGCAGCCCA GTCCAAATAAACGTCCTGTCTAGCA |
| 2275 | Table 3A | Hs.334822 | NM_002295 | 9845501 | Homo sapiens. Similar to ribosomal protein L4, clone MGC:2966 IMAGE:3139805, mRNA, complete cds/cds = (1616, 2617) | 1 | GGTAGGAGCAACCACTGACTGGTCTT AAGCTGTTCTTGCATAGGCTCTTA |
| 2276 | Table 3A | Hs.152931 | NM_002298 | 4504960 | lamin B receptor (LBR), mRNA/cds = (75, 1922) | 1 | TCAGCTACACTTTGTTTTAAGTTTGT TTTTGACATGTTTATTTGGCAAA |
| 2277 | Table 3A | Hs.76506 | NM_002298 | 7382490 | lymphocyte cytosolic protein 1 (L-plastin) (LCP1), mRNA/cds = (173, 2056) | 1 | TCCCCCCTCCGCCTCCCAGGAAGAA AGAATGTTACTGCCTTAATAAAAAA |
| 2278 | Table 3A | Hs.234489 | NM_002300 | 4557031 | Homo sapiens, lactate dehydrogenase B, clone MGC:3600 IMAGE:3028947, mRNA, complete cds/cds = (1745, 2749) | 1 | GTGAATTTGGGCTCACAGAATCAAAG CCTATGCTTGGTAGCTCTTGAACA |
| 2279 | Table 3A | Hs.2250 | NM_002309 | 6006018 | leukemia inhibitory factor (cholinergic differentiation factor) (LIF), mRNA/cds = (64, 672) | 1 | TCCTTCCTTTCCACTGAAAAGCACAT GGCCTTGGGTGACAAATTCCTCTT |
| 2280 | Table 3A | Hs.2798 | NM_002310 | 6042197 | leukemia inhibitory factor receptor (LIFR), mRNA/cds = (153, 3446) | 1 | AGAAATGTTCAGTAATGAAAAAATATA TCCAATCAGAGCCATCCCGAAAA |
| 2281 | literature | Hs.166091 | NM_002312 | 4504996 | ligase IV, DNA, ATP-dependent (LIG4), mRNA/cds = (474, 3008) | 1 | TTTTAACTTTTAAGGTTGAAAAGA CAATAGCCCAAATCCAAGAAAGA AAA |
| 2282 | Table 3A | Hs.158203 | NM_002313 | 6006043 | actin binding LIM protein 1 (ABLIM), | 1 | GCACTCCTTTGTCATATACTCTGCAT |

TABLE 8-continued

| SEQ ID | Origin | Unigene | Locus | GI | Nominal Description | Strand | Probe Sequence |
|---|---|---|---|---|---|---|---|
| | | | | | transcript variant ABLIM-1, mRNA/cds = (99, 2435) | | CACTGTCATACTCACAACTTCGTG |
| 2283 | Table 3A | Hs.890 | NM_002341 | 4505034 | lymphotoxin beta (TNF superfamily, member 3) (LTB), transcript variant 1, mRNA/cds = (8, 742) | 1 | TGGCAGTGGGAAAAATGTAGGAGAC TGTTTGGAAATTGATTTTGAACCTG |
| 2284 | literature | Hs.1116 | NM_002342 | 4505038 | lymphotoxin beta receptor (TNFR superfamily, member 3) (LTBR), mRNA/cds = (168, 1475) | 1 | CATGCAAATAAAAAGAATGGGACCTA AACTCGTGCCGCTCGTGCCGAATT |
| 2285 | Table 3A | Hs.105938 | NM_002343 | 4505042 | lactotransferrin (LTF), mRNA/cds = (294, 2429) | 1 | GGATTGCCCATCCATCTGCTTACAAT TCCCTGCTGTCGTCTTAGCAAGAA |
| 2286 | Table 3A | Hs.210 | NM_002344 | 4505044 | leukocyte tyrosine kinase (LTK), mRNA/cds = (170, 2581) | 1 | GAGCACTGGATTGCTTTCCCATTATG AGCGTCCTTCATCTGGGCAGACCC |
| 2287 | Table 3A | Hs.80887 | NM_002350 | 4505054 | v-yes-1 Yamaguchi sarcoma viral related oncogene homolog (LYN), mRNA/cds = (297, 1835) | 1 | AACCGGATATATACATAGCATGACAT TTCTTTGTGCTTTGGCTTACTTGT |
| 2288 | Table 3A | Hs.75709 | NM_002355 | 10947032 | mannose-6-phosphate receptor (cation dependent) (M6PR), mRNA/cds = (170, 1003) | 1 | ATTTGTTTGCATCCCTCCCCCACACC CTGGTGTTTAAAATGAAGAAAAA |
| 2289 | Table 3A | Hs.330716 | NM_002356 | 11125771 | cDNA FLJ14368 fis, clone HEMBA1001122/cds = UNKNOWN | 1 | AAACTCCTGCTTAAGGTGTTCTAATTT TCTGTGAGCACACTAAAAGCGAA |
| 2290 | Table 3A | Hs.69547 | NM_002385 | 4505122 | myelin basic protein (MBP), mRNA/cds = (10, 570) | 1 | GACATGCGGGCTGGGCAGCTGTTAG AGTCCAACGTGGGGCAGCACAGAGA |
| 2291 | Table 3A | Hs.172195 | NM_002408 | 6031183 | mannosyl (alpha-1,6-)-glycoprotein beta-1,2-N-acetylglucosaminyltransferase (MGAT2), mRNA/cds = (489, 1832) | 1 | ACCAAAATTCAGTGAAGGCATTCTAC AAGTTTTGAGTTAGCATTACATTT |
| 2292 | literature | Hs.1384 | NM_002412 | 4505176 | O-6-methylguanine-DNA methyltransferase (MGMT), mRNA/cds = (40, 663) | 1 1 | TAACACTGCATCGGATGCGGGGCGT GGAGGCACCGCTGTATTAAAGGAAG |
| 2293 | Table 3A | Hs.177543 | NM_002414 | 4505182 | antigen identified by monoclonal antibodies I2E7, F21 and O13 (MIC2), mRNA/cds = (123, 680) | 1 | TCCATCGAGCACGTCTGAAACCCCTG GTAGCCCCGACTTCTTTTTAATTA |
| 2294 | db mining | Hs.83169 | NM_002421 | 13027798 | matrix metalloproteinase 1 (interstitial collagenase) (MMP1), mRNA/cds = (71, 1480) | 1 | CAGTCACTGGTGTCACCCTGGATAG GCAAGGGATAACTCTTCTAACACAA |
| 2295 | db mining | Hs.83326 | NM_002422 | 13027803 | matrix metalloproteinase 3 (stromelysin 1, progelatinase) (MMP3), mRNA/cds = (63, 1496) | 1 | GGGAAGCACTCGTGTGCAACAGACA AGTGACTGTATCTGTGTAGACTATT |
| 2296 | db mining | Hs.2256 | NM_002423 | 13027804 | matrix metalloproteinase 7 (matrilysin, uterine) (MMP7), mRNA/cds = (47, 850) | 1 | TCTATGAGCTTTGTCAGTGCGCGTAG ATGTCAATAAATGTTACATACACA |
| 2297 | db mining | Hs.73862 | NM_002424 | 4505220 | matrix metalloproteinase 8 (neutrophil collagenase) (MMP8), mRNA/cds = (71, 1474) | 1 | ATATGGTGCTGTTTTCTACCCTTGGA AAGAAATGTAGATGATATGTTTCG |
| 2298 | db mining | Hs.2258 | NM_002425 | 4505204 | matrix metalloproteinase 10 (stromelysin 2) (MMP10), mRNA/cds = (22, 1452) | 1 | TTGCTAGGCGAGATAGGGGGAAGAC AGATATGGGTGTTTTAATAAATCT |
| 2299 | db mining | Hs.1695 | NM_002426 | 4505206 | matrix metalloproteinase 12 (macrophage elastase) (MMP12), mRNA/cds = (12, 1424) | 1 | AAGTTGCTTCCTAACATCCTTGGACT GAGAAATTATACTTACTTCTGGCA |
| 2300 | db mining | Hs.2936 | NM_002427 | 13027796 | matrix metalloproteinase 13 (collagenase 3) (MMP13), mRNA/cds = (28, 1443) | 1 | CTCAGGCAAAGAAAATGAAATGCATA TTTGCAAAGTGTATTAGGAAGTGT |
| 2301 | literature | Hs.82380 | NM_002431 | 4505224 | menage a trois 1 (CAK assembly factor) (MNAT1), mRNA/cds = (34, 963) | 1 | TGGAAGAGAGGAATAAATAATTCACC TATATGTGTTTGAGGTTGTGACAG |
| 2302 | literature | Hs.79396 | NM_002434 | 4505232 | N-methylpurine-DNA glycosylase (MPG), mRNA/cds = (146, 1042) | 1 | GCCTGAGCAAAGGGCCTGCCCAGAC AAGATTTTTAATTGTTTAAAAACC |
| 2303 | Table 3A | Hs.1861 | NM_002436 | 6006024 | membrane protein, palmitoylated 1 (55 kD) (MPP1), mRNA/cds = (115, 1515) | 1 | AAATGACACATCTGTGCAATAGAATG ATGTCTGCTCTAGGGAAACCTTCA |
| 2304 | literature | Hs.42674 | NM_002439 | 4505248 | mutS (E. coli) homolog 3 (MHS3), mRNA/cds = (16, 3402) | 1 | ATATTTTATTTGTTTCAGTTCAGATA ATTGGCAACTGGGTGAATCTGGC |
| 2305 | literature | Hs.115246 | NM_002440 | 4505250 | mutS (E. coli) homolog 4 (MSH4), mRNA/cds = (41, 2851) | 1 | TTCCCAGGACCGAACAAGTTCCAGAA AAGACTGAAGAATAATCACAATTC |
| 2306 | literature | Hs.112193 | NM_002441 | 4505252 | mRNA for G7 protein (G7 gene located in the class III region of the major histocompatibility complex/cds = (56, 2611) | 1 | TTCCTTATCTCCCTCAGACGCAGAGT TTTTAGTTTCTCTAGAAATTTTGT |
| 2307 | Table 3A | Hs.288742 | NM_002444 | 4505256 | cDNA: FLJ22712 fis, clone HSI13435/cds = UNKNOWN | 1 | TTTTGGAGGGGTTTATGCTCAATCCA TGTTCTATTTCAGTGCCAATAAAA |
| 2308 | literature | Hs.388 | NM_002452 | 4505274 | nudix (nucleoside diphosphate linked moiety X)-type motif 1 (NUDT1), mRNA/cds = (26, 496) | 1 | CATTGAGTGGGCGCAGAGCCGGGTTT CATCTGGAATTAACTGGATGGAAGG |
| 2309 | Table 3A | Hs.82132 | NM_002460 | 4505286 | interferon regulatory factor 4 (IRF4), mRNA/cds = (105, 1460) | 1 | TGGAAATTCCCGTGTTGCTTCAAACT GAGACAGATGGGACTTAACAGGCA |

TABLE 8-continued

| SEQ ID | Origin | Unigene | Locus | GI | Nominal Description | Strand | Probe Sequence |
|---|---|---|---|---|---|---|---|
| 2310 | Table 3A | Hs.82132 | NM_002460 | 4505286 | interferon regulatory factor 4 (IRF4) mRNA/cds = (105, 1460) | 1 | TGGAAATTCCCGTGTTGCTTCAAACT GAGACAGATGGGACTTAACAGGCA |
| 2311 | Table 3A | Hs.76391 | NM_002462 | 4505290 | myxovirus (influenza) resistance 1, homolog of murine (interferon-inducible protein p78) (MX1), mRNA/cds = (345, 2333) | 1 | CGTCCTGCGGAGCCCTGTCTCCTCT CTCTGTAATAAACTCATTTCTAGCC |
| 2312 | Table 3A | Hs.926 | NM_002463 | 11342663 | myxovirus (influenza) resistance 2, homolog of murine (MX2), mRNA/cds = (104, 2251) | 1 | TTTCCCTGATTATGATGAGCTTCCATT GTTCTGTTAAGTCTTGAAGAGGA |
| 2313 | Table 3A | Hs.79070 | NM_002467 | 12962934 | v-myc avian myelocytomatosis viral oncogene homolog (MYC), mRNA/cds = (558, 1877) | 1 | CAAATGCAACCTCACAACCTTGGCTG AGTCTTGAGACTGAAAGATTTAGC |
| 2314 | Table 3A | Hs.243886 | NM_002482 | 4505332 | nuclear autoantigenic sperm protein (histone-binding) (NASP), mRNA/cds = (85, 2448) | 1 | GGGACACTGGAGGCTGGAGCTACAG TTGAAAGCACTGCATGTTAAGAGGG |
| 2315 | Table 3A | Hs.25812 | NM_002485 | 6996019 | Nijmegen breakage syndrome 1 (nibrin) (NBS1), mRNA/cds = (52, 2316) | 1 | TCTGTCATGCCCACAATCCCTTTCTA AGGAAGACTGCCCTACTATAGCAG |
| 2316 | Table 3A | Hs.19236 | NM_002492 | 4505382 | NADH dehydrogenase (ubiquinone) 1 beta subcomplex, 5 (16 kD, SGDH) (NDUFB5), mRNA/cds = (6, 575) | 1 | GGAGAAATAGGAATTTGTGAACCCCT AAAATTGTAGCAACTTTGAAAGGT |
| 2317 | Table 3A | Hs.10758 | NM_002495 | 4505368 | NADH dehydrogenase (ubiquinone) Fe S protein 4 (18 kD) (NADH-coenzyme Q reductase) (NDUFS4), mRNA/cds = (8, 535) | 1 | ACAAGAGTATCCACAAAATAGGTTGG CACTGACTATATCTCTGCTTGACT |
| 2318 | literature | Hs.1827 | NM_002507 | 4505392 | nerve growth factor receptor (TNFR superfamily, member 16) (NGFR), mRNA/cds = (113, 1396) | 1 | GCCCTCCTGAAACTTACACACAAAAC GTTAAGTGATGAACATTAAATAGC |
| 2319 | Table 3A | Hs.82226 | NM_002510 | 4505404 | glycoprotein (transmembrane) nmb (GPNMB), mRNA/cds = (91, 1773) | 1 | AAACCATCTACTATATGTTAGACATGA CATTCTTTTTCTCTCCTTCCTGA |
| 2320 | Table 3A | Hs.214 | NM_002515 | 4505424 | neuro-oncoligcal ventral antigen 1 (NOVA1), transcript variant 1, mRNA/cds = (60, 1592) | 1 | GTGTATCTCGTGGAATCAGTGGTTAG CATTGCCGCTATTATATTTACTCA |
| 2321 | Table 3A | Hs.89385 | NM_002519 | 4505430 | nuclear protein, ataxia-telangiectasia locus (NPAT), mRNA/cds = (34, 4317) | 1 | TTGTGATGTTAAGAAATTTGTATGGT GTGGCAGTGGTCTATTCCTAAGGA |
| 2322 | Table 3A | Hs.9614 | NM_002520 | 10835082 | nucleophosmin (nucleolar phosphoprotein B23, numatrin) (NPM1), mRNA/cds = (0, 884) | 1 | CGGATGACTGACCAAGAGGCTATTCA AGATCTCTGGCAGTGGAGGAAGTC |
| 2323 | Table 3A | Hs.153952 | NM_002526 | 4505466 | 5' nucleotidase (CD73) (NT5), mRNA/cds = (49, 1773) | 1 | CCTAAATCTGTGTGTGTATTGTGAAG TGGTATAAGAAATGACTTTGAACC |
| 2324 | Table 3A | Hs.66198 | NM_002528 | 6224977 | nth (E. coli endonuclease III)-like 1 (NTHL1), mRNA/cds = (0,938) | 1 | CAGGCTGAGGTGGACCAAGAAGGCA ACCAAGTCCCCAGAGGAGACCCGCG |
| 2325 | Table 3A | Hs.264981 | NM_002535 | 4505484 | 2-5'-oligoadenylate synthetase 2 (69–71 kD) (OAS2), transcript variant 2, mRNA/cds = (19, 2082) | 1 | GAATGTAGGGAAGAGGTGCCAAGCC AACCGTGGGGTTAGCTCTAATTATT |
| 2326 | Table 3A | Hs.74563 | NM_002537 | 9845508 | ornithine decarboxylase antizyme 2 (OAZ2), mRNA/cds = UNKNOWN | 1 | ACGGGGATGTCAGGGAGGCAAGTGT GTTGTGTTACTGTGTCAATAAACTG |
| 2327 | Table 3A | Hs.75212 | NM_002539 | 4505488 | ornithine decarboxylase 1 (ODC1) mRNA/cds = (334, 1719) | 1 | GGCAGAATGGGCCAAAAGCTTAGTG TTGTGACCTGTTTTTAAAATAAAGT |
| 2328 | literature | Hs.96398 | NM_002542 | 7949101 | 8-oxoguanine DNA glycosylase (OGG1), nuclear gene encoding mitochondrial protein, transcript variant 1b, mRNA/cds = (1266, 2240) | 1 | CAAGATGGGGTGGGGATATTGAGG GAGACAGCGCTAAGGATGGTTTTAT |
| 2329 | Table 3A | Hs.77729 | NM_002543 | 4505500 | oxidised low density lipoprotein (lectin-like) receptor 1 (OLR1), mRNA/cds = (61, 882) | 1 | TAGGCTTCTATTTCCTTTCCACCCACT CTTCACAGGCTATTCTACTTTAA |
| 2330 | literature | Hs.81791 | NM_002548 | 4507566 | tumor necrosis factor receptor superfamily, member 11b (osteoprotegerin) (TNFRSF11B), mRNA/cds = (94, 1299) | 1 | GGTAACCAGGTCCAATCAGTAAAAAT AAGCTGCTTATAACTGGAAATGGC |
| 2331 | Table 3A | Hs.172182 | NM_002568 | 4505574 | poly(A)-binding protein, cytoplasmic 1 (PABPC1), mRNA/cds = (502, 2403) | 1 | TCTGTTTTAAGTAACAGAATTGATAAC TGAGCAAGGAAACGTAAATTTGGA |
| 2332 | Table 3A | Hs.75718 | NM_002575 | 4505594 | serine (or cysteine) proteinase inhibitor, clade B (ovalbumin) member 2 (SERPINB2), mRNA/cds = (72, 1319) | 1 | TGCCTTTAATTGTTCTCATAATGAAGA ATAAGTAGGTACCCTCCATGCCC |
| 2333 | Table 3A | Hs.188 | NM_002600 | 4505662 | phosphodiesterase 4B, cAMP-specific (dunce (Drosophila)-homolog phosphodiesterase E4) (PDE4B), mRNA/cds = (765, 2459) | 1 | TGCCATTAAGCAGGAATGTCATGTTC CAGTTCATTACAAAAGAAAACAAT |
| 2334 | literature | Hs.37040 | NM_002607 | 4505678 | platelet-derived growth factor alpha polypeptide (PDGFA), mRNA/cds = (403, 993) | 1 | ACCTGTTTTGTATACCTGAGAGCCTG CTATGTTCTTCTTTTGTTGATCCA |
| 2335 | literature | Hs.1976 | NM_002608 | 4505680 | platelet-derived growth factor beta polypeptide (simian sarcoma viral (v-sis) oncogene homolog) (PDGFB), | 1 | CTGCTTCCTTCAGTTTGTAAAGTCGG TGATTATATTTTTGGGGGCTTTCC |

TABLE 8-continued

| SEQ ID | Origin | Unigene | Locus | GI | Nominal Description | Strand | Probe Sequence |
|---|---|---|---|---|---|---|---|
| 2336 | literature | Hs.81564 | NM_002619 | 4505732 | platelet factor 4 (PF4), mRNA/cds = (7, 312) | 1 | AGCATACTTCTTTTTTCCAGTTTCAAT CTAACTGTGAAAGAAACTTCTGA |
| 2337 | Table 3A | Hs.53155 | NM_002621 | 4505738 | properdin P factor, complement (PFC), mRNA/cds = (242, 1651) | 1 | GAACTCTAACACTTCTCTCCTCCACT CTGAGCCCCCTGACCTTCCAAACC |
| 2338 | literature | Hs.99910 | NM_002627 | 11321600 | phosphofructokinase, platelet (PFKP), mRNA/cds = (33, 2387) | 1 | CCAGTGCGTGCTGTCTGTGGAGTGT GTCTCATGCTTTCAGATGTGCATAT |
| 2339 | Table 3A | Hs.181013 | NM_002629 | 4505752 | phosphoglycerate mutase 1 (brain) (PGAM1), mRNA/cds = (31, 795) | 1 | CCCTGCCACATGGGTCCAGTGTTCAT CTGAGCATAACTGTACTAAATCCT |
| 2340 | Table 3A | Hs.78713 | NM_002635 | 4505774 | solute carrier family 25 (mitochondrial carrier; phosphate carrier), member 3 (SLC25A3), nuclear gene encoding mitochondrial protein, transcript variant 1b, mRNA/cds = (48, 1133) | 1 | TGCTTAAGGCAAGAGTTTCAGATTTA CTGTTGAAATAAACCCAACTGTTC |
| 2341 | Table 3A | Hs.166204 | NM_002638 | 13435395 | PHD finger protein 1 (PHF1), transcript variant 2, mRNA/cds = (215, 1916) | 1 | CCTGACCCCTCCCATCCTTCCCATTT CCTTTGATGTTATTTTGTTACAGC |
| 2342 | Table 3A | Hs.112341 | NM_002638 | 4505786 | protease inhibitor 3, skin-derived (SKALP) (PI3), mRNA/cds = (119, 472) | 1 | TAAGTCCCTGCTGCCCTTCCCCTTCC CACACTGTCCATTCTTCCTCCCAT |
| 2343 | Table 3A | Hs.250697 | NM_002643 | 4505796 | ras-like protein (TC10), mRNA/cds = (0, 641) | 1 | TGATGTGATTGTAGCTTTTTAAACTAT GAAACCCCTGAGAGATTGTACCT |
| 2344 | db mining | Hs.32942 | NM_002649 | 4505802 | phosphoinositide-3-kinase, catalytic, gamma polypeptide (PIK3CG), mRNA/cds = (323, 3628) | 1 | CCCAAAGGTTCCTAAGCCTGGCTGCA AAGAAGAATCAACAGGGACACTTT |
| 2345 | Table 3A | Hs.154846 | NM_002651 | 4505808 | phosphatidylinositol 4-kinase, catalytic, beta polypeptide (PIK4CB), mRNA/cds = (69, 2555) | 1 | TAGAAGTTTGCTTTTTCCCTGCCTGT CTTGGTCACTACCACCTCTTCCCT |
| 2346 | Table 3A | Hs.77274 | NM_002658 | 4505862 | plasminogen activator, urokinase (PLAU), mRNA/cds = (76, 1371) | 1 | TGACCAGCACTGTCTCAGTTTCACTT TCACATAGATGTCCCTTTCTTGGC |
| 2347 | Table 3A | Hs.179657 | NM_002659 | 4505864 | plasminogen activator, urokinase receptor (PLAUR), mRNA/cds = (426, 1433) | 1 | CTGCCCATCTCAGCCTCACCATCACC CTGCTAATGACTGCCAGACTGTGG |
| 2348 | Table 3A | Hs.77438 | NM_002664 | 4505878 | pleckstrin (PLEK), mRNA/cds = (60, 1112) | 1 | TTCCTGAAGCTGTTCCCACTCCCAGA TGGTTTTATCAATAGCCTAGAGGT |
| 2349 | Table 3A | Hs.44499 | NM_002687 | 4505922 | pinin, desmosome associated protein (PNN), mRNA/cds = (30, 2261) | 1 | GGATTACCTTTCCTTGTAAAGAGGAT GCTGCCTTAAGAATTGCATGTTGT |
| 2350 | Table 3A | Hs.180107 | NM_002690 | 4505930 | polymerase (DNA directed), beta (POLB), mRNA/cds = (113, 1120) | 1 | GGGTCTTTGGTGTTTTAAATGATTGT TTCTTCTTCATGCTTTTGCTTGC |
| 2351 | literature | Hs.99890 | NM_002691 | 4505932 | polymerase (DNA directed), delta 1, catalytic subunit (125 kD) (POLD1), mRNA/cds = (53, 3378) | 1 | CATGGCTGCGGGGCGGGACCAGGG AGAATTAATAAAGTTCTGGACTTTTG |
| 2352 | Table 3A | Hs.334828 | AB058697 | 14017804 | mRNA for KIAA1794 protein, partial cds/cds = (1592, 4000) | 1 | ATTTAAAGCACAGTTTGTTTTTTCT GTCACCTATAGAGTGCAAGAATG CAC |
| 2353 | Table 3A | Hs.79402 | NM_002694 | 14702172 | polymerase (RNA) II (DNA directed) polypeptide C (33 kD) (POLR2C), transcript variant gamma, mRNA/cds = (57, 684) | 1 | CAGCACTGTCTCCAGATAGGAACATG CACAAAGCAGTTAATTAGGCAGCC |
| 2354 | Table 3A | Hs.1101 | NM_002698 | 4505958 | POU domain, class 2, transcription factor 2 (POU2F2), mRNA/cds = (54, 1445) | 1 | CTCCCCTCCCATTCCTCTGGTCCCTG CCTTGGTCCCTTGCCTGGGAAGAG |
| 2355 | Table 3A | Hs.2164 | NM_002704 | 4505980 | pro-platelet basic protein (includes platelet basic protein, beta-thromboglobulin, connective tissue-activating peptide III, neutrophil-activating peptide-2) (PPBP), mRNA/cds = (68, 452) | 1 | AAGGTTGGTTAAAAGATGGCAGAAAG AAGATGAAAATAAATAAGCCTGGT |
| 2356 | Table 3A | Hs.17883 | NM_002707 | 4505998 | protein phosphatase 1G (formerly 2C), magnesium-dependent, gamma isoform (PPM1G), mRNA/cds = (24, 1664) | 1 | CTCATCACCGGTTCTGTGCCTGTGCT CTGTTGTGTTGGAGGGAAGGACTG |
| 2357 | Table 3A | Hs.77876 | NM_002709 | 4506004 | *Homo sapiens*, Similar to RIKEN cDNA 2410153K17 gene, clone MGC:19595 IMAGE:3840843, mRNA, complete cds/cds = (469, 1899) | 1 | TTTGCTTGGCAACACGACTTGAAATA AATAAAACTTTGTTTCTTAGGAGA |
| 2358 | Table 3A | Hs.79081 | NM_002710 | 4506006 | protein phosphatase 1, catalytic subunit, gamma isoform (PPP1CC), mRNA/cds = (154, 1125) | 1 | AAAAGAAATCTGTTTCAACAGATGAC CGTGTACAATACCGTGTGGTGAAA |
| 2359 | Table 3A | Hs.36587 | NM_002712 | 4506012 | protein phosphatase 1, regulatory subunit 7 (PPP1R7), mRNA/cds = (15, 1097) | 1 | GACGCCACACACCATTTTCAGATGCC GTTGCAATTAAATCTTGCCACACT |
| 2360 | Table 3A | Hs.179574 | NM_002717 | 4506018 | protein phosphatase 2 (formerly 2A), regulatory subunit B (PR 52), alpha isoform (PPP2R2A), mRNA/cds = (105, 1448) | 1 | ATGTTTTAGTAACAGTTGGCTGTAAT CACTCCTCGCCGTGTCTGGCACTG |
| 2361 | Table 3A | Hs.171734 | NM_002719 | 4506022 | protein phosphatase 2, regulatory | 1 | AGTTCTGCGTTTGGCATCTTCACTCT |

TABLE 8-continued

| SEQ ID | Origin | Unigene | Locus | GI | Nominal Description | Strand | Probe Sequence |
|---|---|---|---|---|---|---|---|
| | | | | | subunit B (B56), gamma isoform (PPP2R5C), mRNA/cds = (88, 1632) | | TTCCAAAATGTATCTGTACATCAG |
| 2362 | Table 3A | Hs.1908 | NM_002727 | 4506044 | proteoglycan 1, secretory granule (PRG1), mRNA/cds = (24, 500) | 1 | TGTGTTTGCAGAGCTAGTGGATGTGT TTGTCTACAAGTATGATTGCTGTT |
| 2363 | Table 3A | Hs.183037 | NM_002734 | 4506062 | protein kinase, cAMP-dependent, regulatory, type I, alpha (tissue specific extinguisher I) (PRKAR1A), mRNA/cds = (87, 1232) | 1 | AAATCTGGGGAAGAGGTTTTATTTAC ATTTTAGGGTGGGTAAGAAAGCCA |
| 2364 | Table 3A | Hs.2499 | NM_002741 | 4506072 | protein kinase C-like 1 (PRKCL1), mRNA/cds = (84, 2912) | 1 | CAGAGCGGAGGCTGGGATCTAGCGA GAGAGATGCAGAAGATGTGAAGAAA |
| 2365 | literature | Hs.324473 | NM_002745 | 4506088 | 40 kDa protein kinase related to rat ERK2/cds = (134, 1180) | 1 | CGTTTGGAGGGGCGGTTTCTGGTAG TTGTGGCTTTTATGCTTTCAAAGAA |
| 2366 | literature | Hs.267445 | NM_002750 | 4506094 | mRNA; cDNA DKFZp434B231 (from clone DKFZp434B231)/cds = UNKNOWN | 1 | GGGGTGGGAGGGATGGGGAGTCGG TTAGTCATTGATAGAACTACTTTGAA |
| 2367 | literature | Hs.274382 | NM_002759 | 4506102 | protein kinase, interferon-inducible double stranded RNA dependent (PRKR), mRNA/cds = (435, 2090) | 1 | TGCAGAAACAGAAAGGTTTTCTTCTT TTTGCTTCAAAAACATTCTTACAT |
| 2368 | db mining | Hs.56 | NM_002764 | 4506126 | phosphoribosyl pyrophosphate synthetase 1 (PRPS1), mRNA/cds = (66, 1022) | 1 | AGATTAACTGCTGGACCTCCTACCTG CATTATCTCATTCTGGCTTCCTTG |
| 2369 | Table 3A | Hs.82159 | NM_002786 | 4506178 | proteasome (prosome, macropain) subunit, alpha type. 1 (PSMA1), mRNA/cds = (105, 896) | 1 | CTTTGTGGTTTTAAAGACAACTGTGA AATAAAATTGTTTCACCGCCTGGT |
| 2370 | Table 3A | Hs.167106 | NM_002788 | 4506182 | proteasome (prosome, macropain) subunit, alpha type, 3 (PSMA3), mRNA/cds = (5, 772) | 1 | GAACTCAGCTGGGTTGGTGAATTAAC TAATGGAAGACATGAAATTGTTCC |
| 2371 | Table 3A | Hs.251531 | NM_002789 | 4506184 | proteasome (prosome, macropain) subunit, alpha type, 4 (PSMA4), mRNA/cds = (59, 844) | 1 | ACGATGATGGTTACCCTTCATGGACG TCTTAATCTTCCACACACATCCCC |
| 2372 | Table 3A | Hs.76913 | NM_002790 | 4506186 | proteasome (prosome, macropain) subunit, alpha type, 5 (PSMA5), mRNA/cds = (21, 746) | 1 | TTCAGTTCTAATAATGTCCTTAAATTT TATTTCCAGCTCCTGTTCCTTGG |
| 2373 | Table 3A | Hs.233952 | NM_002792 | 4506188 | proteasome (prosome, macropain) subunit, alpha type, 7 (PSMA7), mRNA/cds = (24, 770) | 1 | GCCTTTCCATTCCATTTATTCACACTG AGTGTCCTACAATAAACTTCCGT |
| 2374 | Table 3A | Hs.89545 | NM_002796 | 4506198 | proteasome (prosome, macropain) subunit, beta type, 4 (PSMB4), mRNA/cds = (23, 817) | 1 | TGCATTATCCAGAACTGAAGTTGCCC TACTTTAACTTTGAACTTGGCTA |
| 2375 | Table 3A | Hs.118065 | NM_002799 | 4506202 | proteasome (prosome, macropain) subunit, beta type, 7 (PSMB7), mRNA/cds = (14, 847) | 1 | GCCCAGTAAGACACTCATGTGGCTAG TGTTTGCCGAATGAAACTCAACTC |
| 2376 | Table 3A | Hs.61153 | NM_002803 | 4506208 | proteasome (prosome, macropain) 28S subunit, ATPase, 2 (PSMC2), mRNA/cds = (66, 1367) | 1 | TAAGTCTTATGCCAAATTCAGTGCTA CTCCTCGTTACATGACATACAACT |
| 2377 | Table 3A | Hs.79387 | NM_002805 | 4506212 | proteasome (prosome, macropain) 26S subunit, ATPase, 5 (PSMC5), mRNA/cds = (0, 1220) | 1 | AAGTGAGTGGACAGCCTTTGTGTGTA TCTCTCCAATAAAGCTCTGTGGGC |
| 2378 | Table 3A | Hs.341867 | NM_002807 | 4506224 | z172b08.r1 cDNA, 5' end/clone = IMAGE:727663/clone_end = 5' | 1 | TCTCCAAGTCTTTGGTTGAAGAGAAG ATATATGACTGTTGAGTGTGCTCT |
| 2379 | Table 3A | Hs.74619 | NM_002808 | 4506226 | proteasome (prosome, macropain) 26S subunit, non-ATPase, 2 (PSMD2), mRNA/cds = (112, 2673) | 1 | GGGGAATTGTCGCCTCCTGCTCTTTT GTTACTGAGTGAGATAAGGTTGTT |
| 2380 | Table 3A | Hs.155543 | NM_002811 | 4506230 | proteasome (prosome, macropain) 26S subunit, non-ATPase, 7 (Mov34 homolog) (PSMD7), mRNA/cds = (83, 1057) | 1 | TGGCATCCTCAGGGGTTGTGATCCA GCTCCATATATTGTTTACCTTCAAA |
| 2381 | Table 3A | Hs.78468 | NM_002812 | 4506232 | proteasome (prosome, macropain) 26S subunit, non-ATPase, 8 (PSMD8), mRNA/cds = (70, 843) | 1 | CGGGCACTGGGTGGGGCAGGGCAC GAGTTATTAAAACAGTTACACTGCA |
| 2382 | Table 3A | Hs.306328 | NM_002817 | 4506222 | mRNA activated in tumor suppression, clone TSAP13 extended/cds = UNKNOWN | 1 | CGGACATCTTTTCCGTTGCGGTTTGA GAATGTTCCTATAATAAACCCCTC |
| 2383 | Table 3A | Hs.250855 | NM_002823 | 4506276 | prothymosin, alpha (gene sequence 28) (PTMA), mRNA/cds = (155, 487) | 1 | TTTGGCCTGTTTTGATGTATGTGTGA AACAATGTTGTCCAACAATAAACA |
| 2384 | Table 3A | Hs.155894 | NM_002827 | 4506288 | protein tyrosine phosphatase, non-receptor type 1 (PTPN1), mRNA/cds = (72, 1379) | 1 | AGCGAGCTGCTCTGCTATGTCCTTAA GCCAATATTTACTCATCAGGTCAT |
| 2385 | Table 3A | Hs.82829 | NM_002828 | 4506290 | protein tyrosine phosphatase, non-receptor type 2 (PTPN2), mRNA/cds = (60, 1307) | 1 | TGTAGTTGGGGTAGATTATGATTTAG GAAGCAAAAGTAAGAAGCAGCATT |
| 2386 | Table 3A | Hs.63489 | NM_002831 | 4506296 | protein tyrosine phosphatase, non-receptor type 6 (PTPN6), mRNA/cds = (144, 1931) | 1 | GCGATGGACAGACTCACAACCTGAA CCTAGGAGTGCCCCATTGCTTTGTA |
| 2387 | Table 3A | Hs.35 | NM_002832 | 4506298 | protein tyrosine phosphatase, non- | 1 | GCTCAGGAGGGTACAAGCTCCAGAA |

TABLE 8-continued

| SEQ ID | Origin | Unigene | Locus | GI | Nominal Description | Strand | Probe Sequence |
|---|---|---|---|---|---|---|---|
| | | | | | receptor type 7 (PTPN7), mRNA/cds = (155, 1174) | | CAGTAACCAAGTGGGAAAATAAAGA |
| 2388 | Table 3A | Hs.62 | NM_002835 | 4506286 | protein tyrosine phosphatase, non-receptor type 12 (PTPN12), mRNA/cds = (19, 2361) | 1 | CTGGATTCATGCAGCCAGCTTTGCAG GTTATCAGAGATCAAAGATTGTAA |
| 2389 | Table 3A | Hs.26045 | NM_002836 | 4506302 | protein tyrosine phosphatase, receptor type, A (PTPRA), mRNA/cds = (695, 3103) | 1 | TATCATGGGGAGTAATAGGACCAGAG CGGTATCTCTGGCACCACACTAGC |
| 2390 | Table 3A | Hs.170121 | NM_002838 | 4506308 | protein tyrosine phosphatase, receptor type, C (PTPRC), mRNA/cds = (86, 4000) | 1 | CTGTGGAAAAATATTTAAGATAGTTTT GCCAGAACAGTTTGTACAGACGT |
| 2391 | Table 3A | Hs.2050 | NM_002852 | 4506332 | pentaxin-related gene, rapidly induced by IL-1 beta (PTX3), mRNA/cds = (67, 1212) | 1 | ACTCTCAAATAATTAAAAAGGACTGTA TTGTTGAACAGAGGGACAATTGT |
| 2392 | literature | Hs.7179 | NM_002853 | 4506384 | RAD1 (S. pombe) homolog (RAD1), mRNA/cds = (437, 1285) | 1 | AACTCATGGGAATAATTGTGAGTCAG CGTAACATTTCAAGAGTCTAAAGG |
| 2393 | Table 3A | Hs.151536 | NM_002870 | 4506362 | RAB13, member RAS oncogene family (RAB13), mRNA/cds = (139, 750) | 1 | TGCTCCTGTTCTGTCACTTGTCATGG TCTTTCTTGGTATTAAAGGCCACC |
| 2394 | literature | Hs.16184 | NM_002873 | 4506382 | RAD17 (S. pombe) homolog (RAD17), mRNA/cds = (642, 2654) | 1 | GGGGTTGTAAATATCAACTATTCAAC AGTTTAGGATGCAATTACGAGTGT |
| 2395 | literature | Hs.23044 | NM_002875 | 4506388 | Homo sapiens, Similar to RIKEN cDNA 2610036L13 gene, clone MGC:16386 IMAGE:3938081, mRNA, complete cds/cds = (82, 840) | 1 | AATCTTATGTTTCCAAGAGAACTAAA GCTGGAGAGACCTGACCCTTCTCT |
| 2396 | literature | Hs.11393 | NM_002876 | 4506390 | RAD51 (S. cerevisiae) homolog C (RAD51C), mRNA/cds = (16, 423) | 1 | TGCACCAGGTGTTGGAAAAACACAAT TATGGTAAAATAAAGTGTTCTCCT |
| 2397 | literature | Hs.100669 | NM_002877 | 10835028 | RAD51 (S. cerevisiae)-like 1 (RAD51L1), mRNA/cds = (70, 1122) | 1 | AATGGGCACACAGGGAACAGGAAAT GGGAATGAGAGCAAGGGTTGGGTTG |
| 2398 | literature | Hs.125244 | NM_002878 | 4506392 | RAD51 (S. cerevisiae)-like 3 (RAD51L3), mRNA/cds = (124, 993) | 1 | TCTTCTTCATCTCTGTTTTGCTCTTAA AAATATAAAAAGGCAATTCCCCG |
| 2399 | literature | Hs.89571 | NM_002679 | 4506394 | RAD52 (S. cerevisiae) homolog (RAD52), mRNA/cds = (31, 1290) | 1 | AGATGTAACCCACCTTGACCATAAAT TGGCTTTTCATAGTGCTCAGATGT |
| 2400 | Table 3A | Hs.279474 | NM_002880 | 8850222 | HSPC070 protein (HSPC070), mRNA/cds = (331, 1581) | 1 | CTAGGCTCTGGGCACATTTCCTGTTC TTGAATTCTGCTCCTGAAGAGGGT |
| 2401 | Table 3A | Hs.24763 | NM_002882 | 6382077 | RAN binding protein 1 (RANBP1) | 1 | TACCCTGCCCCTCTTTTCGGTTTGT TTTTATTCTTTCATTTTACAAGG |
| 2402 | Table 3A | Hs.758 | NM_002890 | 4506430 | RAS p21 protein activator (GTPase activating protein) 1 (RASA1), transcript variant 1, mRNA/cds = (118, 3261) | 1 | GCTGCCTAACTTATCCATCTTTGAAC TTCTGACTACTTGTTGTATCTGCT |
| 2403 | Table 3A | Hs.29287 | NM_002894 | 4506440 | retinoblastoma-binding protein 8 (RBBP8), mRNA/cds = (298, 2991) | 1 | CCTTTAAAACAATAAGGCGCTTTCATT TTGCACTCTAACTTAAGAGTTTT |
| 2404 | Table 3A | Hs.6108 | NM_002896 | 4506444 | RNA binding motif protein 4 (RBM4), mRNA/cds = (55, 1155) | 1 | TCCTGCCTCCTGCGGCTGTTGGATTT GGGAATGACCTTGGTGAGAGTCTC |
| 2405 | Table 3A | Hs.167791 | NM_002901 | 4506454 | reticulocalbin 1, EF-hand calcium binding domain (RCN1), mRNA/cds = (52, 1047) | 1 | ATACTCTGAGCTGTGGACTGAACTGG CAGACACAACCTGTACAGATTGAA |
| 2406 | literature | Hs.115521 | NM_002912 | 4506482 | REV3 (yeast homolog)-like, catalytic subunit of DNA polymerase zeta (REV3L), mRNA/cds = (822, 9980) | 1 | AAGGAATTATGTGGTCAGTGCATTGT TTTTTAAACTGGAAATCATTTTGT |
| 2407 | Table 3A | Hs.75256 | NM_002922 | 4506514 | regulator of G-protein signalling 1 (RGS1), mRNA/cds = (14, 604) | 1 | TGCTCTTAAAACCAGGGAGTCAGATA TATTTGTAAGGTTAAATCATTGGT |
| 2408 | Table 3A | Hs.78944 | NM_002923 | 4506516 | regulator of G-protein signalling 2, 24 kD (RGS2), mRNA/cds = (32, 667) | 1 | GCCAAAAATCTGTCTTGAAGGCAGCT ACACTTTGAAGTGGTCTTTGAATA |
| 2409 | Table 3A | Hs.82280 | NM_002925 | 11184225 | regulator of G-protein signalling 10 (RGS10), mRNA/cds = (43, 548) | 1 | CCTCTCAGGACGTGCCGGGTTATCA TTGCTTTGTTATTGTAAGGACTG |
| 2410 | Table 3A | Hs.1010 | NM_002932 | 4506544 | regulator of mitotic spindle assembly 1 (RMSA1), mRNA/cds = (774, 2030) | 1 | TGACTATCTGTAATGGATCAATTTTG GATATGACTTTGGGTGGGGGTAAA |
| 2411 | Table 3A | Hs.64318 | NM_002945 | 4506582 | replication protein A1 (70 kD) (RPA1), mRNA/cds = (69, 1919) | 1 | CGAGCTGAGAAGCGGTCATGAGCAC CTGGGGATTTAGTAAGTGTGTCTT |
| 2412 | Table 3A | Hs.79411 | NM_002946 | 4506584 | replication protein A2 (32 kD) (RPA2), mRNA/cds = (77, 889) | 1 | GGTAGTGCCTCCAGGGGCAGAGGAA AAGAAGAAGTGTTACTGCATTTTGT |
| 2413 | literature | Hs.1608 | NM_002947 | 4506588 | replication protein A3 (14 kD) (RPA3), mRNA/cds = (30, 395) | 1 | ATGGTCAGATTAGATGCAAGAATAAA GCAGTTGTCCGAGTCTAAGTTTCT |
| 2414 | Table 3A | Hs.2280 | NM_002950 | 4506674 | ribophorin I (RPN1), mRNA/cds = (137, 1960) | 1 | TGGTATTCTGTTCTGAAGTCTAGGAT ATTTTTCAGCCTATAAAGCCCCCT |
| 2415 | Table 3A | Hs.169476 | NM_002951 | 4506676 | Homo sapiens, glyceraldehyde-3-phosphate dehydrogenase, clone MGC:10926 IMAGE:3628129, mRNA, complete cds/cds = (2306, 3313) | 1 | ACTTACCCAGATGTTGCTTTTGAAAA GTTGAAATGTGTAATTGTTTTGGA |
| 2416 | Table 3A | Hs.182426 | NM_002952 | 4506718 | ribosomal protein S2 (RPS2), mRNA/cds = (11, 892) | 1 | AGCGGACTCAGGCTCCAGCTGTGGC TACAACATAGGGTTTTATACAAGA |
| 2417 | Table 3A | Hs.3297 | NM_002954 | 4506712 | ribosomal protein S27a (RPS27A), mRNA/cds = (38, 508) | 1 | TTATTGTGGCAAATGTTGTCTGACTTA CTGTTTCAACAAACCAGAAGACA |
| 2418 | db mining | Hs.20084 | NM_002957 | 10862707 | retinoid X receptor, alpha (RXRA), | 1 | TGGACAGTAGCATTAGAATTGTGGAA |

TABLE 8-continued

| SEQ ID | Origin | Unigene | Locus | GI | Nominal Description | Strand | Probe Sequence |
|---|---|---|---|---|---|---|---|
| 2419 | Table 3A | Hs.79350 | NM_002958 | 11863158 | mRNA/cds = (75, 1463) RYK receptor-like tyrosine kinase (RYK), mRNA/cds = (103, 1917) | 1 | AAGGAACACGCAAAGGGAGAAGTG CTGGTAAATTTTGTGCTTATCTTCAAG GCTGGCTTAAGTATAAAATTGTT |
| 2420 | Table 3A | Hs.81256 | NM_002961 | 9845514 | S100 calcium-binding protein A4 (calcium protein, calvasculin, metastasin, murine placental homolog) (S100A4), transcript variant 1, mRNA/cds = (69, 374) | 1 | CCCTGGCTCCTTCAGACACGTGCTTG ATGCTGAGCAAGTTCAATAAAGAT |
| 2421 | Table 3A | Hs.100000 | NM_002964 | 9845519 | S100 calcium-binding protein A8 (calgranulin A) (S100A8), mRNA/cds = (55, 339) | 1 | GTTAACTTCCAGGAGTTCCTCATTCT GGTGATAAAGATGGGCTGGCAGCC |
| 2422 | Table 3A | Hs.23978 | NM_002967 | 4506778 | scaffold attachment factor B (SAFB), mRNA/cds = (53, 2800) | 1 | CCTGTCTCGTGGCAACAAGGCTATGT TCTGTTAGGAGTTACCTTAAACTG |
| 2423 | Table 3A | Hs.28491 | NM_002970 | 4506788 | spermidine/spermine N1-acetyltransferase (SAT), mRNA/cds = (165, 680) | 1 | AGTCAGATCTTTCTCCTTGAATATCTT TCGATAAACAACAAGGTGGTGTG |
| 2424 | Table 3A | Hs.74592 | NM_002971 | 4506790 | special AT-rich sequence binding protein 1 (binds to nuclear matrix/scaffold-associating DNA's) (SATB1), mRNA/cds = (214, 2505) | 1 | TCCTATAATTATTTCTGTAGCACTCCA CACTGATCTTTGGAAACTTGCCC |
| 2425 | Table 3A | Hs.112842 | NM_002978 | 4506818 | sodium channel, nonvoltage-gated 1, delta (SCNN1D), mRNA/cds = (0, 1916) | 1 | CCACGGGTGATGCTTCCAGGGGTTC TGGCGGGAGTCTCAGCCGAAGAGAG |
| 2426 | Table 3A | Hs.303649 | NM_002982 | 4506840 | small inducible cytokine A2 (monocyte chemotactic protein 1, homologous to mouse Sig-je) (SCYA2), mRNA/cds = (53, 352) | 1 | GAAATTGCTTTTCCTCTTGAACCACA GTTCTACCCCTGGGATGTTTTGAG |
| 2427 | Table 3A | Hs.73817 | NM_002983 | 4506842 | small inducible cytokine A3 (homologous to mouse Mip-1a) (SCYA3), mRNA/cds = (83, 361) | 1 | ACCAGACTGACAAATGTGTATCGGAT GCTTTTGTTCAGGGCTGTGATCGG |
| 2428 | Table 3A | Hs.75703 | NM_002984 | 4506844 | small inducible cytokine A4 (homologous to mouse Mip-1b) (SCYA4), mRNA/cds = (108, 386) | 1 | CCACTGTCACTGTTTCTCTGCTGTTG CAAATACATGGATAACACATTTGA |
| 2429 | db mining | Hs.66742 | NM_002987 | 4506828 | small inducible cytokine subfamily A (Cys—Cys), member 17 (SCYA17), mRNA/cds = (52, 338) | 1 | CGAAGAAGAGCCACAGTGAGGGAGA TCCCATCCCCTTGTCTGAACTGGAG |
| 2430 | cytokine arrays | Hs.57907 | NM_002989 | 4506834 | small inducible cytokine subfamily A (Cys—Cys), member 21 (SCYA21), mRNA/cds = (58, 462) | 1 | GACCTGATACGGCTCCCCAGTACAC CCCACCTCTTCCTTGTAAATATGAT |
| 2431 | Table 3A | Hs.97203 | NM_002990 | 4506836 | small inducible cytokine subfamily A (Cys—Cys), member 22 (SCYA22), mRNA/cds = (19, 300) | 1 | CTCAAGCGTCCTGGGATCTCCTTCTC CCTCCTGTCCTGTCCTTGCCCCTC |
| 2432 | Table 3A | Hs.247838 | NM_002991 | 4506838 | small inducible cytokine subfamily A (Cys—Cys), member 24 (SCYA24), mRNA/cds = (0, 359) | 1 | CCTCAAGGGAGGAGTGATCTTCACCA CCAAGAAGGGCCAGCAGTTCTGTG |
| 2433 | Table 3A | Hs.164021 | NM_002993 | 4506850 | small inducible cytokine subfamily B (Cys-X-Cys), member 6 (granulocyte chemotactic protein 2) (SCYB6), mRNA/cds = (63, 407) | 1 | TCCTGTGTGTCATGTTGGTTTTTGGT ACTTGTATTGTCATTTGGAGAAAC |
| 2434 | Table 3A | Hs.89714 | NM_002994 | 4506848 | small inducible cytokine subfamily B (Cys-X-Cys), member 5 (epithelial-derived neutrophil-activating peptide 78) (SCYB5), mRNA/cds = (106, 450) | 1 | TCCTGTGATGGAAATACAACTGGTAT CTTCACTTTTTAGGAATTGGGAA |
| 2435 | Table 3A | Hs.3195 | NM_002995 | 4506852 | small inducible cytokine subfamily C, member 1 (lymphotactin) (SCYC1), mRNA/cds = (20, 364) | 1 | AATTTGCAGTAAACTTTTAATTAAATG CTCATCTGGTAACTCAACACCCC |
| 2436 | Table 3A | Hs.3577 | NM_003001 | 9257243 | succinate dehydrogenase complex, subunit C, integral membrane protein, 15 kD (SDHC), nuclear gene encoding mitochondrial protein, mRNA/cds = (26, 535) | 1 | GCTGCTTTTGAGGAGAAAATATATAG CTTTGGACACGAGGAAGATCTAGA |
| 2437 | Table 3A | Hs.168289 | NM_003002 | 4506864 | succinate dehydrogenase complex, subunit D, integral membrane protein (SDHD), nuclear gene encoding mitochondrial protein, mRNA/cds = (11, 490) | 1 | AAACGCTTGGAGTGCTTCTGAATATA CAGAAGTTCCATTTAAGGGCAAGT |
| 2438 | Table 3A | Hs.75232 | NM_003003 | 4506866 | SEC14 (S. cerevisiae)-like 1 (SEC14L1), mRNA/cds = (303, 2450) | 1 | TGCATCGTGTTTCTACCTTTAGTACCT TGCCACTCTTTTAAAACGCTGCT |
| 2439 | Table 3A | Hs.73800 | NM_003005 | 6031196 | selectin P (granule membrane protein 140 kD, antigen CD62 (SELP), mRNA/cds = (95, 2587) | 1 | GACCTTCCTGCCACCAGTCACTGTCC CTCAAATGACCCAAAGACCAATAT |
| 2440 | Table 3A | Hs.79283 | NM_003006 | 6031197 | selectin P ligand (SELPLG), mRNA/cds = (59, 1267) | 1 | AGACCTTTCTTTGGGACTGTGTGGAC CAAGGAGCTTCCATCTAGTGACAA |
| 2441 | Table 3A | Hs.75217 | NM_003010 | 4506888 | mitogen-activated protein kinase kinase 4 (MAP2K4), mRNA/cds = (9, 1208) | 1 | GCTCAGTAACATAACTGCTTCTTGGA GCTTTGGAATATTTTATCCTGTAT |

TABLE 8-continued

| SEQ ID | Origin | Unigene | Locus | GI | Nominal Description | Strand | Probe Sequence |
|---|---|---|---|---|---|---|---|
| 2442 | Table 3A | Hs.145279 | NM_003011 | 4506890 | SET translocation (myeloid leukemia-associated) (SET), mRNA/cds = (3, 836) | 1 | TTCTGCACAGGTCTCTGTTTAGTAAA TACATCACTGTATACCGATCAGGA |
| 2443 | Table 3A | Hs.73965 | NM_003016 | 4506898 | splicing factor, arginine/serine-rich 2 (SFRS2), mRNA/cds = (155, 820) | 1 | CGGGCCTTGCATATAAATAACGGAGC ATACAGTGAGCACATCTAGCTGAT |
| 2444 | Table 3A | Hs.14388 | NM_003022 | 4506924 | SH3 domain binding glutamic acid-rich protein like (SH3BGRL), mRNA/cds = (78, 422) | 1 | AGAGATGCCTTTGTTTGATGAGATTC AAACTTGATGCTATGCTTTAAAAT |
| 2445 | Table 3A | Hs.2554 | NM_003032 | 4506948 | sialyltransferase 1 (beta-galactoside alpha-2,6-sialyltransferase) (SIAT1), mRNA/cds = (310, 1530) | 1 | AGTCCCATTCTTCCTTTTCAATACCTA CCCCCAAATCTTCTCCTAACCCT |
| 2446 | Table 3A | Hs.323032 | NM_003035 | 4506956 | TAL 1 (SCL) interrupting locus (SIL), mRNA/cds = (380, 4243) | 1 | TGTCACACTGGCTATCAAAGAATAAG AAAATTATTGAGTATGAGTGTGTT |
| 2447 | Table 3A | Hs.32970 | NM_003037 | 4506968 | signaling lymphocytic activation molecule (SLAM), mRNA/cds = (133, 1140) | 1 | GCAAAACCCAGAAGCTAAAAAGT CAATAAACAGAAAGAATGATTTT GAGA |
| 2448 | Table 3A | Hs.198296 | NM_003070 | 4507068 | SWI/SNF related, matrix associated, actin dependent regulator of chromatin, subfamily a, member 2 (SMARCA2), mRNA/cds = (297, 5015) | 1 | TTGTGACCAAATGGGCCTCAAAGATT CAGATTGAAACAAACAAAAAGCTT |
| 2449 | Table 3A | Hs.236030 | NM_003075 | 4507080 | SWI/SNF related matrix associated, actin dependent regulator or chromatin, subfamily c, member 2 (SMARCC2), mRNA/cds = (22, 3663) | 1 | AAGGTTCTATTAACCACTTCTAAGGG TACACCTCCCTCCAAACTACTGCA |
| 2450 | Table 3A | Hs.79335 | NM_003076 | 4507082 | SWI/SNF related, matrix associated, actin dependent regulator of chromatin, subfamily d, member 1 (SMARCD1), mRNA/cds = (285, 1572) | 1 | GTTGTATCACCCCCGAGTTAGCATAT CCCAGGCTCGCAGACTCAACACAG |
| 2451 | Table 3A | Hs.174051 | NM_003089 | 4507118 | small nuclear ribonucleoprotein 70 kD polypeptide (RNP antigen) (SNRP70), mRNA/cds = (680, 2524) | 1 | CCACTTGAGTTTGTCCTCCAAGGGTA GGTGTCTCATTTGTTCTGGCCCCT |
| 2452 | Table 3A | Hs.31121 | NM_003098 | 4507136 | syntrophin, alpha 1 (dystrophin-associated protein A1, 59 kD, acidic component) (SNTA1), mRNA/cds = (37, 1554) | 1 | TCCTGTCTCTCTCCTCCTTACTCTTG GATAAATAAACAGCCTGTGAGCAC |
| 2453 | Table 3A | Hs.11183 | NM_003100 | 4507140 | sorting nexin 2 (SNX2), mRNA/cds = (29, 1588) | 1 | CCTGACCCTCTTTGAATTAAGTGGAC TGTGGCATGACATTCTGCAATACT |
| 2454 | Table 3A | Hs.92909 | NM_003103 | 4507152 | NREBP mRNA, complete cds/cds = (49, 7209) | 1 | TCTAAACTTTATTTTCAAAAGCTTAAG GCCCAAATACAAACTTCTCTGGA |
| 2455 | Table 3A | Hs.278571 | NM_003105 | 6325473 | sortilin-related receptor, L (DLR class) A repeats-containing (SORL1), mRNA/cds = (197, 6841) | 1 | CATGGTGATAGCCTGAAAGAGCTTTC CTCACTAGAAACCAAATGGTGTAA |
| 2456 | Table 3A | Hs.21293 | NM_003115 | 4507758 | UDP-N-acetylglucosamine pyrophosphorylase 1 (UAP1), mRNA/cds = (0, 1517) | 1 | GGAGAAGGATTAGAAAGTTATGTGGC AGATAAAGAATTCCATGCACCTCT |
| 2457 | Table 3A | Hs.71465 | NM_003129 | 6806899 | squalene epoxidase (SQLE), mRNA/cds = (214, 1938) | 1 | ACAGTTTTTCTTTTGAATTTAGTATTT GAGATGAGTTGTTGGGACATGCA |
| 2458 | Table 3A | Hs.300741 | NM_003130 | 4507206 | sorcin (SRI), mRNA/cds = (12, 608) | 1 | GATCTAGTCTGTTACACCATTTAGAA CTTTCCTCAGCCATTATCAGTCAT |
| 2459 | Table 3A | Hs.75975 | NM_003133 | 4507216 | signal recognition particle 9 kD (SRP9), mRNA/cds = (106, 366) | 1 | AGCATGGTAAGTTCCCTTAGCTATAT GAATTTTGGCATGTTTCAGAGAGA |
| 2460 | Table 3A | Hs.75761 | NM_003137 | 4507218 | SFRS protein kinase 1 (SRPK1), mRNA/cds = (108, 2075) | 1 | ACATTTTTATTCTTTCTACTGAGGGCA TTGTCTGTTTTCTTTGTAAATGC |
| 2461 | Table 3A | Hs.83715 | NM_003142 | 10835066 | Sjogren syndrome antigen B (autoantigen La) (SSB), mRNA/cds = (72, 1298) | 1 | AAAAGGAAAACCGAATTAGGTCCACT TCAATGTCCACCTGTGAGAAAGGA |
| 2462 | Table 3A | Hs.250773 | NM_003144 | 6552340 | signal sequence receptor, alpha (translocon-associated protein alpha) (SSR1), mRNA/cds = (111, 971) | 1 | CCTATCCCCGGATGTGTGAGAATAAT GTGTTCATAAAGCATGGATCTCGT |
| 2463 | Table 3A | Hs.74564 | NM_003145 | 6552341 | signal sequence receptor, beta (translocon-associated protein beta) (SSR2), mRNA/cds = (50, 601) | 1 | CCAGTGTCTATTCTGGGTTAGAGAAG TGCTTACTAAGGGGTTTTCTAATA |
| 2464 | Table 3A | Hs.321677 | NM_003150 | 4507252 | signal transducer and activator of transcription 3 (acute-phase response factor) (STAT3), mRNA/cds = (220, 2532) | 1 | GGGTGATCTGCTTTTATCTAAATGCA AATAAGGATGTGTTCTCTGAGACC |
| 2465 | Table 3A | Hs.80642 | NM_003151 | 4507254 | signal transducer and activator of transcription 4 (STAT4), mRNA/cds = (81, 2327) | 1 | GGGAGTGTTGTGACTGAAATGCTTGA AACCAAAGCTTCAGATAAACTTGC |
| 2466 | literature | Hs.251664 | NM_003153 | 4507258 | DNA for insulin-like growth factor II (IGF-2); exon 7 and additional ORF/cds = (0, 233) | 1 | GAGCCAATCCACTCCTTCCTTTCTAT CATTCCCCTGCCCACCTCCTTCCA |
| 2467 | Table 3A | Hs.70186 | NM_003169 | 4507312 | suppressor of Ty (S. cerevisiae) 5 homolog (SUPT5H), mRNA/cds = (48, 3311) | 1 | CTTCCTGTACCTCCTCCCCACAGCTT GCTTTTGTTGTACCGTCTTTCAAT |
| 2468 | Table 3A | Hs.12303 | NM_003170 | 11321572 | suppressor of Ty (S. cerevisiae) 6 | 1 | GCTGCTGCCACCGCTTCCTGCCTGT |

TABLE 8-continued

| SEQ ID | Origin | Unigene | Locus | GI | Nominal Description | Strand | Probe Sequence |
|---|---|---|---|---|---|---|---|
| | | | | | homolog (SUPT6H), mRNA/ cds = (1164, 5975) | | CATTTGAATAAACAGTGTTTCTATT |
| 2469 | Table 3A | Hs.106469 | NM_003171 | 4507314 | suppressor of var1 (S. cerevisiae) 3-like 1 (SUPV3L1), mRNA/ cds = (0, 2360) | 1 | TGGGACTCATCCAAAAGGGACGAGA AGAAAGAAGAAGGAACCTGATTCGG |
| 2470 | Table 3A | Hs.3196 | NM_003172 | 4507318 | surfeit 1 (SURF1), mRNA/ cds = (14, 916) | 1 | TCAAGACTGCCTTTATGCTGGATCAT GTGCTACTGGTATAAAGTTCTGGC |
| 2471 | Table 3A | Hs.37938 | NM_003173 | 4507320 | suppressor of variegation 3-9 (Drosophila) homolog 1 (SUV39H1), mRNA/cds = (45, 1283) | 1 | GTACACCCCTCAACCCTATGCAGCCT GGAGTGGGCATCAATAAAATGAAC |
| 2472 | literature | Hs.74101 | NM_003177 | 4507328 | spleen tyrosine kinase (SYK), mRNA/ cds = (148, 1986) | 1 | CCATGAGACTGATCCCTGGCCACTGA AAAGCTTTCCTGACAATAAAAATG |
| 2473 | Table 3A | Hs.32675 | NM_003193 | 6006029 | tubulin-specific chaperone e (TBCE), mRNA/cds = (80, 1663) | 1 | TTGGGAAGTGACCATTTCTAGGCTTA TACATAATAGCAATAATAAAGGCT |
| 2474 | Table 3A | Hs.171626 | NM_003197 | 6006030 | transcription elongation factor B (SIII), polypeptide 1-like (TCEB1L), mRNA/ cds = (101, 592) | 1 | ATGTGGTAAAACCCAGAAAGCATCCA TCATGAATGCAAGATACTTTCAAT |
| 2475 | Table 3A | Hs.75133 | NM_003201 | 4507400 | transcription factor 6-like 1 (mitochrondrial transcription factor 1-like) (TCF6L1), mRNA/cds = (132, 872) | 1 | TTCACATTGTATTCAGAGTTGATGGTT GTACATATAAGTGATTGCTGGTT |
| 2476 | Table 3A | Hs.169294 | NM_003202 | 4507402 | transcription factor 7 (T-cell specific, HMG-box) (TCF7), mRNA/ cds = (79, 885) | 1 | GCCACTGGTTTCTCAGAATCCAAAGA TCACATATTCTAGTGTAACACTGC |
| 2477 | Table 3A | Hs.74637 | NM_003217 | 4507432 | testis enhanced gene transcript (TEGT), mRNA/cds = (40, 753) | 1 | CTGTGCTTTTTGCTTGGGATAATGGA GTTTTTCTTTAGAAACAGTGCCAA |
| 2478 | Table 3A | Hs.77356 | NM_003234 | 4507456 | transferrin receptor (p90, CD71) (TFRC), mRNA/cds = (263, 2545) | 1 | TATCAGACTAGTGACAAGCTCCTGGT CTTGAGATGTCTTCTCGTTAAGGA |
| 2479 | Table 3A | Hs.79059 | NM_003243 | 4507470 | transforming growth factor, beta receptor III (betaglycan, 300 kD) (TGFBR3), mRNA/cds = (348, 2897) | 1 | AGGGCTTGAGGTGAATTTCATTAAAT GGAATAATATGATGCCACTTTGCA |
| 2480 | Table 3A | Hs.87409 | NM_003246 | 4507484 | thrombospondin 1 (THBS1), mRNA/ cds = (111, 3623) | 1 | TTGACCTCCCATTTTTACTATTTGCCA ATACCTTTTTCTAGGAATGTGCT |
| 2481 | Table 3A | Hs.63668 | NM_003264 | 4507528 | toll-like receptor 2 (TLR2), mRNA/ cds = (129, 2483) | 1 | AGCGGGAAGGATTTTGGGTAAATCTG AGAGCTGCGATAAAGTCCTAGGTT |
| 2482 | Table 3A | Hs.159239 | NM_003266 | 4507532 | toll-like receptor 4 (TLR4), mRNA/ cds = (284, 2683) | 1 | TGATGTTTGATGGACCTATGAATCTA TTTAGGGAGACACAGATGGCTGGG |
| 2483 | Table 3A | Hs.31130 | NM_003273 | 4507546 | transmembrane 7 superfamily member 2 (TM7SF2), mRNA/cds = (254, 2023) | 1 | AGCCCTGAGGATGAACAACCTCAGA GAAGAGGTGGTTTAGAGCAAGGAAA |
| 2484 | Table 3A | Hs.1117 | NM_003291 | 4507656 | tripeptidyl peptidase II (TPP2), mRNA/ cds = (23, 3772) | 1 | AATAAATTTGCAAAACCAAGATCACA GTACACCATATGCACTCTGGTACC |
| 2485 | Table 3A | Hs.326456 | NM_003295 | 4507668 | hypothetical protein FLJ20030 (FLJ20030), mRNA/cds = (1, 1239) | 1 | TTTGGAGTGGAGGCATTGTTTTTAAG AAAAACATGTCATGTAGGTTGTCT |
| 2486 | Table 3A | Hs.5542 | NM_003315 | 4507712 | tetratricopeptide repeat domain 2 (TTC2), mRNA/cds = (26, 1480) | 1 | GCGGGGGTGGACAGGGAGGCAGCTT GTGAATTTTTGTTTTACTGTTTAAC |
| 2487 | Table 3A | Hs.178551 | NM_003316 | 10835036 | ribosomal protein L8 (RPL8), mRNA/ cds = (43, 816) | 1 | AACTTCAGATACTTGTGAACATGCCT TATATTTGTCCAACAACTGTCAGA |
| 2488 | Table 3A | Hs.274401 | NM_003321 | 4507732 | mRNA; cDNA DKFZp434P086 (from clone DKFZp434P086); partial cds/ cds = (798, 1574) | 1 | GAAGGGTTGGCCTGCCTGGCTGGGG AGGTCAGTAAACTTTGAATAGTAAG |
| 2489 | literature | Hs.129780 | NM_003327 | 4507578 | tumor necrosis factor receptor superfamily, member 4 (TNFRSF4), mRNA/cds = (5, 838) | 1 | AAGATGTACCCTTCAGGTGAACCTGG TATCAGACCCACAGTACTTGCTGT |
| 2490 | Table 3A | Hs.29877 | NM_003328 | 4507742 | TXK tyrosine kinase (TXK), mRNA/ cds = (86, 1669) | 1 | AGCAAGATAGCCAAATGTGACATCAA GCTCCATTGTTTCGGAAAATCCAGG |
| 2491 | Table 3A | Hs.13046 | NM_003330 | 4507746 | thioredoxin reductase 1 (TXNRD1), mRNA/cds = (439, 1932) | 1 | AGTGGAATGTTCTATCCCCACAAGAA GGATTATATCTTATAGACTTGTCT |
| 2492 | Table 3A | Hs.5308 | NM_003333 | 4507760 | ubiquitin A-52 residue ribosomal protein fusion product 1 (UBA52), mRNA/cds = (37, 423) | 1 | CCCGTGGCCCTGGAGCCTCAATAAA GTGTCCCTTTCATTGACTGGAGCAG |
| 2493 | Table 3A | Hs.80612 | NM_003338 | 4507768 | ubiquitin-conjugating enzyme E2A (RAD6 homolog) (UBE2A), mRNA/ cds = (120, 578) | 1 | TTATGCATTTATCACTTCCAAATCTAA CTTTGCACAAGTAACCCATGTAA |
| 2494 | Table 3A | Hs.811 | NM_003337 | 4507770 | ubiquitin-conjugating enzyme E2B (RAD6 homolog) (UBE28), mRNA/ cds = (421, 879) | 1 | TCCGCACTATATAATTCGCACACATT AATTAGGGTTTATGTACCATACAA |
| 2495 | literature | Hs.75355 | NM_003348 | 4507792 | ubiquitin-conjugating enzyme E2N (homologous to yeast UBC13) (UBE2N), mRNA/cds = (63, 521) | 1 | GCTTGTGACCATTTTGTATGGCTTGT CTGGAAACTTCTGTAAATCTTATG |
| 2496 | Table 3A | Hs.283667 | NM_003349 | 12025659 | arginyl aminopeptidase (aminopeptidase B) (RNPEP), mRNA/ cds = (9, 1982) | 1 | TGCTGATTTATGCAAAGGGCTGGCAT TCTGATGCTTTTCAGGTTAATCC |
| 2497 | literature | Hs.79300 | NM_003350 | 12025664 | ubiquitin-conjugating enzyme E2 variant 2 (UBE2V2), mRNA/ cds = (21, 458) | 1 | TGCATTCTGGCAGTTCTTTTAGGATT ATAGGTTGCAAATTATCCAAATAT |
| 2498 | Table 3A | Hs.80658 | NM_003355 | 13259540 | uncoupling protein 2 (mitochondrial, | 1 | CCGACAGCCCAGCCTAGCCCACTTG |

TABLE 8-continued

| SEQ ID | Origin | Unigene | Locus | GI | Nominal Description | Strand | Probe Sequence |
|---|---|---|---|---|---|---|---|
| | | | | | proton carrier) (UCP2), nuclear gene encoding mitochondrial protein, mRNA/cds = (380, 1309) | | TCATCCATAAAGCAAGCTCAACCTT |
| 2499 | literature | Hs.78853 | NM_003362 | 6224978 | uracil-DNA glycosylase (UNG), mRNA/cds = (106, 1020) | 1 | TTTGCTGTTAGTCGGGTTAGAGTTGG CTCTACGCGAGGTTTGTTAATAAA |
| 2500 | Table 3A | Hs.77500 | NM_003363 | 4507852 | ubiquitin specific protease 4 (proto-oncogene) (USP4), mRNA/cds = (3, 2894) | 1 | CAGACTGCTAGTGTTCTGTCTAAAAA CCAGACAAGGAAATACCCTTCTTT |
| 2501 | literature | Hs.173554 | NM_003366 | 4507842 | ubiquinol-cytochrome c reductase core protein II (UQCRC2), mRNA/cds = (53, 1414) | 1 | TTTTCCAGTGAGGTAAAATAAGGCAT AAATGCAGGTAATTATTCCCAGCT |
| 2502 | Table 3A | Hs.93649 | NM_003367 | 4507846 | upstream transcription factor 2, c-fos interacting (USF2), mRNA/cds = (0, 1040) | 1 | CCGGCACTTCTAGTGGTCTCACCTGG AGGCAAGAGGGAGGGTACAGAGCC |
| 2503 | Table 3A | Hs.284192 | NM_003374 | 4507878 | clone HQ0072/cds = UNKNOWN | 1 | TTTAGAGTCTTCCATTTTGTTGGAATT AGATCCTCCCCTTCAAATGCTGT |
| 2504 | Table 3A | Hs.155191 | NM_003379 | 9257254 | villin 2 (ezrin) (VIL2), mRNA/cds = (117, 1877) | 1 | TTCTCCTTCACAGCTAAGATGCCATG TGCAGGTGGATTCCATGCCGCAGA |
| 2505 | Table 3A | Hs.297753 | NM_003380 | 4507894 | vimentin (VIM), mRNA/cds = (122, 1522) | 1 | TTTCCAGCAAGTATCCAACCAACTTG GTTCTGCTTTCAATAAATCTTTGGA |
| 2506 | Table 3A | Hs.24143 | NM_003387 | 8400739 | Wiskott-Aldrich syndrome protein interacting protein (WASPIP), mRNA/cds = (108, 1619) | 1 | ATGACTTGCATCCCAGCTTTCCACCA ACCAAATTCAAACATTCACTGCTT |
| 2507 | literature | Hs.150930 | NM_003401 | 12408643 | X-ray repair complementing defective repair in Chinese hamster cells 4 (XRCC4), transcript variant 3, mRNA/cds = (175, 1179) | 1 | TGTATGAGACTTTTTGTTGCAAAGGA CACATTTATCATATTCATTCACAC |
| 2508 | Table 3A | Hs.279920 | NM_003404 | 4507948 | tyrosine 3-monooxygenase/tryptophan 5-monooxygenase activation protein, beta polypeptide (YWHAB), mRNA/cds = (372, 1112) | 1 | TGATCTGTCCAGTGTCACTCTGTACC CTCAACATATATCCCTTGTGCGAT |
| 2509 | Table 3A | Hs.75544 | NM_003405 | 4507950 | tyrosine 3-monooxygenase/tryptophan 5-monooxygenase activation protein, eta polypeptide (YWHAH), mRNA/cds = (200, 940) | 1 | AATTCACCCCTCCCACCTCTTTCTTC AATTAATGGAAAAGCGTTAAGGGA |
| 2510 | Table 3A | Hs.75103 | NM_003406 | 4507952 | tyrosine 3-monooxygenase/tryptophan 5-monooxygenase activation protein, zeta polypeptide (YWHAZ), mRNA/cds = (84, 621) | 1 | CTCAGTACTTTGCAGAAAACACCAAA CAAAAATGCCATTTTAAAAAAGGT |
| 2511 | Table 3A | Hs.55481 | NM_003447 | 4508000 | ainc finger protein 165 (ZNF165), mRNA/cds = (587, 2024) | 1 | AGCCTTCAGTCAGAGCTCAAACCTTA GTCAACACCAGAGAATTCACATGA |
| 2512 | Table 3A | Hs.88219 | NM_003454 | 4508012 | zinc finger protein 200 (ZNF200), mRNA/cds = (239, 1423) | 1 | AACCCTCTAAGAATACCTGTTTAAGT CTTGAGTGTTGAAAGGAATTGTTT |
| 2513 | Table 3A | Hs.62112 | NM_003457 | 4508018 | zinc finger protein 207 (ZNF207), mRNA/cds = (202, 1638) | 1 | CCACTGCCTGAAAGGTTTGTACAGAT GCATGCCACAGTAGATGTCCACAT |
| 2514 | Table 3A | Hs.89414 | NM_003467 | 4503174 | chemokine (C-X-C motif), receptor 4 (fusin) (CXCR4), mRNA/cds = (88, 1146) | 1 | TCAGGAGTGGGTTGATTTCAGCACCT ACAGTGTACAGTCTTGTATTAAGT |
| 2515 | Table 3A | Hs.78683 | NM_003470 | 4507856 | ubiquitin specific protease 7 (herpes virus-associated) (USP7), mRNA/cds = (199, 3507) | 1 | CCTTCAGTTATACTTTCAATGACCTTT TGTGCATCTGTTAAGGCAAAACA |
| 2516 | Table 3A | Hs.110713 | NM_003472 | 4503248 | DEK oncogene (DNA binding) (DEK), mRNA/cds = (33, 1160) | 1 | AAGTGAACAAAATAAGCAACTAAATG AGACCTAATAATTGGCCTTCGATT |
| 2517 | Table 3A | Hs.155017 | NM_003489 | 4505454 | nuclear receptor interacting protein 1 (NRIP1), mRNA/cds = (287, 3763) | 1 | CACAACCAAATTTGATGCGATCTGCT CAGTAATATAATTTGCCATTTTA |
| 2518 | Table 3A | Hs.28777 | NM_003512 | 4504244 | H2A histone family, member L (H2AFL), mRNA/cds = (97, 489) | 1 | ACATTGTAATAGAAACAGATTTCCCA AATTCCAGCCTGGCATGAGGTAAT |
| 2519 | literature | Hs.2178 | NM_003528 | 4504276 | H2B histone family, member Q (H2BFQ), mRNA/cds = (42, 422) | 1 | CAGACTGAATAGATCTTAACTGTCTC CTACATGTGTGTTTTCAAATGTGT |
| 2520 | Table 3A | Hs.278571 | NM_003563 | 4507182 | sortilin-related receptor, L (DLR class) A repeats-containing (SQRL1), mRNA/cds = (197, 6841) | 1 | GATATCCCAGCGGTGGTACTTCGGA GACACCTGTCTGCATCTGACTGAGC |
| 2521 | Table 3A | Hs.2864 | NM_003566 | 4503488 | early endosome antigen 1, 162 kD (EEA1), mRNA/cds = (136, 4368) | 1 | ACACTTTCCTCTGCCTTTTTCTCTTAT ATGTGGGTTCATGGTTCAGTTCG |
| 2522 | Table 3A | Hs.9006 | NM_003574 | 4507866 | VAMP (vesicle-associated membrane protein)-associated protein A (33 kD) (VAPA), mRNA/cds = (0, 728) | 1 | AGATAATGTCACCAGTCCTCTTCCTT CACTTCTTGTTGTAATTGCAGCCA |
| 2523 | literature | Hs.66718 | NM_003579 | 4506396 | RAD54 (*S. cerevisiae*)-like (RAD54L), mRNA/cds = (100, 2343) | 1 | CCGGCACACAGGGACTAGGTCTAGT GAGAACATCAGGAGCAGCGAGGGAT |
| 2524 | Table 3A | Hs.78687 | NM_003580 | 4505484 | neutral sphingomyelinase (N-SMase) activation associated factor (NSMAF), mRNA/cds = (12, 2765) | 1 | CATCGGGTTTTGGGTGTGTGTTTTCA TAGCGTGGTTACTTTCTATAATGC |
| 2525 | Table 3A | Hs.14611 | NM_003584 | 4503414 | dual specificity phosphatase 11 (RNA/RNP complex 1-interacting) (DUSP11), mRNA/cds = (124, 1116) | 1 | ATGTATTTCTTTCTGACTAGACTTGTG ATATGCGTGTGTTTATGTACAGA |
| 2526 | Table 3A | Hs.155976 | NM_003588 | 13270466 | cullin 4B (CUL4B), mRNA/ | 1 | GTTCTGTATCAGTTGAATTTTTGTGCT |

TABLE 8-continued

| SEQ ID | Origin | Unigene | Locus | GI | Nominal Description | Strand | Probe Sequence |
|---|---|---|---|---|---|---|---|
| 2527 | Table 3A | Hs.183874 | NM_003589 | 11140810 | cullin 4A (CUL4A), mRNA/ cds = (78, 2231) | 1 | CTTTTCCCTGTGTACGTGGTGGT CATTTATGAGTTCCATGATATGTGGT |
| 2528 | Table 3A | Hs.82919 | NM_003591 | 4503162 | cullin 2 (CUL2), mRNA/ cds = (160, 2139) | 1 | CTAAGAAAGACCAAACAGATTTCT AAATCGGTTGGGTACCATGCTTTTTC |
| 2529 | Table 3A | Hs.14541 | NM_003592 | 4503160 | cullin 1 (CUL1), mRNA/ cds = (146, 2383) | 1 | TCCCCTTCACGTTTGCAGTTGATG GTTCATGTTGGAAAGAATGAAAACAA |
| 2530 | Table 3A | Hs.9456 | NM_003601 | 4507074 | SWI/SNF related, matrix associated, actin dependent regulator of chromatin, subfamily a, member 5 (SMARCA5), mRNA/cds = (202, 3360) | 1 | CTTCAAGTTCATAGGCAGCCAGCC TGTCATTTAAAGACATCAGGTTCATCT GTTTACTGAGCTAGAAACATAGT |
| 2531 | Table 3A | Hs.100293 | NM_003605 | 6006036 | O-linked N-acetylglucosamine (GlcNAc) transferase (UDP-N-acetylglucosamine:polypeptide-N-acetylglucosaminyl transferase) (OGT), mRNA/cds = (2039, 4801) | 1 | ATCTGGTGCCAAATGAAGATTTTTAG GAGTGATTACTAATTATCAAGGGC |
| 2532 | Table 3A | Hs.131924 | NM_003608 | 4507420 | G protein-coupled receptor 65 (GPR65), mRNA/cds = (0, 1013) | 1 | TTCTGCACTGGGAGGTGTAATACATC ACAAAGACAAAGAAAACGCATACT |
| 2533 | Table 3A | Hs.104925 | NM_003633 | 4505460 | ectodermal-neural cortex (with BTB-like domain) (ENC1), mRNA/ cds = (399, 2166) | 1 | AGTTGAAGGAAAATGTTCATGTTCAT ATGTACTTGTTTGCTATGACTACA |
| 2534 | db mining | Hs.323879 | NM_003639 | 4504630 | cDNA FLJ20588 fis, clone KAT09466, highly similar to AF091453 NEMO protein/cds = UNKNOWN | 1 | CACTGGGGAAGTCAAGAATGGGGCC TGGGGCTCTCAGGGAGAACTGCTTC |
| 2535 | Table 3A | Hs.146360 | NM_003641 | 4504580 | interferon induced transmembrane protein 1 (9–27) (IFITM1), mRNA/ cds = (110, 487) | 1 | CCCTAGATACAGCAGTTTATACCCAC ACACCTGTCTACAGTGTCATTCAA |
| 2536 | Table 3A | Hs.167218 | NM_003658 | 6633797 | BarH-like homeobox 2 (BARX2), mRNA/cds = (96, 935) | 1 | GAAAGTGCTTAGCTCTCTCCCTCCTG ACCTCTGGGCAGCCAGTCATCAAA |
| 2537 | Table 3A | Hs.155172 | NM_003664 | 4501974 | adaptor-related protein complex 3, beta 1 subunit (AP3B1), mRNA/ cds = (53, 3334) | 1 | ATCATGTATGCAATACTTTCCCCCTTT TTGCTTTGCTAACCAAAGAGCAT |
| 2538 | Table 3A | Hs.239307 | NM_003680 | 4507946 | tyrosyl-tRNA synthetase (YARS), mRNA/cds = (0, 1586) | 1 | CTGCTGTCTCTTCAGTCTGCTCCATC CATCACCCATTTACCCATCTCTCA |
| 2539 | Table 3A | Hs.82548 | NM_003882 | 4505070 | MAP-kinase activating death domain (MADD), mRNA/cds = (325, 5091) | 1 | TATAGAAAATGTACAGTTGTGTGAAT GTGAAATAAATGTCCTCAACTCCC |
| 2540 | literature | Hs.47504 | NM_003688 | 4504368 | exonuclease 1 (EXO1), mRNA/ cds = (218, 2629) | 1 | GGCCGTGTTCAAAGAGCAATATTCCA GTAAATGCAGACTGCTGCAAAGCT |
| 2541 | Table 3A | Hs.18571 | NM_003690 | 4505580 | protein kinase, interferon-inducible double stranded RNA dependent activator (PRKRA), mRNA/ cds = (96, 1037) | 1 | AGCTGCTGACTTGACTGTCATCCTGT TCTTGTTAGCCATTGTGAATAAGA |
| 2542 | db mining | Hs.296776 | NM_003721 | 4506498 | regulatory factor X-associated ankyrin-containing protein (RFXANK), mRNA/ cds = (417, 1199) | 1 | GAACTGACTTCAAAGGCAGCTTCTGG ACAGGTGGTGGGAGGGACCCTTC |
| 2543 | Table 3A | Hs.118633 | NM_003733 | 11321576 | 2'-5'oligoadenylate synthetase-like (OASL), mRNA/cds = (6, 1550) | 1 | GGAGAGGCTCTGTTTCCAGCCAGTTA GTTTTCTCTGGGAGACTTCTCTGT |
| 2544 | Table 3A | Hs.5120 | NM_003748 | 4505812 | dynein, cytoplasmic, light polypeptide (PIN), mRNA/cds = (93, 362) | 1 | TTTCTATTCCATACTTCTGCCCACGTT GTTTTCTCTCAAAATCCATTCCT |
| 2545 | Table 3A | Hs.57783 | NM_003751 | 4503528 | eukaryotic translation initiation factor 3, subunit 9 (eta, 116 kD) (EIF3S9), mRNA/cds = (53, 2674) | 1 | CCTGTACACAGCCGAGCAGCATTTCC GTTGAAGGACTTGCATCCCCATTG |
| 2546 | Table 3A | Hs.57973 | NM_003753 | 4503522 | caspase recruitment domain protein 10 mRNA, complete cds/ cds = (40, 3138) | 1 | TTGATGCTTAGTGGAATGTGTGTCTA ACTTGCTCTCTGACATTTAGCAGA |
| 2547 | Table 3A | Hs.58189 | NM_003756 | 4503514 | eukaryotic translation initiation factor 3, subunit 3 (gamma, 40 kD) (EIF3S3), mRNA/cds = (5, 1063) | 1 | AAGAAGTTAACATGAACTCTTGAAGT CACACCAGGGCAACTCTTGGAAGA |
| 2548 | Table 3A | Hs.192023 | NM_003757 | 4503512 | eukaryotic translation initiation factor 3, subunit 2 (beta, 36 kD) (EIF3S2), mRNA/cds = (17, 994) | 1 | GGTGGATCTCCAACCAGGCCAGAGA AGATTCTCACAGAAGGTTTTGAACT |
| 2549 | Table 3A | Hs.172684 | NM_003761 | 14043025 | vesicle-associated membrane protein 8 (endobrevin) (VAMP8), mRNA/ cds = (53, 355) | 1 | GGCTGGGAAACTGTTGGTGGCCAGT GGGTAATAAAGACCTTTCAGTATCC |
| 2550 | Table 3A | Hs.77608 | NM_003769 | 4506902 | splicing factor, arginine/serine-rich 9 (SFRS9), mRNA/cds = (52, 717) | 1 | GGTTCGCTCTACTATGGAGATCAACA GTTACTGTGACTGAGTCGGCCCAT |
| 2551 | db mining | Hs.89862 | NM_003789 | 13378136 | TNFRSF1A-associated via death domain (TRADD), mRNA/ cds = (66, 1004) | 1 | GCTCACACTCAGCGTGGGACCCCGA ATGTTAAGCAATGATAATAAAGTAT |
| 2552 | db mining | Hs.251216 | NM_003790 | 4507568 | hypothetical protein DKFZp434A196 (DKFZP434A196), mRNA/ cds = (168, 2732) | 1 | CTGCTCGFCCCCTATCGCTCCAGCCAA GGCGAAGAAGCACGAACGAATGTC |
| 2553 | Table 3A | Hs.75890 | NM_003791 | 4506774 | membrane-bound transcription factor protease, site 1 (MBTPS1), mRNA/ cds = (496, 3654) | 1 | ACCTGCCACCATGTTTTGTAATTTGA GGTCTTGATTTCACCATTGTCGGT |
| 2554 | Table 3A | Hs.7943 | NM_003796 | 4506542 | RPB5-mediating protein (RMP), | 1 | AACGAAAGGAAGTTCTGTTGGAAGCA |

TABLE 8-continued

| SEQ ID | Origin | Unigene | Locus | GI | Nominal Description | Strand | Probe Sequence |
|---|---|---|---|---|---|---|---|
| 2555 | db mining | Hs.155566 | NM_003805 | 4503030 | CASP2 and RIPK1 domain containing adaptor with death domain (CRADD), mRNA/cds = (37, 636) | 1 | TCTGAAGAAACTGGAAAGAGGGTT ACATTTACCTGAATGTTGTCTGAGGA CTGAACTGTGGACTTTACTATTCA |
| 2556 | Table 3A | Hs.87247 | NM_003806 | 4504492 | harakiri, BCL2-interacting protein (contains only BH3 domain) (HRK), mRNA/cds = (120, 395) | 1 | AAATCCAGCTGCAGAAACAGACACCC CAATGCTATTTACATACAGCTCTA |
| 2557 | literature | Hs.54673 | NM_003808 | 4507598 | tumor necrosis factor (ligand) superfamily, member 13 (TNFSF13), mRNA/cds = (281, 1033) | 1 | CCCCGTTCCTCAGTTTTCCCTTTTCAT TCCCACCCCCTAGACTTTGATTT |
| 2558 | literature | Hs.26401 | NM_003809 | 4507596 | tumor necrosis factor (ligand) superfamily, member 12 (TNFSF12), mRNA/cds = (17, 768) | 1 | TTCAGGCACTAAGAGGGGCTGGACC TGGCGGCAGGAAGCCAAAGAGACTG |
| 2559 | literature | Hs.83429 | NM_003810 | 4507592 | tumor necrosis factor (ligand) superfamily, member 10 (TNFSF10), mRNA/cds = (87, 932) | 1 | CGCAACAATCCATCTCTCAAGTAGTG TATCACAGTAGTAGCCTCCAGGTT |
| 2560 | literature | Hs.1524 | NM_003811 | 4507608 | tumor necrosis factor (ligand) superfamily, member 9 (TNFSF9), mRNA/cds = (3, 767) | 1 | CCCAGGCTAGGGGGCTATAGAAACA TCTAGAAATAGACTGAAAGAAAATC |
| 2561 | Table 3A | Hs.2442 | NM_003816 | 4501914 | a disintegrin and metalloproteinase domain 9 (meltrin gamma) (ADAM9), mRNA/cds = (78, 2537) | 1 | ACCTACAAAAAAGTTACTGTGGTATC TATGAGTTATCATCTTAGCTGTGT |
| 2562 | literature | Hs.279899 | NM_003820 | 4507570 | tumor necrosis factor receptor superfamily, member 14 (herpesvirus entry mediator) (TNFRSF14), mRNA/cds = (293, 1144) | 1 | TGGTGTTTAGTGGATACCACATCGGA AGTGATTTTCTAAATTGGATTTGA |
| 2563 | db mining | Hs.86131 | NM_003824 | 4505228 | Fas (TNFRSF6)-associated via death domain (FADD), mRNA/cds = (129, 755) | 1 | TCACTATCTTTCTGATAACAGAATTGC CAAGGCAGCGGGATCTCGTATCT |
| 2564 | literature | Hs.114676 | NM_003839 | 4507564 | tumor necrosis factor receptor superfamily, member 11a, activator of NFKB (TNFRSF11A), mRNA/cds = (38, 1888) | 1 | GAAAAGATGGAGAAAATGAACAG GACATGGGGCTCCTGGAAAGAAA GGGC |
| 2565 | literature | Hs.129844 | NM_003840 | 4507562 | tumor necrosis factor receptor superfamily, member 10d, decoy with truncated death domain (TNFRSF10D), mRNA/cds = (82, 1242) | 1 | GTGGTTTAGGATGTCATTCTTTGCA GTTCTTCATCATGAGACAAGTCTT |
| 2566 | literature | Hs.119664 | NM_003841 | 10835042 | tumor necrosis factor receptor superfamily, member 10c, decoy without an intracellular domain (TNFRSF10C), mRNA/cds = (29, 928) | 1 | AAGGGTGAGGATGAGAAGTGGTCAC GGGATTTATTCAGCCTTGGTCAGAG |
| 2567 | literature | Hs.249190 | NM_003844 | 4507558 | tumor necrosis factor receptor superfamily, member 10a (TNFRSF10A), mRNA/cds = (0, 1406) | 1 | GAGAAGATTCAGGACCTCTTGGTGGA CTCTGGAAAGTTCATCTACTTAGA |
| 2568 | Table 3A | Hs.7043 | NM_003849 | 11321580 | succinate-CoA ligase, GDP-forming, alpha subunit (SUCLG1), mRNA/cds = (31, 1032) | 1 | AGTACAACTGGAAGCCAAAACA AGGTGGAAGATGTCCTGAATTAAG ACGT |
| 2569 | Table 3A | Hs.5085 | NM_003859 | 4503362 | dolichyl-phosphate mannosyltransferase polypeptide 1, catalytic subunit (DPM1), mRNA/cds = (0, 782) | 1 | GTTGCTGGCCTAATGAGCAATGTTCT CAATTTTCGTTTTCATTTTGCTGT |
| 2570 | Table 3A | Hs.153687 | NM_003866 | 4504706 | inositol polyphosphate-4-phosphatase, type II, 105 kD (INPP4B), mRNA/cds = (121, 2895) | 1 | ACAGACCTCCAGAGGGGACTTATGG AAAAGCTGACACCTAAGTTTACCAA |
| 2571 | Table 3A | Hs.1742 | NM_003870 | 4506786 | IQ motif containing GTPase activating protein 1 (IQGAP1), mRNA/cds = (467, 5440) | 1 | TGAATTACTTCCTCCCAAGAGTTTG GACTGCCCGTCAGATTGTTTCTGC |
| 2572 | Table 3A | Hs.279789 | NM_003883 | 13128861 | histone deacetylase 3 (HDAC3), mRNA/cds = (55, 1341) | 1 | TGGCTTTATGTCCATTTTACCACTGTT TTTATCCAATAAACTAAGTCGGT |
| 2573 | Table 3A | Hs.76095 | NM_003897 | 4503326 | immediate early response 3 (IER3), mRNA/cds = (11, 481) | 1 | GCTGTCACGGAGCGACTGTCGAGAT CGCCTAGTATGTTCTGTGAACACAA |
| 2574 | Table 3A | Hs.7165 | NM_003904 | 4508020 | zinc finger protein 259 (ZNF259), mRNA/cds = (28, 1407) | 1 | CCTTTAAGGTTGGAACTTTGAAGTTG GAGAAGGTGGAATAAAGTTACACC |
| 2575 | Table 3A | Hs.61828 | NM_003905 | 4502168 | amyloid beta precursor protein-binding protein 1, 59 kD (APPBP1), mRNA/cds = (73, 1677) | 1 | TGCCTTCGGGTTGTGCTTTAGTCTGT AAAATTCTAAAGGAGAGCTGCTAA |
| 2576 | Table 3A | Hs.8991 | NM_003917 | 4503842 | adaptor-related protein complex 1, gamma 2 subunit (AP1G2), mRNA/cds = (45, 2402) | 1 | GCAAAAACCTGGGACCAGCCCCCTT CTCCCACAAATAAAGCCCAATAAAG |
| 2577 | Table 3A | Hs.58589 | NM_003918 | 5453673 | glycogenin 2 (GYG2), mRNA/cds = (283, 1788) | 1 | GTCATCGGCTTTCAGAGGGAGACCA CGGGAATGTTCAGGGAAACAATGTC |
| 2578 | Table 3A | Hs.306359 | NM_003922 | 4557025 | clone 25038 mRNA sequence/cds = UNKNOWN | 1 | TGAATTGCCTGTTCAGGGTTCCTTAT GCAGAGAAATAAAGCAGATTCAGG |
| 2579 | literature | Hs.35947 | NM_003925 | 4505120 | methyl-CpG binding domain protein 4 (MBD4), mRNA/cds = (176, 1918) | 1 | ACCAACCACCTTTCCAGCCATAGAGA TTTTAATTAGCCCAACTAGAAGCC |
| 2580 | literature | Hs.194685 | NM_003935 | 4507634 | topoisomerase (DNA) III beta | 1 | CTACTTTGTATGATGACCCTGTCCTC |

TABLE 8-continued

| SEQ ID | Origin | Unigene | Locus | GI | Nominal Description | Strand | Probe Sequence |
|---|---|---|---|---|---|---|---|
| 2581 | Table 3A | Hs.169139 | NM_003937 | 4504936 | (TOP3B), mRNA/cds = (113, 2701) kynureninase (L-kynurenine hydrolase) (KYNU), mRNA/cds = (106, 1503) | 1 | CCTCACCCAGGCTGCAGTGCCATG AAAGAGGAGTGGTTTGTGACAAGCG GAATCCAAATGGCATTCGAGTGGCT |
| 2582 | Table 3A | Hs.24322 | NM_003945 | 4502318 | ATPase, H+ transporting, lysosomal (vacuolar proton pump) 9 kD (ATP6H), mRNA/cds = (62, 307) | 1 | GAAGAGCCATCTCAACAGAATCGCAC CAAACTATACTTTCAGGATGAATT |
| 2583 | Table 3A | Hs.47007 | NM_003954 | 4505396 | mitogen-activated protein kinase kinase kinase 14 (MAP3K14), mRNA/cds = (232, 3075) | 1 | TCTGGGTTGTAGAGAACTCTTTGTAA GCAATAAAGTTTGGGGTGATGACA |
| 2584 | literature | Hs.24439 | NM_003958 | 4504868 | ring finger protein (C3HC4 type) 8 (RNF8), mRNA/cds = (112, 1569) | 1 | CTGCTGTCCACTTTCCTTCAGGCTCT GTGAATACTTCAACCTGCTGTGAT |
| 2585 | Table 3A | Hs.108371 | NM_003973 | 4506600 | E2F transcription factor 4, p107/p130-binding (E2F4), mRNA/cds = (62, 1303) | 1 | GCACCTGCTCCAAAGGCATCTGGCA AGAAAGCATAAGTGGCAATCATAAA |
| 2586 | Table 3A | Hs.10315 | NM_003983 | 4507052 | solute carrier family 7 (cationic amino acid transporter, y+ system), member 6 (SLC7A6), mRNA/cds = (261, 1808) | 1 | CTCCTTTTAACGTGTTATTGACAAACC TCCCCAAAAGAATATGCAATTGT |
| 2587 | Table 3A | Hs.339840 | NM_003992 | 4502884 | *Homo sapiens*, clone MGC:16360 IMAGE:3927645, mRNA, complete cds/cds = (561, 731) | 1 | AGCTGCCAGAAAGCACAGATTTGACC CAAGCTATTTATATGTTATAAAGT |
| 2588 | Table 3A | Hs.83426 | NM_003998 | 10835176 | nuclear factor of kappa light polypeptide gene enhancer in B-cells 1 (p105) (NFKB1), mRNA/cds = (397, 3303) | 1 | AGCTGCTGCTGGATCACAGCTGCTTT CTGTTGTCATTGCTGTTGTCCCTC |
| 2589 | literature | Hs.278443 | NM_004001 | 4557021 | Fc fragment of IgG, low affinity IIb, receptor for (CD32) (FCGR2B), mRNA/cds = (0, 875) | 1 | GATGAGGCTGACAAAGTTGGGGCTG AGAACACAATCACCTATTCACTTCT |
| 2590 | Table 3A | Hs.12068 | NM_004003 | 4755131 | carnitine acetyltransferase (CRAT), nuclear gene encoding mitochondrial protein, transcript variant peroxisomal, mRNA/cds = (296, 2113) | 1 | TCCTGCCCCCGCCCTGCTGTATGATA TTAATGTGGAAGGTCATCAATAAA |
| 2591 | Table 3A | Hs.169470 | NM_004010 | 5032314 | dystrophin (muscular dystrophy, Duchenne and Becker types), includes DXS142, DXS164, DXS206, DXS230, DXS239, DXS268, DXS269, DXS270, DXS272 (DMD), transcript variant Dp427p2, mRNA/cds = (702, 11390) | 1 | AAACTGTAAATCATAATGTAACTGAA GCATAAACATCACATGGCATGTTT |
| 2592 | Table 3A | Hs.460 | NM_004024 | 4755127 | activating transcription factor 3 (ATF3), mRNA/cds = (164, 520) | 1 | ACAAGGACGCTGGCTACTGTCTATTA AAATTCTGATGTTTCTGTGAAATT |
| 2593 | Table 3A | Hs.186120 | NM_004031 | 4809287 | interferon regulatory factor 7 (IRF7), transcript variant d, mRNA/cds = (335, 1885) | 1 | CTTCCTTATGGAGCTGGAGCAGCCC GCCTAGAACCCAGTCTAATGAGAAC |
| 2594 | Table 3A | Hs.78637 | NM_004034 | 4809278 | annexin A7 (ANXA7), transcript variant 2, mRNA/cds = (60, 1526) | 1 | TGCATCTCATTTTGCCTAAATTGGTTC TGTATTCATAAACACTTTCCACA |
| 2595 | Table 3A | Hs.217493 | NM_004039 | 4757755 | annexin A2 (ANXA2), mRNA/cds = (49, 1088) | 1 | AGTGAAGTCTATGATGTGAAACACTT TGCCTCCTGTGTACTGTGTCATAA |
| 2596 | Table 3A | Hs.227817 | NM_004049 | 14574570 | BCL2-related protein A1 (BCL2A1), mRNA/cds = (183, 710) | 1 | TTGATGATGTAACTTGACCTTCCAGA GTTATGGAAATTTTGTCCCCATGT |
| 2597 | Table 3A | Hs.155935 | NM_004054 | 4757887 | complement component 3a receptor 1 (C3AR1), mRNA/cds = (0, 1448) | 1 | AGCTCACACGTTCCACCCACTGTCCC TCAAACAATGTCATTTCAGAAAGA |
| 2598 | Table 3A | Hs.153640 | NM_004073 | 4758015 | cytokine-inducible kinase (CNK), mRNA/cds = (38, 1859) | 1 | GGACCACTTTTATTTATTGTCAGACA CTTATTTATTGGGATGTGAGCCCC |
| 2599 | Table 3A | Hs.108080 | NM_004078 | 4758085 | cysteine and glycine-rich protein I (CSRP1), mRNA/cds = (54, 635) | 1 | GGGCTGTACCCAAGCTGATTTCTCAT CTGGTCAATAAAGCTGTTTAGACC |
| 2600 | literature | Hs.78394 | NM_004092 | 12707569 | enoyl Coenzyme A hydratase, short chain, 1, mitochondrial (ECHS1), nuclear gene encoding mitochondrial protein, mRNA/cds = (71, 943) | 1 | GCTCTGAGGGAAACGCTGTCTGCTG CCTTCATACAGATGCTGATTAAAGT |
| 2601 | literature | Hs.4756 | NM_004111 | 6325465 | chromosome 11, BAC CIT-HSP-311e8 (BC269730) containing the hFEN1 gene/cds = (2644, 3786) | 1 | TTTTAGCTCAGGAAAATATGTCAGGC TCAAACCACTTCTCAGGCAGTTTA |
| 2602 | Table 3A | Hs.171862 | NM_004120 | 6996011 | guanylate binding protein 2, interferon-inducible (GBP2), mRNA/cds = (156, 1931) | 1 | TTGTTGAACCATAAAGTTTGCAAAGT AAGGTTAAGTATGAGGTCAATGT |
| 2603 | Table 3A | Hs.284265 | NM_004124 | 4758441 | pRGR1 mRNA, partial cds/cds = (0, 538) | 1 | TGTGGTTTCAGTCTCTGCTAGTTCAT ATTGCATGTTTATTTTGGACAGTC |
| 2604 | Table 3A | Hs.3069 | NM_004134 | 4758569 | heat shock 70 kD protein 9B (mortalin-2) (HSPA9B), mRNA/cds = (29, 2068) | 1 | AGCAGAAATTTTGAAGCCAGAAGGAC AACATATGAAGCTTAGGAGTGAAG |
| 2605 | Table 3A | Hs.80350 | NM_004156 | 4758951 | protein phosphatase 2 (formerly 2A), catalytic subunit, beta isoform (PPP2CB), mRNA/cds = (21, 950) | 1 | ACTGCTTCATCTCCTTTTGCGCTTATT TGGAAATTTTAGTTATAGTGTTT |
| 2606 | Table 3A | Hs.180062 | NM_004159 | 4758969 | proteasome (prosome, macropain) subunit, beta type 8 (large multifunctional protease 7) (PSMB8), mRNA/cds = (220, 1038) | 1 | GAGAGAGTACGGGCTCAGCAGCCAG AGGAGGCCGGTGAAGTGCATCTTCT |
| 2607 | Table 3A | Hs.272493 | NM_004166 | 14589962 | small inducible cytokine subfamily A | 1 | CCCAGTCACCCTCTTGGAGCTTCCCT |

TABLE 8-continued

| SEQ ID | Origin | Unigene | Locus | GI | Nominal Description | Strand | Probe Sequence |
|---|---|---|---|---|---|---|---|
| | | | | | (Cys—Cys) member 15 (SCYA15), transcript variant 2, mRNA/cds = (474, 815) | | GCTTTGAATTAAAGACCACTCATG |
| 2608 | Table 3A | Hs.272493 | NM_004167 | 14602450 | small inducible cytokine subfamily A (Cys—Cys), member 15 (SCYA15), transcript variant 2, mRNA/cds = (474, 815) | 1 | CCCAGTCACCCTCTTGGAGCTTCCCT GCTTTGAATTAAAGACCACTCATG |
| 2609 | Table 3A | Hs.469 | NM_004168 | 4759079 | succinate dehydrogenase complex, subunit A, flavoprotein (Fp) (SDHA), nuclear gene encoding mitochondrial protein, mRNA/cds = (24, 2018) | 1 | GGAGCGTGGCACTTACCTTTGTCCCT TGCTTCATTCTTGTGAGATGATAA |
| 2610 | Table 3A | Hs.75379 | NM_004172 | 4759125 | solute carrier family 1 (glial high affinity glutamate transporter), member 3 (SLC1A3), nuclear gene encoding mitochondrial protein, mRNA/cds = (178, 1806) | 1 | GCATACACATGCACTCAGTGTGGACT GGGAAGCATTACTTTGTAGATGTA |
| 2611 | Table 3A | Hs.172791 | NM_004182 | 4759297 | ubiquitously-expressed transcript (UXT), mRNA/cds = (56, 529) | 1 | AAGCCTCACCATTGACTTCTTCCCCC CATCCTCAGACATTAAAGAGCCTG |
| 2612 | literature | Hs.212680 | NM_004195 | 4759245 | tumor necrosis factor receptor superfamily, member 18 (TNFRSF18), mRNA/cds = (0, 725) | 1 | CTGACCTCGGCCCAGCTTGGACTGC ACATCTGGCAGCTGAGGAGTCAGTG |
| 2613 | Table 3A | Hs.18720 | NM_004208 | 4757731 | programmed cell death 8 (apoptosis-inducing factor) (PDCD8), mRNA/cds = (42, 1883) | 1 | GGAAGATCATTAAGGACGGTGAGCA GCATGAAGATCTCAATGAAGTAGCC |
| 2614 | Table 3A | Hs.79197 | NM_004233 | 4757945 | CD83 antigen (activated B lymphocytes, immunoglobulin superfamily) (CD83), mRNA/cds = (41, 858) | 1 | TTACCTCTGTCTTGGCTTTCATGTTAT TAAACGTATGCATGTGAAGAAGG |
| 2615 | RG housekeeping genes | Hs.6566 | NM_004237 | 11321608 | thyroid hormone receptor interactor 13 (TRIP13), mRNA/cds = (45, 1343) | 1 | AGTTACTGGTCTCTTTCTGCCGAATG TTATGTTTTGCTTTTATCTCACAG |
| 2616 | Table 3A | Hs.85092 | NM_004239 | 10863904 | thyroid hormone receptor interactor 11 (TRIP11), mRNA/cds = (356, 6295) | 1 | CACAAAGTGGCCTTTGGGGAGAAAG TCATGTATTTGTTCGCAATTATGCT |
| 2617 | Table 3A | Hs.151787 | NM_004247 | 4759279 | U5 snRNP-specific protein, 116 kD (U5-116 KD), mRNA/cds = (60, 2978) | 1 | ATTTACTCCAAGTCCTCTCCCCAGCT ACCACCAGTCCCTTACTCTGTTCT |
| 2618 | Table 3A | Hs.184276 | NM_004252 | 4759139 | solute carrier family 9 (sodium/hydrogen exchanger), isoform 3 regulatory factor 1 (SLC9A3R1), mRNA/cds = (212, 1288) | 1 | GCCCATCCCTGAGCCAGGTACCACC ATTGTAAGGAAACACTTTCAGAAAT |
| 2619 | literature | Hs.31442 | NM_004260 | 4759029 | RecQ protein-like 4 (RECQL4), mRNA/cds = (0, 3626) | 1 | AGGACCGACGCTTCTGGAGAAAATAC CTGCACCTGAGCTTCCATGCCCTG |
| 2620 | Table 3A | Hs.90606 | NM_004261 | 4759095 | 15 kDa selenoprotein (SEP15), mRNA/cds = (4, 492) | 1 | TTCACAAAGATTTGCGTTAATGAAGA CTACACAGAAAACCTTTCTAGGGA |
| 2621 | Table 3A | Hs.15259 | NM_004281 | 14043023 | BCL2-associated athanogene 3 (BAG3), mRNA/cds = (306, 2033) | 1 | ATACCTGACTTTAGAGAGAGTAAAAT GTGCCAGGAGCCATAGGAATATCT |
| 2622 | Table 3A | Hs.341182 | NM_004288 | 8670550 | 602417256F1 cDNA, 5' end/clone = IMAGE:4538829/clone_end = 5' | 1 | ATGGAAAGATGTGGTCTGAGATGGGT GCTGCAAAGATCATAATAAAGTCA |
| 2623 | Table 3A | Hs.75393 | NM_004300 | 4757713 | acid phosphatase 1, soluble (ACP1), transcript variant a, mRNA/cds = (775, 1251) | 1 | ACATCCAGAAAGAAGGACACTTGTAT GCTAGTCTATGGTCAGTTGAGGAA |
| 2624 | Table 3A | Hs.274350 | NM_004301 | 4757717 | BAF53 (BAF53A), mRNA/cds = (138, 1425) | 1 | TTGACTAGTAAAAGTTACTGCCTAGT CTTTTTACCTTAGGCTTACAGAAT |
| 2625 | Table 3A | Hs.109918 | NM_004310 | 4757769 | ras homolog gene family, member H (ARHH), mRNA/cds = (579, 1154) | 1 | TTGCCCAGGCCAGTTAGAAAATCCCT TGGGGAACTGTGATGAATATTCCA |
| 2626 | Table 3A | Hs.75811 | NM_004315 | 4757785 | N-acylsphingosine amidohydrolase (acid ceramidase) (ASAH), mRNA/cds = (17, 1204) | 1 | ATAATCACAGTTGTGTTCCTGACACT CAATAAACAGTCACTGGAAAGAGT |
| 2627 | literature | Hs.234799 | NM_004327 | 11038638 | breakpoint cluster region (BCR), transcript variant 1, mRNA/cds = (488, 4303) | 1 | TGACCGGATTCCCTCACTGTTGTATC TTGAATAAACGCTGCTGCTTCATC |
| 2628 | db mining | Hs.2534 | NM_004329 | 4757853 | bone morphogenetic protein receptor, type IA (BMPR1A), mRNA/cds = (309, 1907) | 1 | CCAAAGTTGGAGCTTCTATTGCCATG AACCATGCTTACAAAGAAAGCACT |
| 2629 | literature | Hs.82794 | NM_004344 | 4757901 | centrin, EF-hand protein, 2 (CETN2), mRNA/cds = (47, 565) | 1 | GTGAACTCCTGCACTGGCATTTGGAT GTGTGTTAATGCTATTTGTTTTGT |
| 2630 | Table 3A | Hs.170019 | NM_004350 | 4757917 | runl-related transcription factor 3 (RUNX3), mRNA/cds = (9, 1256) | 1 | GCTGGGTGGAAACTGCTTTGCACTAT CGTTTGCTTGGTGTTTGTTTTTAA |
| 2631 | Table 3A | Hs.84298 | NM_004355 | 10835070 | CD74 antigen (invariant polypeptide of major histocompatibility complex, class II antigen-associated) (CD74), mRNA/cds = (7, 705) | 1 | GCTTGTTATCAGCTTTCAGGGCCATG GTTCACATTAGAATAAAAGGTAGT |
| 2632 | Table 3A | Hs.75564 | NM_004357 | 4757941 | CD151 antigen (CD151), mRNA/cds = (84, 845) | 1 | CTTTGCCTTGCAGCCACATGGCCCCA TCCCAGTTGGGGAAGCCAGGTGAG |
| 2633 | Table 3A | Hs.75887 | NM_004371 | 6996002 | coatomer protein complex, subunit | 1 | TGCGGGTTATTGATTTGTTCTTTACAA |

TABLE 8-continued

| SEQ ID | Origin | Unigene | Locus | GI | Nominal Description | Strand | Probe Sequence |
|---|---|---|---|---|---|---|---|
| | | | | | alpha (COPA), mRNA/cds = (466, 4140) | | CTATTGTTCTCATATTTCTCACA |
| 2634 | Table 3A | Hs.79194 | NM_004379 | 4758053 | cAMP responsive element binding protein 1 (CREB1), mRNA/cds = (198, 7526) | 1 | AGTTATTAGTTCTGCTTTAGCTTTCCA ATATGCTGTATAGCCTTTGTCAT |
| 2635 | Table 3A | Hs.23598 | NM_004380 | 4758055 | CREB binding protein (Rubinstein-Taybi syndrome) (CREBBP), mRNA/cds = (198, 7526) | 1 | GCTGTTTTCAACATTGTATTTGGACTA TGCATGTGTTTTTTCCCCATTGT |
| 2636 | Table 3A | Hs.76053 | NM_004398 | 13514826 | DEAD/H (Asp-Glu-Ala-Asp/His) box polypeptide 5 (RNA helicase, 68 kD) (DDX5), mRNA/cds = (170, 2014) | 1 | AAGTAAATGTACAGTGATTTGAAATA CAATAATGAAGGCAATGCATGGCC |
| 2637 | Table 3A | Hs.155595 | NM_004404 | 4758157 | neural precursor cell expressed, developmentally down-regulated 5 (NEDD5), mRNA/cds = (258, 1343) | 1 | CCCACACTGCTACACTTCTGATCCCC TTTGGTTTTACTACCCAAATCTAA |
| 2638 | Table 3A | Hs.171695 | NM_004417 | 7108342 | dual specificity phosphatase 1 (DUSP1), mRNA/cds = (248, 1351) | 1 | TCTTAAGCAGGTTTGTTTTCAGCACT GATGGAAAATACCAGTGTTGGGTT |
| 2639 | Table 3A | Hs.1183 | NM_004418 | 12707563 | dual specificity phosphatase 2 (DUSP2), mRNA/cds = (85, 1029) | 1 | GGGGTTGGAAACTTAGCACTTTATAT TTATACAGAACATTCAGGATTTGT |
| 2640 | Table 3A | Hs.2128 | NM_004419 | 12707565 | dual specificity phosphatase 5 (DUSP5), mRNA/cds = (210, 1364) | 1 | ACCCGTGTGAATGTGAAGAAAAGCAG TATGTTACTGGTTGTTGTTGTTGT |
| 2641 | Table 3A | Hs.74088 | NM_004430 | 4756251 | early growth response 3 (EGR3), mRNA/cds = (357, 1520) | 1 | TTGCACTGTGAGCAAATGCTAATACA GTAAATATATTGTGTTTGCTGACA |
| 2642 | Table 3A | Hs.55921 | NM_004446 | 4758293 | glutamyl-prolyl-tRNA synthetase (EPRS), mRNA/cds = (58, 4380) | 1 | AAATGAAGTCACACAGGACAATTATT CTTATGCCTAAGTTAACAGTGGAT |
| 2643 | Table 3A | Hs.48876 | NM_004462 | 4758349 | farnasyl-diphosphate farnesyltransferase 1 (FDFT1),mRNA/cds = (44, 1297) | 1 | GTCGCTGCATATGTGACTGTCATGAG ATCCTACTTAGTATGATCCTGGCT |
| 2644 | Table 3A | Hs.76362 | NM_004492 | 4758485 | general transcription factor IIA, 2 (12 kD subunit) (GTF2A2), mRNA/cds = (141, 470) | 1 | AAGGACAAAAGTTGTTGCCTTCCTAA GAACCTTCTTTAATAAACTCATTT |
| 2645 | Table 3A | Hs.103804 | NM_004501 | 14141160 | heterogeneous nuclear ribonucleoprotein U (scaffold attachment factor A) (HNRPU), transcript variant 1, mRNA/cds = (217, 2691) | 1 | CTGCATTTTGATTCTGAAAAGAAAGC TGGCTTTGCCCATTTCTTATTAAA |
| 2646 | db mining | Hs.171545 | NM_004504 | 7262381 | HIV-1 Rev binding protein (HRB), mRNA/cds = (243, 1931) | 1 | ACCTGTCTGCATAATAAAGCTGATCA TGTTTTGCTACAGTTTGCAGGTGA |
| 2647 | literature | Hs.152983 | NM_004507 | 4758575 | HUS1 (S. pombe) checkpoint homolog (HUS1), mRNA/cds = (60, 902) | 1 | TACTGGTAGATGTGCTCATTCTCCCT GAAACATACCCATCATATTGTCCT |
| 2648 | Table 3A | Hs.38125 | NM_004510 | 4758587 | interferon-induced protein 75, 52 kD (IFI75), mRNA/cds = (170, 1396) | 1 | AGGAAGCAATGTGGTTGGACCTGGTT AAGGGAAAGGCTGATTACGGAAAT |
| 2649 | Table 3A | Hs.75117 | NM_004515 | 4758601 | interleukin enhancer binding factor 2, 45 kD (ILF2), mRNA/cds = (39, 1259) | 1 | AACTAATACTTTGCTGTTGAAATGTTG TGAAATGTTAAGTGTCTGGAAAT |
| 2650 | Table 3A | Hs.6198 | NM_004517 | 4758605 | integrin-linked kinase (ILK), mRNA/cds = (156, 1514) | 1 | GAGCTTTGTCACTTGCCACATGGTGT CTTCCAACATGGGAGGGATCAGCC |
| 2651 | db mining | Hs.111301 | NM_004530 | 11342665 | matrix metalloproteinase 2 (gelatinase A, 72 kD gelatinase, 72 kD type IV collagenase) (MMP2), mRNA/cds = (289, 2271) | 1 | CCCTGTTCACTCTACTTAGCATGTCC CTACCGAGTCTCTTCTCCACTGGA |
| 2652 | Table 3A | Hs.198271 | NM_004544 | 4758767 | NADH dehydrogenase (ubiquinone) 1 alpha subcomplex, 10 (42 kD) (NDUFA10), mRNA/cds = (21, 1088) | 1 | TGCACATTGTTTTTCTTCTGACTTCCA GAAATAAAAGTGTTTCCATGGGA |
| 2653 | Table 3A | Hs.173611 | NM_004550 | 4758785 | NADH dehydrogenase (ubiquinone) Fe S protein 2 (49 kD) (NADH-coenzyme Q reductase) (NDUFS2), mRNA/cds = (6, 1397) | 1 | ACTAAAAAGGAGAAATTATAATAAAT TAGCCGTCTTGCGCCCCTAGGCC |
| 2654 | Table 3A | Hs.80595 | NM_004552 | 4758789 | NADH dehydrogenase (ubiquinone) Fe S protein 5 (15 kD) (NADH-coenzyme Q reductase) (NDUFS5), mRNA/cds = (71, 391) | 1 | ACGACAAACCTCCTTGTCAAAGTGTG TAAAAATAAAGGATTGCTCCATCC |
| 2655 | Table 3A | Hs.91640 | NM_004556 | 4758805 | nuclear factor of kappa light polypeptide gene enhancer in B-cells inhibitor, epsilon (NFKBIE), mRNA/cds = (33, 1535) | 1 | CCACTGGGGAAGGGAAGTTTCAGTA ACATGCACTAAAATGGCAGAGACG |
| 2656 | Table 3A | Hs.74497 | NM_04559 | 4758829 | nuclease sensitive element binding protein 1 (NSEP1), mRNA/cds = (234, 1202) | 1 | AAAGATTGGAGCTGAAGACCTAAAGT GCTTGCTTTTTGCCCGTTGACCAG |
| 2657 | Table 3A | Hs.158225 | NM_004571 | 4758929 | PBX/knotted 1 hoemobox 1 (PKNOX1), mRNA/cds = (85, 1392) | 1 | GAAGTCAGTGGGAAACACACAG AAATTTATTTTAAAATCTTTCAGG AGCT |
| 2658 | Table 3A | Hs.7688 | NM_004576 | 4758953 | protein phosphatase 2 (formerly 2A), regulatory subunit B (PR 52), beta isoform (PPP2R2B), mRNA/cds = (525, 1856) | 1 | AGATGTATTAGAAGTCCTGACTTTCA AGTGTAATTTGCTTTGGAGGAGGA |
| 2659 | literature | Hs.240457 | NM_004584 | 4759021 | RAD9 (S. pombe) homolog (RAD9), mRNA/cds = (76, 1251) | 1 | CTGTGCAGAAGAGCTGCCAGGCAGT GTCTTAGATGTGAGACGGAGGCCAT |

TABLE 8-continued

| SEQ ID | Origin | Unigene | Locus | GI | Nominal Description | Strand | Probe Sequence |
|---|---|---|---|---|---|---|---|
| 2660 | Table 3A | Hs.75498 | NM_004591 | 4759075 | small inducible cytokine subfamily A (Cys—Cys), member 20 (SCYA20), mRNA/cds = (58, 348) | 1 | ACATCATGGAGGGTTTAGTGCTTATC TAATTTGTGCCTCACTGGACTTGT |
| 2661 | Table 3A | Hs.30035 | NM_004593 | 4759097 | splicing factor, arginine/serine-rich (transformer 2 Drosophila homolog) 10 (SFRS10), mRNA/cds = (121, 987) | 1 | TTGCTTACCAAAGGAGGCCCAATTTC ACTCAAATGTTTTGAGAACTGTGT |
| 2662 | Table 3A | Hs.53125 | NM_004597 | 7242206 | small nuclear ribonucleoprotein D2 polypeptide (16.5 kD) (SNRPD2), mRNA/cds = (30, 366) | 1 | TCACTCCTCTGTCCTATGAAGACCGC TGCCATTGGTGTTGAGAATAATAA |
| 2663 | literature | Hs.91175 | NM_004618 | 10835217 | topoisomerase (DNA) III alpha (TOP3A), mRNA/cds = (177, 3182) | 1 | GTTAAGCCAGGACATCCAGAATTCAT TGCTTTAATAAAGAACCCAGGCCG |
| 2664 | Table 3A | Hs.75066 | NM_004822 | 4759269 | translin (TSN), mRNA/cds = (81, 767) | 1 | TCAGTTTTAACAAATGCTATTAAAGTG GAGAAGCACACTCTGGTCTTGGA |
| 2665 | db mining | Hs.320 | NM_004628 | 4759331 | xeroderma pigmentosum, complementation group C (XPC), mRNA/cds = (191, 2662) | 1 | CTCACTGCCTCTTTGCAGTAGGGGAG AGAGCAGAGAAGTACAGGTCATCT |
| 2666 | literature | Hs.8047 | NM_004629 | 4759335 | Fanconi anemia, complementation group G (FANCG), mRNA/cds = (492, 2360) | 1 | TTGACTTTGCTCGAGGCACCTTTTTT CCTGTTTCTCCTTTTCTGTTGTCG |
| 2667 | Table 3A | Hs.159627 | NM_004632 | 4756117 | death associated protein 3 (DAP3), mRNA/cds = (73, 1269) | 1 | AAATGGGTTTCACTGTGAATGCGTGA CAATAAGATATTCCCTTGTTCCTA |
| 2668 | Table 3A | Hs.237955 | NM_004637 | 13794266 | mRNA for RAB7 protein/cds = (602, 1225) | 1 | AACGAATTTCCTGAACCTATCAAACT GGACAAGAATGACCGGGCAAGGC |
| 2669 | Table 3A | Hs.25911 | NM_004638 | 4758107 | HLA-B associated transcript 2 (BAT2), mRNA/cds = (101, 6529) | 1 | CTTCCCCTGGTCCCCTGTCCCTGGG GCTGTTTGTTAAAAAAGAGTAATAA |
| 2670 | Table 3A | Hs.966 | NM_004645 | 4758023 | coilin (COIL), mRNA/cds = (22, 1752) | 1 | ACCGTGAAAATTGGTTTCATTTAACAA AAGATCAGATCCCTCCTTCAGCT |
| 2671 | Table 3A | Hs.77576 | NM_004652 | 11641424 | ubiquitin specific protease 9, x chromosome (Drosophila fat facets related) (USP9X), transcript variant 1, mRNA/cds = (59, 7750) | 1 | TTTCTTGTTACACCCACTGCACTCTG CAACCAGTGTTGCCTGCCTCATGG |
| 2672 | Table 3A | Hs.80358 | NM_004653 | 4759149 | SMC (mouse) homolog, Y chromosome (SMCY), mRNA/cds = (275, 4694) | 1 | GGGAAAAACAAGAATTTCATGACTCT ACCTGTGGTCTATCTTTAATTTCA |
| 2673 | Table 3A | Hs.121102 | NM_004665 | 4759313 | vanin 2 (VNN2), mRNA/cds = (11, 1573) | 1 | GCTGTGCCCTTGAAGAGAATAGTAAT GATGGGAATTTAGAGGTTTATGAC |
| 2674 | Table 3A | Hs.6856 | NM_004674 | 4757789 | ash2 (absent, small, or homeotic, Drosophila, homolog)-like (ASH2L), mRNA/cds = (4, 1890) | 1 | TCCAAGGAAATGGTAACCTGTTTCTG AGAACACCTGAAATCAATGGCTAT |
| 2675 | Table 3A | Hs.155103 | NM_004681 | 4758253 | eukaryotic translation initiation factor 1A, Y chromosome (EIF1AY), mRNA/cds = (132, 588) | 1 | TTCATTGTAATCCACTGTTTTGGCTTT CATGAACAAGTAAATTACAGTGT |
| 2676 | Table 3A | Hs.54483 | NM_004688 | 4758813 | N-myc (and STAT) interactor (NMI), mRNA/cds = (280, 1203) | 1 | ACTTATTTCCATGTTTCTGAATCTTCT TTGTTTCAAATGGTGCTGCATGT |
| 2677 | Table 3A | Hs.5097 | NM_004710 | 4759201 | synaptogyrin 2 (SYNGR2), mRNA/cds = (29, 703) | 1 | ATGCCCGGCCTGGGATGCTGTTTGG AGACGGAATAAATGTTTTCTCATTC |
| 2678 | Table 3A | Hs.40323 | NM_004725 | 4757879 | BUB3 (budding uninhibited by benzimidazoles 3, yeast) homolog (BUB3), mRNA/cds = (70, 1056) | 1 | TACTCTAAACCTGTTATTTCTGTGCTA ATAAACGAGATGCAGAACCCTTG |
| 2679 | Table 3A | Hs.77324 | NM_004730 | 4759033 | eukaryotic translation termination factor 1 (ETF1), mRNA/cds = (135, 1448) | 1 | TGCAGAGAGATACTAAGCAGCAAAAT CTTGGTGTTGTGATGTACAGAAAT |
| 2680 | Table 3A | Hs.326159 | NM_004735 | 4758689 | leucine rich repeat (in FLII) interacting protein 1 (LRRFIP1), mRNA/cds = (178, 2532) | 1 | AGTCTTTGATCTTGAACCGATACTTTT GGATCTCATTGTTGATATACCTG |
| 2681 | Table 3A | Hs.333513 | NM_004757 | 4758265 | small inducible cytokine subfamily E, member 1 (endothelial monocyte-activating) (SCYE1), mRNA/cds = (49, 987) | 1 | TGGAATCAAATAAAATGCTTCCACTA CCAAAAGACATTAGAGAAAACCTT |
| 2682 | Table 3A | Hs.9075 | NM_004760 | 4758191 | serine/threonine kinase 17a (apoptosis-inducing) (STK17A), mRNA/cds = (117, 1361) | 1 | TGCCGAATACCTTAAAGTAACTAATTA TCCTTACACACAAAAGGCTCAGT |
| 2683 | Table 3A | Hs.170160 | NM_004761 | 4758531 | RAB2, member RAS oncogene family-like (RAB2L), mRNA/cds = (0, 2333) | 1 | CTTTCCCAGGATCAAGGCCACAGGG AGGAAGATTGCACGGGCACTGTTCT |
| 2684 | Table 3A | Hs.1050 | NM_004762 | 4758963 | pleckstrin homology. Sec7 and coiled/coil domains 1 (cytohesin 1) (PSCD1), transcript variant 1, mRNA/cds = (69, 1265) | 1 | CTTGTAAACTAGCGCCAAGGAACTGC AGCAAATAAACTCCAACTCTGCCC |
| 2685 | Table 3A | Hs.11482 | NM_004768 | 4759099 | splicing factor, arginine/serine-rich 11 (SRFS11), mRNA/cds = (83, 1537) | 1 | TGTGCAGTAGAAACAAAAGTAGGCTA CAGTCTGTGCCATGTTGATGTACA |
| 2686 | Table 3A | Hs.15589 | NM_004774 | 4759265 | PPAR binding protein (PPARBP), mRNA/cds = (235, 4935) | 1 | AGGAGGGTTTAAATAGGGTTCAGAGA TCATAGGAATATTAGGAGTTACCT |
| 2687 | Table 3A | Hs.26703 | NM_004779 | 4758945 | CCR4-NOT transcription complex, subunit 8 (CNOT8), mRNA/cds = (244, 1122) | 1 | TGGTGGAAGTAAAAACTGGTAACTCA CTCAAGTGAATGAATGGTCTTGCA |
| 2688 | Table 3A | Hs.23965 | NM_004790 | 4759041 | solute carrier family 22 (organic anion | 1 | GCAGGAAAGGGAAACAGACGCGACA |

TABLE 8-continued

| SEQ ID | Origin | Unigene | Locus | GI | Nominal Description | Strand | Probe Sequence |
|---|---|---|---|---|---|---|---|
| | | | | | transporter), member 6 (SLC22A6), mRNA/cds = (0, 1652) | | GCAACAAGAGCACCAGAAGTATATG |
| 2689 | Table 3A | Hs.77965 | NM_004792 | 4758105 | peptidyl-prolyl isomerase G (cyclophilin G) (PPIG), mRNA/cds = (157, 2421) | 1 | TCCATTCTGTTTCGGATTTTAAGTTTG AGAGACTTGCTAATGAATCTCCT |
| 2690 | Table 3A | Hs.28757 | NM_004800 | 4758873 | transmembrane 9 superfamily member 2 (TM9SF2), mRNA/cds = (133, 2124) | 1 | CCTTCAGAAACACCGTAATTCTAAAT AAACCTCTTCCCATACACCTTTCC |
| 2691 | Table 3A | Hs.49587 | NM_004811 | 4758669 | leupaxin (LPXN), mRNA/cds = (93, 1253) | 1 | CTGGACAACTTTGAGTACTGACATCA TTGATAAATAAACTGGCTTGTGGT |
| 2692 | Table 3A | Hs.168103 | NM_004818 | 4759277 | prp28, U5 snRNP 100 kd protein (U5-100K), mRNA/cds = (39, 2501) | 1 | CCCAGGGGATTTTTAAGTAGATGGG GGGACACGGTGAACTGGCTGTGTC |
| 2693 | Table 3A | Hs.3628 | NM_004834 | 4758523 | mitogen-activated protein kinase kinase kinase kinase 4 (MAP4K4), mRNA/cds = (79, 3576) | 1 | ACTCCAAAATAAATCAAGGCTGCAAT GCAGCTGGTGCTGTTCAGATTCCA |
| 2694 | Table 3A | Hs.102508 | NM_004836 | 4758891 | eukaryotic translation initiation factor 2-alpha kinase 3 (EIF2AK3), mRNA/cds = (72, 3419) | 1 | TGAAATCTTAAGTGTCTTATATGTAAT CCTGTAGGTTGGTACTTCCCCCA |
| 2695 | Table 3A | Hs.227806 | NM_004841 | 4758807 | RAS protein activator like 2 (RASAL2), mRNA/cds = (125, 3544) | 1 | TGGGAGTCTTCTCTTTTAGACAGGGG CTTTTTGTTTTAACCCCAATTGT |
| 2696 | db mining | Hs.78364 | NM_004847 | 6680470 | allograft inflammatory factor 1 (AIF1), transcript variant 2, mRNA/cds = (453, 851) | 1 | TGACCCAGATATGGAAACAGAAGACA AAATTGTAAGCCAGAGTCAACAAA |
| 2697 | Table 3A | Hs.10649 | NM_004848 | 4758579 | basement membrane-induced gene (ICB-1), mRNA/cds = (128, 982) | 1 | AGGTTTCATCAGGTGGTTAAAGTCGT CAAAGTTGTAAGTGACTAACCAAG |
| 2698 | Table 3A | Hs.274472 | NM_004850 | 6633807 | high-mobility group (nonhistone chromosomal) protein 1 (HMG1), mRNA/cds = (52, 699) | 1 | ATGCTGTCAAAGTTACAGTTTACGCA GGACATTCTTGCCGTATTCTCATG |
| 2699 | Table 3A | Hs.178710 | NM_004859 | 4758011 | clathrin, heavy polypeptide (Hc) (CLTC), mRNA/cds = (172, 5199) | 1 | TGTGTGTTTACTAACCCTTCCCTGAG GCTTGTGTATGTTGGATATTGTGG |
| 2700 | Table 3A | Hs.76507 | NM_004862 | 4758913 | LPS-induced TNF-alpha factor (PIG7), mRNA/cds = (233, 919) | 1 | TCTGTAATCAAATGATTGGTGTCATTT TCCCATTTGCCAATGTAGTCTCA |
| 2701 | Table 3A | Hs.59403 | NM_004863 | 4758667 | serine palmitoyltransferase, long chain base subunit 2 (SPTLC2), mRNA/cds = (188, 1876) | 1 | TGCCCAGCAGCCATCTTAATACATTA AACCAGTTTAAAAAATACCTTCCA |
| 2702 | Table 3A | Hs.5409 | NM_004875 | 4759045 | RNA polymerase I subunit (RPA40), mRNA/cds = (22, 1050) | 1 | GCCAGAGTTGCCAACCCCGGCTGG ATACCTTCAGCAGAGAAATCTTCCG |
| 2703 | Table 3A | Hs.66371 | NM_004876 | 4758513 | zinc finger protein 254 (ZNF254), mRNA/cds = (134, 1195) | 1 | AATCCATTAACACCTGCTCACATCTTA CTCAAAATTGTAGAGTTCATAGT |
| 2704 | Table 3A | Hs.75258 | NM_004893 | 4758495 | H2A histone family, member Y (H2AFY), mRNA/cds = (173, 1288) | 1 | ATTTGCAATTTGGAAATTTGTGTGAGTT GATTTAGTAAAATGTTAAACCGC |
| 2705 | Table 3A | Hs.80426 | NM_004899 | 4757871 | brain and reproductive organ-expressed (TNFRSF1A modulator) (BRE), mRNA/cds = (146, 1297) | 1 | AAGTAAAGCCTCAGGAATGCCCACG CCTTTCTTCCAAAGCCTTTGTCTCT |
| 2706 | Table 3A | Hs.145696 | NM_004902 | 4757925 | splicing factor (CC1.3) (CC1.3), mRNA/cds = (149, 1723) | 1 | TCAAACAAATGACTTTCATATTGCAAC AATCTTTGTAAGAACCACTCAAA |
| 2707 | Table 3A | Hs.119 | NM_004906 | 4758635 | Wilms' tumor 1-associating protein (KIAA0105), mRNA/cds = (124, 579) | 1 | GGGGAATGTGTTCCTTCATTGTATTT GGGCCTTTTGTATTGCACTCTTGA |
| 2708 | Table 3A | Hs.737 | NM_004907 | 4758313 | Homo sapiens, Similar to kinesin family member 5B, clone MGC:15265 IMAGE:4297793, mRNA, complete cds/cds = (424, 1566) | 1 | TTGTTTACCTTTCGTGCGGTGGATTC TTTTTAACTCCGTCTACCTGGCGT |
| 2709 | Table 3A | Hs.288156 | NM_004911 | 4758303 | cDNA: FLJ21819 fis, clone HEP01185/cds = UNKNOWN | 1 | GGGGTTTGTGCTATACACTGGGATGT CTAATTGCAGCAATAAAGCCTTTC |
| 2710 | Table 3A | Hs.81964 | NM_004922 | 4758833 | SEC24 (S. cerevisiae) related gene family, member C (SEC24C), mRNA/cds = (114, 3491) | 1 | ACCTGGGATGCCCTGCTCTGGACC TCTCATTTCTCTTCATTGGTTTATT |
| 2711 | Table 3A | Hs.333417 | NM_004930 | 4826658 | capping protein (actin filament) muscle Z-line, beta (CAPZB), mRNA/cds = (0, 818) | 1 | AGCCTGCTTCTGCCACACCTCGCTCT CAGTCTCTCCACATTTCCATAGAG |
| 2712 | Table 3A | Hs.2299 | NM_004931 | 4826666 | CD8 antigen, beta polypeptide 1 (p37) (CD8B1), mRNA/cds = (50, 682) | 1 | AAGTTTCTCAGCTCCCATTTCTACTCT CCCATGGCTTCATGCTTCTTTCA |
| 2713 | Table 3A | Hs.171872 | NM_004941 | 4826689 | DEAD/H (Asp-Glu-Ala-Asp/His) box polypeptide 8 (RNA helicase) (DDX8), mRNA/cds = (73, 3735) | 1 | GAGCTACTGTGCTCATCTAAAGTGTT TGCCCCACTTCCCACCCCGTCTCC |
| 2714 | Table 3A | Hs.251064 | NM_004965 | 4826757 | high-mobility group (nonhistone chromosomal) protein 14 (HMG14), mRNA/cds = (150, 452) | 1 | ATGTTAAGATTTGTGTACAAATTGAAA TGTCTGTACTGATCCTCAACCAA |
| 2715 | Table 3A | Hs.808 | NM_004966 | 14141150 | heterogeneous nuclear ribonucleoprotein F (HNRPF), mRNA/cds = (323, 1570) | 1 | TCTGTTGATAGCTGGAGAACTTTAGT TTCAAGTACTACATTGTGAAAGCA |
| 2716 | literature | Hs.115541 | NM_004972 | 13325062 | Janus kinase 2 (a protein tyrosine kinase) (JAK2), mRNA/cds = (494, 3892) | 1 | TGAGGGGTTTCAGAATTTTGCATTGC AGTCATAGAAGAGATTTATTTCCT |
| 2717 | Table 3A | Hs.40154 | NM_004973 | 11863151 | jumonji (mouse) homolog (JMJ), mRNA/cds = (244, 3984) | 1 | CCTTGGGAGGGAGACTTCATGTGGTT TATTGCGAGTTTTTTGTTTACTTT |
| 2718 | Table 3A | Hs.184050 | NM_004985 | 4826811 | v-Ki-ras2 Kirsten rat sarcoma 2 viral oncogene homolog (KRAS2), mRNA/ | 1 | GTATGTTAATGCCAGTCACCAGCAGG CTATTTCAAGGTCAGAAGTAATGA |

TABLE 8-continued

| SEQ ID | Origin | Unigene | Locus | GI | Nominal Description | Strand | Probe Sequence |
|---|---|---|---|---|---|---|---|
| 2719 | Table 3A | Hs.279946 | NM_004990 | 14043021 | methionine-tRNA synthetase (MARS), mRNA/cds = (23, 2725) | 1 | GCCCCTAAAGGCAAGAAGAAAA AGTAAAAGACCTTGGCTCATAGAA AGTC |
| 2720 | Table 3A | Hs.75103 | NM_005005 | 6274549 | tyrosine 3-monooxygenase/tryptophan 5-monooxygenase activation protein, zeta polypeptide (YWHAZ), mRNA/cds = (84, 621) | 1 | AGTGAAATATGTTACAGAACATGCAC TTGCCCTAATAAAAAATCAGTGAA |
| 2721 | Table 3A | Hs.8248 | NM_005006 | 4826855 | NADH dehydrogenase (ubiquinone) Fe S protein 1 (75 kD) (NADH-coenzyme Q reductase) (NDUFS1), mRNA/cds = (46, 2229) | 1 | TGCAGATGCTCTTAAAAGCATTGATA ACCTTTGTGACGAACATAAAGAGA |
| 2722 | Table 3A | Hs.182255 | NM_005008 | 4826859 | non-histone chromosome protein 2 (S. cerevisiae)-like 1 (NHP2L1), mRNA/cds = (94, 480) | 1 | GCTAGTTCATGTGTTCTCCATTCTTGT GAGCATCCTAATAAATCTGTTCC |
| 2723 | Table 3A | Hs.151134 | NM_005015 | 4826879 | oxidase (cytochrome c) assembly 1-like (OXA1L), mRNA/cds = (0, 1487) | 1 | AACCCTCCCAATATCCCTAGCAGCAG CAGCAAACCAAAGTCAAAGTATCC |
| 2724 | Table 3A | Hs.75721 | NM_005022 | 4826897 | profilin 1 (PFN1), mRNA/cds = (127, 549) | 1 | CACCTCCCCCTACCCATATCCCTCCC GTGTGTGGTTGGAAAACTTTTGTT |
| 2725 | db mining | Hs.100724 | NM_005037 | 4826929 | peroxisome proliferative activated receptor, gamma (PPARG), mRNA/cds = (172, 1608) | 1 | GAGTCCTGAGCCACTGCCAACATTTC CCTTCTTCCAGTTGCACTATTCTG |
| 2726 | literature | Hs.180455 | NM_005053 | 4826963 | RAD23 (S. cerevisiae) homolog A (RAD23A), mRNA/cds = (38, 1127) | 1 | CCCCACCCCAGAACAGAACCGTGTC TCTGATAAAGGTTTTGAAGTGAATA |
| 2727 | Table 3A | Hs.180610 | NM_005066 | 4826997 | splicing factor proline/glutamine rich (polypyrimidine tract-binding protein-associated) (SFPQ), mRNA/cds = (85, 2208) | 1 | CCCATTTCTTGTTTTTAAAAGACCAAC AAATCTCAAGCCCTATAAATGGC |
| 2728 | Table 3A | Hs.149923 | NM_005080 | 14110394 | X-box binding protein 1 (XBP1), mRNA/cds = (48, 833) | 1 | AGTGTAGCTTCTGAAAGGTGCTTTCT CCATTTATTTAAAACTACCCATGC |
| 2729 | Table 3A | Hs.1579 | NM_005082 | 4827064 | zinc finger protein 147 (estrogen-responsive finger protein) (ZNF147), mRNA/cds = (39, 1931) | 1 | GAGTGCCCGATTCCTCTTAGAGAAAA TCCATAGCCTTCAGATCTTGGTGT |
| 2730 | Table 3A | Hs.82712 | NM_005087 | 4826735 | fragile X mental retardation, autosomal homolog 1 (FXR1), mRNA/cds = (12, 1877) | 1 | ACTTTGACACCTACTGTGTTATAAAAT ATATCATCAGATGTGCCTTGAGA |
| 2731 | Table 3A | Hs.21595 | NM_005088 | 10835221 | DNA segment on chromosome X and Y (unique) 155 expressed sequence (DXYS155E), mRNA/cds = (166, 1323) | 1 | AGCTGTAACGTTCGCGTTAGGAAAGA TGGTGTTTATTCCAGTTTGCATTT |
| 2732 | literature | Hs.248197 | NM_005092 | 4827033 | tumor necrosis factor (ligand) superfamily, member 18 (TNFSF18), mRNA/cds = (0, 533) | 1 | TGATATTCAACTCTGAGCATCAGGTT CTAAAAAATAATACATACTGGGGT |
| 2733 | Table 3A | Hs.75243 | NM_005104 | 12408641 | bromodomain-containing 2 (BRD2), mRNA/cds = (1701, 4106) | 1 | GTCATCTCCCCATTTGGTCCCCTGGA CTGTCTTTGTTGATTCTAACTTGT |
| 2734 | Table 3A | Hs.95220 | NM_005109 | 4826877 | oxidative-stress responsive 1 (OSR1), mRNA/cds = (342, 1925) | 1 | GAGAATAATGATGTACCAATAAGTGG AGATTCCTCCTTATGATGTATGCT |
| 2735 | literature | Hs.241382 | NM_005118 | 4827031 | tumor necrosis factor (ligand) superfamily, member 15 (TNFSF15), mRNA/cds = (1123, 1647) | 1 | ACAAGACAGACTCCACTCAAAATTTA TATGAACACCACTAGATACTTCCT |
| 2736 | Table 3A | Hs.11861 | NM_005121 | 4827043 | thyroid hormone receptor-associated protein, 240 kDa subunit (TRAP240), mRNA/cds = (77, 6601) | 1 | TCCATACCATTGTGTGTGGAGGATTT ACAGCTAAGCTGTAGTTGCAGAGT |
| 2737 | Table 3A | Hs.3382 | NM_005134 | 4826933 | protein phosphatase 4, regulatory subunit 1 (PPP4R1), mRNA/cds = (93, 2894) | 1 | ACACTTTTGATTGTTTTCTAGATGTCT ACCAATAAATGCAATTTGTGACC |
| 2738 | Table 3A | Hs.75981 | NM_005151 | 4827049 | ubiquitin specific protease 14 (tRNA-guanine transglycosylase) (USP14), mRNA/cds = (91, 1575) | 1 | ACTGTACAATTTCTGAAGATGGTTATT AACACTGTGCTGTTAAGCATCCA |
| 2739 | Table 3A | Hs.152818 | NM_005154 | 4827053 | ubiquitin specific protease 8 (USP8), mRNA/cds = (317, 3673) | 1 | TCAGTCCTTTCTTAGGGAAATGACAG GGCAAAGCAATTTTTCTGTTGGCT |
| 2740 | Table 3A | Hs.89399 | NM_005176 | 6671590 | ATP synthase, H+ transporting, mitochondrial F0 complex, subunit c (subunit 9), isoform 2 (ATP5G2), mRNA/cds = (59, 484) | 1 | AGTACAAGGCCCGAAGGGTAGTGAT GGTGCTAAACTCAACATGGATTTGG |
| 2741 | Table 3A | Hs.431 | NM_005180 | 4885094 | murine leukemia viral (bmi-1) oncogene homolog (BMI1), mRNA/cds = (479, 1459) | 1 | CCCCAGTCTGCAAAAGAAGCACAATT CTATTGCTTTGTCTTATAGT |
| 2742 | Table 3A | Hs.838 | NM_005191 | 4885122 | CD80 antigen (CD28 antigen ligand 1, B7-1 antigen) (CD80), mRNA/cds = (375, 1241) | 1 | CTTCTTTTGCCATGTTTCCATTCTGCC ATCTTGAATTGTCTTGTCAGCCA |
| 2743 | Table 3A | Hs.247824 | NM_005214 | 4885166 | cytotoxic T-lymphocyte-associated protein 4 (CTLA4), mRNA/cds = (0, 671) | 1 | GGGTCTATGTGAAAATGCCCCCAACA GAGCCAGAATGTGAAAAGCAATTT |
| 2744 | literature | Hs.211567 | NM_005215 | 4885174 | deleted in colorectal carcinoma (DCC), mRNA/cds = (0, 4343) | 1 | CCTTCTTTCACAGGCATCAGGAATTG TCAAATGATGATTATGAGTTCCCT |

TABLE 8-continued

| SEQ ID | Origin | Unigene | Locus | GI | Nominal Description | Strand | Probe Sequence |
|---|---|---|---|---|---|---|---|
| 2745 | literature | Hs.34789 | NM_005216 | 4885176 | dolichyl-diphosphooligosaccharide-protein glycosyltransferase (DDOST), mRNA/cds = (0, 1370) | 1 | CATCTTCAGCATCGTCTTCTTGCACA TGAAGGAGAAGGAGAAGTCCGACT |
| 2746 | literature | Hs.89296 | NM_005238 | 4885216 | excision repair cross-complementing rodent repair deficiency, complementation group 4 (ERCC4), mRNA/cds = (0, 2750) | 1 | GGGAATGCTGCAAATGCCAAACAGCT TTATGATTTCATTCACACCTCTTT |
| 2747 | Table 3A | Hs.129953 | NM_005243 | 4885224 | Ewing sarcoma breakpoint region 1 (EWSR1), transcript variant EWS, mRNA/cds = (43, 2013) | 1 | TTAAAAATGGTTGTTTAAGACTTTAAC AATGGGAACCCCTTGTGAGCATG |
| 2748 | Table 3A | Hs.1422 | NM_005248 | 4885234 | Gardner-Rasheed feline sarcoma viral (v-fgr) oncogene homolog (FGR), mRNA/cds = (147, 1736) | 1 | GGGAGAAGTTTGCAGAGCACTTCCC ACCTCTCCTGAATAGTGTGTATGTGT |
| 2749 | Table 3A | Hs.79022 | NM_005261 | 4885262 | GTP-binding protein overexpressed in skeletal muscle (GEM), mRNA/cds = (213, 1103) | 1 | TGGTTGACCCTTGTATGTCACAGCTC TGCTCTATTTATTATTATTTTGCA |
| 2750 | Table 3A | Hs.73172 | NM_005263 | 4885266 | growth factor independent 1 (GFI1), mRNA/cds = (267, 1535) | 1 | TGGGAAGGAAGGCTCTGTCTTCAACT CTTTGACCCTCCATGTGTACCATA |
| 2751 | Table 3A | Hs.237519 | NM_005271 | 4885280 | yz35c09.s1 cDNA, 3' end/ clone = IMAGE:285040/clone_end = 3' | 1 | GCATGGCTTAACCTGGTGATAAAAGC AGTTATTAAAAGTCTACGTTTTCC |
| 2752 | Table 3A | Hs.239891 | NM_005301 | 4885320 | G protein-coupled receptor 35 (GPR35), mRNA/cds = (0, 929) | 1 | CTCCCCGTGCTAAGGCCCACAAAAG CCAGGACTCTCTGTGCGTGACCCTC |
| 2753 | Table 3A | Hs.289101 | NM_005313 | 4885358 | glucose regulated protein, 58 kD (GRP58), mRNA/cds = (0, 1517) | 1 | AATTCAAGAAGAAAAACCCAAG AAGAAGAAGAAGGCACAGGAGGAT CTCT |
| 2754 | literature | Hs.89578 | NM_005316 | 4885364 | *Homo sapiens*, general transcription factor I/H, polypeptide 1 (62 kD subunit), clone MGC:8323 IMAGE: 2819217, mRNA, complete cds/cds = (169, 1815) | 1 | TCCCAGAGCTGATGCTATTGTACTTG CACATTGGAGACTGAAAGGAAAGA |
| 2755 | literature | Hs.136657 | NM_005320 | 4885376 | H1 histone family, member 3 (H1F3), mRNA/cds = (0, 665) | 1 | GGGGAAGCCGAAGGTTACAAAGGCA AAGAAGGCAGCTCCGAAGAAAAAGT |
| 2756 | Table 3A | Hs.14601 | NM_005335 | 4885404 | hematopoietic cell-specific Lyn substrate 1 (HCLS1), mRNA/cds = (42, 1502) | 1 | TCCCTGAAGAAATATCTGTGAACCTT CTTTCTGTTCAGTCCTAAAATTCG |
| 2757 | Table 3A | Hs.132834 | NM_005337 | 4885410 | hematopoietic protein 1 (HEM1), mRNA/cds = (1582, 3423) | 1 | CCTCTCCGACCTTCATCACTATTCTTA GGATAATGCTGGCGGGCAGAGAT |
| 2758 | Table 3A | Hs.193989 | NM_005345 | 5579469 | TAR DNA binding protein (TARDBP), mRNA/cds = (88, 1332) | 1 | ACTGCCATCTTACGACTATTTCTTCTT TTTAATACACTTAACTCAGGCCA |
| 2759 | Table 3A | Hs.274402 | NM_005346 | 5579470 | heat shock 70 kD protein 1B (HSPA1B), mRNA/cds = (152, 2077) | 1 | AGGGTGTTTCGTTCCCTTTAAATGAA TCAACACTGCCACCTTCTGTACGA |
| 2760 | Table 3A | Hs.289088 | NM_005348 | 13129149 | heat shock 90 kD protein 1, alpha (HSPCA), mRNA/cds = (60, 2258) | 1 | GACCCTACTGCTGATGATACCAGTGC TGCTGTAACTGAAGAAATGCCACC |
| 2761 | Table 3A | Hs.1765 | NM_005356 | 4885448 | lymphocyte-specific protein tyrosine kinase (LCK), mRNA/cds = (51, 1580) | 1 | CATTTCCTGAGACCACCAGAGAGAG GGGAGAAGCCTGGGATTGACAGAAG |
| 2762 | Table 3A | Hs.1765 | NM_005356 | 4885448 | lymphocyte-specific protein tyrosine kinase (LCK), mRNA/cds = (51, 1580) | 1 | CATTTCCTGAGACCACCAGAGAGAG GGGAGAAGCCTGGGATTGACAGAAG |
| 2763 | db mining | Hs.75862 | NM_005359 | 4885456 | MAD (mothers against decapentaplegic, Drosophila) homolog 4 (MADH4), mRNA/cds = (128, 1786) | 1 | GCTAAGAAGCCTATAAGAGGAATTTC TTTTCCTTCATTCATAGGGAAAGG |
| 2764 | Table 3A | Hs.297939 | NM_005385 | 6631099 | cathepsin B (CTSB), mRNA/cds = (177, 1196) | 1 | ACTGACAGAGTGAACTACAGAAATAG CTTTTCTTCCTAAAGGGGATTGTT |
| 2765 | literature | Hs.301862 | NM_005395 | 4885552 | postmeiotic segregation increased 2-like 9 (PMS2L9), mRNA/cds = (0, 794) | 1 | CAGACAATGGATGTGGGGTAGAAGA AGAAACTTTGAAGGCTTAATCTCT |
| 2766 | Table 3A | Hs.288757 | NM_005402 | 4885568 | v-ral simian leukemia viral oncogene homolog A (ras related) (RALA), mRNA/cds = (0, 629) | 1 | AAAAGAAGAGGAAAAGTTTAGC CAAGAGAATCAGAGAAAGATGCTG CATT |
| 2767 | literature | Hs.103982 | NM_005409 | 14790145 | small inducible cytokine subfamily B (Cys-X-Cys), member 11 (SCYB11), mRNA/cds = (93, 377) | 1 | AGTGCACATATTTCATAACCAAATTAG CAGCACCGGTCTTAATTTGATGT |
| 2768 | Table 3A | Hs.72988 | NM_005419 | 4885614 | signal transducer and activator of transcription 2, 113 kD (STAT2), mRNA/cds = (57, 2612) | 1 | TAGACCTCTTTTTCTTACCAGTCTCCT CCCCTACTCTGCCCCCTAAGCTG |
| 2769 | literature | Hs.129727 | NM_005431 | 4885656 | X-ray repair complementing defective repair in Chinese hamster cells 2 (XRCC2), mRNA/cds = (86, 928) | 1 | AGCACAGTAAAAGTAAAGACTATTCT GTTTCTAGGCTGTTGAATCAAAGT |
| 2770 | literature | Hs.99742 | NM_005432 | 12408644 | X-ray repair complementing defective repair in Chinese hamster cells 3 (XRCC3), mRNA/cds = (353, 1393) | 1 | CATGGGCACAGTGGTGACCCCTTG ATTCCCACCGTACAACCCCCTCCAC |
| 2771 | literature | Hs.75238 | NM_005441 | 4885104 | chromatin assembly factor 1, subunit B (p60) (CHAF1B), mRNA/cds = (62, 1741) | 1 | CGTTATCCAGTGTGAAAATCAGTGAG TCCTCCCTGGCATCCTCGTGAAAG |
| 2772 | Table 3A | Hs.301704 | NM_005442 | 11321608 | eomesodermin (*Xenopus laevis*) homolog (EOMES), mRNA/cds = (0, 2060) | 1 | GCTGAAGAGTATAGTAAAGACACCTC AAAAGGCATGGGAGGGTATTATGC |

TABLE 8-continued

| SEQ ID | Origin | Unigene | Locus | GI | Nominal Description | Strand | Probe Sequence |
|---|---|---|---|---|---|---|---|
| 2773 | Table 3A | Hs.169487 | NM_005461 | 4885446 | Kreisler (mouse) maf-related leucine zipper homolog (KRML), mRNA/cds = (73, 1044) | 1 | TTCAGACTGGTTTCTGTTTTTTGGTTA TTAAAATGGTTTCCTATTTTGCT |
| 2774 | Table 3A | Hs.170311 | NM_005463 | 14110410 | heterogeneous nuclear ribonucleoprotein D-like (HNRPDL), transcript variant 1, mRNA/cds = (580, 1642) | 1 | TTTATGATTAGGTGACGAGTTGACAT TGAGATTGTCCTTTTCCCCTGATC |
| 2775 | literature | Hs.24284 | NM_005484 | 11496991 | ADP-ribosyltransferase (NAD+; poly(ADP-ribose) polymerase)-like 2 (ADPRTL2), mRNA/cds = (149, 1753) | 1 | CCCCAACCAGGTCCGTATGCGGTAC CTTTTAAAGGTTCAGTTTAATTTCC |
| 2776 | literature | Hs.271742 | NM_005485 | 11496992 | ADP-ribosyltransferase (NAD+; poly (ADP-ribose) polymerase)-like 3 (ADPRTL3), mRNA/cds = (246, 1847) | 1 | TCCTGCAAGFGCTGGACTGTGATCTTC AATCATCCTGCCCATCTCTGGTAC |
| 2777 | Table 3A | Hs.180370 | NM_005507 | 5031634 | cofilin 1 (non-muscle) (CFL1), mRNA/cds = (51, 551) | 1 | GGTCACGGCTACTCATGGAAGCAGG ACCAGTAAGGGACCTTCCGATTAAAA |
| 2778 | literature | Hs.184926 | NM_005508 | 5031626 | chemokine (C—C motif) receptor 4 (CCR4), mRNA/cds = (182, 1264) | 1 | CCTTCTAACCTGAACTGATGGGTTTC TCCAGAGGGAATTGCAGAGTACTG |
| 2779 | Table 3A | Hs.77961 | NM_005514 | 5031742 | major histocompatibility complex, class I, B (HLA-B), mRNA/cds = (0, 1088) | 1 | ATGTGTAGGAGGAAGAGTTCAGGTG GAAAAGGAGGGAGCTACTCTCAGGC |
| 2780 | Table 3A | Hs.334767 | NM_005517 | 5031748 | hypothetical protein MGC5629 (MGC5829), mRNA/cds = (285, 539) | 1 | AACGATTGTCTGCCCATGTCCTGCCT GAAATACCATGATTGTTTATGGAA |
| 2781 | Table 3A | Hs.245710 | NM_005520 | 5031752 | heterogeneous nuclear ribonucleoprotein H1 (H) (HNRPH1), mRNA/cds = (72, 1421) | 1 | TTCCTTTTAGGTATATTGCGCTAAGT GAAACTTGTCAAATAAATCCTCCT |
| 2782 | Table 3A | Hs.177559 | NM_005534 | 5031782 | interferon gamma receptor 2 (interferon gamma transducer 1) (IFNGR2), mRNA/cds = (648, 1661) | 1 | GTCTTGACTTTGGCAAATGAGCCGGA GCCCCTTGGGCAGGTCACACAACC |
| 2783 | literature | Hs.121544 | NM_005535 | 5031784 | interleukin 12 receptor, beta 1 (IL12RB1), mRNA/cds = (64, 2052) | 1 | GATACAGAGTTGTCCTTGGAGGATGG AGACAGGTGCAAGGCCAAGATGTG |
| 2784 | Table 3A | Hs.155939 | NM_005541 | 5031798 | inositol polyphosphate-5-phosphatase, 145 kD (INPP5D), mRNA/cds = (140, 3706) | 1 | TCCCATGATGGAAGTCTGCGTAACCA ATAAATTGTGCCTTTCTCACTCAA |
| 2785 | Table 3A | Hs.56205 | NM_005542 | 5031800 | insulin induced gene 1 (INSIG1), mRNA/cds = (414, 1247) | 1 | TCTACATGTCTTGGGGGCGGGCTCA AATTCTTCGAAAGTGGTTGGATTAA |
| 2786 | Table 3A | Hs.211576 | NM_005546 | 5031810 | IL2-inducible T-cell kinase (ITK), mRNA/cds = (2021, 3883) | 1 | ACCTGTTATCCTTTGTAGAGCACACA GAGTTAAAAGTTGAATATAGCAAT |
| 2787 | Table 3A | Hs.23881 | NM_005556 | 5031842 | keratin 7 (KRT7), mRNA/cds = (56, 1465) | 1 | TGAGCTTCTCCAGCAGTGCGGGTCC TGGGCTCCTGAAGGCTTATTCCATC |
| 2788 | Table 3A | Hs.81915 | NM_005563 | 13518023 | stathmin 1/oncoprotein 18 (STMN1), mRNA/cds = (91, 540) | 1 | GCATGTCCTCATCCTTTCCTGCCATA AAAGCTATGACACGAGAATCAGAA |
| 2789 | Table 3A | Hs.2488 | NM_005565 | 7382491 | lymphocyte cytosolic protein 2 (SH2 domain-containing leukocyte protein of 76 kD) (LCP2), mRNA/cds = (207, 1808) | 1 | ACCCCTCCCCATGAACACAAGGGTTT TATCCTTTCCTTTAAAAACAGTGT |
| 2790 | Table 3A | Hs.314760 | NM_005566 | 5031856 | HOA7-1-F8 cDNA | 1 | TGCAACCAACTATCCAAGTGTTATAC CAACTAAAACCCCCAATAAACCTT |
| 2791 | db mining | Hs.153883 | NM_005585 | 5031898 | Smad6 mRNA, complete cds/cds = (936, 2426) | 1 | ATGCCCAGACAAAAAGCTAATACCAG TCACTCGATAATAAAGTATTCGCA |
| 2792 | literature | Hs.20555 | NM_005590 | 5031920 | meiotic recombination (S. cerevisiae) 11 homolog A (MRE11A), mRNA/cds = (170, 2296) | 1 | TGGCACTGAGAAACATGCAAGATACA GGAAAAATGAAAATGTTACAAGCT |
| 2793 | Table 3A | Hs.158164 | NM_005594 | 5031930 | transporter 1, ATP-binding cassette, sub-family B (MDR/TAP) (TAP1), mRNA/cds = (30, 2456) | 1 | TCTCAAAGGAGTAACTGCAGCTTGGT TTGAAATTTGTACTGTTTCTATCA |
| 2794 | Table 3A | Hs.18069 | NM_005606 | 5031990 | Homo sapiens, protease, cysteine, 1 (legumain), clone MGC:15832 IMAGE:3507728, mRNA, complete cds/cds = (1124, 2425) | 1 | GTCAACCTTTGTGAGAAGCCGTATCC ACTTCACAGGATAAAATTGTCCAT |
| 2795 | Table 3A | Hs.256290 | NM_005620 | 5032058 | S100 calcium-binding protein A11 (caligizzarin) (S100A11), mRNA/cds = (120, 437) | 1 | ATCTCCACAGCCCACCCATCCCCTGA GCACACTAACCACCTCATGCAGGC |
| 2796 | Table 3A | Hs.8180 | NM_005625 | 5032082 | syndecan binding protein (syntenin) (SDCBP), mRNA/cds = (148, 1044) | 1 | TTTCCTGACTCCTCCTTGCAAACAAA ATGATAGTTGACACTTTATCCTGA |
| 2797 | Table 3A | Hs.76122 | NM_005626 | 5032088 | splicing factor, arginine/serine-rich 4 (SFRS4), mRNA/cds = (47, 1531) | 1 | CCTGCAGTAACCCATAGGAAATAAAC TGTAGAGTTCCATATTCTGCGGCC |
| 2798 | Table 3A | Hs.296323 | NM_005627 | 5032090 | serum/glucocorticoid regulated kinase (SGK), mRNA/cds = (42, 1337) | 1 | TAGAAAGGGTTTTTATGGACCAATGC CCCAGTTGTCAGTCAGAGCCGTTG |
| 2799 | Table 3A | Hs.155188 | NM_005642 | 14717406 | TATA box binding protein (TBP)-associated factor, RNA polymerase II, F, 55 kD (TAF2F), mRNA/cds = (740, 1789) | 1 | TGTGATGACGTGAGATCAATAAGAAG AACCTAGTCTAGAGACAATGATGC |
| 2800 | literature | Hs.100030 | NM_005652 | 5032168 | telomeric repeat binding factor 2 (TERF2), mRNA/cds = (124, 1626) | 1 | GTGCTTGCTGTCTCTCCCGGACACCC TTAAAGACTGTCTTTTAGCAAAA |
| 2801 | Table 3A | Hs.82173 | NM_005655 | 5032176 | TGFB inducible early growth response (TIEG), mRNA/cds = (123, 1565) | 1 | AACATTGTTTTTGTATATTGGGTGTAG ATTTCTGACATCAAAACTTGGAC |
| 2802 | literature | Hs.170263 | NM_005657 | 5032188 | tumor protein p53-binding protein, 1 | 1 | TGTGTAACTGGATTCCTTGCATGGAT |

TABLE 8-continued

| SEQ ID | Origin | Unigene | Locus | GI | Nominal Description | Strand | Probe Sequence |
|---|---|---|---|---|---|---|---|
| 2803 | Table 3A | Hs.2134 | NM_005658 | 5032192 | (TP53BP1), mRNA/cds = (173, 6091) TNF receptor-associated factor 1 (TRAF1), mRNA/cds = (75, 1325) | 1 | CTTGTATATAGTTTTATTTGCTGA CAGGACCTCCAAGCCACTGAGCAAT GTATAACCCCAAAGGGAATTCAAAA |
| 2804 | Table 3A | Hs.7381 | NM_005662 | 5032220 | voltage-dependent anion channel 3 (VDAC3), mRNA/cds = (99, 950) | 1 | GATCTGACCCACCAGTTTGTACATCA CGTCCTGCATGTCCCACACCATTT |
| 2805 | Table 3A | Hs.155968 | NM_005667 | 5031824 | zinc finger protein homologous to Zfp103 in mouse (ZFP103), mRNA/cds = (922, 2979) | 1 | ACAATCTCTGTCCAGCACCTCTTGGT TAAATAATGTATGCTGTGAGACAT |
| 2806 | Table 3A | Hs.172813 | NM_005678 | 13027652 | PAK-interacting exchange factor beta (P85SPR), mRNA/cds = (473, 2413) | 1 | TGCGTCTTGTGAAATTGTGTAGAGTG TTTGTGAGCTTTTTGTTCCCTCAT |
| 2807 | Table 3A | Hs.30570 | NM_005710 | 5031956 | polyglutamine binding protein 1 (PQBP1), mRNA/cds = (257, 1054) | 1 | CTTCGGCCTCCCTGGCCCTGGGTTA AAATAAAAGCTTTCTGGTGATCCTG |
| 2808 | Table 3A | Hs.82425 | NM_005717 | 5031592 | actin related protein 2/3 complex, subunit 5 (16 kD) (ARPC5), mRNA/cds = (24, 479) | 1 | TGAGCTTGTGCTTAGTATTTACATTG GATGCCAGTTTTGTAATCACTGAC |
| 2809 | Table 3A | Hs.6895 | NM_005719 | 5031596 | actin related protein 2/3 complex, subunit 3 (21 kD) (ARPC3), mRNA/cds = (25, 561) | 1 | ATTTGAAATTTTCTGCAGCATTAAAGC TGGCGCTTAATAAGAATAAGTAA |
| 2810 | Table 3A | Hs.10927 | NM_005721 | 7262289 | HSZ78330 cDNA/clone = 2.49-(CEPH) | 1 | TCGCATTCTGTTTCTTGCTTAAAAGA AGAGTAAAGACAAGAGTGTTGGA |
| 2811 | Table 3A | Hs.42915 | NM_005722 | 5031570 | ARP2 (actin-related protein 2, yeast) homolog (ACTR2), mRNA/cds = (74, 1258) | 1 | CCTGCCAGTGTCAGAAAATCCTATTT ATGAATCCTGTCGGTATTCCTTGG |
| 2812 | Table 3A | Hs.173125 | NM_005729 | 5031986 | peptidylprolyl isomerase F (cyclophilin F) (PPIF), mRNA/cds = (83, 706) | 1 | CTGTCAGCCAAGGTGCCTGAAACGAT ACGTGTGCCCACTCCACTGTCACA |
| 2813 | Table 3A | Hs.83583 | NM_005731 | 5031598 | actin related protein 2/3 complex, subunit 2 (34 kD) (ARPC2), mRNA/cds = (84, 988) | 1 | GAAGCGGCTGGCAACTGAAGGCTGG AACACTTGCTACTGGATAATCGTAG |
| 2814 | literature | Hs.41587 | NM_005732 | 5032016 | Rad50 (Rad50) mRNA, complete cds/cds = (388, 4326) | 1 | TCGATCAGTGCTCAGAGATTGTGAAA TGCAGTGTTAGCTCCCTGGGATTC |
| 2815 | Table 3A | Hs.182591 | NM_005739 | 6382080 | RAS guanyl releasing protein 1 (calcium and DAG-regulated) (RASGRP1), mRNA/cds = (103, 2498) | 1 | AGGACAAATCTTGTTGTATTAACAGC AGGGTCACTTCTCATTTTCTTTGC |
| 2816 | Table 3A | Hs.182429 | NM_005742 | 5031972 | protein disulfide isomerase-related protein (P5), mRNA/cds = (94, 1416) | 1 | AGTCGTATTCTGTCACATAATATTTTG AAGAAAACTTGGCTGTCGAAACA |
| 2817 | Table 3A | Hs.291904 | NM_005745 | 10047078 | accessory proteins BAP31/BAP29 (DXS1357E), mRNA/cds = (136, 876) | 1 | AGGAGGGTGGGTGGAACAGGTGGAC TGGAGTTTCTCTTGAGGGCAATAAA |
| 2818 | Table 3A | Hs.291904 | NM_005745 | 10047078 | accessory proteins BAP31/BAP29 (DXS1357E), mRNA/cds = (138, 876) | 1 | AGGAGGGTGGGTGGAACAGGTGGAC TGGAGTTTCTCTTGAGGGCAATAAA |
| 2819 | Table 3A | Hs.239138 | NM_005748 | 5031976 | pre-B-cell colony-enhancing factor (PBEF), mRNA/cds = (27, 1502) | 1 | TGCACCTCAAGATTTTAAGGAGATAA TGTTTTAGAGAGAATTTCTGCTT |
| 2820 | Table 3A | Hs.179608 | NM_005771 | 5032034 | retinol dehydrogenase homolog (RDHL), mRNA/cds = (7, 978) | 1 | GCTTATGGTCCCCAGCATTTACAGTA ACTTGTGAATGTTAAGTATCATCT |
| 2821 | Table 3A | Hs.173993 | NM_005777 | 5032032 | RNA binding motif protein 6 (RBM6), mRNA/cds = (133, 3504) | 1 | CTTGTTTTGTTTGTCTCTCCTTTTCTT TTGTTACTGTTCTTGCTGCTAGA |
| 2822 | Table 3A | Hs.201675 | NM_005778 | 5032030 | RNA binding motif protein 5 (RBM5), mRNA/cds = (148, 2595) | 1 | TTTTGGAAGATTTTCAGTCTAGTTGC CAAATCTGGCTCCTTTACAAAAGA |
| 2823 | Table 3A | Hs.152720 | NM_005792 | 5031918 | M-phase phosphoprotein 6 (MPHOSPH6), mRNA/cds = (32, 514) | 1 | TCAAGAATAAAAATGCCTCTCCAGCC TTAAGTATTTACATGCTCCCAGGT |
| 2824 | Table 3A | Hs.179982 | NM_005802 | 5032190 | tumor protein p53-binding protein (TP53BPL), mRNA/cds = (540, 2987) | 1 | TCTGGAAATGTGTTATAAGCTAGGAG AATCCCTTTGGACAGTCTTTATTT |
| 2825 | Table 3A | Hs.143460 | NM_005813 | 6563384 | protein kinase C, nu (PRKCN), mRNA/cds = (555, 3227) | 1 | ATTTCCTATCACCATACTTTTCCATGT GAAAACCTGAGCCTATTTCTAGT |
| 2826 | Table 3A | Hs.142023 | NM_005816 | 5032140 | T cell activation, increased late expression (TACTILE), mRNA/cds = (928, 2637) | 1 | TGGCTGTTGCTTTGCTTCATGTGTAT GGCTATTTGTATTTAACAAGACTT |
| 2827 | Table 3A | Hs.157144 | NM_005819 | 5032130 | syntaxin 6 (STX6), mRNA/cds = (0, 767) | 1 | ATAGCCATCCTCTTTGCAGTCCTGTT GGTTGTGCTCATCCTCTTCCTAGT |
| 2828 | Table 3A | Hs.99491 | NM_005825 | 5031822 | RAS guanyl releasing protein 2 (calcium and DAG-regulated) (RASGRP2), mRNA/cds = (253, 2082) | 1 | AGGGCCAGGGCTGGTGTCCCTAAGG TTGTACAGACTCTTGTGAATATTTG |
| 2829 | Table 3A | Hs.15265 | NM_005826 | 14141188 | heterogeneous nuclear ribonucleoprotein R (HNRPR), mRNA/cds = (90, 1991) | 1 | GCCGTGACAATTTGTTCTTTGATGTG ATTGTATTTCCAATTTCTTGTTCA |
| 2830 | Table 3A | Hs.18192 | NM_005839 | 5032118 | Ser/Arg-related nuclear matrix protein (plenty of prolines 101-like) (SRM160), mRNA/cds = (5, 2467) | 1 | TGGTATATACAACTTTCAGAGCCTCT TGTATTTGGAAGGCTGGAAGGGCC |
| 2831 | Table 3A | Hs.29117 | NM_005859 | 5032006 | purine-rich element binding protein A (PURA), mRNA/cds = (59, 1027) | 1 | GCTACTGCAGGGTGAGGAAGAAGGG GAAGAAGATTGATCAAACAGAATGA |
| 2832 | Table 3A | Hs.23964 | NM_005870 | 12056471 | sin3-associated polypeptide. 18 kD (SAP18), mRNA/cds = (573, 1034) | 1 | TGTTTCAAGCCCTTCTGTAAAATATGA AGAAAAGTTCTTAGCATTCTGT |
| 2833 | Table 3A | Hs.22960 | NM_005872 | 5031652 | breast carcinoma amplified sequence 2 (BCAS2), mRNA/cds = (48, 725) | 1 | TTCTAAACACATTCTTGATCACCAAAC AACTTCAGAAAGACAGTGACTGT |
| 2834 | Table 3A | Hs.21756 | NM_005875 | 5031710 | translation factor sui1 homolog (GC20), mRNA/cds = (241, 582) | 1 | ATCTTTGTGAGCAATTATGCTCCCAA ATCTAAGCAAGTAATAAAGAAGGG |
| 2835 | Table 3A | Hs.21189 | NM_005880 | 7549807 | DnaJ (Hsp40) homolog, subfamily A, | 1 | TGTAAAGTTTGTACAATTTGTCCTGAA |

TABLE 8-continued

| SEQ ID | Origin | Unigene | Locus | GI | Nominal Description | Strand | Probe Sequence |
|---|---|---|---|---|---|---|---|
| | | | | | member 2 (DNAJA2), mRNA/ cds = (52, 1290) | | GCTTTGTGTTTGGCTGCACCTGC |
| 2836 | Table 3A | Hs.277721 | NM_005899 | 14110374 | membrane component, chromosome 17, surface marker 2 (ovarian carcinoma antigen CA125) (M17S2), transcript variant 2, mRNA/ cds = (459, 3359) | 1 | ACAGTATAACTCCTGAATGCTACTTA AATAAACCAGGATTCAAACTGCAA |
| 2837 | db mining | Hs.82483 | NM_005901 | 5174510 | MAD (mothers against decapentaplegic, Drosophila) homolog 2 (MADH2), mRNA/cds = (55, 1458) | 1 | AGAAGCAGATTTTCCTGTAGAAAAAC TAATTTTTCTGCCTTTTACCAAAA |
| 2838 | db mining | Hs.288261 | NM_005902 | 5174512 | cDNA: FLJ23037 fis, clone LNG02036, highly similar to HSU88019 mad protein homolog (hMAD-3) mRNA/ cds = UNKNOWN | 1 | GAGCTTGCTCCAGATTCTGATGCATA CGGCTATATTGGTTTATGTAGTCA |
| 2839 | db mining | Hs.100602 | NM_005904 | 5174516 | MAD (mothers against decapentaplegic, Drosophila) homolog 7 (MADH7), mRNA/cds = (295, 1575) | 1 | ATGGGTGTTATCACCTAGCTGAATGT TTTCTAAAGGAGTTTATGTTCCA |
| 2840 | Table 3A | Hs.75375 | NM_005917 | 5174538 | malate dehydrogenase 1, NAD (soluble) (MDH1), mRNA/ cds = (55, 1059) | 1 | ACGTGCTTCTTGGTACAGGTTTGTGA ATGACAGTTTATCGTCATGCTGTT |
| 2841 | Table 3A | Hs.32353 | NM_005922 | 5803087 | mitogen-activated protein kinase kinase kinase 4 (MAP3K4), transcript variant 1, mRNA/cds = (142, 4965) | 1 | TGTTGTTGTTGGCAAGCTGCAGGTTT GTAATGCAAAAGGCTGATTACTGA |
| 2842 | Table 3A | Hs.68583 | NM_005932 | 5174566 | mitochondrial intermediate peptidase (MIPEP), nuclear gene encoding mitochondrial protein, mRNA/ cds = (74, 2215) | 1 | TCATTGTTCGCTTCTGTAATTCTGAAA AACTTTAAACTGGTAGAACTTGG |
| 2843 | Table 3A | Hs.211581 | NM_005955 | 5174588 | metal-regulatory transcription factor 1 (MTF1), mRNA/cds = (83, 2344) | 1 | CCAGTGCTGTTTGGTGGTCTGCCTTC TTTTTAATGGTATTTTCTTCCTCA |
| 2844 | Table 3A | Hs.78103 | NM_005969 | 5174612 | nucleosome assembly protein 1-like 4 (NAP1L4), mRNA/cds = (149, 1278) | 1 | GCCCCACCATTCATCCTGTCTGAAGG TCCTGGGTTTGGTGTGACCGCTTG |
| 2845 | Table 3A | Hs.48029 | NM_005985 | 5174686 | snail 1 (drosophila homolog), zinc finger protein (SNAI1), mRNA/ cds = (61, 855) | 1 | CCGACAGGTGGGCCTGGGAGGAAAA TGTTTACATTTTAAAGGCACACTG |
| 2846 | Table 3A | Hs.12570 | NM_005993 | 8400735 | tubulin-specific chaperone d (TBCD), mRNA/cds = (109, 3667) | 1 | GGGGTGGACGCCTCTGCCTTCACTT GAACACAAATGTGCTTCCTATAAAA |
| 2847 | Table 3A | Hs.1708 | NM_005998 | 5174726 | chaperonin containing TCP1, subunit 3 (gamma) (CCT3), mRNA/cds = (0, 1634) | 1 | GGCAGCCCCCAGTCCCTTTCTGTCC CAGCTCAGTTTTCCAAAAGACACTG |
| 2848 | Table 3A | Hs.3712 | NM_006003 | 5174742 | ubiquinol-cytochrome c reductase, Rieske iron-sulfur polypeptide 1 (UQCRFS1), nuclear gene encoding mitochondrial protein, mRNA/ cds = (90, 914) | 1 | CTGTTAAGCACTGTTATGCTCAGTCA TACACGCGAAAGGTACAATGTCTT |
| 2849 | Table 3A | Hs.73818 | NM_006004 | 5174744 | ubiquinol-cytochrome c reductase hinge protein (UQCRH), mRNA/ cds = (36, 311) | 1 | ATGGGTTTGGCTTGAGGCTGGTAGCT TCTATGTAATTCGCAATGATTCCA |
| 2850 | Table 3A | Hs.3776 | NM_006007 | 5174754 | zinc finger protein 216 (ZNF216), mRNA/cds = (288, 929) | 1 | TTCAGTTTTGCTTTCAATTTTATGTAC CTTAGTTCTGAGTTAGACCTGCA |
| 2851 | Table 3A | Hs.272897 | NM_006009 | 5174732 | Tubulin, alpha, brain-specific (TUBA3), mRNA/cds = (0, 1355) | 1 | AAGGATTATGAGGAGGTTGGTGTGCA TTCTGTTGAAGGAGAGGGTGAGGA |
| 2852 | Table 3A | Hs.75412 | NM_006010 | 5174392 | arginine-rich, mutated in early stage tumors (ARMET), mRNA/ cds = (132, 836) | 1 | TCCCTTCCTTCTGTTGCTGGTGTACT CTAGGACTTCAAAGTGTGTCTGGG |
| 2853 | Table 3A | Hs.43910 | NM_006016 | 5174406 | CD164 antigen, sialomucin (CD164), mRNA/cds = (79, 648) | 1 | AGTTCATTAAAAACTGCAAAACCAAT CTGTATCATGTACCAAACTGACTT |
| 2854 | Table 3A | Hs.137555 | NM_006018 | 5174460 | putative chemokine receptor, GTP-binding protein (HM74), mRNA/ cds = (60, 1223) | 1 | TGCACGTTCCTCCTGGTTCCTTCGCT TGTGTTTCTGTACTTACCAAAAAT |
| 2855 | Table 3A | Hs.46465 | NM_006019 | 5174620 | T-cell, immune regulator 1 (TCIRG1), mRNA/cds = (57, 2546) | 1 | TGCCAGACCTCCTTCCTGACCTCTGA GGCAGGAGAGGAATAAAGACGGTC |
| 2856 | literature | Hs.54418 | NM_006020 | 5174384 | alkylation repair, alkB homolog (ABH), mRNA/cds = (223, 1122) | 1 | AGTCCCAAGGGTGTTTTGTTACTGTT TTCTCCATGAATAAACTCACTTGA |
| 2857 | Table 3A | Hs.43628 | NM_006021 | 5174494 | deleted in lymphocytic leukemia, 2 (DLEU2), mRNA/cds = (240, 494) | 1 | ATTAATGTCATTTCTGGAAGTGTGAA AATGTTAATGTTCAACAAGCAACA |
| 2858 | Table 3A | Hs.82043 | NM_006023 | 5174422 | D123 gene product (D123), mRNA/ cds = (280, 1290) | 1 | GCGGGTGGGCCGAGCAGTGTGGACA TCAGCCACTTTTTATATTCATGTAC |
| 2859 | Table 3A | Hs.997 | NM_006025 | 5174622 | protease, serine, 22 (P11), mRNA/ cds = (154, 1263) | 1 | CCACTGAGAACTAAATGCTGTACCAC AGAGCGGGTGTGAACTATGGTTT |
| 2860 | Table 3A | Hs.109804 | NM_006026 | 5174448 | H1 histone family, member X (H1FX), mRNA/cds = (101, 742) | 1 | AAACAATCGCTCCGGGCTCAGGGCT GCGCGGCTCTTCCCTTCATTCCATG |
| 2861 | Table 3A | Hs.24594 | NM_006048 | 5174482 | ubiquitination factor E4B (homologous to yeast UFD2) (UBE4B), mRNA/ cds = (85, 3993) | 1 | TGTCCTCTGTTCAATTCCTAACGCAA ACTACAATAAATGGTGACACACGT |
| 2862 | Table 3A | Hs.274243 | NM_006054 | 5174654 | receptor tyrosine kinase-like orphan receptor 1 (ROR1), mRNA/ | 1 | AGCACCTAAGGAGCTTGAATCTTGGT TCCTGTAAAATTTCAAATTGATGT |

TABLE 8-continued

| SEQ ID | Origin | Unigene | Locus | GI | Nominal Description | Strand | Probe Sequence |
|---|---|---|---|---|---|---|---|
| 2863 | Table 3A | Hs.54452 | NM_006060 | 5174500 | zinc finger protein, subfamily 1A, 1 (Ikeros) (ZNFN1A1), mRNA/ cds = (168, 1727) | 1 | ACCAACACTGTCCCAAGGTGAAATGA AGCAACAGAGAGGAAATTGTACAT |
| 2864 | Table 3A | Hs.318501 | NM_006074 | 5174698 | stimulated trans-acting factor (50 kDa) (STAF50). | 1 | TGTCAGCCATTTCAATGTCTTGGGAA ACAATTTTTTGTTTTTGTTCTGTT |
| 2865 | Table 3A | Hs.8024 | NM_006083 | 11038650 | IK cytokine, down-regulator of HLA II (IK), mRNA/cds = (111, 1784) | 1 | AGAGCTTGATCGCCAGTGGAAGAAG ATTAGTGCAATCATTGAGAAGAGGA |
| 2866 | Table 3A | Hs.1706 | NM_006084 | 5174474 | interferon-stimulated transcription factor 3, gamma (48 kD) (ISGF3G), mRNA/cds = (34, 1215) | 1 | TTTCCCTCTTCCCTGACCTCCCAACT CTAAAGCCAAGCACTTTATATTTT |
| 2867 | Table 3A | Hs.5662 | NM_006098 | 5174446 | guanine nucleotide binding protein (G protein), beta polypeptide 2-like 1 (GNB2L1), mRNA/cds = (95, 1048) | 1 | GGCAGGTGACCATTGGCACACGCTA GAAGTTTATGGCAGAGCTTTACAAA |
| 2868 | Table 3A | Hs.284142 | NM_006134 | 8659558 | chromosome 21 open reading frame 4 (C21orf4), mRNA/cds = (158, 634) | 1 | CTGTTTGTAGATAGGTTTTTTATCTCT CAGTACACATTGCCAAATGGAGT |
| 2869 | Table 3A | Hs.1987 | NM_006139 | 5453610 | CD28 antigen (Tp44) (CD28), mRNA/ cds = (222, 884) | 1 | GCTCACCTATTTGGGTTAAGCATGCC AATTTAAAGAGACCAAGTGTATGT |
| 2870 | Table 3A | Hs.82646 | NM_006145 | 5453689 | heat shock 40 kD protein 1 (HSPF1), mRNA/cds = (40, 1062) | 1 | TAGACTCATTGTAAGTTGCCACTGCC AACATGAGACCAAAGTGTGTGACT |
| 2871 | Table 3A | Hs.334851 | NM_006148 | 5453709 | LIM and SH3 protein 1 (LASP1), mRNA/cds = (75, 860) | 1 | CAAACCTTTCTGGCCTGTTATGATTC TGAACATTTGACTTGAACCACAAG |
| 2872 | Table 3A | Hs.40202 | NM_006152 | 5453723 | lymphoid-restricted membrane protein (LRMP), mRNA/cds = (574, 2241) | 1 | GGGAAAGTATAGCATGAAACCAGAG GTTCTCAGAATGACCGTAAGATAGC |
| 2873 | Table 3A | Hs.75512 | NM_006156 | 5453759 | neural precursor cell expressed, developmentally down-regulated 6 (NEDD8), mRNA/cds = (99, 344) | 1 | AGTCCTGTGTGCTTCCCTCTCTTATG ACTGTGTCCCTGGTTGTCAATAAA |
| 2874 | Table 3A | Hs.79389 | NM_006159 | 5453765 | nel (chicken)-like 2 (NELL2), mRNA/ cds = (96, 2546) | 1 | ATCTTCAGAATCAGTTAGGTTCCTCA CTGCAAGAAATAAAATGTCAGGCA |
| 2875 | Table 3A | Hs.96149 | NM_006162 | 5453771 | transcription factor (NF-ATc/B) mRNA/ complete cds/cds = (369, 2646) | 1 | CTTCTGGCACCCCTGGGGTTCAATAC TGGAAGTGCCTTATTTAACCAGAC |
| 2876 | Table 3A | Hs.75643 | NM_006163 | 5453773 | nuclear factor (erythroid-derived 2), 45 kD (NFE2), mRNA/cds = (273, 1394) | 1 | GGTCTTAGCCTCCACCTTGTCTAAG CTTTGGTCTATAAAGTGCGCTACA |
| 2877 | Table 3A | Hs.155396 | NM_006164 | 5453775 | nuclear factor (erythroid-derived 2)-like NFE2L2), mRNA/cds = (39, 1808) | 1 | TGATGATATGACATCTGGCTAAAAAG AAATTATTGCAAAACTAACCACGA |
| 2878 | Table 3A | Hs.95262 | NM_006165 | 5453777 | nuclear factor related to kappa B binding protein (NFRKB), mRNA/ cds = (2220, 5216) | 1 | TCCAAAGCAGTCTCCACTGTTGTTGT GACTACAGCTCCGTCTCCTAAACA |
| 2879 | Table 3A | Hs.15243 | NM_006170 | 5453791 | nucleolar protein 1 (120 kD) (NOL1), mRNA/cds = (0, 2567) | 1 | ATTGTCACCAGGTTGGAACTCTTGCC TCTGTGAGGATGCCTTCTCTACTG |
| 2880 | Table 3A | Hs.82120 | NM_006186 | 5453821 | nuclear receptor subfamily 4, group A, member 2 (NR4A2), mRNA/ cds = (317, 2113) | 1 | TTTTCTTTGTATATTTCTAGTATGGCA CATGATATGAGTCACTGCCTTTT |
| 2881 | Table 3A | Hs.41694 | NM_006190 | 5453829 | origin recognition complex, subunit 2 (yeast homolog)-like (ORC2L), mRNA/ cds = (186, 1919) | 1 | TGACCTTCATGATACCAGTGAGAAGC CAGGCTAGAGAAATAAAATCCTGA |
| 2882 | Table 3A | Hs.2853 | NM_006196 | 14141164 | poly(rC)-binding protein 1 (PCBP1), mRNA/cds = (177, 1247) | 1 | ACGGATTGGTTAAAAAATGCTTCATA TTTGAAAAAGCTGGGAATTGCTGT |
| 2883 | Table 3A | Hs.79709 | NM_006224 | 5453907 | phosphotidylinositol transfer protein (PITPN), mRNA/cds = (216, 1028) | 1 | GTCTCTCTCCATTGTGTTCCGATCCA TTTCTGTGTGTTCCCCCAACCTTT |
| 2884 | Table 3A | Hs.89040 | NM_006228 | 11079650 | prepronociceptin (PNOC), mRNA/ cds = (211, 741) | 1 | GCCACTGCCATAACTTGTTTGTAAAA GAGCTGTTCTTTTTGACTGATTGT |
| 2885 | literature | Hs.168846 | NM_006231 | 5453925 | polymerase (DNA directed), epsilon (POLE), mRNA/cds = (44, 6904) | 1 | GAACATTGCCCAGCACTACGGCATGT CGTACCTCCTGGAGACCCTGGAGT |
| 2886 | Table 3A | Hs.155079 | NM_006243 | 5453949 | protein phosphatase 2, regulatory subunit B (B56), alpha isoform (PPP2R5A), mRNA/cds = (571, 2031) | 1 | ATCTTCATTGGGGATTGAGCAGCAT TTAATAAAGTCTATGTTTGTATTT |
| 2887 | Table 3A | Hs.9247 | NM_006251 | 5453963 | protein kinase, AMP-activated, alpha 1 catalytic subunit (PRKAA1), mRNA/ cds = (23, 1675) | 1 | TTATAACCGAGGGCTGGCGTTTTGGA ATCGAATTTCGACAGGGATTGGAA |
| 2888 | Table 3A | Hs.315366 | NM_006255 | 5453971 | protein kinase C, eta (PRKCH), mRNA/ cds = (166, 2214) | 1 | TTCCCAGCATCAGCCTTAGAACAAGA ACCTTACCTTCAAGGAGCAAGTGA |
| 2889 | Table 3A | Hs.75348 | NM_006263 | 5453989 | proteasome (prosome, macropain) activator subunit 1 (PA28 alpha) (PSME1), mRNA/cds = (92, 841) | 1 | CCAGATTTTCCCCAAACTTGCTTCTG TTGAGATTTTTCCCTCACCTTGCC |
| 2890 | Table 3A | Hs.81848 | NM_006265 | 5453993 | RAD21 (S. pombe) homolog (RAD21), mRNA/cds = (184, 2079) | 1 | AACCAAGGAGTTTTCCCCGTTTGTAA AAAGACATTGTAGATAATTGAATG |
| 2891 | Table 3A | Hs.199179 | NM_006267 | 6382078 | RAN binding protein 2 (RANBP2), mRNA/cds = (127, 9801) | 1 | ACCATGTTCTTTCGTTAAAGATTTGCT TTATACAAGATTGTTGCAGTACC |
| 2892 | Table 3A | Hs.173159 | NM_006283 | 5454099 | transforming, acidic coiled-coil containing protein 1 (TACC1), mRNA/ cds = (320, 2737) | 1 | CACATCTGCTTCCACTGTGTTCCCAC GGGTGCCATGAAGTGTGTGAGGAG |
| 2893 | Table 3A | Hs.89657 | NM_006284 | 5454105 | TATA box binding protein (TBP)- associated factor, RNA polymerase II, | 1 | CGCACTACTTCACCTGAGCCACCCAA CCTAAATGTACTTATCTGTCCCCA |

TABLE 8-continued

| SEQ ID | Origin | Unigene | Locus | GI | Nominal Description | Strand | Probe Sequence |
|---|---|---|---|---|---|---|---|
| | | | | | H, 30 kD (TAF2H), mRNA/cds = (17, 673) | | |
| 2894 | Table 3A | Hs.116481 | NM_001782 | 4502682 | CD72 antigen (CD72), mRNA/cds = (108, 1187) | 1 | GGGCGGCCCGGAGCCAGCCAGGCA GTTTTATTGAAATCTTTTTAAATAAT |
| 2895 | Table 3A | Hs.18420 | NM_006289 | 5454129 | talin 1 (TLN1), mRNA/cds = (126, 7751) | 1 | CTCTCCAAGAGTATTATTAACGCTGC TGTACCTCGATCTGAATCTGCCGG |
| 2896 | Table 3A | Hs.211600 | NM_006290 | 5454131 | tumor necrosis factor, alpha-induced protein 3 (TNFAIP3), mRNA/cds = (66, 2438) | 1 | TCCCTAATAGAAAGCCACCTATTCTTT GTTGGATTTCTTCAAGTTTTTCT |
| 2897 | Table 3A | Hs.101382 | NM_006291 | 5454133 | tumor necrosis factor, alpha-induced protein 2 (TNFAIP2), mRNA/cds = (131, 2095) | 1 | AGTACTGCTTTTGTATGTATGTTGAAC AGGATCCAGGTTTTTATAGCTTG |
| 2898 | Table 3A | Hs.118910 | NM_006292 | 5454139 | tumor susceptibility gene 101 (TSG101), mRNA/cds = (90, 1262) | 1 | CACTTTCTATCCTCTGTAAACTTTTTG TGCTGAATGTTGGGACTGCTAAA |
| 2899 | Table 3A | Hs.131255 | NM_006294 | 5454151 | ubiquinol-cytochrome c reductase binding protein (UQCRB), mRNA/cds = (32, 367) | 1 | GAAGAATGGGCAAAGAAGTAATCATG TAGTTGAAGTCTGTGGATGCAGCT |
| 2900 | Table 3A | Hs.279841 | NM_018062 | 8922359 | hypothetical protein FLJ10335 (FLJ10335), mRNA/cds = (33, 1160) | 1 | CAAAGGTTCTTGAGACTCTTGATATTT CTGTCTTCTCCTTGTGCTTTCCT |
| 2901 | literature | Hs.98493 | NM_006297 | 5454171 | X-ray repair complementing defective repair in Chinese hamster cells 1 (XRCC1), mRNA/cds = (105, 2006) | 1 | CCGATGGATCTACAGTTGCAATGAGA AGCAGAAGTTACTTCCTCACCAGC |
| 2902 | Table 3A | Hs.293007 | NM_006310 | 5453987 | aminopeptidase puromycin sensitive (NPEPPS), mRNA/cds = (404, 3031) | 1 | TTCCTGCATAACTCAATCTGAACCAA GGATTGTAGTTTAGTTTTCCTCCT |
| 2903 | Table 3A | Hs.287994 | NM_006312 | 5454073 | nuclear receptor co-repressor 2 (NCOR2), mRNA/cds = (1, 7554) | 1 | GCAGGGTGGTGGTATTCTGTCATTTA CACACGTCGTTCTAATTAAAAAGC |
| 2904 | Table 3A | Hs.10842 | NM_006325 | 6042206 | RAN, member RAS oncogene family (RAN), mRNA/cds = (114, 764) | 1 | GCACTTTTTGTTTGAATGTTAGATGCT TAGTGTGAAGTTGATACGCAAGC |
| 2905 | db mining | Hs.12540 | NM_006330 | 5453721 | lysophospholipase I (LYPLA1), mRNA/cds = (35, 727) | 1 | GCAAGAAATATTCCATTGAAATATTGT GCTGTAACATGGGAAAGTGTAAA |
| 2906 | literature | Hs.19400 | NM_006341 | 6006019 | MAD2 (mitotic arrest deficient, yeast, homolog)-like 2 (MAD2L2), mRNA/cds = (111, 746) | 1 | GCCAACACTGTCTGTCTCAAATACTG TGCTGTGAGTTGTTTCAATAAAGG |
| 2907 | Table 3A | Hs.104019 | NM_006342 | 5454101 | transforming, acidic coiled-coil containing protein 3 (TACC3), mRNA/cds = (108, 2624) | 1 | GACCTCATCTCCAAGATGGAGAAGAT CTGACCTCCACGGAGCCGCTGTCC |
| 2908 | Table 3A | Hs.43913 | NM_008346 | 5453889 | PIBF1 gene product (PIBF1), mRNA/cds = (0, 2276) | 1 | CTTTACTAAAAAAGAAGCACCTGAGT GGTCTAAGAAACAAAAGATGAAGA |
| 2909 | Table 3A | Hs.158196 | NM_006354 | 5454103 | Homo sapiens, Similar to transcriptional adaptor 3 (ADA3, yeast homolog)-like (PCAF histone acetylase complex), clone MGC:3508 IMAGE:3009860, mRNA, complete cds/cds = (557, 1666) | 1 | GCCTGGAAGACTCTGAAGGAGCGTG AGAGCATCCTGAAGCTGCTGGATGG |
| 2910 | Table 3A | Hs.307099 | NM_006356 | 5453558 | clone 023e08 My032 protein mRNA, complete cds/cds = (46, 459) | 1 | CAGGAGGAAGCTCTGGCCCTTGTATT ACACATTCTGGACATTAAAAATAA |
| 2911 | Table 3A | Hs.69469 | NM_006360 | 5453653 | dendritic cell protein (GA17), mRNA/cds = (51, 1175) | 1 | GCCTTTTGAGTCTTTCCGATACCTGA GTTTTTATGCTTATAATTTTTGTT |
| 2912 | Table 3A | Hs.173497 | NM_006363 | 14591927 | Sec23 (S. cerevisiae) homolog B (SEC23B), transcript variant 3, mRNA/cds = (112, 2415) | 1 | TTAAGCTGAGGATACAACCAGGAAAT GCAACGGTGTCAGATTGTGTTCAA |
| 2913 | Table 3A | Hs.104125 | NM_006367 | 10938021 | adenylyl cyclase-associated protein (CAP), mRNA/cds = (62, 1489) | 1 | TCTACCCATTTCCTGAGGCCTGTGGA AATAAACCTTTATGTACTTAAAGT |
| 2914 | Table 3A | Hs.79089 | NM_006378 | 5454049 | sema domain, immunoglobulin domain (Ig), transmembrane domain (TM) and short cytoplasmic domain, (semaphorin) 4D (SEMA4D), mRNA/cds = (87, 2675) | 1 | AGCAATAAACTCTGGATGTTTGTGCG CGTGTGTGGACAGTCTTATCTTCC |
| 2915 | Table 3A | Hs.279939 | NM_008389 | 13699881 | mitochondrial carrier homolog 1 (MTCH1), nuclear gene encoding mitochondrial protein, mRNA/cds = (0, 1118) | 1 | AGCTGTTGATGCTGGTTGGACAGGTT TGAGTCAAATTGTACTTTGCTCCA |
| 2916 | Table 3A | Hs.296585 | NM_006392 | 5453793 | nucleolar protein (KKE/D) repeat) (NOP56), mRNA/cds = (21, 1829) | 1 | AGGTGACATTTCCCACCCTGTGCCCG TGTTCCCAATAAAAACAAATTCAC |
| 2917 | Table 3A | Hs.84153 | NM_006400 | 13259506 | dynactin 2 (p50) (DCTN2), mRNA/cds = (136, 1358) | 1 | CTGTGGCTGACTGTAATACTGTACAA CTGTTTCTGACCATTAAATGCTGT |
| 2918 | Table 3A | Hs.80261 | NM_006403 | 5453679 | enhancer of filamentation 1 (cas-like docking; Crk-associated substrate related) (HEF1), mRNA/cds = (163, 2667) | 1 | ACATATGCAGACCTGACACTCAAGAG TGGCTAGCTACACAGAGTCCATCT |
| 2919 | Table 3A | Hs.92384 | NM_006407 | 7669496 | vitamin A responsive; cytoskeleton related (JWA), mRNA/cds = (89, 855) | 1 | TGACTTCACAGACATGGTCTAGAATC TGTACCCTTACCCACATATGAAGA |
| 2920 | Table 3A | Hs.139120 | NM_006413 | 5454023 | Homo sapiens, ribonuclease P (30kD), clone MGC:12256 IMAGE:3827681, mRNA, complete cds/cds = (294, 1100) | 1 | CCCAGTCTCTGTCAGCACTCCCTTCT TCCCTTTTATAGTTCATCAGCCAC |
| 2921 | Table 3A | Hs.82921 | NM_006416 | 5453620 | solute carrier family 35 (CMP-sialic | 1 | TGACTGAGTACCCCTTTAGTGAGTAC |

TABLE 8-continued

| SEQ ID | Origin | Unigene | Locus | GI | Nominal Description | Strand | Probe Sequence |
|---|---|---|---|---|---|---|---|
| | | | | | acid transporter), member 1 (SLC35A1), mRNA/cds = (27, 1040) | | CCCTTTAGTGCTATATTTGTGCCA |
| 2922 | Table 3A | Hs.82316 | NM_006417 | 5453743 | interferon-induced, hepatitis C-associated microtubular aggregate protein (44kD) (MTAP44), mRNA/cds = (0, 1334) | 1 | TGCCTTTTGAGCAAATAGGGAATCTA AGGGAGGAAATTATCAACTGTGCA |
| 2923 | db mining | Hs.100431 | NM_006419 | 5453576 | small inducible cytokine B subfamily (Cys-X-Cys motif), member 13 (B-cell chemoattractant) (SCYB13), mRNA/cds = (90, 419) | 1 | GCGGGGCCGGGGGGACTCTGGTATC TAATTCTTTAATGATTCCTATAAAT |
| 2924 | Table 3A | Hs.94631 | NM_006421 | 6715588 | brefeldin A-inhibited guanine nucleotide-exchange protein 1 (BIG1), mRNA/cds = (141, 5690) | 1 | ACAACTTTCTGTACAATATTGATTCCC ATCTGGCATATTCTAATCAGGTT |
| 2925 | Table 3A | Hs.108809 | NM_006429 | 5453806 | chaperonin containing TCP1, subunit 7 (eta) (CCT7), mRNA/cds = (68, 1699) | 1 | TTTTACAAGGAAGGGGTAGTAATTGG CCCACTCTCTTCTTACTGGAGGCT |
| 2926 | Table 3A | Hs.119529 | NM_006432 | 5453677 | epididymal secretory protein (19.5kD) (HE1), mRNA/cds = (10, 465) | 1 | AACAACATTAACTTGTGGCCTCTTTCT ACACCTGGAAATTTACTCTTGAA |
| 2927 | Table 3A | Hs.174195 | NM_006435 | 10835237 | interferon induced transmembrane protein 2 (1-8D) (IFITM2), mRNA/cds = (279, 677) | 1 | ACAGCCGAGTCCTGCATCAGCCCTTT ATCCTCACACGCTTTTCTACAATG |
| 2928 | Table 3A | Hs.77225 | NM_006437 | 11496990 | ADP-ribosyltransferase (NAD+; poly (ADP-ribose) polymerase)-like 1 (ADPRTL1), mRNA/cds = (106, 5280) | 1 | GTCAAGGCTAAGTCAAATGAAACTGA ATTTTAAACTTTTTGCATGCTTCT |
| 2929 | Table 3A | Hs.118131 | NM_006441 | 5453745 | 5,10-methenyltetrahydrofolate synthelase (5-formyltetrahydrofolate cyclo-ligase) (MTHFS), mRNA/cds = (13, 624) | 1 | AAACGACATGAAGGTAGATGAAGTCC TTTACGAAGACTCGTCAACAGCTT |
| 2930 | Table 3A | Hs.340268 | NM_006461 | 5453831 | qy37e05.x1 cDNA, 3' end/clone = IMAGE:2014208/clone_end = 3' | 1 | CCCAATACCAAGACCAACTGGCATAG AGCCAACTGAGATAAATGCTATTT |
| 2931 | Table 3A | Hs.233936 | NM_006471 | 5453739 | myosin, light polypeptide, regulatory, non-sarcomeric (20kD) (MLCB), mRNA/cds = (114, 629) | 1 | GGGTCTATACAGAGTCAATATATTTTT TCAGAGAAAGTTAGTTCGGCTCG |
| 2932 | Table 3A | Hs.179526 | NM_006472 | 5454161 | upregulated by 1,25-dihydroxyvitamin D-3 (VDUP1), mRNA/cds = (221, 1396) | 1 | CCAGAAAGTGTGGGCTGAAGATGGT TGGTTTCATGTGGGGTATTATGTA |
| 2933 | Table 3A | Hs.5509 | NM_006495 | 5729817 | ecotropic viral integration site 2B (EVI2B), mRNA/cds = (0, 1346) | 1 | TCCAACCTTGAGATCCAGTGTCAGGA GTTCTCTATTCCTCCCAACTCTGA |
| 2934 | literature | Hs.155573 | NM_006502 | 5729981 | polymerase (DNA directed), eta (POLH), mRNA/cds = (237, 2378) | 1 | TGGCACAGAAAAGGGACCAAGTTTAA AAAAGGGTTTTAAATGTAATGAGA |
| 2935 | db mining | Hs.858 | NM_006509 | 5730006 | v-rel avian reticuloendotheliosis viral oncogene homolog B (nuclear factor of kappa light polypeptide gene enhancer in B-cells 3) (RELB), mRNA/cds = (144, 1883) | 1 | GGGGTAGGTTGGTTGTTCAGAGTCTT CCCAATAAAGATGAGTTTTTGAGC |
| 2936 | Table 3A | Hs.4888 | NM_006513 | 5730028 | seryl-tRNA synthetase (SARS), mRNA/cds = (75, 1619) | 1 | TGGGCATAGGGACCCATCATTGATGA CTGATGAAACCATGTAATAAAGCA |
| 2937 | Table 3A | Hs.155040 | NM_006526 | 5730123 | zinc finger protein 217 (ZNF217), mRNA/cds = (271, 3417) | 1 | ATTTTCCTACAGCCCTTTGTACTTCAA AATATGTTTTTGTGTCCATCAGT |
| 2938 | Table 3A | Hs.251636 | NM_006537 | 5730109 | ubiquitin specific protease 3 (USP3), mRNA/cds = (93, 1658) | 1 | TCAGCACTAACTAAATAAATTTGTTGG TTCAGTTGTACTTGTCCTGCAAA |
| 2939 | Table 3A | Hs.86088 | NM_006548 | 5729881 | IGF-II mRNA-binding protein 1 (IMP-1), mRNA/cds = (9, 1742) | 1 | AGAGGGTGGATCACACCTCAGTGGG AAGAAAAATAAAATTTCCTTCAGGT |
| 2940 | Table 3A | Hs.119537 | NM_006559 | 5730026 | GAP-associated tyrosine phosphoprotein p62 (Sam68) (SAM68), mRNA/cds = (106, 1437) | 1 | TGTGTAAGTCTGCCTAAATAGGTAGC TTAAACTTATGTCAAAATGTCTGC |
| 2941 | Table 3A | Hs.59106 | NM_006568 | 5729764 | cell growth regulatory with ring finger domain (CGR19), mRNA/cds = (27, 1025) | 1 | TCCTTTCTGCTTAGTGAATGAATACT GGAATCCATCTGTGTTGATACAAT |
| 2942 | db mining | Hs.270737 | NM_006573 | 5730096 | tumor necrosis factor (ligand) superfamily, member 13b (TNFSF13B), mRNA/cds = (0, 857) | 1 | GCAATACCAAGAGAAAATGCACAAAT ATCACTGGATGGAGATGTCACATT |
| 2943 | Table 3A | Hs.4069 | NM_006582 | 13435376 | glucocorticoid modulatory element binding protein 1 (GMEB1), transcript variant 1, mRNA/cds = (138, 1859) | 1 | TGGGGATCTCAGGGCCAGGAGTTAT GTTTTGATTTGGAATTTTAATTATT |
| 2944 | Table 3A | Hs.12820 | NM_006590 | 5730024 | SnRNP assembly defective 1 homolog (SAD1), mRNA/cds = (492, 1466) | 1 | CCAGTAACTTCGCTCTGTTAGAGGTG GAGGATTTTCCTATGTTCCCCCCA |
| 2945 | literature | Hs.241517 | NM_006596 | 5729983 | DNA polymerase theta (POLQ) mRNA, complete cds/cds = (0, 8174) | 1 | TGCTGAAAAGATTGTACTTTGTGATC CCAATCAGAGGGATGGAGCTAATC |
| 2946 | Table 3A | Hs.180414 | NM_006597 | 5729876 | heat shock 70kD protein 8 (HSPA8), mRNA/cds = (83, 2023) | 1 | TCAGACTGCTGAGAAGGAAGAATTTG AACATCAACAGAAAGAGCTGAGA |
| 2947 | Table 3A | Hs.154672 | NM_006836 | 13699869 | methylene tetrahydrofolate dehydrogenase (NAD+ dependent), methenyltetrahydrofolate cyclohydrolase (MTHFD2), nuclear gene encoding mitochondrial protein, | 1 | TGGGCAGCTTGGGTAAGTACGCAAC TTACTTTTCCACCAAAGAACTGTCA |

TABLE 8-continued

| SEQ ID | Origin | Unigene | Locus | GI | Nominal Description | Strand | Probe Sequence |
|---|---|---|---|---|---|---|---|
| 2948 | Table 3A | Hs.38927 | NM_006644 | 5729878 | heat shock 105kD (HSP105B), mRNA/cds = (76, 1110) | 1 | TGTGAAAGTGTGGAATGGAAGAAATG TCGATCCTGTTGTAACTGATTGTG |
| 2949 | Table 3A | Hs.1845 | NM_006674 | 5729965 | MHC class I region ORF (P5-1), mRNA/cds = (313, 2757) | 1 | CTAATTTCAGTGCTTGTGCTTGGTTG TTCAGGGCCATTTCAGGTTTGGGT |
| 2950 | Table 3A | Hs.76807 | NM_006696 | 5730052 | major histocompatibility complex, class II, DR alpha (HLA-DRA), mRNA/cds = (304, 735) | 1 | AGCTAGCAGATCGTAGCTAGTTTGTA TTGTCTTGTCAATTGTACAGACTT |
| 2951 | Table 3A | Hs.5300 | NM_006698 | 5729737 | bladder cancer associated protein (BLCAP), mRNA/cds = (26, 790) | 1 | ATGGGCCAGGCAGAGAACAGAACTG GAGGCAGTCCATCTAGGGAATGGGA |
| 2952 | Table 3A | Hs.75207 | NM_006708 | 5729841 | glyoxalase I (GLO1), mRNA/cds = (254, 517) | 1 | GTTTCCTTTTTGGGTGAAATGGATTTA TGTGAGTGCTTTAAACAAATAGC |
| 2953 | Table 3A | Hs.74861 | NM_006713 | 5729967 | activated RNA polymerase II transcription cofactor 4 (PC4), mRNA/cds = (87, 641) | 1 | GAACAATGGAGCCAGCTGAAGGAAC AGATTTCTGACATAGATGACGCAGT |
| 2954 | Table 3A | Hs.195471 | NM_006732 | 5803016 | 6-phosphofructo-2-kinase/fructose-2,6-biphosphatase 3 (PFKFB3), mRNA/cds = (114, 1676) | 1 | CGTCCCCTCTCCCCTTGGTTCTGCAC TGTTGCCAATAAAAAGCTCTTAAA |
| 2955 | Table 3A | Hs.75367 | NM_006748 | 5803170 | Src-like adapter (SLA), mRNA/cds = (41, 871) | 1 | GAGCACCCAGAGGGATTTTCAGTG GGAAGCATTACACTTTGCTAAATCA |
| 2956 | Table 3A | Hs.77837 | NM_006759 | 13027637 | UDP-glucose pyrophosphorylase 2 (UGP2), mRNA/cds = (84, 1610) | 1 | AGCACAGATGGTGCAATACTTTCCTT CTTTGAAGAGATCCCAAAGTTAGT |
| 2957 | Table 3A | Hs.75462 | NM_006783 | 5802987 | BTG family, member 2 (BTG2), mRNA/cds = (71, 547) | 1 | TGGAAGAATGTACAGCTTATGGACAA ATGTACACCTTTTTGTTACTTTAA |
| 2958 | Table 3A | Hs.100555 | NM_006773 | 13787205 | DEAD/H (Asp—Glu—Ala—Asp/His) box polypeptide 18 (Myc-regulated) (DDX18), mRNA/cds = (71, 2063) | 1 | TTTTGGAGCAAAAACTATGGGTTGTA ATTTGAATAAAGTGTCACTAAGCA |
| 2959 | Table 3A | Hs.143604 | NM_006777 | 10048402 | Kaiso (ZNF-kaiso), mRNA/cds = (0, 2018) | 1 | TTCAGCAGGAAAATGATTCAATTTTA AACAAAATGTAACAGATGGCAGT |
| 2960 | Table 3A | Hs.33085 | NM_006784 | 5803220 | WD repeat domain 3 (WDR3), mRNA/cds = (47, 2878) | 1 | AAGTAGCCAAGCTAAGATGCCTGGCT GGGCTTCTGAGGAATTAATACACT |
| 2961 | Table 3A | Hs.4943 | NM_006787 | 10863906 | hepatocellular carcinoma associated protein; breast cancer associated gene 1 (JCL-1), mRNA/cds = (69, 1889) | 1 | CTGACCGCCACTCTCACATTTGGGCT CTTCGCTGGCCTTGGTGGAGCTGG |
| 2962 | Table 3A | Hs.6353 | NM_006791 | 5803101 | MORF-related gene 15 (MRG15), mRNA/cds = (131, 1102) | 1 | TGCATTGTGTAGCTAGTTTTCTGGAA AAGTCAATCTTTTAGGAATTGTTT |
| 2963 | Table 3A | Hs.88764 | NM_006800 | 5803103 | male-specific lethal-3 (Drosophila)-like 1 (MSL3L1), mRNA/cds = (105, 1670) | 1 | ACAGCTATACTTTGTTGTGTAATGTTA TGGTTCCCTTTCTGTAAAATGTT |
| 2964 | Table 3A | Hs.77897 | NM_006802 | 5803166 | splicing factor 3a, subunit 3, 60kD (SF3A3), mRNA/cds = (8, 1513) | 1 | GACAGGATCCCCCAGAGACCCCATTT GCCTCTCAACACTCAGACCTTCAA |
| 2965 | Table 3A | Hs.272168 | NM_006811 | 5803192 | DNA sequence from clone RP1-179M20 on chromosome 20 Contains a 3' end of a novel gene similar to cellular retinaldehyde-binding protein, the TDE1 gene (Tumour differentially expressed 1), the PKIG gene encoding protein kinase (cAMP-dependent, catalytic) inhibitor gamma, the 3' end of the ADA gene encoding adenosine deaminase, 2 CpG islands, ESTs, STSs and GSSs/cds = (69, 1490) | 1 | TTTGGTTTAAAATGTAAGATAGGAAA TGTTGGATATTTGAGGCCATGCT |
| 2966 | Table 3A | Hs.75969 | NM_006813 | 5802981 | proline-rich protein with nuclear targeting signAl (B4-2), mRNA/cds = (113, 1096) | 1 | AATCTACATTTTCTTACCAGGAGCAG CATTGAGGTTTTTGAGCATAGTAC |
| 2967 | Table 3A | Hs.75841 | NM_006817 | 13124889 | chromosome 12 open reading frame 8 (C12orf8), mRNA/cds = (11, 796) | 1 | ACTAACCCACGATTCTGAGCCCTGAG TATGCCTGGACATTGATGCTAACA |
| 2968 | Table 3A | Hs.75612 | NM_006819 | 5803180 | stress-induced-phosphoprotein 1 (Hsp70/Hsp90-organizing protein) (STIP1), mRNA/cds = (62, 1693) | 1 | TTATTCTGCGTCCCCTTCTCCAATAAA ACAAGCCAGTTGGGCGTGGTTAT |
| 2969 | Table 3A | Hs.75470 | NM_006820 | 5803026 | hypothetical protein, expressed in osteoblast (GS3688), mRNA/cds = (241, 1482) | 1 | TCCTTCCCACTCTCTCCAACATCACA TTCACTTTAAATTTTTCTGTATAT |
| 2970 | Table 3A | Hs.74405 | NM_006826 | 5803226 | tyrosine 3-monooxygenase/typtophan 5-monooxygenase activation protein, theta-polypeptide (YWHAQ), mRNA/cds = (100, 837) | 1 | AGTCCCAAAAAAGCCTTGTGAAAATG TTATGCCCTATGTAACAGCAGAGT |
| 2971 | Table 3A | Hs.15591 | NM_006833 | 5803095 | COP9 subunit 6 (MOV34 homolog, 34 kD) (MOV34-34KD), mRNA/cds = (43, 938) | 1 | AGGGGAGGGCACTACACTTCCTTGA GAGAAACCGCTGTCATTAATAAAAG |
| 2972 | Table 3A | Hs.79933 | NM_006835 | 5802991 | cycline I (CCNI), mRNA/cds = (0, 1133) | 1 | AGGCTGTAGAAGGAAATATACCTTAA CAGGCTGATTTGGAGTGACCCAGA |
| 2973 | Table 3A | Hs.278613 | NM_006837 | 5803045 | interferon, alpha-inductible protein 27 (IF127), mRNA/cds = (54, 422) | 1 | ACCAGTTACCCAAAATCTGATTAGAA GTATAAGGTGCTCTGAAGTGTCCT |
| 2974 | Table 3A | Hs.78504 | NM_006839 | 5803114 | inner membrane protein, mitochondrial (mitofilin) (IMMT), mRNA/cds = (92, 2368) | 1 | TGAGGCTTGTGAGGCCAATCAAAATA ATGTTTGTGATCTCTACTACTGTT |

TABLE 8-continued

| SEQ ID | Origin | Unigene | Locus | GI | Nominal Description | Strand | Probe Sequence |
|---|---|---|---|---|---|---|---|
| 2975 | Table 3A | Hs.75916 | NM_006842 | 5803154 | splicing factor 3b, subunit 2, 145kD (SF3B2), mRNA/cds = (48, 2666) | 1 | CAGTTCCCAAGGACTTGTCATTTCAT GTTCTTATTTTAGACCTGTTTTGT |
| 2976 | db mining | Hs.105928 | NM_006847 | 5803063 | leukocyte immunoglobulin-like receptor, subfamily B (with TM and ITIM domains), member 3 (LILRB3), mRNA/cds = (49, 1944) | 1 | ACCACTAGAAGATTCCGGGAACGTTG GGAGTCACCTGATTCTGCAAAGAT |
| 2977 | Table 3A | Hs.315463 | NM_006850 | 5803085 | interleukin 24 (IL24), mRNA/cds = (274, 894) | 1 | GTCAAGCTGACCTTGCTGATGGTGAC ATTGCACCTGGATGTACTATCCAA |
| 2978 | Table 3A | Hs.64639 | NM_006851 | 5803150 | glioma pathogenesis-related protein (RTVP1), mRNA/cds = (128, 928) | 1 | ACAGCTCAAGTACCCTAATTTAGTTC TTTTGGACTAATACAATTCAGGAA |
| 2979 | db mining | Hs.113277 | NM_006865 | 5803061 | leukocyte immunoglobulin-like receptor, subfamily A (without TM domain), member 3 (LILRA3), mRNA/cds = (62, 1381) | 1 | GATGACGCTGGGCACAGAGGGTCAG GTCCTGTCAAGAGGAGCTGGGTGTC |
| 2980 | Table 3A | Hs.82143 | NM_006874 | 6857815 | E74-like factor 2 (ets domain transcription factor) (ELF2), mRNA/cds = (121, 1722) | 1 | AACATCTCTCTTCTCCTTCCCAACTAC TGCATGAAGAAATTCTACTTCCA |
| 2981 | Table 3A | Hs.80205 | NM_006875 | 5803124 | pim-2-oncogene (PIM2), mRNA/cds = (185, 1189) | 1 | TTCCTGCCTGGATTATTTAAAAAGCC ATGTGTGGAAACCCACTATTTAAT |
| 2982 | Table 3A | Hs.177530 | NM_006886 | 5901895 | ATP synthase, H+ transporting, mitochondrial F1 complex, epsilon subunit (ATP5E), mRNA/cds = (91, 246) | 1 | TGCTACATTTCCAAGGTGAAGATGTG TGGGCACATGTTATGGCAGATTGA |
| 2983 | Table 3A | Hs.177656 | NM_006888 | 5901911 | calmodulin 1 (phosphorylase kinase, delta) (CALM1), mRNA/cds = (199, 648) | 1 | ACAACCATCAACATTGCTGTTCAAAG AAATTACAGTTTACGTCCATTCCA |
| 2984 | Table 3A | Hs.155410 | NM_006899 | 5901981 | isocitrate dehydrogenase 3 (NAD+) beta (IDH3B), mRNA/cds = (79, 1236) | 1 | CCCACCCATAGGCCCTGTCCATACCC ATGTAAGGTGTTCAATAAAGAACA |
| 2985 | Table 3A | Hs.118684 | NM_006923 | 14141194 | stromal cell-derived factor 2 (SDF2), mRNA/cds = (39, 674) | 1 | ACTCTTCAGGAGCTTGGCATCATGGA CTGTTAATGTATGTGATTTTCCCC |
| 2986 | Table 3A | Hs.166975 | NM_006925 | 5902077 | splicing factor, arginino/serine-rich 5 (SFRS5), mRNA/cds = (218, 541) | 1 | GGTCAAGGGTGTCCTCCACTCTTTAA CAGCTGCTGGACAGACACATTAGA |
| 2987 | Table 3A | Hs.7594 | NM_006931 | 5902089 | solute carrier family 2 (facilitated glucose transpoter), member 3 (SLC2A3), mRNA/cds = (242, 1732) | 1 | GCAACTTCATGTCAACTTTCTGGCTC CTCAAACAGTAGGTTGGCAGTAAG |
| 2988 | Table 3A | Hs.180139 | NM_006937 | 5902097 | SMT3 (suppressor of mil two 3, yeast) homolog 2 (SMT3H2), mRNA/cds = (90, 377) | 1 | CCAAGTGGAGACGGGGATGGGGAAA AATACTGATTCTGTGGAAAATACCC |
| 2989 | Table 3A | Hs.88948 | NM_006938 | 5902101 | small nuclear ribonucleoprotein D1 polypeptide (16kD) (SNRPD1), mRNA/cds = (150, 509) | 1 | TGTGTAATGTACCTGTCAGTGCCTCC TTTATTAAGGGGTTCTTTGAGAAT |
| 2990 | Table 3A | Hs.237825 | NM_006947 | 5902123 | signal recognition particle 72kD (SRP72), mRNA/cds = (0, 2015) | 1 | GCAGGGGCTCCAGCAACAAAAAAGA AACAGCAACAGAAAAAGAAGAAAGG |
| 2991 | Table 3A | Hs.108642 | NM_006983 | 5902159 | Homo sapiens, zinc finger protein 22 (KOX 15), clone MGC:9735 IMAGE:3852749, mRNA, complete cds/cds = (133, 807) | 1 | AGACTCACTTACCCTCTTGGAAAGCT GGTACAGAAGGAAGTCTGTGGCTG |
| 2992 | Table 3A | Hs.167741 | NM_006994 | 6325463 | butyrophilin, subfamily 3, member A3 (BTN3A3), mRNA/cds = (171, 1925) | 1 | CCTGGTCATTGGTGGATGTTAAACCC ATATTCCTTTCAACTGCTGCCTGC |
| 2993 | Table 3A | Hs.225951 | NM_006999 | 6631114 | topoisomerase-related function protein 4-1 (TRF4), mRNA/cds = (37, 1665) | 1 | AATGAATTGGCCTGGCTACCACTGTG GTCGCGTGCTACAGGTTTGACAAA |
| 2994 | Table 3A | Hs.97932 | NM_007015 | 5901931 | chondromodulin 1 precursor (CHM-1), mRNA/cds = (0, 1004) | 1 | TTGATTTGCCATAAGTCTTCCCTTGCT TGCATCTTCCAAAGCTATTTCGA |
| 2995 | Table 3A | Hs.93502 | NM_007020 | 5902143 | U1-snRNP binding protein homolog (70kD) (U1SNRNPBP), transcript variant 1, mRNA/cds = (213, 953) | 1 | AGTGAAGTTACAGTGGAAATGAGTGG AGGGGGATTGTCTTTCAACGCAGC |
| 2996 | Table 3A | Hs.149443 | NM_007022 | 5901883 | putative tumor suppressor (101F6), mRNA/cds = (0, 668) | 1 | GCTTGGTCATTATGAACCAGGTGAGC AATGCCTACCTATACCGCAAGAGG |
| 2997 | literature | Hs.41693 | NM_007034 | 6631084 | DnaJ-like heat shock protein 40 (HLJ1), mRNA/cds = (176, 1189) | 1 | AAGGCACTGAAAATATAAAAGGACTG GTAGTTTACTGATGTAGATGTGAA |
| 2998 | Table 3A | Hs.87497 | NM_007047 | 5901905 | butyrophilin, subfamily 3, member A2 (BTN3A2), mRNA/cds = (188, 1147) | 1 | GCAGAAAAGGGGAACTCATTTAGCTC ACGAGTGGTCGAGTGAAGATTGAA |
| 2999 | Table 3A | Hs.169963 | NM_007049 | 5921460 | butyrophilin, subfamily 2, member A1 (BTN2A1), mRNA/cds = (210, 1793) | 1 | TATCTTGAGACGCCTTACAAATGATG GAGGATTCCAAAGAGTTTTTGTTT |
| 3000 | Table 3A | Hs.164170 | NM_007063 | 5902153 | vascular Rab-GAP/TBC-containing (VRP), mRNA/cds = (1117, 3810) | 1 | AAAATGTTGTTGTGTACATACCATGC TTTCAATGTTGGCTTCCAAGTTTT |
| 3001 | Table 3A | Hs.21907 | NM_007067 | 5901961 | histone acetyltransferase (HBOA), mRNA/cds = (42, 1877) | 1 | GGTAGAATGTGCTCTTCTATATCTAC TCCTCAATAAAGCATGTTCTCTGC |
| 3002 | literature | Hs.37181 | NM_007068 | 5901995 | DMC1 (dosage suppressor of mck1, yeast homolog) meiosis-specific homologous recombination (DMC1), mRNA/cds = (53, 1075) | 1 | CCACAAGAGGATTAAGGGAGGAAT GTTTATAGGACACACACAAAAGC |
| 3003 | Table 3A | Hs.109606 | NM_007074 | 5902133 | coronin, actin-binding protein, 1A (CORO1A), mRNA/cds = (100, 1485) | 1 | CTCCAGCAGGGTCAGCCATTCACAC CCATCCACTCACCTCCCATTCCAG |
| 3004 | Table 3A | Hs.252574 | NM_007104 | 6325471 | ribosomal protein L10a (RPL10A), mRNA/cds = (15, 668) | 1 | AAACTGGCAGAATGTCCGGGCCTTAT ATACAAGAGCACCATGGGCAAGC |

TABLE 8-continued

| SEQ ID | Origin | Unigene | Locus | GI | Nominal Description | Strand | Probe Sequence |
|---|---|---|---|---|---|---|---|
| 3005 | Table 3A | Hs.29352 | NM_007115 | 6005905 | tumor necrosis factor, alpha-induced Protein 6 (TNFAIP6) mRNA/cds = (68, 901) | 1 | AACACACAGTGTTTATGTTGGAATCT TTTGGAACTCCTTTGATCTCACTG |
| 3006 | Table 3A | Hs.301819 | NM_007145 | 6005965 | zinc finger protein 146 (ZNF146), mRNA/cds = (856, 1734) | 1 | TGGGAGTGAGGATGGGAATGCTGTA TCTGTGGAAGTCATGTTATACTGGA |
| 3007 | Table 3A | Hs.260523 | NM_007158 | 6005738 | neuroblastoma RAS viral (v-ras) oncogene homolog (NRAS), mRNA/cds = (253, 822) | 1 | TGCTTAGATCACTGCAGCTTCTAGGA CCCGGTTTCTTTTACTGATTTAAA |
| 3008 | Table 3A | Hs.301637 | NM_007187 | 6005977 | zinc finger protein 258 (ZNF258), mRNA/cds = (93, 2264) | 1 | CTGAACTACCAAATAGCTGTGGGCTT TCTGGAACTGCTGGCTGGGTTGCT |
| 3009 | Table 3A | Hs.14963 | NM_007192 | 6005756 | chromatin-specific transcription elongation factor, 140 kDa subunit (FACTP140), mRNA/cds = (291, 3434) | 1 | GCTCTGTGACTTTAAGAGAAGAAGGG GGGAGGGGTCCCGGATTTTATGTT |
| 3010 | literature | Hs.146329 | NM_007194 | 6005849 | protein kinase Chk2 (RAD53), mRNA/cds = (0, 1631) | 1 | AGAAATGTCCTTCTTTCACTCTGCAT CTTTCTTTTCTTTGAGTCGTTTTT |
| 3011 | literature | Hs.271699 | NM_007195 | 6005847 | polymerase (DNA directed) iota (POLI), mRNA/cds = (64, 2211) | 1 | TCCAGATAAAGCAAGAATAGTTGCAA GAAGTAAATTCTGGCACAAAGCGT |
| 3012 | literature | Hs.251398 | NM_007205 | 6005917 | three prime repair exonuclease 2 (TREX2), mRNA/cds = (0, 710) | 1 | CCCACAATGGCTTTGATTATGATTTC CCCTGCTGTGTGCCGAGCTGCGG |
| 3013 | literature | Hs.79086 | NM_007208 | 6005861 | mitochondrial ribosomal protein L3 (MRPL3), mRNA/cds = (76, 1122) | 1 | AAATTACAGAAACATGTTAAAGGCCG GACAAAGGAAAGACAATAAAATCA |
| 3014 | Table 3A | Hs.182825 | NM_007209 | 6005859 | ribosomal protein L35 (RPL35), mRNA/cds = (27, 398) | 1 | GAAGTACGCGGTCAAGGCCTGAGGG GCGCATTGTCAATAAAGCACAGCTG |
| 3015 | Table 3A | Hs.151676 | NM_007210 | 13124893 | UDP-N-acetyl-alpha-D-galactosamine:polypeptide N-acetylgalactosaminyltransferase 6 (GalNAc-T6) (GALNT6), mRNA/cds = (0, 1868) | 1 | TCTACAGCCATGTCCTATTCCTTGAT CATCCAAAGCACCTGCAGAGTCCA |
| 3016 | Table 3A | Hs.28866 | NM_007217 | 6005897 | programmed cell death 10 (PDCD10), mRNA/cds = (153, 791) | 1 | AATGTAGCTTAATCATAATCTCACACT GAAGATTTTGCATCACTTTTGCT |
| 3017 | Table 3A | Hs.28285 | NM_007218 | 6005911 | patched related protein translocated in renal cancer (TRC8), mRNA/cds = (0, 1994) | 1 | TGATGATGATGTTCAAAGAGAAAGAA ATGGAGTGATTCAGCACACAGGCG |
| 3018 | Table 3A | Hs.283646 | NM_007220 | 6005722 | carbonic anhydrase VB, mitochondrial (CA5B), nuclear gene encoding mitochondrial protein, mRNA/cds = (137, 1090) | 1 | GCCACCAGCCAAGCAACCCCCTAAA ACATTCATATCTAGGCAGTATTTTG |
| 3019 | Table 3A | Hs.94446 | NM_007221 | 6005831 | polyamine-modulated factor 1 (PMF1), mRNA/cds = (111, 608) | 1 | GCCTTTACCATGTTCTCTCCACATCC GTAAATAAACTTCCTTCACTACAA |
| 3020 | literature | Hs.334676 | NM_007248 | 6005752 | three prime repair exonuclease 1 (TREX1), mRNA/cds = (256, 1170) | 1 | CCACACCTGGCGAGTAGGCCAAGAA GGAAAATCTGACGAATAAAGACCCC |
| 3021 | literature | Hs.78016 | NM_007254 | 6005835 | polynucleotide kinase 3'-phosphatase (PNKP), mRNA/cds = (0, 1565) | 1 | GGGCTGAGCCCCGCCCAGCTCCCCT CCACAATAAACGCTGTTTCTCCTTG |
| 3022 | Table 3A | Hs.10958 | NM_007262 | 6005748 | RNA-binding protein regulatory subunit (DJ-1), mRNA/cds = (20, 589) | 1 | TTTCTCAGCCTACAAATTGTGTCTATA CATTTCTAAGCCTTGTTTGCAGA |
| 3023 | db mining | Hs.10326 | NM_007263 | 6005734 | coatomer protein complex, subunit epsilon (COPE), mRNA/cds = (42, 968) | 1 | GAGCCCACCCCCAGCACCCCCATCT GTTAATAAATATCTCAACTCCAAAA |
| 3024 | Table 3A | Hs.8813 | NM_007269 | 6005885 | syntaxin binding protein 3 (STXBP3), mRNA/cds = (51, 1829) | 1 | TGGAGTGATTTCACAGTGTGTACTGT TTTGCCACATACTTCTAAAGAACA |
| 3025 | Table 3A | Hs.8724 | NM_007271 | 6005813 | serine threonine protein kinase (NDR), mRNA/cds = (595, 1992) | 1 | CCCTTTGGAAATGGTGAAGGAACCAG CCCAATAGAAGTACAGAGCCAGCT |
| 3026 | Table 3A | Hs.7771 | NM_007273 | 6005853 | B-cell associated protein (REA), mRNA/cds = (9, 906) | 1 | CTCCCTCAAGGCTGGGAGGAGATAA ACACCAACCCAGGAATTCTCAATAA |
| 3027 | Table 3A | Hs.7719 | NM_007278 | 6005763 | GABA(A) receptor-associated protein (GABARAP), mRNA/cds = (104, 457) | 1 | AGGGACTGAAATTGTGGGGGGAAGG TAGGAGGCACATCAATAAAGAGGAA |
| 3028 | Table 3A | Hs.1298 | NM_007289 | 6042203 | membrane metallo-endopeptidase (neutral endopeptidase, enkephalinase, CALLA, CD10) (MME), transcript variant 2b, mRNA/cds = (228, 2480) | 1 | TGGGGCAAAACCTTGCTAATTTTCTC AAAAGCATTTATCATTCTTGTTGC |
| 3029 | literature | Hs.194143 | NM_007295 | 6552300 | breast cancer 1, early onset (BRCA1), transcript variant BRCA1b, mRNA/cds = (397, 5988) | 1 | CCCCCAGTGTGCAAGGGCAGTGAAG ACTTGATTGTACAAAATACGTTTTG |
| 3030 | Table 3A | Hs.21486 | NM_007315 | 6274551 | signal transducer and activator of transcription 1, 91kD (STAT1), mRNA/cds = (196, 2448) | 1 | AGATGGCGAGAACCTAAGTTTCAGTT GATTTACAATTGAAATGACTAAA |
| 3031 | Table 3A | Hs.3260 | NM_007318 | 7549812 | presenilin 1 (Alzheimer disease 3) (PSEN1), transcript variant I-463, mRNA/cds = (553, 1944) | 1 | TGTCAGACCTTCTTCCACAGCAAATG AGATGTATGCCCAAAGCGGTAGAA |
| 3032 | Table 3A | Hs.279611 | NM_007329 | 6633800 | deleted in malignant brain tumors 1 (DMBT1), transcript variant 2, mRNA/cds = (106, 7347) | 1 | GTTGCAGGGCGAGGTCAAGAGAGTT CTGACCTGGATGGCCCATAGACCTG |
| 3033 | Table 3A | Hs.74335 | NM_007355 | 6680306 | heat shock 90kD protein 1, beta (HSPCB), mRNA/cds = (0, 2174) | 1 | GACAGCAGGATTGGATGTTGTGTATT GTGGTTTATTTTATTTTCTTCATT |
| 3034 | Table 3A | Hs.74085 | NM_007360 | 6679051 | DNA segment on chromosome 12 (unique) 2489 expressed sequence (D12S2489E), mRNA/cds = (338, 988) | 1 | AGTGCCTTCCCTGCCTGTGGGGGTC ATGCTGCCACTTTTAATGGGTCCTC |

TABLE 8-continued

| SEQ ID | Origin | Unigene | Locus | GI | Nominal Description | Strand | Probe Sequence |
|---|---|---|---|---|---|---|---|
| 3035 | Table 3A | Hs.172207 | NM_007363 | 7657382 | non-POU-domain-containing, octamer-binding (NONO), mRNA/cds = (138, 1551) | 1 | TTTGGAGTTTTTCTGAAAAATGGAGC AGTAATGCAGCATCAACCTATTAA |
| 3036 | Table 3A | Hs.158135 | NM_011086 | 6755061 | mRNA for KIAA0981 protein, partial cds/cds = (0, 1737) | 1 | CAATGGACAAGTATTTCCTAATGGTA CCAGACCACTGGACAGGCTTGGGT |
| 3037 | Table 3A | Hs.9754 | NM_012068 | 12597624 | activating transcription factor 5 (ATF5), mRNA/cds = (319, 1167) | 1 | GTGTTGGAGAGGGGCTGTGTCTGGG TGAGGGATGGCGGGGTACTGATTTT |
| 3038 | Table 3A | Hs.97199 | NM_012072 | 11496985 | complement component C1q receptor (C1QR), mRNA/cds = (148, 2106) | 1 | GTGCTTTGAGGGTCAGCCTTTAGGAA GGTGCAGCTTTGTTGTCCTTTGAG |
| 3039 | Table 3A | Hs.173334 | NM_012081 | 6912353 | ELL-RELATED RNA POLYMERASE II, ELONGATION FACTOR (ELL2), mRNA/cds = (0, 1922) | 1 | GGCTCACATCAAAAGGCTAATAGGTG AATTTGACCAACAGCAAGCAGAGT |
| 3040 | Table 3A | Hs.1710 | NM_012089 | 9961243 | ATP-binding cassette, sub-family B (MDR/TAP), member 10 (ABCB10), nuclear gene encoding mitochondrial protein, mRNA/cds = (43, 2259) | 1 | CAGAAAGCAAACAACACAATTA CAAGGTTGAATCTGAGGAAAATAA TCCT |
| 3041 | Table 3A | Hs.342849 | NM_012097 | 6912243 | xv24a05.x1 cDNA, 3' end/close = IMAGE:2814032/clone_end = 3' | 1 | TCTCTCTGTGTTCTCTGTATTGTACTA ACCAACCTCCCAAATCGCTGAGC |
| 3042 | Table 3A | Hs.33979 | NM_012123 | 6912299 | CGI-02 protein (CGI-02), mRNA/cds = (268, 2124) | 1 | CCTGGAATAAAACTCAACATGCAGAT TTGCCTACTCATAGGGACTTTGCC |
| 3043 | Table 3A | Hs.22857 | NM_012124 | 6912303 | chord domain-containing protein 1 (CHP1), mRNA/cds = (84, 1082) | 1 | TGCCTCCCTGATGGAAAACTATATAA AATTGTAGACTTAAAAGGTTTGTG |
| 3044 | Table 3A | Hs.36794 | NM_012142 | 6912335 | cyclin D-type binding-protein 1 (CCNDBP1), mRNA/cds = (87, 1172) | 1 | TTCATTGTAAAGATGTTGATGGTCTC AATAAAATGCTAACTTGCCAGTGA |
| 3045 | Table 3A | Hs.83363 | NM_012151 | 12056462 | coagulation factor VIII-associated (intronic transcript) (FBA), mRNA/cds = (57, 1172) | 1 | CGTCCGCACGGTACGTCTTCATGGG AGTCATTTATTCCTTACAGCTTCC |
| 3046 | Table 3A | Hs.24178 | NM_012155 | 6912355 | microtubule-associated protein like echinoderm EMAP (EMAP-2), | 1 | TGGTGTTTGGTTTGGGGTGTTTTTTA AGTTTTTTCTTTTATATCATCCAG |
| 3047 | Table 3A | Hs.5912 | NM_012179 | 7106310 | F-box only protein 7 (FBXO7), mRNA/cds = (205, 1773) | 1 | CTCCCTGCTCTTGGTTCTCCTCTAGA TTGAAGTTTGTTTTCTGATGCTGT |
| 3048 | Table 3A | Hs.79381 | NM_012198 | 6912387 | grancalcin, EF-hand calcium-binding protein (GCA), mRNA/cds = (119, 772) | 1 | TGAAGACATAGTTCACCTAAAATGGC ATCCTGCTCTGAATCTAGACTTTT |
| 3049 | Table 3A | Hs.14520 | NM_012199 | 6912351 | eukaryotic translation initiation factor 2C, 1 (EIF2C1), mRNA/cds = (213, 2786) | 1 | CCCTTTGAGATTTGTGTTTGTGTCCT GCTTTGAGCTGTACCTTGTCCAGT |
| 3050 | Table 3A | Hs.5734 | NM_012215 | 11024697 | meningioma expressed antigen 5 (hyaluronidase) (MGEA5), mRNA/cds = (395, 3145) | 1 | TCCTGTAGAAAACGAACTGTAAAAGA CCATGCAAGAGGCAAAATAAAACT |
| 3051 | literature | Hs.271353 | NM_012222 | 6912519 | mutY (E. coli) homolog (MUTYH), mRNA/cds = (134, 1774) | 1 | CCAGTGACACCTCTGAAAGCCC CCATTCCCTGAGAATCCTGTTGTT AGTA |
| 3052 | Table 3A | Hs.26719 | NM_012231 | 10092605 | PR domain containing 2, with ZNF domain (PRDM2), mRNA/cds = (855, 6014) | 1 | CCTGGTCAGTGGTGGTCTTCAAGAC GACAGCTCTGTATCTGCCATGTGAA |
| 3053 | Table 3A | Hs.44017 | NM_012237 | 13775599 | sirtuin (silent mating type information regulation 2, S. cerevisiae, homolog) 2 (SIRT2), transcript variant 1, mRNA/cds = (200, 1369) | 1 | CCCACTTCCCATGCTGGATGGGCAG AAGACATTGCTTATTGGAGACAAAT |
| 3054 | Table 3A | Hs.31176 | NM_012238 | 13775598 | sirtuin (silent mating type information regulation 2, S. cerevisiae, homolog) 1 (SIRT1), mRNA/cds = (53, 2296) | 1 | TTACTGGCATATGTTTTGTAGACTGTT TAATGACTGGATATCTTCCTTCA |
| 3055 | Table 3A | Hs.22891 | NM_012244 | 6912669 | solute carrier family 7 (cationic amino acid transporter, y+ system), member 8 (SLC7A8), mRNA/cds = (730, 2337) | 1 | AATGTAAGGTTGTTTTGGGGGATGGA GTTAGAACCTTAATGATAATTTCT |
| 3056 | Table 3A | Hs.79008 | NM_012245 | 6912675 | SKI-INTERACTING PROTEIN (SNW1), mRNA/cds = (27, 1637) | 1 | TTTGGAGTGGGCAAAGTAACCTCTTG CTTGGTGCAACTATTTGTTTCAAA |
| 3057 | Table 3A | Hs.268555 | NM_012255 | 6912743 | 5'-3' exoribonuclease 2 (XRN2), mRNA/cds = (68, 2920) | 1 | GCTTATAAACACATTTGAGGAATAGG AGGTCCGGGTTTTCCATAATGGGT |
| 3058 | Table 3A | Hs.10882 | NM_012257 | 6912409 | HMG-box containing protein 1 (HBP1), mRNA/cds = (23, 1567) | 1 | TCTTATCATTGCATACATTTTCTGGAT GCTTGAGCCATCAGATATCAGCT |
| 3059 | Table 3A | Hs.23170 | NM_012280 | 7110660 | homolog of yeast SPB1 (JM23), mRNA/cds = (300, 1289) | 1 | TGCAGTGGGAATTCTTGAGTGAGGTC TTACCTCTTCTTTAAACCTCTTCA |
| 3060 | Table 3A | Hs.173714 | NM_012286 | 6912447 | MORF-related gene X (KIAA0026), mRNA/cds = (305, 1171) | 1 | TGCATTATTGTGTAGCCACGGTTTTC TGGAAAAGTTGATATTTTAGGAAT |
| 3061 | Table 3A | Hs.18895 | NM_012290 | 6912719 | tousled-like kinase 1 (TLK1), mRNA/cds = (212, 2575) | 1 | ATTACATTGGAAGGGAGCTTTCAAGA TGGTAGGATATTGACTAACTGAGC |
| 3062 | Table 3A | Hs.30687 | NM_012296 | 6912459 | GRB2-associated binding protein 2 (GAB2), mRNA/cds = (160, 2076) | 1 | CATGGTACAGGCTTGGAGCTTGCAG GTCCCTTTCTACTGTGGTGTTGGAG |
| 3063 | Table 3A | Hs.120165 | NM_012318 | 6912481 | leucine zipper-EF-hand containing transmembrane protein 1 (LETM1), mRNA/cds = (297, 2516) | 1 | TGTGCAGGGACAGTTGGCTTCCAGA GGTTTCAGCTTTCAGTTATTTGAGA |
| 3064 | Table 3A | Hs.234279 | NM_012325 | 6912493 | microtubule-associated protein, RP/EB family, member 1 (MAPRE1), mRNA/cds = (64, 870) | 1 | AATTCCATTTTATTGGGAACCCATTT CCACCTGGTCTTTCTTGACAGGG |

TABLE 8-continued

| SEQ ID | Origin | Unigene | Locus | GI | Nominal Description | Strand | Probe Sequence |
|---|---|---|---|---|---|---|---|
| 3065 | Table 3A | Hs.172740 | NM_012326 | 10800411 | microtubule-associated protein, RP/EB family, member 3 (MAPRE3), mRNA/cds = (153, 998) | 1 | AAATAAACTTGTGTGGTAAAAGTACA TGCCATGTGTCCCTCAACTGAAAA |
| 3066 | Table 3A | Hs.18625 | NM_012332 | 6912517 | Mitochondrial Acyl-CoA Thioesterase (MT-ACT48), mRNA/cds = (147, 1367) | 1 | TTCAAGACAATTTTAATTGTGAACCTA CCATGTTGCCTCCCATCTTCTGA |
| 3067 | Table 3A | Hs.215766 | NM_012341 | 6912531 | GTP-binding protein (NGB), mRNA/cds = (23, 1924) | 1 | TTTGTAAGAGCTGGGAGCAAACACGT TTATGAGTGTGTCGGAATCCCGTG |
| 3068 | Table 3A | Hs.74420 | NM_012381 | 6912561 | origin recognition complex, subunit 3 (yeast homolog)-like (ORC3L), mRNA/cds = (26, 2161) | 1 | CCCAAACAGGCATGTATCAAAACACC TGTGGAGTACTTTAGACTCCAACA |
| 3069 | Table 3A | Hs.241531 | NM_012392 | 6912581 | PEF protein with a long N-terminal hydrophobic domain (peflin) (PEF), mRNA/cds = (12, 866) | 1 | TGGGGCCAAAAGTCCAGTGAAATTGT AAGCTTCAATAAAAGGATGAAACT |
| 3070 | Table 3A | Hs.21807 | NM_012406 | 9055315 | PR domain containing 4 (PRDM4), mRNA/cds = (122, 2527) | 1 | TGGGCTGGAGTAGAGGACTCTGGTG GGAAGGTTTTGCTGCTAATGTATTT |
| 3071 | Table 3A | Hs.79033 | NM_012413 | 9257235 | glutaminyl-peptide cyclotransferase (glutaminyl cyclase) (QPCT), mRNA/cds = (11, 1098) | 1 | AGCTAAACAGTACTTAAATAGCGGTT GGAACTAGGTAGCCTTTCGAATTT |
| 3072 | literature | Hs.128501 | NM_012415 | 6912621 | RAD54, S. cerevisiae, homolog of, B (RAD54B), mRNA/cds = (80, 2812) | 1 | TGTCATTCATTTTTCAGAATATAACCA CTCAAGCTACTGGCACATAGTGA |
| 3073 | Table 3A | Hs.333212 | NM_012417 | 6912623 | retinal degeneration B beta (RDGBB), mRNA/cds = (0, 998) | 1 | TCTGATAGAGAAAAAGACTGCTTTGT CACTCAAACATGTTCCTTCGACCT |
| 3074 | Table 3A | Hs.151242 | NM_012423 | 14591905 | serine (or cysteine) proteinase inhibitor, clade G (C1 inhibitor), member 1 (SERPING1), mRNA/cds = (60, 1562) | 1 | GGCATCGCCCATGCTCCTCACCTGTG TTTTGTAATCAGAAATAAATTGCT |
| 3075 | Table 3A | Hs.334826 | NM_012433 | 6912653 | splicing factor 3b, subunit 1, 155kD (SF3B1), mRNA/cds = (0, 3914) | 1 | TTTGATGTTAAACAGTAAATGCCAGT AGTGACCAAGAACACAGTGATTAT |
| 3076 | literature | Hs.159737 | NM_012444 | 6912679 | SPO11, meiotic protein covalently bound to DSB (S. cerevisiae)-like (SPO11), mRNA/cds = (108, 1298) | 1 | CCTTTGCCTTTATACTTTAGGGGTCTT ACTCCATTAATTCATTTGTTACA |
| 3077 | literature | Hs.244613 | NM_012448 | 6912687 | signal transducer and activator of transcription 5B (STAT5B), mRNA/cds = (146, 2509) | 1 | TGCACGTTATGGTGTTTCTCCCTCTC ACTGTCTGAGAGTTTAGTTGTAGC |
| 3078 | Table 3A | Hs.109571 | NM_012456 | 6912707 | translocase of inner mitochondrial membrane 10 (yeast) homolog (TIMM10), mRNA/cds = (129, 401) | 1 | CTGTAGAGAGTCTTCAAGATCCCGGA GTGGTAGCGCTGTCTCCTGGTGAA |
| 3079 | Table 3A | Hs.7797 | NM_012461 | 6912715 | TERF1 (TRF1)-interacting nuclear factor 2 (TINF2), mRNA/cds = (262, 1326) | 1 | TAGTAGGAATGAAGTGGAAGTCCAG GCTTGGATTGCCTAACTACACTGCT |
| 3080 | Table 3A | Hs.105806 | NM_012483 | 7108345 | granulysin (GNLY), transcript variant 519, mRNA/cds = (280, 669) | 1 | GATCCAGAATCCACTCTCCAGTCTCC CTCCCCTGACTCCCTCTGCTGTCC |
| 3081 | Table 3A | Hs.199263 | NM_013233 | 7019542 | Ste-20 related kinase (SPAK), mRNA/cds = (173, 1816) | 1 | ATTCCATTCTATTGTTACACAACGAT TACTCGAAGATGACTGCAAAGGT |
| 3082 | Table 3A | Hs.283781 | NM_013234 | 10801344 | muscle specific gene (M9), mRNA/cds = (171, 827) | 1 | AGCCAAGAAGAGAGCATTAAACCCAA GAACATTGTGGAGAAGATTGACTT |
| 3083 | Table 3A | Hs.13493 | NM_013236 | 7106298 | like mouse brain protein E46 (E46L), mRNA/cds = (198, 1625) | 1 | TATATTGTACTTACTGTGACAGCAGA TAATAAACCAGTCTCTTGGAGGGC |
| 3084 | Table 3A | Hs.279529 | NM_013237 | 7019508 | px19-like protein (PX19), mRNA/cds = (176, 835) | 1 | CTTATTCTCCCATTGGGCAGCTGAGG ACCGAGGCACAGAGGTGCGGTGAC |
| 3085 | Table 3A | Hs.126355 | NM_013252 | 10281668 | C-type (calcium dependent, carbohydrate-recognition domain) lectin, superfamily member 5 (CLECSF5), mRNA/cds = (197, 763) | 1 | TCACTGTATACCACTGGAGTTTTCTG GTTATCTCTCGTATAGCAAAATCT |
| 3086 | Table 3A | Hs.169330 | NM_013259 | 10047091 | neuronal protein (NP25), mRNA/cds = (49, 897) | 1 | GCTGCCACCTCCTGTTCATTTAGAAC TATGCAAAGACTCCGCTTCCGTTT |
| 3087 | Table 3A | Hs.136748 | NM_013269 | 7019446 | lectin-like NK cell receptor (LLT1), mRNA/cds = (13, 588) | 1 | ACAGCAAAGCCCCAACTAATCTTTAG AAGCATATTGGAACTGATAACTCC |
| 3088 | Table 3A | Hs.14805 | NM_013272 | 7706713 | solute carrier family 21 (organic anion transporter), member 11 (SLC21A11), mRNA/cds = (193, 2325) | 1 | GCCAGCTTGGAGGATGGACATTTCTG GATACATACACATACAAAACAG |
| 3089 | literature | Hs.129903 | NM_013274 | 7019490 | polymerase (DNA-directed), lambda (POLL), mRNA/cds = (371, 2098) | 1 | GTCAACATCATCCGGCACCCTCTGG GGTAGGAGAACAGCCATTCCACATG |
| 3090 | Table 3A | Hs.54642 | NM_013283 | 11034824 | methionine adenosyltransferase II, beta (MAT2B), mRNA/cds = (0, 1004) | 1 | TCATATGTGTGGTTATACTCATAATAA TGGGCCTTGTAAGCCTTTTCACC |
| 3091 | literature | Hs.252646 | NM_013284 | 7019492 | wm25f06.x1 cDNA, 3' end/clone = IMAGE:2436995/clone_end = 3' | 1 | CTGCTTGACTCACCGGCTTCCTATTT GATGCACCCAGGCCCCCTTGTGGC |
| 3092 | Table 3A | Hs.75528 | NM_013285 | 7019418 | nucleolar GTPase (HUMAUANTIG), mRNA/cds = (79, 2274) | 1 | GGGACAGAAACACAAACGCAAA AAATTCAGACAAAAGCAGTAATGT TTAA |
| 3093 | Table 3A | Hs.106260 | NM_013322 | 7019538 | sorting nexin 10 (SNX10), mRNA/cds = (128, 733) | 1 | GCGATCCTCATCCCTTCAGCAATATG TATTTGAGTTCACACTATTTCTGT |
| 3094 | Table 3A | Hs.289080 | NM_013326 | 7019454 | colon cancer-associated protein Mic1 (MIC1), mRNA/cds = (76, 1905) | 1 | TTTTGAACAGCGAAACCAGCGTTTGC GAGGGAGCCCCAATTTCACACCAG |

TABLE 8-continued

| SEQ ID | Origin | Unigene | Locus | GI | Nominal Description | Strand | Probe Sequence |
|---|---|---|---|---|---|---|---|
| 3095 | literature | Hs.283018 | NM_013347 | 9558730 | replication protein A complex 34 kd subunit homolog Rpa4 (HSU24186), mRNA/cds = (404, 1189) | 1 | TTCCAAAAGAAAAACTAGTTGCAGTC AGGGAGCCAGCGAAAAGACAAAAA |
| 3096 | Table 3A | Hs.272409 | NM_013351 | 7019548 | T-box 21 (TBX21), mRNA/cds = (211, 1818) | 1 | ACTGAGAGTGGTGTCTGGATATATTC CTTTTGTCTTCATCACTTTCTGAA |
| 3097 | Table 3A | Hs.58636 | NM_013352 | 7019520 | squamous cell carcinoma antigen recognized by T cell (SART-2), mRNA/cds = (149, 3025) | 1 | GCATGCATTCATTGGTTGTTCAATAA GTGAGATGATTACAGATAATACTG |
| 3098 | literature | Hs.189138 | NM_013368 | 7019514 | RPA-binding trans-activator (RBT1), mRNA/cds = (291, 881) | 1 | CTGATTTCATAACCAGGCCGGACCAC GTGCAATAGGGTGGAAACCAAACT |
| 3099 | Table 3A | Hs.138713 | NM_013378 | 7019566 | pre-B lymphocyte gene 3 (VPREB3), mRNA/cds = (42, 413) | 1 | GAAGACGACGCGGATTACTACTGCTC TGTTGGCTACGGCTTTAGTCCCTA |
| 3100 | Table 3A | Hs.279784 | NM_013388 | 7019502 | protactin regulatory element binding (PREB), mRNA/cds = (131, 1384) | 1 | TGAACCTCAGCCCATTAGGCAGGAAA AGTTGATATTTAATAAACAAGGAA |
| 3101 | Table 3A | Hs.171825 | NM_013390 | 7019554 | basic helix-loop-helix domain containing, class B, 2 (BHLHB2), mRNA/cds = (196, 1434) | 1 | CCAAGGCACTTGGTTTTTCTGTTTTAT ATACTAATAATCAGGGCCTAAGT |
| 3102 | Table 3A | Hs.272736 | NM_013392 | 7019332 | nuclear receptor binding protein (NRBP), mRNA/cds = (112, 1719) | 1 | GGGGGGCCATTCGATTCGCCTCAGTT GCTGCTGTAATAAAAGTCTACTTTT |
| 3103 | Table 3A | Hs.7838 | NM_013446 | 7305272 | makorin, ring finger protein, 1 (MKRN1), mRNA/cds = (122, 1570) | 1 | ACTTTAAGAAAAAACAAATAATT GTTGCAGAGGTCTCTGTATTTTG CAGC |
| 3104 | Table 3A | Hs.8858 | NM_013448 | 7304918 | bromodomain adjacent to zinc finger domain, 1A (BAZ1A), mRNA/cds = (115, 5139) | 1 | CTGTACCAGTGCTGGCTGCAGGTATT AAGTCCAAGTTTATTAACTAGATA |
| 3105 | Table 3A | Hs.277401 | NM_013449 | 7304920 | bromodomain adjacent to zinc finger domain, 2A (BAZ2A), mRNA/cds = (739, 6375) | 1 | GCCACCTCTGTGTTCCTGTCATAGCA AATATGGGACCATCACCAGCTTAC |
| 3106 | Table 3A | Hs.234680 | NM_013451 | 7305052 | fer-1 (C. elegans)-like 3 (myoferlin) (FER1L3), mRNA/cds = (96, 6281) | 1 | TCCTGAGGTGATATACTTCATATTTGT AATCAACTGAAAGAGCTGTGCAT |
| 3107 | literature | Hs.100299 | NM_013975 | 7710125 | ligase III, DNA, ATP-dependent (LIG3), transcript variant alpha, mRNA/cds = (323, 3091) | 1 | TGCTGGGTTTGCCATCTTTTTTTGT TTTCTTTGAAAAGCAGCTTAGTT ACCC |
| 3108 | Table 3A | Hs.8262 | NM_013995 | 7669502 | lysosomal-associated membrane protein 2 (LAMP2), transcript variant LAMP2b, mRNA/cds = (137, 1369) | 1 | CCACTAGTTGATGTATGGTATCTTTA GATATTTGCCTGTCTGTTTGCTCA |
| 3109 | Table 3A | Hs.127649 | NM_014007 | 7662099 | KIAA0414 protein (KIAA0414), mRNA/cds = (1132, 2535) | 1 | AATGGCCTACAACCAAGCTATTTGTC CCCTACTTTGAGTCTTAACTGTGG |
| 3110 | Table 3A | Hs.301175 | NM_014029 | 7661739 | HSPC022 protein (HSPC022), mRNA/cds = (18, 623) | 1 | ATCCTGAGCTGCACTTACCTGTGAGA GTCTTCAAACTTTTAAACCTTGCC |
| 3111 | Table 3A | Hs.11125 | NM_014041 | 7661745 | HSPC033 protein (HSPC033), mRNA/cds = (168, 443) | 1 | TGCTCTGAGATGGGGAACAGAACAC ACAAGTATGAAGTTTCTTTCAGGTG |
| 3112 | Table 3A | Hs.182238 | NM_014052 | 7661715 | GW128 protein (GW128) | 1 | AAGCACACCCGTGGTTGTGAAAATAG TATAGCAAAAAAGAAAAATCCCCCG |
| 3113 | Table 3A | Hs.76640 | NM_014059 | 7662650 | RGC32 protein (RGC32), mRNA/cds = (146, 499) | 1 | TGTTTACCTGCTTGCAGCATATTAGA ACAGACGATCCATGCTAATATTGT |
| 3114 | Table 3A | Hs.279040 | NM_014065 | 7661837 | HT001 protein (HT001), mRNA/cds = (241, 1203) | 1 | AATCCTTACTTAAAATTCTTCCGTTAC CACCCTTGAAACAATTAGCTTTT |
| 3115 | Table 3A | Hs.5327 | NM_014106 | 7662624 | PRO1914 protein (PRO1914), mRNA/cds = (1222, 1425) | 1 | ATAACAGTTCTATTTGGAATGATACC CACAACTCTACAAGCATCTTATCC |
| 3116 | Table 3A | Hs.78961 | NM_014110 | 13699255 | protein phosphatase 1, regulatory (inhibitor) subunit 8 (PPP1R8), mRNA/cds = (935, 1318) | 1 | AGAGATTTGTACATTTGTGTAATAGG CCTTTTCATGCTTTATGTGTAGCT |
| 3117 | Table 3A | Hs.26102 | NM_014112 | 7657658 | trichorhinophalangeal syndrome I gene (TRPS1), mRNA/cds = (638, 4483) | 1 | TCTTGGTGTATTTCTTATGCAAACAAT CTTCAGGCAGCAAAGATGTCTGT |
| 3118 | Table 3A | Hs.179898 | NM_014153 | 7661761 | HSPC055 protein (HSPC055), mRNA/cds = (1400, 1903) | 1 | AACCTGTACTGTTGGTATTGTGTTAG TGTATGGACCAATACTGCCTGTAA |
| 3119 | Table 3A | Hs.279474 | NM_014160 | 8850222 | HSPC070 protein (HSPC070), mRNA/cds = (331, 1581) | 1 | AATTGAGGGACCATCAGATAACTGTA TTTTGTCAGGTGCAATAAAAACAA |
| 3120 | Table 3A | Hs.5232 | NM_014165 | 7661785 | HSPC125 protein (HSPC125), mRNA/cds = (79, 608) | 1 | CTATGTGTACTCCTCATCCCTCCTGC TGTATATTTCTCATTTTTTGCGT |
| 3121 | Table 3A | Hs.181112 | NM_014168 | 7661787 | HSPC126 protein (HSPC126), mRNA/cds = (25, 837) | 1 | TTAAAAGTAACAAAAACTGCCA TTTGACAGTAAAGGCTCTTGGCTT CTGT |
| 3122 | Table 3A | Hs.279761 | NM_014169 | 7661793 | HSPC134 protein (HSPC134), mRNA/cds = (45, 716) | 1 | GCTCCCTTCTCTTTGATAGCAGTTAT AATGCCCTTGTTCCCAATAAAACT |
| 3123 | Table 3A | Hs.13645 | NM_014174 | 7661803 | HSPC144 protein (HSPC144), mRNA/cds = (446, 1123) | 1 | CTGAGATACTGCTGCTGGAATGGGC GAGACATTGCTGCAAAGAAGTCAAG |
| 3124 | Table 3A | Hs.30026 | NM_014188 | 7661831 | cDNA FLJ13048 fis, clone NT2RP3001399, weakly similar to SSU72 PROTEIN/cds = (27, 488) | 1 | CTGCGGCGTGTTAGGAATGACCTGG AATTGTCAATAAACAGATGCTGCTG |
| 3125 | Table 3A | Hs.121025 | NM_014205 | 7656935 | chromosome 11 open reading frame 5 (C11orf5), mRNA/cds = (45, 1256) | 1 | AGCTCCCTAGCTGAACGGGTTACCCT GGTCATTAATAAAGCTGTGACTGG |
| 3126 | Table 3A | Hs.58685 | NM_014207 | 7656964 | CD5 antigen (p56—62) (CD5), mRNA/cds = (72, 1559) | 1 | CTCATCTAAAGACACCTTCCTTTCCA CTGGCTGTCAAGCCACAGGGCACC |
| 3127 | Table 3A | Hs.70499 | NM_014210 | 7657074 | ecotropic viral integration site 2A | 1 | GGCAGAATCCACACCAGCTTATCAAC |

TABLE 8-continued

| SEQ ID | Origin | Unigene | Locus | GI | Nominal Description | Strand | Probe Sequence |
|---|---|---|---|---|---|---|---|
| 3128 | Table 3A | Hs.173902 | NM_014225 | 7657474 | (EVI2A), mRNA/cds = (219, 917) protein phosphatase 2 (formerly 2A), regulatory subunit A (PR65), alpha isoform (PPP2R1A), mRNA/cds = (138, 1907) | 1 | CAACACAGCTAATTTTAGAATAGG GACAGGACAGTGACCTTGGGAGGAA GGGGCTACTCCGCCATCCTTAAAAG |
| 3129 | Table 3A | Hs.273307 | NM_014230 | 7657616 | signal recognition particle 68kD (SRP68), mRNA/cds = (0, 1859) | 1 | GGACAAGTTGGAACAGAAGACCAAG AGTGGCCTCACTGGATACATCAAGG |
| 3130 | Table 3A | Hs.332724 | NM_014232 | 7657674 | AV705126 cDNA, 5' end/clone = ADBCFB08/clone_end = 5' | 1 | CCCCAATTCTGTGGCGCATCCCAGATT GTGAAAATGTACAATAAATGTGTA |
| 3131 | Table 3A | Hs.14084 | NM_014245 | 7657521 | ring finger protein 7 (RNF7), mRNA/cds = (53, 394) | 1 | TTCAGAGAACTTTTTGCATGCTTATG GTTGATCAGTTAAAAAAGAATGTT |
| 3132 | Table 3A | Hs.279919 | NM_014248 | 7657507 | ring-box 1 (RBX1), mRNA/cds = (6, 332) | 1 | TGCTGTTTCTGTAGCCATATTGTATTC TGTGTCAAATAAAGTCCAGTTGG |
| 3133 | Table 3A | Hs.74711 | NM_014280 | 7657610 | splicing factor similar to dnaJ (SPF31), mRNA/cds = (7, 801) | 1 | ACGCCACCCAAACCTTTCACTTTCCA AAGAGCTAGCCGTCCTCCACCCAG |
| 3134 | Table 3A | Hs.227823 | NM_014287 | 10947030 | pM5 protein (PM5), mRNA/cds = (0, 3668) | 1 | GCATCTGAGATCCTGTTGGAAACCAC AGCAACCTGTATTCATTATTAGGA |
| 3135 | Table 3A | Hs.54609 | NM_014291 | 7657117 | glycine C-acetyltransferase (2-amino-3-ketobutyrate coenzyme A ligase) (GCAT), mRNA/cds = (3, 1262) | 1 | GGACGTGACCTGTGCTGAGGGCTGT GAGAATGTGAAACAACAGTGTGAAA |
| 3136 | Table 3A | Hs.10729 | NM_014306 | 7657014 | hypothetical protein (HSPC117), mRNA/cds = (75, 1592) | 1 | GCCATCAGATTGATCTTCTTCACACC AAGCTCTGTTTACATTCCGAGAGG |
| 3137 | literature | Hs.5212 | NM_014311 | 7657596 | cDNA FLJ10927 fis, clone OVARC 1000488/cds = UNKNOWN | 1 | CCTTTCCTCACAGGGACCAAGACAAA GCATGGGACATGAAATTAAGAGTG |
| 3138 | Table 3A | Hs.278994 | NM_014313 | 7657594 | Rhesus blood group, CcEe antigens (RHCE), mRNA/cds = (0, 1253) | 1 | AAGCATGATTCCCACAAGGACTAAGT ATCAGTGATTTGTAATTTTCCTGT |
| 3139 | Table 3A | Hs.20597 | NM_014315 | 7657300 | host cell factor homolog (LCP), mRNA/cds = (316, 1536) | 1 | ACCTGTTGGTTTTAATGTGCATGTGA ATGGCCTAGAGAACCTATTTTTGT |
| 3140 | Table 3A | Hs.7256 | NM_014319 | 7706606 | integral inner nuclear membrane protein (MAN1), mRNA/cds = (6, 2741) | 1 | CCGACCAAGATCCCTCCCTGCAAGA CAGATGGGAATGTGTATAATAACTA |
| 3141 | Table 3A | Hs.76556 | NM_014330 | 9790902 | protein phosphatase 1, regulatory (inhibitor) subunit 15A (PPP1R15A), mRNA/cds = (240, 2264) | 1 | GGGAGGCGTGGCTGAGACCAACTGG TTTGCCTATAATTTATTAACTATTT |
| 3142 | Table 3A | Hs.38738 | NM_014343 | 7858980 | claudin 15 (CLDN15), mRNA/cds = (254, 940) | 1 | GGACGGTGTCCCCGCACGTTTGTATT GTGTATAAATACATTCATTAATAA |
| 3143 | Table 3A | Hs.48433 | NM_014345 | 7657183 | endocrine regulator (HRIHFB2436), mRNA/cds = (621, 6920) | 1 | ATCCTTTCCTCAACCTCCTCCTTTCC CAATTAATTTCAACCATAGTACGA |
| 3144 | Table 3A | Hs.17839 | NM_014350 | 7657123 | TNF-induced protein (GG2-1), mRNA/cds = (197, 769) | 1 | GCCAGCTATGTCCTCTAGGAAATGAC AGACCCAACCACCAGCAATAAACA |
| 3145 | Table 3A | Hs.283737 | NM_014366 | 7857047 | AD-017 protein (LOC58830), mRNA/cds = (118, 1233) | 1 | CTGTAAAAAGACAATTCATCTCATTGT GAGTGGAAGTAGTTATCTGGAAT |
| 3146 | Table 3A | Hs.97101 | NM_014373 | 7857135 | putative G protein-coupled receptor (GPCR150), mRNA/cds = (321, 1337) | 1 | GCATTTCAGAATGTGTCTTTTGAAGG GCTATACCAGTTATTAAATAGTGT |
| 3147 | literature | Hs.279843 | NM_014381 | 7857338 | mutl. (*E. coli*) homolog 3 (MLH3), mRNA/cds = (114, 4403) | 1 | CCAGGTTTCTGCACTGGTCCCCTCT TTTCCCTTCAGTCTTCTTCACTTC |
| 3148 | Table 3A | Hs.182470 | NM_014394 | 7657479 | PTD010 protein (PTD010), mRNA/cds = (129, 1088) | 1 | ACACTGCTACACCATTACTTTCTTGA GACATTTGTAAGTCCTTTGATACA |
| 3149 | Table 3A | Hs.128342 | NM_014406 | 7657252 | potassium large conductance calcium-activated channel, subfamily M, beta member 3-like (KCNMB3L), mRNA/cds = (243, 1918) | 1 | TGAATAACTAGTGATACCCTCAATAA AACAGGGATTGCCAAGAAGGGAAC |
| 3150 | Table 3A | Hs.27258 | NM_014412 | 7656951 | calcyclin binding protein (CACYBP), mRNA/cds = (117, 603) | 1 | ACCTTTAACATGTAAAGATGCTCACC TTGTTCAGAAGAGAATAAACCAGT |
| 3151 | Table 3A | Hs.301956 | NM_014415 | 7657702 | zinc finger protein (ZNF-U69274), mRNA/cds = (161, 3322) | 1 | TATGTCATAAACATGTAAATAAAAGAT GTTGAATCTTGTTGAAAGCGCGG |
| 3152 | Table 3A | Hs.14125 | NM_014454 | 7657436 | p53 regulated PA26 nuclear protein (PA26), mRNA/cds = (11, 1668) | 1 | TTGTATTCTGGAAGCGTGAATTGCTT TTGAAGTCTGTCAGTATTACTGGT |
| 3153 | Table 3A | Hs.326248 | NM_014456 | 7657448 | cDNA:FLJ22071 fis, clone HEP11691/cds = UNKNOWN | 1 | TTTGTAAGCGAAGGAGATGGAGGTC GTCTTAAACCAGAGAGCTACTGAAT |
| 3154 | Table 3A | Hs.111632 | NM_014463 | 7657314 | Lsm3 protein (LSM3), mRNA/cds = (29, 337) | 1 | ACTCACAACTTCTTAAGCTAAATGGT ATTTTCATTTTTCTCAAGCTCTCC |
| 3155 | Table 3A | Hs.127011 | NM_014464 | 7857644 | tubulointerstitial nephrilis antigen (TIN-AG), mRNA/cds = (1, 1431) | 1 | AGTTTAGCAATATGACATTCTTGGTG ACAGTGGAATCTTGTCTCTTCAC |
| 3156 | Table 3A | Hs.300684 | NM_014478 | 7656976 | calcitonin gene-related peptide-receptor component protein (CGRP-RCP), mRNA/cds = (61, 507) | 1 | GCCACTGACCTTGGCTCACCTTAGAG GAATTTCCTCGAGAACAACAGAGA |
| 3157 | literature | Hs.154149 | NM_014481 | 7856891 | *Homo sapiens*, apurinic/apyrimidinic endonuclease (APEX nuclease)-like 2 protein, clone MGc:1418 IMAGE:3139156, mRNA, complete cds/cds = (38, 1594) | 1 | ACTTCTGTCTTTGCTGGAAAGTGTAT TTGTGCATAAATAAAGTCTGTGTA |
| 3158 | Table 3A | Hs.120766 | NM_014487 | 13384595 | nucleolar cysteine-rich protein (HSA6591), mRNA/cds = (173, 1135) | 1 | TTCTCTTTCTTCACAATGTATGTCCTC AGTGGTACCTATTATTGATGCCT |
| 3159 | Table 3A | Hs.296433 | NM_014499 | 10092632 | putative purinergic receptor (P2Y10), | 1 | CTGTGACCCGCTCCCGCCTCATGAG |

TABLE 8-continued

| SEQ ID | Origin | Unigene | Locus | GI | Nominal Description | Strand | Probe Sequence |
|---|---|---|---|---|---|---|---|
| 3160 | Table 3A | Hs.187660 | NM_014504 | 7857495 | putative Rab5 GDP/GTP exchange factor homologue (RABEX5), mRNA/cds = (77, 1552) | 1<br>1 | CAAGGAGAGTGGTTCATCAATGATT<br>TGTAGGGTAAATGTGACTGGAATACA<br>CCTTTGGAACGGAATTCTTTATCA |
| 3161 | db mining | Hs.278457 | NM_014512 | 7857276 | killer cell immunoglobulin-like receptor, three domains, short cytoplasmic tail, 1 (KIR3DS1), mRNA/cds = (11, 1174) | 1 | AGAACTTCCAAATGCTGAGCCCAGAT<br>CCAAAGTTGTCTTCTGTCCACGAG |
| 3162 | Table 3A | Hs.239720 | NM_014515 | 7857384 | CCR4-NOT transcription complex, subunit 2 (CNOT2), mRNA/cds = (115, 1737) | 1 | TGACAAATTAGAAGAACGGCCTCACC<br>TGCCATCCACCTTCAACTACAACC |
| 3163 | Table 3A | Hs.17667 | NM_014521 | 7657561 | SH3-domain binding protein 4 (SH3BP4), | 1 | TGGATATTTTAACCTGTTAAGTGTGT<br>GTGTGTTTTCTGTACCCAACCAGA |
| 3164 | Table 3A | Hs.275243 | NM_014624 | 9845517 | S100 calcium-binding protein A6 (calcyclin) (S100A6), mRNA/cds = (102, 374) | 1 | TAAATAGGGAAGATGGAGACACCTCT<br>GGGGGTCCTCTCTGAGTCAAATCC |
| 3165 | Table 3A | Hs.173288 | NM_014633 | 7661949 | KIAA0155 gene product (KIAA0155), mRNA/cds = (86, 3607) | 1 | TGTGTTAGGTTGAATAAGGTGTGGAA |
| 3166 | Table 3A | Hs.170307 | NM_014636 | 7662069 | Ral guanine nucleotide exchange factor RalGPS1A (RalGPS1A), mRNA/cds = (267, 1940) | 1 | GCAGTAACCACTGAACGTCAATCAGC<br>CCTCCATGGGGTTCTTTCGATTTT |
| 3167 | Table 3A | Hs.323580 | NM_014644 | 11036643 | cDNA FLJ10757 fis, clone NT2RP3004578, highly similar to mRNA for KIAA0477 protein/cds = UNKNOWN | 1 | GTTTGAAGTTGTGACTCTCCTGCTAC<br>CAATTAAATAAAGCTTACTTTGCC |
| 3168 | Table 3A | Hs.166318 | NM_014646 | 7662021 | lipin 2 (LPIN2), mRNA/cds = (239, 2929) | 1 | TGCAAGATGAATGGCTAATATTTTGG<br>TGCAGTGTTTGATGTTCAAAACAA |
| 3169 | Table 3A | Hs.323712 | NM_014664 | 7662203 | KIAA0615 gene product (KIAA0615), mRNA/cds = (237, 2927) | 1 | CTGCCTGTTCAGAACTGTTTAATAGC<br>AGTTACTCTTGAGTGTATTTACCT |
| 3170 | Table 3A | Hs.132853 | NM_014666 | 7661967 | KIAA0171 gene product (KIAA0171), mRNA/cds = (101, 1978) | 1 | ATTCTAGAGTTTGGAATGCAAAATTAA<br>TTGTTTTACCCTCAAGCTGGGAA |
| 3171 | Table 3A | Hs.155291 | NM_014670 | 7661849 | KIAA0005 gene product (KIAA0005), mRNA/cds = (80, 1339) | 1 | TGGGGTGAATTTGTTAAAATGAGTAA<br>CTTTGATAAAGTTTTTCATGCACA |
| 3172 | Table 3A | Hs.154332 | NM_014874 | 7662001 | KIAA0212 gene product (KIAA0212), mRNA/cds = (58, 2031) | 1 | AAAAGTATAGAGTTGGAAACTCTGGG<br>AAAACTTACGGAAATACACAAATG |
| 3173 | Table 3A | Hs.151791 | NM_014879 | 7661899 | KIAA0092 gene product (KIAA0092), mRNA/cds = (53, 1477) | 1 | ATGTGTCAACCACCATTTCAGCTATT<br>AAAAACTCCTGTTATCTCCTTGTT |
| 3174 | Table 3A | Hs.186840 | NM_014686 | 7662075 | KIAA0355 gene product (KIAA0355), mRNA/cds = (838, 4050) | 1 | TACAATGCTTCCAAACTGGAACTCTA<br>CATTTTGTATCTTTTAAAGCTCCT |
| 3175 | Table 3A | Hs.111894 | NM_014713 | 13518239 | lysosomal-associated protein transmembrane 4 alpha (LAPTM4A), mRNA/cds = (148, 849) | 1 | GTGACTTGACTGTGGAAGATGATGGT<br>TGCATGTTTCTAGTTTGTATATGT |
| 3176 | Table 3A | Hs.181418 | NM_014730 | 7661947 | KIAA0152 gene product (KIAA0152), mRNA/cds = (128, 1006) | 1 | CCTTCCATGTCCCACCCCACTCCCAC<br>CAAAAAGTACAAAATCAGGATGTT |
| 3177 | Table 3A | Hs.81892 | NM_014736 | 7661905 | KIAA0101 gene product (KIAA0101), mRNA/cds = (61, 396) | 1 | TGGTGTTTGATTATTGGAATGGTGCC<br>ATATTGTCACTCCTTCTACTTGCT |
| 3178 | Table 3A | Hs.80905 | NM_014737 | 7661963 | Ras association (RalGDS/AF-6) domain family 2 (RASSF2), mRNA/cds = (196, 1176) | 1 | ACAGGGCCTCAGCAAGGGAGCCATA<br>CATTTTTGTAACATTTTGATATGTT |
| 3179 | Table 3A | Hs.108920 | NM_014739 | 7661957 | HT018 mRNA, complete cds/cds = (451, 1179) | 1 | GGCTAAACGATTCTTACTCAGTGTGA<br>TGTATAATGATGCAACAGGGACCC |
| 3180 | Table 3A | Hs.79768 | NM_014740 | 7661919 | KIAA0111 gene product (KIAA0111), mRNA/cds = (214, 1449) | 1 | TAATGGGGTTTATATGGACTTTCTTCT<br>CATAAATGGCCTGCCGTCTCCCT |
| 3181 | Table 3A | Hs.77724 | NM_014749 | 7662189 | KIAA0586 gene product (KIAA0586), mRNA/cds = (274, 4875) | 1 | ATACCTTCTGAACGGGAAGAGACAGC<br>CAGCACAGTGTTTATGCCACTGGT |
| 3182 | Table 3A | Hs.77685 | NM_014752 | 7661907 | KIAA0102 gene product (KIAA0102), mRNA/cds = (307, 678) | 1 | TTCCACTAGTATATCCCTGTTGATTTG<br>TTTGTGCCTTTATTAACTGCCA |
| 3183 | Table 3A | Hs.77329 | NM_014754 | 7662646 | phosphatidylserine synthase 1 (PTDSS1), mRNA/cds= (102, 1523) | 1 | TCATCTGTGCCATGCTCTAGAACCTT<br>GACCTTGATAGTTCACCACGTCTG |
| 3184 | Table 3A | Hs.76988 | NM_014757 | 13376996 | mastermind (drosophila)-like 1 (MAML1), mRNA/cds = (263, 3313) | 1 | ACTGCCCTTAACTCTGGTATACACCA<br>AAAAGAAATCTTTACTTTCCTTGT |
| 3185 | Table 3A | Hs.75824 | NM_014761 | 7661971 | KIAA0174 gene product (KIAA0174), mRNA/cds = (63, 1157) | 1 | AGGCAGCCTTTCTTTAATGTTTTCAGT<br>TGGTTTGTATTTTGTAGCTCAGT |
| 3186 | Table 3A | Hs.75574 | NM_014763 | 7661911 | mitochondrial ribosomal protein L19 (MRPL19), mRNA/cds = (34, 876) | 1 | CCAGAATGGTCTTTAATGAGCATGGA<br>ACCTGAGCAAAGGGAATAGGTGGG |
| 3187 | Table 3A | Hs.75416 | NM_014764 | 7661885 | DAZ associated protein 2 (DAZAP2), mRNA/cds = (69, 575) | 1 | TCTCTCTCTACACTGTGGTGCACTTA<br>ACTTGTGGAATTTTTATACTAAAA |
| 3188 | Table 3A | Hs.74583 | NM_014767 | 7662035 | KIAA0275 gene product (KIAA0275), mRNA/cds = (316, 1590) | 1 | ACTCAGCCTAAGGAAACAAGTACACT<br>CCACACATGCATAAAGGAAATCAA |
| 3189 | Table 3A | Hs.52528 | NM_014779 | 7662235 | KIAA0669 gene product (KIAA0669), mRNA/cds = (1016, 3358) | 1 | TGTCAAATAAAAGAGAACGAACAGGT<br>AGTTTGGTGGAGCTGAGCTAGTGT |
| 3190 | Table 3A | Hs.28020 | NM_014805 | 7662293 | KIAA0766 gene product (KIAA0766), mRNA/cds = (116, 1939) | 1 | TTTGCATCATGTAGTCATTGAGTGAG<br>GGGGAGATATAAGCCAAGGATTTT |
| 3191 | Table 3A | Hs.23488 | NM_014814 | 7661913 | KIAA0107 gene product (KIAA0107), mRNA/cds = (25, 1194) | 1 | GCTTACTTCACAATGTGCCCAGGTCA<br>GCTGTATAAAATAAATACTGCATT |
| 3192 | Table 3A | Hs.279849 | NM_014819 | 7662123 | KIAA0438 gene product (KIAA0438), | 1 | TGTAATGGTTGGTTTATTGTTCTATAA |

TABLE 8-continued

| SEQ ID | Origin | Unigene | Locus | GI | Nominal Description | Strand | Probe Sequence |
|---|---|---|---|---|---|---|---|
| 3193 | Table 3A | Hs.17969 | NM_014827 | 7662231 | KIAA0663 gene product (KIAA0663), mRNA/cds = (213, 2645) | 1 | CCCCAGCCCATCATTTTCTGTGT AGTCAATGTTTCGTGTTCCGCATTATT TGAACCATTTGCCCTTACAGAAA |
| 3194 | Table 3A | Hs.194035 | NM_014828 | 7662273 | KIAA0737 gene product (KIAA0737), mRNA/cds = (32, 1897) | 1 | AGGGAGCAGTGCTTTTGGGTCCTAG AACCTGTTGAGTTTCTAATGAATAT |
| 3195 | Table 3A | Hs.173802 | NM_014832 | 7662197 | KIAA0603 gene product (KIAA0603), mRNA/cds = (347, 4246) | 1 | AATGACTTGTTATAGCTCAGTGTGCC CTTGAATCCATACAGTTTCTTAAA |
| 3196 | Table 3A | Hs.15087 | NM_014837 | 7662023 | KIAA0250 gene product (KIAA0250), | 1 | TGTTTTGTTTTCTGGGTTTTGTTTTTT GTTTTTGTCTGTGCAAGACCTGC |
| 3197 | Table 3A | Hs.7764 | NM_014851 | 7662139 | KIAA0469 gene product (KIAA0469), mRNA/cds = (184, 1803) | 1 | GGCTTCCATGTCCAGAATCCTGCTTA AGGTTTTAGGGTACCTTCAGTACT |
| 3198 | Table 3A | Hs.6684 | NM_014858 | 7662151 | KIAA0476 gene product (KIAA0476), mRNA/cds = (588, 4728) | 1 | CCTGACCTGTGCAATAAGGATTGTTC CCTGCGAAGTTTTGTTGGATGTAA |
| 3199 | Table 3A | Hs.8338 | NM_014859 | 7662241 | KIAA0672 gene product (KIAA0672), mRNA/cds = (300, 2756) | 1 | GAGTCTGGGGTAAGGGTGGGGGTTG AAAGTTGTTATCTTTAAATACATGT |
| 3200 | Table 3A | Hs.5737 | NM_014864 | 7662149 | KIAA0475 gene product (KIAA0475), mRNA/cds = (336, 1585) | 1 | TTGATCTGCCAAGGATTTCCTCTCAG AGCTGTTGCACAGACAGAGATTGT |
| 3201 | Table 3A | Hs.5094 | NM_014868 | 7662652 | ring finger protein 10 (RNF10), mRNA/cds = (698, 2983) | 1 | GGGGGTTTCCACAATGTGAGGGGGA ACCAAGAAAATTTTAAATACAGTGT |
| 3202 | Table 3A | Hs.273397 | NM_014871 | 7662257 | KIAA0710 gene product (KIAA0710), mRNA/cds = (203, 3550) | 1 | TGCCTGTCCCAAGTTTTGTTCCATTTT TTAAAAATTTGTTGTAAACTGCA |
| 3203 | Table 3A | Hs.3085 | NM_014877 | 7661883 | helicase KIAA0054 (KIAA0054), mRNA/cds = (145, 5973) | 1 | TATTGTTACATATGTTTGCATCAAGCT AGCAGCCAAGAGGTTAATTGTGC |
| 3204 | Table 3A | Hs.1528 | NM_014882 | 7661881 | KIAA0053 gene product (KIAA0053), mRNA/cds = (193, 2109) | 1 | AAACCAGAACAAGCAACAAACTGTAT TTATGCAAGCAAAATTGATGAGAA |
| 3205 | Table 3A | Hs.8170 | NM_014886 | 7662676 | hypothetical protein (YR-29), mRNA/cds = (82, 864) | 1 | TGATGTTTCTGAATACTACCAAACAG CCATACATGTCTGCAATGAAGAGA |
| 3206 | Table 3A | Hs.23518 | NM_014887 | 7656970 | hypothetical protein from BCRA2 region (CG005), mRNA/cds = (165, 1916) | 1 | TATCATCCTCCTTCTCAACCCATCTC CCTAACCCCACATGCTTGCCAGTT |
| 3207 | Table 3A | Hs.239189 | NM_014905 | 7662327 | glutaminase (GLS), mRNA/cds = (19, 2028) | 1 | TTCTGAAATTGGGAAACATTTATTTA AATGCAATCAGGTAGTGTTGCTT |
| 3208 | Table 3A | Hs.131915 | NM_014913 | 7662345 | KIAA0863 protein (KIAA0863), mRNA/cds = (185, 3580) | 1 | GACTGAATTTGACATCTGGTATGCTG GTATGTAGCTCAGACATCAAGAGT |
| 3209 | Table 3A | Hs.110488 | NM_014918 | 7662433 | KIAA0990 protein (KIAA0990), mRNA/cds = (494, 2902) | 1 | TTGTACTTTTCAGAACCATTTTGTCTC ATTATTCCTGTTTTAGCTGAAGA |
| 3210 | Table 3A | Hs.104305 | NM_014922 | 14719827 | death effector filament-forming Cad-4 like apoptosis protein (DEFCAP), transcript variant B, mRNA/cds = (522, 4811) | 1 | CTGGCTGTGTCACAGGGTGAGCCCC AAAATTGGGGTTCAGCGTGGGAGGC |
| 3211 | Table 3A | Hs.211576 | NM_005546 | 5031810 | IL2-inducible T-cell kinase (ITK), mRNA/cds = (2021, 3883) | 1 | AATGGTCCCCTGTGTTTGTAGAGAAC TCCCTTATACAGAGTTTTGGTTCT |
| 3212 | Table 3A | Hs.70266 | NM_014933 | 7662389 | yeast Sec31p homolog (KIAA0905), mRNA/cds = (53, 3715) | 1 | TTCTTTCATGTCCTCCCTACTTCCTCA GTGTCAATCAGATTAAAGTGTGT |
| 3213 | Table 3A | Hs.42959 | NM_014939 | 7662447 | KIAA1012 protein (KIAA1012), mRNA/cds = (57, 4364) | 1 | TTTGAACTTTGGTCATAGAGTCTTCAT ATTTCAGTATTTGGTGGTCCCTA |
| 3214 | Table 3A | Hs.24083 | NM_014950 | 7662437 | KIAA0997 protein (KIAA0997), mRNA/cds = (282, 2196) | 1 | ACCCTAGAGTTACTCTCTTTTGGGAA CATAAGGAGGTATACAGAACTGCA |
| 3215 | Table 3A | Hs.323346 | NM_014953 | 7662443 | KIAA1008 protein (KIAA1008), mRNA/cds = (93, 2879) | 1 | TTGATGTGTCACAAAACATTACTCATT TGATTTCCCCCACCCCCGCCAAC |
| 3216 | Table 3A | Hs.10031 | NM_014959 | 7662403 | KIAA0955 protein (KIAA0955), mRNA/cds = (313, 1608) | 1 | TCAGGGCGTTTGAATGTGAATTAGGA CCAGCGCAATGAATGCTCAAGTTG |
| 3217 | Table 3A | Hs.227133 | NM_014977 | 7662237 | KIAA0670 protein/acinus (KIAA0670), mRNA/cds = (327, 4352) | 1 | AGTTCCCAGTCTCTTCTGTCCTGCAG CCCTTGCCTCTTTCCCACAGGTTC |
| 3218 | Table 3A | Hs.184827 | NM_014999 | 7661921 | KIAA0118 protein (KIAA0118), mRNA/cds = (255, 932) | 1 | GTAGAATCAGGCACTGCTCGCAGAA GGAACACAGATTGTAGAGATTAACA |
| 3219 | Table 3A | Hs.184245 | NM_015001 | 14790189 | SMART/HDAC1 associated repressor protein (SHARP), mRNA/cds = (204, 11198) | 1 | TTTTCTCAGCGCAGTTTTGTTTTGTGT GTCCATTGGATTACAAACTTTAT |
| 3220 | Table 3A | Hs.151411 | NM_015057 | 7662379 | KIAA0916 protein (KIAA0916), mRNA/cds = (146, 14071) | 1 | TGCCTCATTATCTTGCAGCTGTAAAC ATATTGGAATGTACATGTCAATAA |
| 3221 | Table 3A | Hs.132942 | NM_015071 | 7662207 | GTPase regulator associated with the focal adhesion kinase pp125(FAK); KIAA0621 protein (KIAA0621), mRNA/cds = (423, 2667) | 1 | GCCATAGCCTGAATCTTTTAGGGGTA TTAAGGTCAGCCTCTCACTCTTCC |
| 3222 | Table 3A | Hs.306117 | NM_015125 | 11056033 | capicua protein (CIC) mRNA, complete cds/cds = (40, 4866) | 1 | AGCCGCCTTCCAGGCCCGCTATGCA GACATCTTTCCCTCCAAGGTTTGTC |
| 3223 | Table 3A | Hs.79337 | NM_015148 | 8923825 | KIAA0135 protein (KIAA0135), mRNA/cds = (1803, 3791) | 1 | AGCAGCTTTCTTCAAGTCGCTCTTTA GCCCTTTGTGGTTAATCTCTCAGT |
| 3224 | Table 3A | Hs.11000 | NM_015344 | 7662509 | MYO47 protein (MYO47) mRNA/cds = (84, 479) | 1 | TGCACTGATACAACATTACCATTCTTC TATGGAAAGAAAACTTTTGATGA |
| 3225 | Table 3A | Hs.287586 | NM_015384 | 7661841 | cDNA FLJ13648 fis, clone PLACE1011340, weakly similar to IDN3-B mRNA/cds = UNKNOWN | 1 | ATAGAGGAGGAGGCACTTCAGGGGT GAGGCGGAGGAGGAGTCAACGTATT |
| 3226 | Table 3A | Hs.105460 | NM_015393 | 7661631 | DKFZP564O0823 protein (DKFZP564O0823), | 1 | ATACCCACACAGCAACTGGTCCACTG CTTTACTGTCTGTTGGATAATGGC |

TABLE 8-continued

| SEQ ID | Origin | Unigene | Locus | GI | Nominal Description | Strand | Probe Sequence |
|---|---|---|---|---|---|---|---|
| 3227 | Table 3A | Hs.99843 | NM_015400 | 7661691 | DKFZP586N0721 protein (DKFZP586N0721), mRNA/cds = (170, 904) | 1 | AGATTTGTGTCCTCTCATTCCCTCTCT TCCTCTTGTAAGTGCCCTTCTAA |
| 3228 | Table 3A | Hs.75884 | NM_015416 | 7661659 | DKFZP588A011 protein (DKFZP586A011), mRNA/cds = (726, 1151) | 1 | GCACTGTTTTAAACCCAAGTAAAGA CTGCTTGAAACCTGTTGATGGAAA |
| 3229 | Table 3A | Hs.64595 | NM_015423 | 7661649 | aminoadipate-semlaldehyde dehydrogenase-phosphopantetheinyl transferase (AASDHPPT), mRNA/cds = (330, 832) | 1 | AGATTTCCCCTCAGTTTCCATTGACTT AGATCAGGTTACAGAGAAAGGCA |
| 3230 | Table 3A | Hs.48320 | NM_015435 | 13491169 | mRNA for ring-IBR-ring domain containing protein Dorfin, complete cds/cds = (317, 2833) | 1 | AGATCGAGATCTTCAGTCCTCTGCTT CATCTGTGAGCTTGCCTTCAGTCA |
| 3231 | Table 3A | Hs.12305 | NM_015509 | 7661639 | DKFZP566B183 protein (DKFZP566B183), mRNA/cds = (166, 1095) | 1 | AGTGACTAAATACTGGGAACCTATTT TCTCAATCTTCCTCCATGTTGTGT |
| 3232 | Table 3A | Hs.6880 | NM_015530 | 7661569 | DKFZP434D156 protein (DKFZP434D156), mRNA/cds = (351, 749) | 1 | TGGCACTCTGTGGCTCCTTGTAGTAT TATAGCTATACTGGGAAAGCATAG |
| 3233 | Table 3A | Hs.187991 | NM_015626 | 7661595 | DKFZP564A122 protein (DKFZP564A122), mRNA/cds = (230, 1384) | 1 | TTGGTGAGTTGCCAAAGAAGCAATAC AGCATATCTGCTTTTGCCTTCTGT |
| 3234 | Table 3A | Hs.156764 | NM_015646 | 7661677 | RAP1B, member of RAS oncogene family (RAP1B), mRNA/cds = (2570, 2908) | 1 | AATTGACCAACCTAATGTTACAACTA CTTTGAGGTGGCCAAATGTAAACT |
| 3235 | Table 3A | Hs.44563 | NM_015697 | 7661549 | Homo sapiens, Similar to RIKEN cDNA 2310002F18 gene, clone MGC:10413 IMAGE:3954787, mRNA/cds = (148, 702) | 1 | CTACTACGCTGCCCTGGGTGCTGTA GGAGCCCATCTGACTCACCAGAAAT |
| 3236 | Table 3A | Hs.5324 | NM_015702 | 7661547 | hypothetical protein (CL25022), mRNA/cds = (16, 1131) | 1 | AAGGCCTCAGTTTTAATTATTTTCTTC CCAAAATAAATCACACATTTGGT |
| 3237 | Table 3A | Hs.110707 | NM_015726 | 7657147 | H326 (H326), mRNA/cds = (157, 1047) | 1 | GGTGGGGTGATAGGGTGGGCTAAAA ACCATGCACTCTGGAATTTGTTGTA |
| 3238 | Table 3A | Hs.25674 | NM_015832 | 7710144 | methyl-CpG binding domain protein 2 (MBD2), transcript variant testis-specific, mRNA/cds = (176, 1969) | 1 | AGAGGCAGCTTCTAGACAGAGTTGCT TAATGAAAGGGTTTGTAATACTTT |
| 3239 | Table 3A | Hs.278573 | NM_015874 | 7706215 | H-2K binding factor-2 (LOC51580), mRNA/cds = (229, 1137) | 1 | GCTCAGTTCCATATTTCATCCGTGAA AAACTTGCAATACGAGCAGTTTCA |
| 3240 | Table 3A | Hs.104640 | NM_015898 | 7705374 | HIV-1 inducer of short transcripts binding protien (FBI1), mRNA/cds = (238, 1500) | 1 | CAACGGCCAGGAGAAGCACTTTAAG GACGAGGACGAGGACGAGGACGTGG |
| 3241 | Table 3A | Hs.287414 | NM_015906 | 7706235 | transcriptional intermediary factor 1 gamma (TIF1GAMMA), transcript variant alpha, mRNA/cds = (0, 1754) | 1 | ATACAGCCCCGGCAGAAAACGCCTA AAGTCAGATGAGAGACCAGTACATA |
| 3242 | Table 3A | Hs.145956 | NM_015919 | 7706241 | zinc finger protein mRNA, complete cds/cds = (84, 3467) | 1 | ACCAGAAACTTCAAATGTGTCACAAA AGATGAGCAGAACTATCCCGAGGT |
| 3243 | Table 3A | Hs.279813 | NM_015932 | 7705428 | hypothetical protein (HSPC014), mRNA/cds = (1073, 3133) | 1 | AAAGCGAAGTCATGGGAGAGCCACA CTTGATGGTGGAATATAAACTTGGT |
| 3244 | Table 3A | Hs.171774 | NM_015933 | 7705430 | hypothetical protein (HSPC016), mRNA/cds = (82, 507) | 1 | TCCCTGCCATAACATCTTTTGCCACG TATAGCTGGAATTAAGTGTTGTCT |
| 3245 | Table 3A | Hs.119908 | NM_015934 | 7706253 | nucleolar protein NOP5/NOP58 (NOP5/NOP58), mRNA/cds = (38, 232) | 1 | CTGGTGACTCCACACTTCCAACCTGC TCTAAAAAACGCAAAATAGAACAG |
| 3246 | Table 3A | Hs.84038 | NM_015937 | 7706257 | CGI-06 protein (LOC51604), mRNA/cds = (0, 1589) | 1 | TGTGTAGTGGATGGAGTTTACTGTTT GTGGAATAAAAACGGCTGTTTCCG |
| 3247 | Table 3A | Hs.5798 | NM_015946 | 7705599 | pelota (Drosophila) homolog (PELO), mRNA/cds = (6, 1730) | 1 | ACAGGGATTTCTTATGTCTTTGGCTA CACTAGATATTTGTGATTGGCAA |
| 3248 | Table 3A | Hs.7236 | NM_015953 | 7705715 | eNOS interacting protein (LOC51070), mRNA/cds = (259, 1416) | 1 | AGGCCTGAGTGTGTGCGGGAGACCA AATAAACCGGCTTGGGTGCGCAAAA |
| 3249 | Table 3A | Hs.7104 | NM_015995 | 7706289 | mRNA; cDNA DKFZp761P06121 (from clone DKFZp781P06121)/cds = UNKNOWN | 1 | AAGAAAGAAGAGAGGAGAACTTG ATGCCAAGTCCACGAAAAACAA TTTTT |
| 3250 | Table 3A | Hs.6153 | NM_016001 | 7705764 | CGI-48 protein (LOC51096), mRNA/cds = (44, 949) | 1 | GATCCAGCTGTGCTTAAGAGCCAGTA ATGTCTTAATAAACATGTGGCAGC |
| 3251 | Table 3A | Hs.7194 | NM_016007 | 7706297 | CGI-74 protein | 1 | AAGCACTTGTTTTATTTTGTGTGTGGA GTATAAAGGCTACACCCTATTG |
| 3252 | Table 3A | Hs.318725 | NM_016018 | 7705782 | CGI-72 protein (LOC51105), mRNA/cds = (107, 1872) | 1 | CCTTTTCTACAGAATCATCAGGCAT GGGTAAGGTGGCTAACGCTGAGAT |
| 3253 | Table 3A | Hs.110803 | NM_016039 | 7706321 | CGI-99 protein (LOC51637), mRNA/cds = (69, 1400) | 1 | TGGGTATGTTCTAGAGATTTACCACC ATTGCTTATTGCTTTTTTCTTTAA |
| 3254 | Table 3A | Hs.286131 | NM_016041 | 7705603 | CGI-101 protein (LOC51009), mRNA/cds = (161, 895) | 1 | TCTTCTTGATAGATGAGGCCATGGTG TAAATGGAAGTTTCAGAGAGGACA |
| 3255 | Table 3A | Hs.271614 | NM_016049 | 7705615 | CGI-112 protein (LOC51016), mRNA/cds = (6, 635) | 1 | GTGGGTTGGTCCCACTAATGGAAATG GAAATGCCTGAGCCAGGCCAGCGG |
| 3256 | Table 3A | Hs.283670 | NM_016058 | 7706334 | CGI-119 protein (LOC51643), mRNA/cds = (158, 784) | 1 | AATCTATTCCTGCACCTGTTACGGTT TCTGGAAGCAGTTAATAAAAAGTA |

TABLE 8-continued

| SEQ ID | Origin | Unigene | Locus | GI | Nominal Description | Strand | Probe Sequence |
|---|---|---|---|---|---|---|---|
| 3257 | Table 3A | Hs.181271 | NM_016057 | 7708338 | CGI-120 protein (LOC51644), mRNA/cds = (37, 570) | 1 | GCATGGAGTCAGGAGAAAACCACCTT CATAAACTGCTCTGTGCAAAGAGG |
| 3258 | Table 3A | Hs.27693 | NM_016059 | 7706338 | peptidylprolyl isomerase (cyclophilin)-like 1 (PPIL1), mRNA/cds = (227, 727) | 1 | ACAAATGCCCCTGTTTATCAATAGGT GACTACTTACTACACATGGAACCA |
| 3259 | Table 3A | Hs.184542 | NM_016061 | 7706340 | CGI-127 protein (LOC51646), mRNA/cds = (125, 490) | 1 | TGATTATATGCAGATTCCTAGTAGCA TGCCTTACCTACAGCACTATGTGC |
| 3260 | Table 3A | Hs.32826 | NM_016063 | 7705623 | CGI-130 protein (LOC51020), mRNA/cds = (63, 575) | 1 | GGTCATTGAGCCTCAGGTAGGGAATA TATCAACCCGATTTCTTCCTCTCT |
| 3261 | Table 3A | Hs.5887 | NM_016090 | 9994184 | RNA binding motif protein 7 (RBM7), mRNA/cds = (21, 821) | 1 | TTTCAAAGTGCCCAGACTGTGTACAA AGACACATGTAATGGAGATTGTAC |
| 3262 | Table 3A | Hs.119503 | NM_016091 | 7705432 | HSPC025 (HSPC025), mRNA/cds = (33, 1727) | 1 | AGGACCGAAGTGTTTCAAGTGGATCT CAGTAAAGGATCTTTGGAGCCAGA |
| 3263 | Table 3A | Hs.7953 | NM_016099 | 7705820 | HSPC041 protein (LOC51125), mRNA/cds = (141, 455) | 1 | AGTTTCACTGTCAGAGATATTGTAGG TGCTAATACTGGATTTCGTCTCAG |
| 3264 | Table 3A | Hs.27023 | NM_016108 | 7706370 | vesicle transport-related protein (RA410), mRNA/cds = (7, 1929) | 1 | AGTTAGAAGAGCAATATGTTTCCTTC TCTGTAACAGTGTCCTAACAGTGA |
| 3265 | db mining | Hs.306603 | NM_016115 | 7705830 | cDNA FLJ11517 fis, clone HEMBA 1002337/cds = UNKNOWN | 1 | AGCTGCCACTTCCCAGAAGCCTACAT AATTATTTGCTCTATGAAGACGTT |
| 3266 | Table 3A | Hs.142295 | NM_016123 | 7705840 | putative protein kinase NY-REN-64 antigen (LOC51135), mRNA/cds = (49, 1431) | 1 | GCCACTAATAACATTGGGCTAATATC TGCTGTGCTTCTCTGACAGGTAGT |
| 3267 | Table 3A | Hs.279921 | NM_016127 | 7706384 | HSPC035 protein (LOC51669), mRNA/cds = (18, 1035) | 1 | AGCATGCAGTTCTCTGTGAAATCTCA AATATTGTTGTAATAGTCTGTTTC |
| 3268 | Table 3A | Hs.102950 | NM_016128 | 11559928 | coat protein gamma-cop (LOC51137), mRNA/cds = (15, 2639) | 1 | TGAATCTATCCCCCAAGAAACCATCT TATCCCTGTAATAAATCAGCATGT |
| 3269 | Table 3A | Hs.272398 | NM_016135 | 7706730 | transcription factor ets (TEL2), mRNA/cds = (75, 1100) | 1 | GTGCTTCCAGGCGGCACTGACAGCC TCAGTAACAATAAAAACAATGGTAG |
| 3270 | Table 3A | Hs.108969 | NM_016145 | 7706664 | PTD008 protein (PTD008), mRNA/cds = (233, 553) | 1 | GTCCATGTTTCTAGGGGTATTCATTT GCTTTCTCGTTGAAACCTGTTGTT |
| 3271 | Table 3A | Hs.279901 | NM_016146 | 7706666 | PTD009 protein (PTD009), mRNA/cds = (257, 916) | 1 | TAGGTCCATAAATGTTGTAATAAATAT TCCTTTGATCTTGGTGTTTGCGT |
| 3272 | Table 3A | Hs.306706 | NM_016154 | 7706872 | cDNA:FLJ21192 fis, clone COL00107, highly similar to AF165522 ras-related GTP-binding protein 4b (RAB4B) mRNA/cds = UNKNOWN | 1 | GCTAGTACCTGTTATTATTACCTGG AGGCCTGTCCAGCACCCACCCTAC |
| 3273 | Table 3A | Hs.279518 | NM_016160 | 4502146 | amytoid beta (AF) precursor-like protein 2 (APLP2), mRNA/cds = (72, 2363) | 1 | CCCACTATGCACAGATTAAACTTCAC CTACAAACTCCTTAATATGATCTG |
| 3274 | Table 3A | Hs.75251 | NM_016166 | 7706636 | DEAD/H (Asp—Glu—Ala—Asp/His) box binding protein 1 (DDXBP1), mRNA/cds = (96, 2051) | 1 | TGTGCTCTGTTTTACCTTACTCTGTTT AGAAAAGTATACAAGCGTGTTTT |
| 3275 | Table 3A | Hs.241578 | NM_018200 | 7706424 | U6 snRNA-associated Sm-like protein LSm8 (LOC51691), mRNA/cds = (82, 372) | 1 | TGAGTGTGTCTCTGGATTTTGACCCC TTATTGATTCATTGTAATATGTAA |
| 3276 | literature | Hs.135756 | NM_016218 | 7705343 | polymerase (DNA-directed) kappa (POLK), mRNA/cds = (172, 2784) | 1 | ACATTTGTAAGGGCTCTCAAAGATTC ACACATGCCTATATTATCATAAGA |
| 3277 | Table 3A | Hs.7905 | NM_016224 | 7706705 | SH3 and PX domain-containing protein SH3PX1 (SH3PX1), mRNA/cds = (43, 1830) | 1 | TCCGCATCCATTATTTAAACCAGTGG AAATTGTCTCTATTTTTGGAAAGT |
| 3278 | Table 3A | Hs.108636 | NM_016227 | 7705321 | membrane protein CH1 (CH1), mRNA/cds = (124, 4341) | 1 | ACGGAGCTGTAGTGCCATTAGAAACT GTGAATTTCCAAATAAATCTGAAC |
| 3279 | Table 3A | Hs.5741 | NM_016230 | 7705898 | flavohemoprotein b5 + b5R (LOC51167), mRNA/cds = (6, 1469) | 1 | AGCCTTCAGTTTCTTAAATGAAATCAA ATGTTCCTTCAGTACAGGTAACT |
| 3280 | Table 3A | Hs.127561 | NM_016239 | 7705900 | myosin XVA (MYO15A), mRNA/cds = (338, 10930) | 1 | CCAGACCCCCATCACTTGATGGGCC ACACAAGTTTGAGAGTGGTACAAGG |
| 3281 | Table 3A | Hs.250646 | NM_016252 | 10442821 | baculovairl Iap repeat-containing 6 (BIRC6), mRNA/cds = (0, 14489) | 1 | TCAGGTTAAACCCAGCAGCAGCAAAG AACTCCCCAGTGACTTCCAGTTAT |
| 3282 | Table 3A | Hs.107740 | NM_016270 | 7706468 | Kruppel-like factor (LOC51713), mRNA/cds = (84, 1151) | 1 | GGTGGGCATTTTTGGGCTACCTGGTT CGTTTTTATAAGATTTTGCTGGGT |
| 3283 | Table 3A | Hs.8148 | NM_016275 | 7706470 | selenoprotein T (LOC51714), mRNA/cds = (138, 629) | 1 | AGTGCAATAATACTGTATAGCTTTCC CCCACCTCCCACAAAATCACCCAG |
| 3284 | Table 3A | Hs.279588 | NM_018283 | 7706211 | adrenal gland protein AD-004 (LOC51578), mRNA/cds = (341, 859) | 1 | AATCATGTTGCAGAACCAGCAGGTGG ATAGTATATAGGTTTATGCCTGGG |
| 3285 | Table 3A | Hs.6406 | NM_016289 | 7706480 | MO25 protein (LOC51719), mRNA/cds = (53, 1078) | 1 | GGTGCAGCGTGTCAGACACAACATTC ATGTTACTCTTACATTGGAATCTG |
| 3286 | literature | Hs.182366 | NM_016292 | 7706484 | heat shock protein 75 (TRAP1), mRNA/cds = (4, 2118) | 1 | GGACTGACACCACAGATGACAGCCC CACCTCCTTGAGCTTTATTTACCTA |
| 3287 | Table 3A | Hs.14770 | NM_016293 | 7706486 | bridging integrator 2 (BIN2), mRNA/cds = (38, 1735) | 1 | ACGACCCATTTTGCAAGACTTAAAGC CGGAAGAACACATTTTCAGATTGT |
| 3288 | Table 3A | Hs.284164 | NM_016301 | 9994188 | protein x 0004 (LOC51184), mRNA/cds = (31, 885) | 1 | AGGAATTACTGTAACAAAATATGTAT GTCCGAAGGGAAAAAGCTGCAAGG |
| 3289 | Table 3A | Hs.102897 | NM_016302 | 10047097 | CGI-47 protein (LOC51095), mRNA/cds = (131, 1348) | 1 | TCCTGTGGAATCTGATATGTCTGGTA GCATGTCATTGATGGGACATGAAG |
| 3290 | Table 3A | Hs.284162 | NM_016304 | 10047101 | 60S ribosomal protein L30 isolog (LOC51187), mRNA/cds = (143, 634) | 1 | ATGGCACTAGGCAGCATTTGTATAGT AACTAATGGCAAAAATTCATGGCT |
| 3291 | Table 3A | Hs.334811 | NM_016312 | 7706500 | Npw38-binding protien NpwBP | 1 | ATTTGATTAAAATTATTTCCCACTGAC |

TABLE 8-continued

| SEQ ID | Origin | Unigene | Locus | GI | Nominal Description | Strand | Probe Sequence |
|---|---|---|---|---|---|---|---|
| | | | | | (LOC51729), mRNA/cds = (143, 2066) | | CTAAACTTTCAGTGATTTGTGGG |
| 3292 | literature | Hs.110347 | NM_016316 | 7706880 | REV1 (yeast homolog)-like (REV1L), mRNA/cds = (212, 3967) | 1 | AAAGCAAGTGTTTTGTACATTTCTTTT CAAAAAGTGCCAAATTTGTCAGT |
| 3293 | Table 3A | Hs.83761 | NM_016325 | 7706506 | zinc finger protein 274 (ZNF274), mRNA/cds = (401, 2266) | 1 | AATCTGCACTGATATTACATCCACAG TACCACAGTATTTATGTGTATGAA |
| 3294 | Table 3A | Hs.16085 | NM_016334 | 7706703 | putative G-protein coupled receptor (SH120), mRNA/cds = (103, 1470) | 1 | ATGGTAGCTGAGCCAAACACGTAGG ATTTCCGTTTTAAGGTTCACATGGA |
| 3295 | Table 3A | Hs.279918 | NM_016391 | 7705450 | hypothetical protein (HSPC111), mRNA/cds = (62, 598) | 1 | AAGCCAGAACCTGCTGTTTTCAGGGT GGGTGATGTAAATATAGTGTGTAC |
| 3296 | Table 3A | Hs.239720 | NM_016398 | 7705464 | CCR4-NOT transcription complex, subunit 2 (CNOT2), mRNA/cds = (115, 1737) | 1 | TGACAAATTAGAAGAACGGCCTCACC TGCCATCCACCTTCAACTACAACC |
| 3297 | Table 3A | Hs.334788 | NM_016406 | 7705480 | hypothetical protein FLJ14639 (FLJ14639), mRNA/cds = (273, 689) | 1 | TCTTTCTGGTTTCTGGAGATAACCCA TCAATAAAAGCTGCTTCCTCTGGT |
| 3298 | Table 3A | Hs.98289 | NM_016440 | 7705992 | VRK3 for vaccine related kinase 3 (LOC51231), mRNA/cds = (118, 1542) | 1 | GGGACCCCTCCTACCCTTGACTCCTC TGTGCTTTGGTAATAAATTGTTTT |
| 3299 | Table 3A | Hs.3059 | NM_016451 | 7705368 | coatomer protein complex, subunit beta (COPB), mRNA/cds = (178, 3039) | 1 | GTTCTGAATGCTGTCCTCAAAGTATA TAATGTTTCATGTACCAAGACCCT |
| 3300 | Table 3A | Hs.172918 | NM_016466 | 7706006 | hypothetical protein (LOC51239), mRNA/cds = (0, 527) | 1 | GACATCTGCTCCCTCCTCCTGCAACA CAGCCCAGCCCTGAAGGCCATCCG |
| 3301 | Table 3A | Hs.171566 | NM_016468 | 7706010 | hypothetical protein (LOC51241), mRNA/cds = (0, 320) | 1 | TGGGAAGATCCTGACCTCCTCCAAG GAAGAAATCCAGAAAGCCTTAAGAC |
| 3302 | Table 3A | Hs.75798 | NM_016470 | 7705508 | hypothetical protein (HSPC207), mRNA/cds = (0, 620) | 1 | AGCCAGTGATCTCTCTGACTTTCAAT CAGTTTCCAAGCTTAACCAGGGCA |
| 3303 | Table 3A | Hs.55847 | NM_016497 | 7706044 | hypothetical protein (LOC51258), mRNA/cds = (0, 386) | 1 | AAACGCATCCGCTATCTCTACAAACA CTTTAACCGACATGGGAAGTTTCG |
| 3304 | Table 3A | Hs.278429 | NM_016520 | 7706556 | hepatocellular carcinoma-associated antigen 59 (LOC51759), mRNA/cds = (27, 896) | 1 | TCCTCCAGCTGACAGAAAAATCCAGG ATGAGATCAGAAGGATACTGGTGT |
| 3305 | Table 3A | Hs.183125 | NM_016523 | 7705573 | killer cell lectin-like receptor subfamily F, member 1 (KLRF1), mRNA/cds = (64, 759) | 1 | TTCCAGGCTTTTGCTACTCTTCACTC AGCTACAATAAACATCCTGAATGT |
| 3306 | Table 3A | Hs.75425 | NM_016525 | 8394498 | ubiquitin associated protein (UBAP), mRNA/cds = (172, 1680) | 1 | ACACCTAGTCATAGAAATCAGTCTCT CTGGTTTGTTTTGTATTATGTTGT |
| 3307 | Table 3A | Hs.239208 | NM_016533 | 7706622 | ninjurin 2 (NINJ2), mRNA/cds = (56, 484) | 1 | CACTGCTTCCTTCTGCTCCAGGCCTC AATTTTCCCTTCTTGTAAAATGGA |
| 3308 | Table 3A | Hs.10071 | NM_016551 | 7706574 | seven transmembrane protein TM7SF3 (TM7SF3), mRNA/cds = (37, 1749) | 1 | ACTTTCGGAGGGAGTTTATTATTGAG TCTTTATCTGTGACAGTATTTGGA |
| 3309 | Table 3A | Hs.179152 | NM_018582 | 7706092 | toll-like receptor 7 (LOC51264), mRNA/cds = (135, 3284) | 1 | ATAGAGAGGTAATTAAATTGCTGGAG CCAACTATTTCACAACTTCTGTAA |
| 3310 | Table 3A | Hs.18552 | NM_016565 | 7706098 | E2IG2 protein (LOC51287), mRNA/cds = (131, 421) | 1 | GTTCCACCAGTATTTACCAGGAAAAC AAAGAATGTGTTAAGGGATGCTCC |
| 3311 | Table 3A | Hs.267182 | NM_016569 | 7706728 | T-box 3 (ulnar mammary syndrome) (TBX3), mRNA/cds = (116, 1908) | 1 | TGCTATTTCCTATTTTCACCAAAATTG GGGAAGGAGTGCCACTTTCCAGC |
| 3312 | Table 3A | Hs.14896 | NM_016598 | 7706132 | DHHC1 protein (LOC51304), mRNA/cds = (214, 1197) | 1 | TGCTGCCACTTTTCAATTCTGTCAGT GCTTCCACATGGAAACAAAATGCA |
| 3313 | Table 3A | Hs.24125 | NM_016604 | 7706598 | putative zinc finger protein (LOC51780), mRNA/cds = (744, 4997) | 1 | TCACTTTCTGTATTTAATTTTGTTGA AGGGCTGATTGGGATTTCCATGT |
| 3314 | Table 3A | Hs.46847 | NM_016614 | 7705261 | TRAF and TNF receptor-associated protein (AD022), mRNA/cds = (16, 1104) | 1 | GCATGAAGAGACATAGCCTTTTAGTT TTGCTAATTGTGAAATGGAAATGC |
| 3315 | Table 3A | Hs.107139 | NM_016619 | 7706157 | hypothetical protein (LOC51316), mRNA/cds = (101, 448) | 1 | TGTTGTCCCTGAACTTAGCTAAATGG TGCAACTTAGTTTCTCCTTGCTTT |
| 3316 | db mining | Hs.106826 | NM_016621 | 7706159 | cDNA FLJ13196 fis, clone NT2RP3004426, weakly similar to CHROMODOMAIN HELICASE-DNA-BINDING PROTEIN 4/cds = (385, 2289) | | TCATAGTGTCAGTGAGGTCCCGTGAG TCTTTGTGAGTCCTTGTGTCATCG |
| 3317 | Table 3A | Hs.92918 | NM_016623 | 7705303 | hypothetical protien (BM-009), mRNA/cds = (385, 1047) | 1 | GTGCGTAGAATATTACGTATGCATGT TCATGTCTAAAGAATGGCTGTTGA |
| 3318 | Table 3A | Hs.70333 | NM_016628 | 7706169 | mRNA for KIAA1844 protein, partial cds/cds = (0, 1105) | 1 | CGTGGTTGTGGGAGGGGAAAGAGGA AACAGAGCTAGTCAGATGTGAATTG |
| 3319 | Table 3A | Hs.71475 | NM_016630 | 13699804 | acid cluster protein 33 (ACP33), mRNA/cds = (176, 1102) | 1 | GGACATTGGTTATTTTATGCTTTCTTG GATATAACCATGATCAGAGTGCC |
| 3320 | Table 3A | Hs.278027 | NM_016733 | 8051617 | LIM domain kinase 2 (LIMK2), transcript variant 2b, mRNA/cds = (315, 2168) | 1 | GCAAGTGTAGGAGTGGTGGGCCTGA ACTGGGCCATTGATCAGACTAAATA |
| 3321 | literature | Hs.342801 | NM_018734 | 9951919 | paired box gene 5 (B-cell lineage specific activator protein) (PAX5), mRNA/cds = (448, 1623) | 1 | AATCAGAAGAGCCTGGAAAAAG ACCTAGCCCAACTTCCCTTGTGGG AAAC |
| 3322 | Table 3A | Hs.324470 | NM_016824 | 9943847 | adducin 3 (gamma) (ADD3), transcript variant 1, mRNA/cds = (31, 2151) | 1 | TCAACAAAGGGGATTTTGTACACATA ACATGGGTTATTTAGTTTAACTCT |
| 3323 | Table 3A | Hs.77273 | NM_016936 | 9055373 | ras homolog gene family, member A (ARHA), mRNA/cds = (151, 732) | 1 | CTTTTGTGCAGCGACTATGTTGGTGT TAGGGGTGGTGTGGAGATTGTTAA |
| 3324 | Table 3A | Hs.159565 | NM_018952 | 8393083 | surface glycoprotein, Ig superfamily | 1 | ATTTATGCCTTAAATGTTTTCTTCCCC |

TABLE 8-continued

| SEQ ID | Origin | Unigene | Locus | GI | Nominal Description | Strand | Probe Sequence |
|---|---|---|---|---|---|---|---|
| | | | | | member (CDO), mRNA/cds = (0, 3722) | | ATTCCTTCCTCCCCCTCGGTAGG |
| 3325 | Table 3A | Hs.9082 | NM_017426 | 8393857 | nuceloporin p54 (NUP54), mRNA/cds = (25, 1542) | 1 | TTTGTATTTGTGAACTCATCTGTGGG AGGAGTAAAGAAAATCCAAAAGCA |
| 3326 | Table 3A | Hs.83551 | NM_017459 | 9665258 | microfibrillar-associated protein 2 (MFAP2), transcript variant 1, mRNA/cds = (114, 685) | 1 | CCCCCGTGGGCATGGACCACCTTTAT TTTATACAAAATTAAAAACAAGTT |
| 3327 | Table 3A | Hs.85100 | NM_017491 | 9257256 | WD repeat domain 1 (WDR1), transcript variant 1, mRNA/cds = (202, 2022) | 1 | ACTGTAAACTAATCTGTCATTGTTTTT ACCTTCCTTTTCTTTTTCAGTGC |
| 3328 | Table 3A | Hs.139262 | NM_017523 | 8923794 | XIAP associated factor-1 (HSXIAPAF1), mRNA/cds = (0, 953) | 1 | TACTTGCTGTGGTGGTCTTGTGAAAG GTGATGGGTTTTATTCGTTGGGCT |
| 3329 | Table 3A | Hs.119018 | NM_017544 | 8923943 | transcription factor NRF (NRF), mRNA/cds = (653, 1819) | 1 | AAAGAATTAGTGTATGCTTCCTGAAT AAAAAGGAGCCAAAGTTGATCAGA |
| 3330 | Table 3A | Hs.306195 | NM_017601 | 8922168 | over-expressed breast tumor protein (OBTP), mRNA/cds = (0, 224) | 1 | AGGGGGTGATTTTTGCTCTTGTCCTG AGAAATAACAGTGCTGTTTAAAA |
| 3331 | Table 3A | Hs.32922 | NM_017632 | 8923039 | hypothetical protein FLJ20036 (FLJ20036), mRNA/cds = (162, 1904) | 1 | AGCTTAAGGTTTTAAAAATGTTGCCC GTAATGTTGAACGTGTCTGTTAGA |
| 3332 | Table 3A | Hs.246875 | NM_017644 | 8923080 | hypothetical protein FLJ20059 (FLJ20059), mRNA/cds = (25, 1290) | 1 | GGATGCACGTACAGAATACATTCAGC CGTCAGGTAATAACATGAAGCAGT |
| 3333 | Table 3A | Hs.7942 | NM_017657 | 8923087 | hypothetical protein FLJ20080 (FLJ20080), mRNA/cds = (315, 3044) | 1 | GGACAGTTTCTATTGCTTTTCCTTTTT TCCATCCCTTCCCTACCCATCAAA |
| 3334 | Table 3A | Hs.26389 | NM_017748 | 8923268 | hypothetical protein FLJ20287 (FLJ20287), mRNA/cds = (131, 2920) | 1 | AGACTTACATTACTGCTTTAACGTGTA TATCACTGGGCATCCCCAAGGGC |
| 3335 | Table 3A | Hs.8928 | NM_017748 | 8923270 | hypothetical protein FLJ20291 (FLJ20291), mRNA/cds = (117, 1394) | 1 | GTCAGGTTAGGTCAAAGCCAGGGAG TGACAGAATCTGGGAAATCAAACAA |
| 3336 | Table 3A | Hs.7862 | NM_017761 | 8923294 | hypothetical protein FLJ20312 (FLJ20312), mRNA/cds = (133, 552) | 1 | CCTCTTGATGCCTAAGCAGGTAAGCA GATGCCTAAGCTGTATTTCTCCAA |
| 3337 | Table 3A | Hs.126721 | NM_017762 | 8923296 | hypothetical protein FLJ20313 (FLJ20313), mRNA/cds = (344, 1699) | 1 | TGGATCTGTCAAACTAACACTTATGC CTTTAGTCTCATTGTATGAGGTGT |
| 3338 | Table 3A | Hs.306668 | NM_017774 | 8923317 | cDNA FLJ14089 fis, clone MAMMA1000257/cds = UNKNOWN | 1 | ACCTGCCCATCATTGGTCTTTACTAAG TGAAGTGACTTCTTTCTTTAACAA |
| 3339 | Table 3A | Hs.105461 | NM_017780 | 8923329 | hypothetical protein FLJ20357 (FLJ20357), mRNA/cds = (35, 2083) | 1 | GCTGCCAACTGTAGTAATGATGCTTT TAATAAAAGTGACCCATGATATGC |
| 3340 | Table 3A | Hs.6831 | NM_017792 | 8923351 | hypothetical protein FLJ20373 (FLJ20373), mRNA/cds = (268, 849) | 1 | ACTGTTGTCCCCCCACCCTTTTTTCC TTAAATAAAGTAAAAATGACACCC |
| 3341 | Table 3A | Hs.283685 | NM_017801 | 8923369 | hypothetical protein FLJ20396 (FLJ20396), mRNA/cds = (107, 658) | 1 | TGTGAATACTGTGTAGCAGGATCTTG AGAGTCCTTGTTCTTACATAGGCA |
| 3342 | Table 3A | Hs.14220 | NM_017827 | 8923420 | hypothetical protein FLJ20450 (FLJ20450), mRNA/cds = (27, 1583) | 1 | AAGAGGCTTCCATCCCTCCTTCCTTC TTTCCTCCTACAGTGCTGAGCAAA |
| 3343 | Table 3A | Hs.132071 | NM_017830 | 8923426 | ovarian carcinoma immunoreactive antigen (OCIA), mRNA/cds = (167, 904) | 1 | GTTGAATTGGGGTGGATGGGGGGAG CAAGCATAATTTTTAAGTGTGAAGC |
| 3344 | Table 3A | Hs.5811 | NM_017835 | 8923436 | chromosome 21 open reading frame 59 (C21ORF59), mRNA/cds = (360, 776) | 1 | TCACCAGCTGATGACACTTCCAAAGA GATTAGCTCACCTTTCTCCTAGGC |
| 3345 | Table 3A | Hs.5080 | NM_017840 | 8923447 | mitochondrial ribosomal protein L16 (MRPL16), mRNA/cds = (111, 866) | 1 | CCCACTGAAGTCTTTGGGTAGCTCTT AAGCCATAACTAAGGAGCAGCATT |
| 3346 | Table 3A | Hs.39850 | NM_017859 | 8923486 | hypothetical protein FLJ20517 (FLJ20517), mRNA/cds = (44, 1690) | 1 | AGTGACGAGGAGGAAGTGGCCTACA CGGGTTAGCTGCCCAGTGAGCCATC |
| 3347 | Table 3A | Hs.44344 | NM_017867 | 8923502 | hypothetical protein FLJ20534 (FLJ20534), mRNA/cds = (20, 1060) | 1 | AACAGAAGTCAAGAGAACATAG ACCAACTTGCTGCATGAGTAAGGT GGCT |
| 3348 | Table 3A | Hs.107213 | NM_017892 | 8923548 | hypothetical protein FLJ20585 (FLJ20585), mRNA/cds = (99, 746) | 1 | TTTTCCCTGCTATTGAGGAAGTATTTT GCCTTCCCTACTCACTGAGAAGT |
| 3349 | Table 3A | Hs.55781 | NM_017897 | 8923558 | hypothetical protein FLJ20604 (FLJ20604), mRNA/cds = (99, 1476) | 1 | CGGAACCAGAATTTGATCTCAACTAT GTTCCACTAAAGGCACAGGAATGG |
| 3350 | Table 3A | Hs.18791 | NM_017899 | 8923562 | hypothetical protein FLJ20607 (FLJ20607), mRNA/cds = (48, 698) | 1 | CGCACCTTGTGTCTTGTAGGGTATGG TATGTGGGACTTCGCTGTTTTTAT |
| 3351 | Table 3A | Hs.52184 | NM_017903 | 8923570 | hypothetical protein FLJ20618 (FLJ20618), mRNA/cds = (318, 725) | 1 | AGCAGTTATATTGCCCCTTGGTTTTA TTCAGTTTAACTACTGTTTCCAA |
| 3352 | Table 3A | Hs.49376 | NM_017917 | 8923599 | hypothetical protein FLJ20644 (FLJ20644), mRNA/cds = (276, 1637) | 1 | AGCAAAATCCTCAGAAATGGTCTAAA TAAAACACTTGATATGCCTAGAGA |
| 3353 | Table 3A | Hs.234149 | NM_017918 | 8923601 | hypothetical protein FLJ20647 (FLJ20647), mRNA/cds = (90, 838) | 1 | TGATTTTGCAACTTAGGATGTTTTTGA GTCCCATGGTTCATTTTGATTGT |
| 3354 | Table 3A | Hs.180201 | NM_017924 | 8923614 | hypothetical protein FLJ20671 (FLJ20671), mRNA/cds = (72, 494) | 1 | TTACCTGGATTCCATTGGCTGGTTTT ACCACTCCTATCAGATTGTAGTGT |
| 3355 | Table 3A | Hs.48712 | NM_017948 | 8923662 | hypothetical protein FLJ20736 (FLJ20736), mRNA/cds = (130, 1851) | 1 | CTCTTTGCCCTCTATCCTGAGTAACT AATGGACATCTTCTCATGCAAGGT |
| 3356 | Table 3A | Hs.279937 | NM_014980 | 7662439 | KIAA1001 protein (KIAA1001), mRNA/cds = (458, 2035) | 1 | GCCACAGAATGGTCACCCAGCTTATT TAGGTGTAGACAAGTATGACACAG |
| 3357 | Table 3A | Hs.280978 | NM_018114 | 8922464 | hypothetical protein FLJ10496 (FLJ10498), mRNA/cds = (13, 429) | 1 | GCCACAGAGGCTCCAATACCTGGGA ATGTTCACAAAGTCATCAACTGGAA |
| 3358 | Table 3A | Hs.55024 | NM_018053 | 8922341 | hypothetical protein FLJ10307 (FLJ10307), mRNA/cds = (28, 462) | 1 | AGAATGTGTGTGCCTGTGGGTCTCTA CAAGTGACAGATGTGTTGTTTTCA |
| 3359 | Table 3A | Hs.100895 | NM_018099 | 8922433 | hypothetical protein FLJ10462 (FLJ10462), mRNA/cds = (147, 1694) | 1 | TCCAAATTGTTTCCTAACATTCTATTT TATGCCTTTGCGTATTAAACGTG |
| 3360 | Table 3A | Hs.4997 | NM_018107 | 8922449 | hypothetical protein FLJ10482 | 1 | GCCTCTACTGTGGCCTCAACCCTGG |

TABLE 8-continued

| SEQ ID | Origin | Unigene | Locus | GI | Nominal Description | Strand | Probe Sequence |
|---|---|---|---|---|---|---|---|
| | | | | | (FLJ10482), mRNA/cds = (149, 1369) | | CAATTATAGCTACTCCCATCCCTTA |
| 3361 | Table 3A | Hs.236844 | NM_018169 | 8922572 | hypothetical protein FLJ10652 (FLJ10652), mRNA/cds = (50, 1141) | 1 | AACTGAACACAATTTTGGGACAACGT TTAAACATTACTTTTCATACTTGA |
| 3362 | Table 3A | Hs.66048 | NM_018174 | 8922582 | chromosome 19 open reading frame 5 (c19orf5), mRNA/cds = (175, 2193) | 1 | CTGAGCCCAGCCCGCCTGTCCCTAG ATTCAGCCACCATCAGAAATAAACTG |
| 3363 | Table 3A | Hs.8083 | NM_018210 | 8922653 | hypothetical protein FLJ10769 (FLJ10769), mRNA/cds = (14, 1186) | 1 | ACTGTGCCATGGACATTTTTCCTCTG GGGAATTAACATCTAAATTCTGGT |
| 3364 | Table 3A | Hs.59838 | NM_018227 | 8922683 | hypothetical protein FLJ10808 (FLJ10808), mRNA/cds = (180, 1559) | 1 | ACAACGCTCTTAGAGAATCCGTGAAT GTGAACAGACAAATGTGGCTAACC |
| 3365 | Table 3A | Hs.18851 | NM_018253 | 8922730 | hypothetical protein FLJ10875 (FLJ10875), mRNA/cds = (100, 2037) | 1 | TAGGAGAATAAGAGTCTGGAGACTG GGAGCCTTCACTTCGGCCTCCGATT |
| 3366 | Table 3A | Hs.8739 | NM_018255 | 8922734 | hypothetical protein FLJ10879 (FLJ10879), mRNA/cds = (10, 2490) | 1 | TGCTGAGTGGTTACACTTTGCAAGCT GTGGTGAAGATCACACTGTGAAGA |
| 3367 | Table 3A | Hs.143954 | NM_018270 | 8922763 | hypothetical protein FLJ10914 (FLJ10914), mRNA/cds = (71, 685) | 1 | CCCAGTGCTGATGGAGATGCCACTTT CGTGTGACTGCGAACATTAAAGCA |
| 3368 | Table 3A | Hs.6118 | NM_018285 | 8922793 | mitochondrial ribosomal protein S4 (MRPS4), mRNA/cds = (47, 601) | 1 | TGTTCAGGATCTCCTCCCTTGTTTAA ATGTCAATAAATGCCCCAACTGCT |
| 3369 | Table 3A | Hs.302981 | NM_018295 | 8922813 | hypothetical protein FLJ11000 (FLJ11000), mRNA/cds = (223, 780) | 1 | TTATTCATATATTCCTGTCCAAAGCCA CACTGAAAACAGAGGCAGAGACA |
| 3370 | Table 3A | Hs.30822 | NM_018326 | 8922872 | hypothetical protein FLJ11110 (FLJ11110), mRNA/cds = (44, 1033) | 1 | AGGTCATCCACACACTTCTGCCCCCA CTGCATTGAATTTTTTGCTTATGT |
| 3371 | Table 3A | Hs.105216 | NM_018331 | 8922883 | hypothetical protein FLJ11125 (FLJ11125), mRNA/cds = (203, 712) | 1 | TTTTCGTTCTCCTCCTACCCCAGATC TCTACAAGGACATTGCCCCTAAGC |
| 3372 | Table 3A | Hs.8033 | NM_018346 | 8922910 | hypothetical protein FLJ11164 (FLJ11164), mRNA/cds = (58, 1384) | 1 | GTGTTTGTAATTCTTCTTTGTCCTTTT ACCTACAGAAATGGTCACATGGT |
| 3373 | Table 3A | Hs.184465 | NM_018370 | 8922957 | hypothetical protein FLJ11259 (FLJ11259), mRNA/cds = (87, 485) | 1 | AGGATGTTTGTAGTGCTATAATATAG AATGGGATTTACTCTGCTTTACCA |
| 3374 | Table 3A | Hs.11260 | NM_018371 | 8922959 | hypothetical protein FLJ11264 (FLJ11264), mRNA/cds = (362, 1189) | 1 | AGCTAATTATCTCTTTGAGTCCTTGCT TCTGTTTGCTCACAGTAAGCTCA |
| 3375 | Table 3A | Hs.26194 | NM_018384 | 8922984 | hypothetical protein FLJ11296 (FLJ11296), mRNA/cds = (303, 1226) | 1 | TCCTACTTATTTAAGCTATTTGAGCTC CGGGTCTCTTCTACCTGCATTCT |
| 3376 | literature | Hs.266514 | NM_018394 | 8923000 | hypothetical protein FLJ11342 (FLJ11342), mRNA/cds = (10, 930) | 1 | AGTGATTGCCACCTAAATCAGAAGAC GTTCTAAAGTCAGTAAGAAAGTGT |
| 3377 | Table 3A | Hs.183856 | NM_018399 | 9055235 | VNN3 protein (HSA238982), mRNA/cds = (45, 1550) | 1 | CACGCTTAGGGCAGGGATCTGGGAA ATTCCAGTGATCTCCTTAGCAGAG |
| 3378 | Table 3A | Hs.123090 | NM_018450 | 8922086 | BRG1-Associated Factor 250a (BAF250a) mRNA, complete cds/cds = (378, 7235) | 1 | TTTCTAATCGAGGTGTGAAAAAGTTC TAGGTTCAGTTGAAGTTCTGATGA |
| 3379 | Table 3A | Hs.7731 | NM_018453 | 8922092 | uncharacterized bone marrow protein BM036 (BM036), mRNA/cds = (95, 796) | 1 | TCATTCTGTTTTTGATGAACATTTGGA AACTGTCGGGCTTTTTATTAAAG |
| 3380 | Table 3A | Hs.6375 | NM_018471 | 8923807 | uncharacterized hypothalamus protein HT010 (HT010), mRNA/cds = (226, 1419) | 1 | CAATGCCCTGTGTTAAATTGTTTAAAA GTTTCCCTTTTCTTTTTTGCCAA |
| 3381 | Table 3A | Hs.334370 | NM_018476 | 8923715 | brain expressed, X-linked 1 (BEX1), mRNA/cds = (171, 548) | 1 | ACCTATTGCATGGAAAGATGCTCATT ATAGTGAAGTTAATAAAGCACCTT |
| 3382 | Table 3A | Hs.274369 | NM_018477 | 8923711 | uncharacterized hypothalamus protein HARP11 (HARP11), mRNA/cds = (80, 1333) | 1 | AGAGGACTATAGTGGAAGTGAAAGCA TTCTGTGTTTACTCTTTGCATTAA |
| 3383 | db mining | Hs.10669 | NM_018482 | 8923867 | mRNA for KIAA1249 protein, partial cds/cds = (0, 2850) | 1 | TGAATTGCACTGTGAAAAGCACTCTT CCCTCTCAGTTTTCGTTCATCCTG |
| 3384 | Table 3A | Hs.102652 | NM_018489 | 8922080 | hypothetical protein ASH1 (ASH1), mRNA/cds = (309, 9218) | 1 | CCATGGGGTCAGAAGGGCACGGTAG TTCTTGCAATTATTTTTGTTTTACC |
| 3385 | Table 3A | Hs.160271 | NM_018490 | 8923700 | G protein-coupled receptor 48 (GPR48), mRNA/cds = (444, 3299) | 1 | AATGTGGGAAGGATTTATTTACAGTG TGTTGTAATTTTGTAAGGCCAACT |
| 3386 | Table 3A | Hs.7535 | NM_018491 | 13236498 | COBW-like protein (LOC55871), mRNA/cds = (64, 1251) | 1 | AGCTACTGTGACAGAAACAGAA AAGCAGTGGACAACACGTTTCCAA GAAG |
| 3387 | Table 3A | Hs.104741 | NM_018492 | 8923876 | PDZ-binding kinase; T-cell originated protein kinase (TOPK), mRNA/cds = (154, 1122) | 1 | TGCTCATGCTGACTTAAAACACTAGC AGTAAAACGCTGTAAACTGTAACA |
| 3388 | Table 3A | Hs.283330 | NM_018507 | 8924082 | hypothetical protein PRO1843 (PRO1843), mRNA/cds = (964, 1254) | 1 | TCCAATGCAGTCCCATTCTTTATGGC CTATAGTCTCACTCCCAACTACCC |
| 3389 | Table 3A | Hs.186874 | NM_018519 | 8924144 | hypothetical protein PRO2266 (PRO2266), mRNA/cds = (258, 826) | 1 | GGTGTCTGACTTAATGACTCCTGCTG AAGTTGAATTGTGAGATGTTATCC |
| 3390 | Table 3A | Hs.343477 | AF119911 | 7770258 | PRO2975 mRNA, complete cds/cds = UNKNOWN | 1 | CATTTGTCTGGAAATGCTGCCGGGAG CCTATTGTGTAAATGTAGGTATTT |
| 3391 | Table 3A | Hs.147644 | NM_018555 | 10092612 | zinc finger protein 331:zinc finger protein 463 (ZNF381), mRNA/cds = (376, 1767) | 1 | GCGGGAAGGCATGTAACCACCTAAA CCATCTCCGAGAACATAGAGGATC |
| 3392 | Table 3A | Hs.300496 | NM_018579 | 8924027 | mitochondria solute carrier protein (MSCP) mRNA, complete cds, alternatively spliced/cds = (44, 511) | 1 | CAGGTCAACCCCCACCGGACCTACA ACCCGCAGTCCCACATCATCTCAGG |
| 3393 | Table 3A | Hs.300496 | NM_018579 | 6924027 | mitochondria solute carrier protein (MSCP) mRNA, complete cds, alternatively spliced/cds = (44, 511) | 1 | CAGGTCAACCCCCACCGGACCTACA ACCCGCAGTCCCACATCATCTCAGG |

TABLE 8-continued

| SEQ ID | Origin | Unigene | Locus | GI | Nominal Description | Strand | Probe Sequence |
|---|---|---|---|---|---|---|---|
| 3394 | Table 3A | Hs.52881 | NM_018807 | 13699664 | hypothetical protein PRO1853) (PRO1653), mRNA/cds = (472, 771) | 1 | TTTAGGGTTGTGACTGGCTTTGGTGC AAATGTGTGCTCAAGCTAATAAGT |
| 3395 | Table 3A | Hs.103657 | NM_018823 | 8924137 | PRO2219 mRNA, complete cds/cds = (823, 1056) | 1 | ACTTGTGTTTTGTTTGGGGGCTGGGA AATGTATTTTTACATTGTAGCCAA |
| 3396 | Table 3A | Hs.241576 | NM_018630 | 8924181 | hypothetical protein PRO2577 (PRO2577), mRNA/cds = (491, 664) | 1 | AACATTGTGCTCTAACAGTATGACTA TTCTTTCCCCCACTCTTAAACAGT |
| 3397 | Table 3A | Hs.283022 | NM_018643 | 8924261 | triggering receptor expressed on myeloid cells 1 (TREM1), mRNA/cds = (47, 751) | 1 | CCAAGGGAGGAGGGAGGAGGTAAAA GGCAGGGAGTTAATAACATGAATTA |
| 3398 | Table 3A | Hs.14317 | NM_018646 | 8923941 | nucleolar protein family A, member 3 (H/ACA small nucleolar RNPs) (NOLA3), mRNA/cds = (97, 291) | 1 | TACTCTTTGGCATCCAGTCTCTCGTG GCGATTGATTATGCTTGTGTGAGG |
| 3399 | Table 3A | Hs.195292 | NM_018666 | 8924241 | putative tumor antigen (SAGE), mRNA/cds = (167, 2881) | 1 | CCTTCCAGAAGCTACGAAAAAGGGA GCTGTTTAAATTTAATAAATCTCTG |
| 3400 | Table 3A | Hs.8117 | NM_018695 | 8923908 | erbb2-interacting protein ERBIN (ERBB2IP), mRNA/cds = (323, 4438) | 1 | AAGTGCCATAGAAGACCAATAACTGT TTAGTTGAGGCTAGTCTGGAACCT |
| 3401 | Table 3A | Hs.78825 | NM_018834 | 10047081 | matrin 3 (MATR3), mRNA/cds = (254, 2800) | 1 | TGGATTCAAGTTACTGAAGTGAATAC CAATAAAAAGAAAACCCTAGGCCA |
| 3402 | Table 3A | Hs.44163 | NM_018838 | 10092656 | 13kDa differentiation-associated protein (LOC55967), mRNA/cds = (53, 490) | 1 | AGGAGTGGATCCCACCTTCAACACCT TACAAGTAAAGACAATGAAGAACA |
| 3403 | Table 3A | Hs.183842 | NM_018955 | 11024713 | ubiquitin B (UBB), mRNA/cds = (94, 783) | 1 | CAGTAATAGCTGAACCTGTTCAAAAT GTTAATAAAGGTTTCGTTGCATGG |
| 3404 | db mining | Hs.44234 | NM_018965 | 9507202 | triggering receptor expressed on myeloid cells 2 (TREM2), mRNA/cds = (94, 786) | 1 | AGGGAGTGGGGAGGTGGTAAGAACA CCTGACAACTTCTGAATATTGGACA |
| 3405 | Table 3A | Hs.274428 | NM_018975 | 9507032 | TRF2-interacting talomeric RAP1 protein (RAP1), mRNA/cds = (136, 1034) | 1 | AAAATTAGTGGATTGACTCCACTTTG TTGTGTTGTTTTCATTGTTGAAAA |
| 3406 | Table 3A | Hs.61053 | NM_018986 | 9506676 | hypothetical protein (FLJ20356), mRNA/cds = (91, 3285) | 1 | AATGGAGGCACGAACGCAGGGGCCA AATAGCAATAAATGGGTTTTGTTTT |
| 3407 | Table 3A | Hs.80618 | NM_018996 | 9506648 | hypothetical protein (FLJ20015), mRNA/cds = (31, 522) | 1 | TGTTTTGATTGTTTTGCAAGGAAGAA AGACAATGGAATAACATACCTTCA |
| 3408 | Table 3A | Hs.83954 | NM_019006 | 9506852 | protein associated with PRK1 (AWP1), mRNA/cds = (244, 804) | 1 | TCATTGCTGTCTACAGGTTTCTTTCA GATTATGTTCATGGGTTTGTGTGT |
| 3409 | Table 3A | Hs.98324 | NM_019044 | 9506632 | hypothetical protein (FLJ10996), mRNA/cds = (135, 857) | 1 | GAAAACAGACCTTGTGCTGAGGACAC GTCAATAAAAATTATACCTTCCCC |
| 3410 | db mining | Hs.110746 | NM_019052 | 9506772 | HCR (a-helix coiled-coil rod) homologue) (HCR), mRNA/cds = (79, 2427) | 1 | GGGATACCAGCTGAGTCTGAATTCTG CTCTAAATAAAGACGACTACAGAG |
| 3411 | Table 3A | Hs.274248 | NM_019059 | 9506858 | hypothetical protein FLJ20758 (FLJ20758), mRNA/cds = (464, 1306) | 1 | TGGCTCGGATAAGAGATGGGACATC ATTCAGTCACTAGTTGGATGGCACA |
| 3412 | Table 3A | Hs.124835 | NM_019062 | 9506662 | hypothetical protein (FLJ20225), mRNA/cds = (177, 860) | 1 | AACTTGATGAAAGTATTGCAGTATTG ATGCCATTGTAGAATAGAACTGGA |
| 3413 | Table 3A | Hs.30909 | NM_019081 | 11464998 | KIAA0430 gene product (KIAA0430), mRNA/cds = (0, 3599) | 1 | TTTGTGTGTTGGGACCAAACAGTTGT CAATAAACTTTACAAGCGAGCATC |
| 3414 | Table 3A | Hs.76807 | NM_019111 | 9506780 | major histocompatibility complex, class II, DR alpha (HLA-DRA), mRNA/cds = (26, 790) | 1 | CATGGGGCTCTCTTGTGTACTTATTG TTTAAGGTTTCCTCAAACTGTGAT |
| 3415 | Table 3A | Hs.25951 | NM_019555 | 9506400 | Rho guanine nucleotide exchange factor (GEF) 3 (ARHGEF3), mRNA/cds = (127, 1707) | 1 | AGGTGGTCAATGAATGTTTTGATGAA ATGAATGTTTTTGTATAATGGCCT |
| 3416 | Table 3A | Hs.278857 | NM_019597 | 14141155 | heterogeneous nuclear ribonucleoprotein H2 (H') (HNRPH2), mRNA/cds = (78, 1427) | 1 | ACGGGACAATTTAAGATGTAATACC AATACTTTAGAAGTTTGGTCGTGT |
| 3417 | Table 3A | Hs.159523 | NM_019604 | 9624976 | class-I MHC-restricted T cell associated molecule (CRTAM), mRNA/cds = (0, 1181) | 1 | ACAGCAAACTTTGGCATTTATGTGGA GCATTTCTCATTGTTGGAATCTGA |
| 3418 | Table 3A | Hs.159523 | NM_019604 | 9624976 | class-I MHC-restricted T cell associated molecule (CRTAM), mRNA/cds = (0, 1181) | 1 | ACAGCAAACTTTGGCATTTATGTGGA GCATTTCTCATTGTTGGAATCTGA |
| 3419 | Table 3A | Hs.324743 | NM_019853 | 9790172 | protein phosphatase 4 regulatory subunit 2 (PPP4R2), mRNA/cds = (417, 1778) | 1 | ACTTTTATGTAAAAAAGTGCACCTTTA GTTTTACAAGTAAAGCAGGTTGT |
| 3420 | Table 3A | NA | NM_019997 | 9910435 | Mus musculus cDNA sequence AB041581 (AB041581), mRNA. | 1 | TCTTAATAATAATGAAGACGACTTACC CTGTGGAATTGAACACACTGGTG |
| 3421 | Table 3A | Hs.5392 | NM_020122 | 10047127 | potassium channel modulatory factor (DKFZP434L1021), mRNA/cds = (53, 1198) | 1 | GCTGCTGTGTGTATTTATGAATATTAA TGAATAAAAACTGCTTGGATGGT |
| 3422 | Table 3A | Hs.8203 | NM_020123 | 10047129 | endomembrane protein emp70 precursor isolog (LOC56889), mRNA/cds = (19, 1779) | 1 | ACCGTGTAAAGTGGGGATGGGGTAA AAGTGGTTAACGTACTGTTGGATCA |
| 3423 | Table 3A | Hs.236628 | NM_020135 | 9910349 | putative helicase RUVBL (LOC56897), mRNA/cds = (238, 1575) | 1 | TAAATTTATTTATTTATGAAAAAACT CGTGCCGAATTCTTGGCCTCGAG |
| 3424 | Table 3A | Hs.110796 | NM_020150 | 9910541 | GTP-binding protein SAR1 (SAR1) mRNA, complete cds/cds = (124, 720) | 1 | GGGTTTCCGCTGGCTCTCCCAGTATA TTGACTGATGTTTGGACGGTGAAA |

TABLE 8-continued

| SEQ ID | Origin | Unigene | Locus | GI | Nominal Description | Strand | Probe Sequence |
|---|---|---|---|---|---|---|---|
| 3425 | Table 3A | Hs.334775 | NM_020151 | 9910251 | Homo sapiens, Similar to RIKEN cDNA 1200014H14 gene, clone IMAGE:3139657, mRNA partial cds/cds = (0, 523) | 1 | GTACAGTTACTCATGTCATTGTAATG ATTTCACTCCTAACTGTGACATTT |
| 3426 | literature | Hs.21320 | NM_020165 | 14550404 | postreplication repair protein hRAD18p (RAD18), mRNA/cds = (77, 1564) | 1 | ACTGAGTTGTCAGAAATTATGTCAAA ATGAAAACTGTTTGTTTCATGACA |
| 3427 | Table 3A | Hs.6879 | NM_020188 | 9910183 | DC13 protein (DC13), mRNA/cds = (175, 414) | 1 | ACCTGACTTCACCATGTTTATTCCCTT TGCCTACAACCAGTTAATATCTG |
| 3428 | Table 3A | Hs.7045 | NM_020194 | 9910247 | GL004 protein (GL004), mRNA/cds = (72, 726) | 1 | TCATGCGTGAACAATTTAAAAAACGA CAGAATAAGGTACAAATGTAGTGT |
| 3429 | literature | Hs.9822 | NM_020196 | 9910259 | HCNP protein; XPA-binding protein 2 (HCNP), | 1 | CCCATCCCCCCTCCCCACCCCCATC CCCAATACAGCTACGTTTGTACATC |
| 3430 | Table 3A | Hs.283611 | NM_020217 | 9910199 | hypothetical protein DKFZp5471014 (DKFZp5471014), mRNA/cds = (1774, 2166) | 1 | CCAACAAAATTGGGATCATCCAAACT GAGTCCATCTGGCTAATTCTAAAT |
| 3431 | Table 3A | Hs.79457 | NM_017860 | 8923488 | hypothetical protein FLJ20519 (FLJ20519), mRNA/cds = (74, 604) | 1 | TGACTGGAACTGAGAGTAAATTGGGA ATGTATGACCAATCTTAGACCCTG |
| 3432 | Table 3A | Hs.4859 | NM_020307 | 9945319 | cyclin L ania-6a (LOC57018), mRNA/cds = (54, 1834) | 1 | TGTTTAAATGATGGTGAATACTTTCTT AACACTGGTTTGTCTGCATGTGT |
| 3433 | Table 3A | Hs.283728 | NM_020357 | 9966826 | PEST-containing nuclear protein (pcnp), mRNA/cds = (18, 554) | 1 | ACCTAAGGTCAAGCTGGGAGAGAGA AATGACTGAGATGAATGTCTTTACT |
| 3434 | Table 3A | Hs.322901 | NM_020368 | 9968798 | disrupter of silencing 10 (SAS10), mRNA/cds = (161, 1600) | 1 | GCTTAGGGAAATTTCACAGTTCATTG TGGAGTGTTAAACTTAGAACATGT |
| 3435 | Table 3A | Hs.111988 | NM_020382 | 9966854 | PR/SET domain containing protein 07 (SET07), mRNA/cds = (150, 1331) | 1 | TGTTACAGGTTTCCAAGGTGGACTTG AACAGATGGCCTTATATTACCAAA |
| 3436 | Table 3A | Hs.12450 | NM_020403 | 14589940 | protocadherin 9 (PCDH9), mRNA/cds = (118, 3729) | 1 | TGTTACTGCTTTGCCAGTTCTACGTT ATTTACAATTATTCAGCTCTTGCA |
| 3437 | Table 3A | Hs.286233 | NM_020414 | 14251213 | sperm autoantigenic protein 17 (SPA17), mRNA/cds = (1210, 1665) | 1 | TTTCTGTATTGCAGTGTTTATAGGCTT CTTGTGTGTTAAACTTGATTTCA |
| 3438 | Table 3A | Hs.287369 | NM_020525 | 10092624 | interleukin 22 (IL22), mRNA/cds = (71, 610) | 1 | AACTAACCCCCTTTCCCTGCTAGAAA TAACAATTAGATGCCCCAAAGCGA |
| 3439 | Table 3A | Hs.81328 | NM_020529 | 10092618 | nuclear factor of kappa light polypeptide gene enhancer in B-cells inhibitor, alpha (NFKBIA), mRNA/cds = (94, 1047) | 1 | GTTTGTGTTACCCTCCTGTAAATGGT GTACATAATGTATTGTTGGTAATT |
| 3440 | Table 3A | Hs.78888 | NM_020548 | 10140852 | diazepam binding inhibitor (GABA receptor modulator, acyl-Coenzyme A binding protein) (DBI), mRNA/cds = (0, 314) | 1 | GCTCACCATACGGCTCTAACAGATTA GGGGCTAAAACGATTACTGACTTT |
| 3441 | literature | Hs.247302 | NM_020648 | 10190663 | twisted gastrulation (TSG), mRNA/cds = (13, 684) | 1 | CGGCTGATGGGACAGGAATTGAAGA AGAGAATTGACTCGTATGAACAGGA |
| 3442 | literature | Hs.149342 | NM_020661 | 10190699 | activation-induced cytidine deaminase (AICDA), mRNA/cds = (76, 672) | 1 | TGGTGCTACGAAGCCATTTCTCTTGA TTTTTAGTAAACTTTTATGACAGC |
| 3443 | Table 3A | Hs.295231 | NM_020666 | 10190705 | CLK4 mRNA, complete cds/cds = (153, 1514) | 1 | TGAGAAACTGTTTGACCTGGTTCGAA GAATGTTAGAATATGATCCAACTC |
| 3444 | Table 3A | Hs.105052 | NM_020979 | 10280625 | adaptor protein with pleckstrin homology and src homology 2 domains (APS), mRNA/cds = (127, 2025) | 1 | GGTGGGACACGCCAAGCTCTTCAGT GAAGACACGATGTTATTAAAAGCCT |
| 3445 | Table 3A | Hs.104624 | NM_020980 | 11038852 | aquaporin 9 (AQP9), mRNA/cds = (286, 1173) | 1 | TGCTTTGAAGCTACCTGGATATTTCC TATTTGAAATAAAATTGTTCGGTC |
| 3446 | Table 3A | Hs.211563 | NM_020993 | 10337612 | B-cell CLL/lymphoma 7A (BCL7A), mRNA/cds = (953, 1648) | 1 | ATCGCCAAGAACCTGGTTAGAGGCAT AAAGACCTTTTTTCACCGTTACCT |
| 3447 | Table 3A | Hs.6574 | NM_021008 | 10337616 | suppressin (nuclear deformed) epidermal autoregulatory factor-1 (DEAF-1)-related) (SPN), mRNA/cds = (356, 2011) | 1 | TGCTGCGACGCACATACATACGTGTT GTGTCTGTCAATAAAGTGTAAATA |
| 3448 | Table 3A | Hs.178391 | NM_021029 | 10445222 | ribosomal protein L44 (RPL44), mRNA/cds = (37, 357) | 1 | TGGGAGGAGATAAGAAGAGAAAGGG CCAAGTGATCCAGTTCTAAGTGTCA |
| 3449 | Table 3A | Hs.28578 | NM_021038 | 10518339 | muscleblind (Drosophila)-like (MBNL), mRNA/cds = (1414, 2526) | 1 | TGCAGTAGTTGACTTTGCTGTATGGA AAAATAAAGTGAAATTGCCCTAAT |
| 3450 | literature | Hs.51011 | NM_021064 | 10800131 | H2A histone family, member P (H2AFP), mRNA/cds = (30, 422) | 1 | GCTAAATAAGGAATACTCATGCCAAG ATCATCGAATTGTGCCTCCTCCCT |
| 3451 | Table 3A | Hs.51299 | NM_021074 | 10835024 | NADH dehydrogenase (ubiquinone) flavoprotein 2 (24kD) (NDUFV2), mRNA/cds = (18, 767) | 1 | ACCCAAGGGACCTGGATTTGGTGTAC AAGCAGGCCTTTAATTTATATTGA |
| 3452 | Table 3A | Hs.63302 | NM_021090 | 10835108 | myotubularin related protein 3 (MTMR3) | 1 | GGAGTCAGTCAGTGCTCCTATATTTT TCATTTTTTGTCAAAGCAAGAAGT |
| 3453 | Table 3A | Hs.324406 | NM_021104 | 10883874 | ribosomal protein L41 (RPL41), mRNA/cds = (83, 160) | 1 | TTTGTGGCCGAGTGTAACAACCATAT AATAAATCACCTCTTCCGCTGTTT |
| 3454 | Table 3A | Hs.196282 | NM_021105 | 10863876 | phospholipid scramblase 1 (PLSCR1), mRNA/cds = (256, 1212) | 1 | TTCTACATGAAATGTTTAGCTCTTACA CTCTATCCTTCCTAGAAAATGT |
| 3455 | Table 3A | Hs.75968 | NM_021109 | 11056080 | thymosin, beta 4, X chromosome (TMSB4X), mRNA/cds = (77, 211) | 1 | GGACGACAGTGAAATCTAGAGTAAAA CCAAGCTGGCCCAAGTGTCCTGCA |
| 3456 | Table 3A | Hs.154890 | NM_021122 | 12669908 | fatty-acid-Coenzyme A ligase, long-chain 2 (FACL2), mRNA/cds = (13, 2109) | 1 | TGTTTTGGGGTCTGTGAGAGTACATG TATTATATACAAGCACAACAGGGC |

TABLE 8-continued

| SEQ ID | Origin | Unigene | Locus | GI | Nominal Description | Strand | Probe Sequence |
|---|---|---|---|---|---|---|---|
| 3457 | Table 3A | Hs.96 | NM_021127 | 10863922 | phorbol-12-myristate-13-acetate-induced protein 1 (PMAIP1), mRNA/cds = (173, 337) | 1 | AGGAACAGTTAGTTCTCATCTAGAAT GAAAGTTCCATATATGCATTGGTG |
| 3458 | Table 3A | Hs.71818 | NM_021128 | 14589958 | polymerase (RNA) II (DNA directed) polypeptide L (7.6kD) (POLR2L), mRNA/cds = (21, 224) | 1 | TGTGTGTGTATCCCATACCCCACTCT GGAAGGAACCATCCAGTAAAGGTC |
| 3459 | Table 3A | Hs.184011 | NM_021129 | 11056043 | pyrophosphatase (inorganic) (PP), nuclear gene encoding mitochondrial protein, mRNA/cds = (77, 948) | 1 | GTGCAAGGGGAGCACATATTGGATG TATATGTTACCATATGTTAGGAAAT |
| 3460 | Table 3A | Hs.267690 | NM_021130 | 10863926 | mRNA for KIAA1228 protein, partial cds/cds = (0, 2176) | 1 | TTTCCTTGTTCCCTCCCATGCCTAGC TGGATTGCAGAGTTAAGTTTATGA |
| 3461 | literature | Hs.84981 | NM_021141 | 12408850 | X-ray repair complementing defective repair in Chinese hamster cells 5 (double-strand-break rejoining; Ku autoantigen, 80kD) (XRCC5), mRNA/cds = (33, 2231) | 1 | ACCCAGTCACCTCTGTCTTCAGCACC CTCATAAGTCGTCACTAATACACA |
| 3462 | Table 3A | Hs.12743 | NM_021151 | 10863952 | carnitine O-octanoyltransferase (CROT), mRNA/cds = (136, 1974) | 1 | TGAATCACATTGTCAGAATTTTTTCCT CCTCGCTGTTCAATTTTGTAGTT |
| 3463 | Table 3A | Hs.7137 | NM_021188 | 10863994 | clones 23667 and 23775 zinc finger protein (LOC57862), mRNA/cds = (182, 1618) | 1 | AGATGCCTTGTTGCTTTGAAGAAGGG AGTGATGTCAATTCTCTTGTTACA |
| 3464 | Table 3A | Hs.8185 | NM_021199 | 10864010 | CGI-44 protein; sulfide dehydrogenase like (yeast) (CGI-44), mRNA/cds = (76, 1428) | 1 | CCATGTGGGCTACTCATGATGGGCTT GATTCTTTGGGAATAATAAAATGA |
| 3465 | Table 3A | Hs.12152 | NM_021203 | 14917112 | APMCF1 protein (APMCF1), mRNA/cds = (16, 831) | 1 | AAAAGTTCTCTGTAGATTTCTGAAGT GCATATTCATTGATGCCAAGAAAA |
| 3466 | Table 3A | Hs.25726 | NM_021211 | 10864022 | transposon-derived Buster1 transposese-like protein (LOC58486), mRNA/cds = (468, 2549) | 1 | GGAGGAGTTTGCATGTCTCATGATAA CCAAATGTAAGATGAAAATAAAAG |
| 3467 | Table 3A | Hs.29417 | NM_021212 | 10864024 | HCF-binding transcription factor Zhangfei (ZF), mRNA/cds = (457, 1275) | 1 | TTGGTGACTTAGTGATTTTGTCATTTT TTACATCAACTTCATGGTCTTGT |
| 3468 | literature | Hs.274363 | NM_021257 | 10864064 | neuroglobin (NGB), mRNA/cds = (0, 455) | 1 | CGCCCGGCAGCCCCCATCCATCTGT |
| 3469 | Table 3A | Hs.19520 | NM_021603 | 11125763 | FXYD domain-containing ion transport regulator 2 (FXYD2), transcript variant b, mRNA/cds = (67, 261) | 1 | GTCTGTCTGTTGGCCTGTATCTGTT CACCTCATGCTTATAATAAAGCCGG |
| 3470 | Table 3A | Hs.104305 | NM_021621 | 14719827 | death effector filament-forming Ced-4-like apoptosis protein (DEFCAP), transcript variant B, mRNA/cds = (522, 4811) | 1 | CTGGCTGTGTCACAGGGTGAGCCCC AAAATTGGGGTTCAGCGTGGGAGGC |
| 3471 | Table 3A | Hs.17757 | NM_021622 | 11055985 | pleckstrin homology domain-containing, family A (phosphoinositide binding specific) member 1 (PLEKHA1), mRNA/cds = (66, 1260) | 1 | GCCGTCCTCAGTTACCTTTCATGAGG CTTCTAGCCAAAGATGATAAAGGG |
| 3472 | Table 3A | Hs.106747 | NM_021626 | 11055991 | serine carboxypeptidase 1 precursor protein (HSCP1), mRNA/cds = (32, 1390) | 1 | AGGATAAAATCATTGTCTCTGGAGGC AATTTGGAAATTATTTCTGCTTCT |
| 3473 | Table 3A | Hs.3826 | NM_021633 | 11056005 | cDNA FLJ14750 fis, clone NT2RP3002948, weakly similar to RING CANAL PROTEIN/cds = (200, 1906) | 1 | CGGGTGATTACAGGCACCAGTGCAG TGATGATTGTACTTATTTGACACAT |
| 3474 | Table 3A | Hs.155418 | NM_021643 | 11056053 | GS3955 protein (GS3955), mRNA/cds = (1225, 2256) | 1 | GCCTCTGGTGCTTTGTCCTGTATTTG GTTTAATGTTTTTGTCCTAATCTC |
| 3475 | Table 3A | Hs.279681 | NM_021644 | 14141158 | heterogeneous nuclear ribonucleoprotein H3 (2H9) (HNRPH3), transcript variant 2H9, mRNA/cds = (118, 1158) | 1 | TTGATGTGAATTCAGTTATTGAACTTG TTACTTGTTTTTGCCAGAAATGT |
| 3476 | Table 3A | Hs.174030 | NM_021777 | 11496993 | a disintegrin and metalloproteinase domain 28 (ADAM28), transcript variant 1, mRNA/cds = (47, 2374) | 1 | AAGCTTCGAACTCAAAATCATGGAAA GGTTTTAAGATTTGAGGTTGGTTT |
| 3477 | Table 3A | Hs.288906 | NM_021818 | 11141888 | WW Domain-Containing Gene (WW45), mRNA/cds = (215, 1366) | 1 | CCCAGTTAGATATCAGTGAGTTTGAA TAACTGAAGAAATGTTGACAATGT |
| 3478 | Table 3A | Hs.10724 | NM_021821 | 11141894 | MDS023 protein (MDS023), mRNA/cds = (335, 1018) | 1 | AAGTACACCTGTCAGCTGTTTCTTAC CACTTCGATGGTTGTGATTAATTT |
| 3479 | Table 3A | Hs.154938 | NM_021825 | 11141900 | hypothetical protein MDS025 (MDS025), mRNA/cds = (5, 769) | 1 | TGTTTGCTTGAACAGTTGTGTAAATC ATACAGGATTTTGTGGGTATTGGT |
| 3480 | literature | Hs.302003 | NM_021922 | 11345453 | Fanconi anemia, complementation group E (FANCE), mRNA/cds = (185, 1795) | 1 | TGACCTTCTGTGTTTTTGTTTCTGACT TGAATAAATTTATCAATGGTGTTG |
| 3481 | Table 3A | Hs.7174 | NM_021931 | 11345467 | hypothetical protein FLJ22759 (FLJ22759), mRNA/cds = (2, 2113) | 1 | CCAGGGCTGCTTTGCTGTGATGATGA TTGCATTTCAACACATGCCAGATG |
| 3482 | Table 3A | Hs.89751 | NM_021950 | 11386188 | membrane-spanning 4-domains, subfamily A, member 2 (Fc fragment of IgE, high affinity I, receptor for, beta polypeptide) (MS4A2), mRNA/cds = (90, 983) | 1 | GAGTTACCACACCCCATGAGGGAAG CTCTAAATAGCCAACACCCATCTGT |

TABLE 8-continued

| SEQ ID | Origin | Unigene | Locus | GI | Nominal Description | Strand | Probe Sequence |
|---|---|---|---|---|---|---|---|
| 3483 | Table 3A | Hs.2484 | NM_021966 | 11415027 | T-cell leukemia/lymphoma 1A (TCL1A), mRNA/cds = (45, 389) | 1 | TTCTATCCTTGACTTAGATTCTGGTG GAGAGAAGTGAGAATAGGCAGCCC |
| 3484 | Table 3A | Hs.75569 | NM_021975 | 11496238 | v-rel avian reticuloendotheliosis viral oncogene homolog A (nuclear factor of kappa light polypeptide gene enhancer in B-cells 3 (p65))) (RELA), mRNA/cds = (38, 1651) | 1 | TCTTGCTCTTTCTACTCTGAACTAATA AAGCTGTTGCCAAGCTGGACGGC |
| 3485 | literature | Hs.245342 | NM_021979 | 13676856 | hypothetical protein FLJ14642 (FLJ14642), mRNA/cds = (23, 583) | 1 | TGCAAACAAATGCATAAATGCAAATG TAAAGTAAAGCTGAAATTGATCTC |
| 3486 | Table 3A | Hs.326801 | NM_021998 | 11527399 | DNA sequence from PAC 75N13 on chromosome Xq21.1. Contains ZNF6 like gene, ESTs, STSs and CpG islands/cds = (567, 2882) | 1 | ATGCTACTTGGGAGAAAACTCTCACT AACTGTCTCACCGGGTTTCAAAGC |
| 3487 | Table 3A | Hs.293970 | NM_021999 | 11527401 | methylmalonate-semialdehyde dehydrogenase (ALDH6A1), mRNA/cds = (42, 1649) | 1 | TGCAATGGAATATAAATATCACAAAG TTGTTTAACTAGACTGCGTGTTGT |
| 3488 | Table 3A | Hs.82407 | NM_022059 | 11545764 | CXC chemokine ligand 16 (CXCL16), mRNA/cds = (423, 1244) | 1 | TTTCACCTCCTCAGTCCCTTGCCTAC CCCAGTGAGAGTCTGATCTTGTTT |
| 3489 | Table 3A | Hs.136164 | NM_022117 | 11545834 | cutaneous T-cell lymphoma-associated tumor antigen se20-4 (SE20-4), mRNA/cds = (129, 2210) | 1 | CGCCTCTCCCCGTGGACCCTGTTAAT CCCAATAAAATTCTGAGCAAGTTC |
| 3490 | Table 3A | Hs.24633 | NM_022136 | 11545870 | SAM domain, SH3 domain and nuclear localisation signals, 1 (SAMSN1), mRNA/cds = (82, 1203) | 1 | AGGATTCGCTGTTGAAACAAGTTGTC CAAGCAATGTTATATTCATTTTTA |
| 3491 | Table 3A | Hs.184052 | NM_022152 | 11545897 | PP1201 protein (PP1201), mRNA/cds = (75, 1010) | 1 | GGAAGGGGGACAAGGGTCAGTCTGT CGGGTGGGGGCAGAAATCAAATCAG |
| 3492 | Table 3A | Hs.184052 | NM_022152 | 11545897 | PP1201 protein (PP1201), mRNA/cds = (75, 1010) | 1 | GGAAGGGGGACAAGGGTCAGTCTGT CGGGTGGGGGCAGAAATCAAATCAG |
| 3493 | literature | Hs.294030 | NM_022447 | 13937360 | topoisomerase-related function protein 4-2 (TRF4-2), mRNA/cds = (336, 869) | 1 | TTTTTCCCAGCTCGCCACAGAATGGA TCATGAAGACTGACAACTGCAAAA |
| 3494 | Table 3A | Hs.74899 | NM_022451 | 11967984 | hypothetical protein FLJ12820 (FLJ12820), mRNA/cds = (156, 1451) | 1 | AGGAGTGGCCTAAGAAATGCGTGTTT CAGTGACTAGATTATAAATATTCT |
| 3495 | Table 3A | Hs.15220 | NM_022473 | 11968022 | zinc finger protein 106 (ZFP106), mRNA/cds = (335, 5986) | 1 | AGCTGTGAACTTCGTAACTTTGTAAA GCAAGATATAAAGCAAATACAAGA |
| 3496 | Table 3A | Hs.27556 | NM_022485 | 11968038 | hypothetical protein FLJ22405 (FLJ22405), mRNA/cds = (81, 1334) | 1 | AGGAGGGATCACCTGCACTGAGAAT GAGGCAGTTTGACACAGATCACAAA |
| 3497 | Table 3A | Hs.26367 | NM_022488 | 11968042 | PC3-98 protein (PC3-96), mRNA/cds = (119, 586) | 1 | TGTTCCACTACCAGCCTTACTTGTTTA ATAAAAATCAGTGCAAAGAGAAA |
| 3498 | Table 3A | Hs.22353 | NM_022494 | 11968052 | hypothetical protein FLJ21952 (FLJ21952), mRNA/cds = (424, 1665) | 1 | ACCTCAGATTTTGTTACCTGTCTTTTA AAAATGCAGATTTGTCAAATCA |
| 3499 | Table 3A | Hs.23259 | NM_022496 | 11968056 | hypothetical protein FLJ13433 (FLJ13433), mRNA/cds = (35, 1225) | 1 | TTAACGGCTTCACTGGACAGTTTTCC TTAGAAGGTAGTTTTGTGTGACTG |
| 3500 | Table 3A | Hs.275885 | NM_022551 | 14165467 | mRNA; cDNA DKFZp586A0618 (from clone DKFZp586A0818)/cds = UNKNOWN | 1 | ACCGTGGGTGTGTCCAAGAAGAAATA AGTCTGTAGGCCTTGTCTGTTAAT |
| 3501 | Table 3A | Hs.161788 | NM_022570 | 13384803 | C-type (calcium dependent, carbohydrate-recognition domain) lectin, superfamily member 12 (CLECSF12), mRNA/cds = (71, 676) | 1 | CCAATGGATATTTCTGTATTACTAGG GAGGCATTTACAGTCCTCTAATGT |
| 3502 | literature | Hs.65328 | NM_022725 | 12232378 | Fanconi anemia, complementation group F (FANCF), mRNA/cds = (13, 1137) | 1 | TAGCTTTAGAAAATAACAGTTTGTGAA CTTACTTCCCTATATTTGCAGCT |
| 3503 | Table 3A | Hs.83809 | NM_022727 | 12232380 | HpaII tiny fragments locus 9C (HTF9C), mRNA/cds = (235, 1662) | 1 | CTTTGTGGACTAGCCAAGGCTGTGAG GGCCAGAATAAACAACTGCTCAAC |
| 3504 | Table 3A | Hs.7503 | NM_022738 | 12232392 | hypothetical protein FLJ14153 (FLJ14153), mRNA/cds = (30, 1427) | 1 | GCCGAGCAATGACCCTTTTCAATTTC TTATTTCTGTGTTACTGAGGACCC |
| 3505 | Table 3A | Hs.194477 | NM_022739 | 12232398 | E3 ubiquitin ligase SMURF2 (SMURF2), mRNA/cds = (8, 2254) | 1 | GAAACATGTGGATTTGCTGTGGAATG ACAAGCTTCAAGGATTTACCCAGG |
| 3506 | Table 3A | Hs.34516 | NM_022766 | 12232440 | mRNA for KIAA1646 protein, partial cds/cds = (0, 1446) | 1 | TTTGATCTGAAATGTTTGAGAAGACA CGAATAAAGTTACTTGGGCAGAAA |
| 3507 | Table 3A | Hs.154057 | NM_022790 | 13027789 | matrix metalloproteinase 19 (MMP19), transcript variant rasi-3, mRNA/cds = (1642, 1899) | 1 | TCCCATCAAAAAGGGTATCAAATGCCT TGGAAGCTCCCTGATCCTACAAAA |
| 3508 | Table 3A | Hs.121849 | NM_022818 | 13699868 | microtubule-associated proteins 1A/1B light chain 3 (MAP1A/1BLC3), mRNA/cds = (84, 461) | 1 | ATCTGACATTATTGTAACTACCGTGT GATCAGTAAGATTCCTGTAAGAAA |
| 3509 | Table 3A | Hs.148123 | NM_022894 | 12587626 | hypothetical protein FLJ12972 (FLJ12972), mRNA/cds = (168, 1076) | 1 | ACCTTGTACCATGGAAAACATGAAAA GAGTCTTAGAAGTAAAGAACAACA |
| 3510 | Table 3A | Hs.57987 | NM_022898 | 12697634 | B-cell lymphoma/leukaemia 11B (BCL11B), mRNA/cds = (267, 2738) | 1 | AGCATGTGTCTGCCATTTCATTTGTA CGCTTGTTCAAAACCAAGTTTGTT |
| 3511 | Table 3A | Hs.128003 | NM_022900 | 12597838 | hypothetical protein FLJ21213 (FLJ21213), mRNA/cds = (74, 1042) | 1 | TGAGCTGTATTACCATAAGTAGAATTT TAAGTAAACTGGTGAATTTGGGC |
| 3512 | Table 3A | Hs.194688 | NM_023005 | 14670389 | bromodomain adjacent to zinc finger domain, 1B (BAZ1B), transcript variant 1, mRNA/cds = (352, 4803) | 1 | GCCCCATTAAAGGGTGAACTTGTAAT AAATTGGAATTTCAAATAAACCTC |
| 3513 | Table 3A | Hs.168232 | NM_023079 | 12751494 | hypothetical protein FLJ13855 | 1 | TGCCCTAATCTTGAGTTGAGGAAATA |

TABLE 8-continued

| SEQ ID | Origin | Unigene | Locus | GI | Nominal Description | Strand | Probe Sequence |
|---|---|---|---|---|---|---|---|
| 3514 | db mining | Hs.37026 | NM_024013 | 13128949 | interferon, alpha 1 (IFNA1), mRNA/cds = (67, 636) | 1 | TATGCACAGGAGTCAAAGAGATGT AACGTCATGTGCACCTTTACACTGTG GTTAGTGTAATAAAACATGTTCCT |
| 3515 | Table 3A | Hs.302981 | NM_024033 | 8922813 | hypothetical protein FLJ11000 (FLJ11000), mRNA/cds = (223, 780) | 1 | TTATTCATATATTCCTGTCCAAAGCCA CACTGAAAACAGAGGCAGAGACA |
| 3516 | Table 3A | Hs.115960 | NM_024036 | 13128987 | hypothetical protein MGC3103 (MGC3103), mRNA/cds = (10, 984) | 1 | GCAGCCACCCACTGGGAGTCTTGTTT TTATTTATAATAAAATTGTTGGGG |
| 3517 | Table 3A | Hs.7392 | NM_024045 | 13129005 | nucleolar protein GU2 (GU2), mRNA/cds = (107, 2320) | 1 | ATCCACCAAAAATTAGGTCATCATAG TTGAGGTATGTGTCTGCTATTTGC |
| 3518 | Table 3A | Hs.103834 | NM_024056 | 13129025 | hypothetical protein MGC5576 (MGC5576), mRNA/cds = (51, 803) | 1 | CCATTGGCTGGAACATGGATTGGGG ATTTGATAGAAAAATAAACCCTGCT |
| 3519 | Table 3A | Hs.115659 | NM_024061 | 13129035 | hypothetical protein MGC5521 (MGC5521), mRNA/cds = (163, 708) | 1 | GTTCCTTACTCTGTCCTTGATGGAGG GGAGAAGGGAGGGCAAAGAAGTTA |
| 3520 | Table 3A | Hs.267400 | NM_024095 | 13129097 | hypothetical protein MGC5540 (MGC5540), mRNA/cds = (77, 943) | 1 | TGGTTTTCCTTTGGGGACGTGGTTAA CGGTCCAGAAGAATCCCTTCTAGA |
| 3521 | Table 3A | Hs.321130 | NM_024101 | 13129107 | hypothetical protein MGC2771 (MGC2771), mRNA/cds = (184, 1986) | 1 | ACCCCTTTCACTCTTGGCTTTCTTATG TTGCTTTCATGAATGGAATGGAA |
| 3522 | Table 3A | Hs.109701 | NM_024292 | 13236509 | ubiquitin-like 5 (UBL5), mRNA/cds = (65, 286) | 1 | CCCATCCTCATCCCCCACACTGGGAT AGATGCTTGTTTGTAAAAACTCAC |
| 3523 | Table 3A | Hs.78768 | NM_024298 | 13236521 | malignant cell expression-enhanced gene/tumor progression-enhanc (LENG4), mRNA/cds = (1101, 1700) | 1 | TCAGGCCGCCTAGCTGCCCCTTTGC CAGGTTAATAAAGCACTGACTTGTT |
| 3524 | Table 3A | Hs.323193 | NM_024334 | 13236586 | hypothetical protein MGC3222 (MGC3222), mRNA/cds = (149, 1351) | 1 | AAGGATTTTAAATAACTGCCGACTTC AAAAGTGTTCTTAAAACGAAAGAT |
| 3525 | Table 3A | Hs.15961 | NM_024348 | 13259513 | dynactin 3 (p22) (DCTN3), transcript variant, 2 mRNA/cds = (16, 546) | 1 | CACCCACCCTCCCCCCAATCAGTGTT CTTATTTCAGTGACAATAAACCAT |
| 3526 | Table 3A | Hs.8121 | NM_024408 | 13249343 | Notch (Drosophila) homolog 2 (NOTCH2), mRNA/cds = (12, 7427) | 1 | ATAGCTGGTGACAAACAGATGGTTGC TCAGGGACAAGGTGCCTTCCAATG |
| 3527 | db mining | Hs.12315 | NM_004557 | 13375722 | hypothetical protein FLJ11608 (FLJ11608), mRNA/cds = (561, 1184) | 1 | CATGGATATCATGTATCCTTCCTGGT GCTCACACACCTGTCACCTTGTAA |
| 3528 | Table 3A | Hs.337561 | NM_024567 | 13375737 | hypothetical protein FLJ21616 (FLJ21616), mRNA/cds = (119, 1093) | 1 | GCTGTGTGACTTAGTAGATAAAATAC TGCCTTCTGCCTTTGGGACCATGA |
| 3529 | db mining | Hs.236449 | NM_024898 | 13376352 | hypothetical protein FLJ22757 (FLJ22757), mRNA/cds = (92, 2473) | 1 | ACTTCCATCTCAGCTAATGCACCCAC CAGCTCAAACACACCAATAAAGCT |
| 3530 | literature | Hs.72241 | NM_030662 | 13489053 | mitogen-activated protein kinase kinase 2 (MAP2K2), mRNA/cds = (263, 1465) | 1 | GCTGCTGTGTGTGGTCTCAGAGGCT CTGCTTCCTTAGGTTACAAAACAAA |
| 3531 | Table 3A | Hs.196270 | NM_030780 | 13540550 | folate transporter/carrier (LOC81034), mRNA/cds = (128, 1075) | 1 | ATTTATCGTAAACATCCACGAGTGCT GTTGCACTACCATCTATTTGTTGT |
| 3532 | Table 3A | Hs.211458 | NM_030788 | 13540564 | DC-specific transmembrane protein (LOC81501), mRNA/cds = (51, 1463) | 1 | CCCCACAATGGTCTCTTTTCTCCCTG CTCCCTTATTAAAGAACTCTTTCT |
| 3533 | cytokine arrays | Hs.46468 | NM_031409 | 14043039 | chemokine (C—C motif) receptor 6 (CCR6), transcript variant 2, mRNA/cds = (551, 1675) | 1 | CAGTGGTTCCCATTGATTCTCCCCAT ATCTTTTTGCTCTCAGGCTCTGGC |
| 3534 | Table 3A | Hs.301183 | NM_031419 | 13899228 | molecule possessing ankyrin repeats induced by lipopolysaccharide (MAJL), homolog of mouse (MAJL), mRNA/cds = (48, 2204) | 1 | CTTGTATCTCTAAATATGGTGTGATAT GAACCAGTCCATTCACATTGGAA |
| 3535 | Table 3A | Hs.245798 | NM_031435 | 13899258 | hypothetical protein DKFZp56410422 (DKFZP56410422), mRNA/cds = (510, 1196) | 1 | ACATAGATTTTCTGCCAACAAATCCT CTCTGCTGTTCACATTATCCTTTG |
| 3536 | db mining | Hs.238730 | NM_031437 | 13899264 | hypothetical protein MGC10823 (MGC10823), mRNA/cds = (63, 1235) | 1 | CAGAGGTGGGAGTAACTGCTGGTAG TGCCTTCTTTGGTTGTGTTGCTCAG |
| 3537 | Table 3A | Hs.103376 | NM_031453 | 13899290 | hypothetical protein MGC11034 (MGC11034), mRNA/cds = (245, 640) | 1 | TTAGAACCAAAGTTATTCTTAATAAAA ATCACCACATGCTTGGACCATGC |
| 3538 | Table 3A | Hs.281397 | NM_031480 | 13899339 | hypothetical protein AD034 (AD034), mRNA/cds = (195, 1880) | 1 | GCTCTTACACTTCGTCTTTAATGTTCT TTTTGGAGTTAGGACCTCTCAGT |
| 3539 | RG housekeeping genes | Hs.334691 | NM_032223 | 1419927 | hypothetical protein FLJ22427 (FLJ22427), mRNA/cds = (40, 2631) | 1 | ACCTTGACATGGGTTGTCTAATAAAA CTCGGACCCTTCTTGTGAAATCAA |
| 3540 | Table 3A | NA | R11456 | 764191 | spleen 1NFLS cDNA clone IMAGE:129880 5' similar to | 1 | ATCCCAGTGCACAGTGAGTTGTATAT CACAAATAGGAGGCCATTCCAGGA |
| 3541 | RG housekeeping genes | Hs.170222 | R14692 | 768965 | Na+/H+ exchanger NHE-1 isoform [human, heart, mRNA, 4516 nl]/cds = (577, 3024) | 1 | GAAGCTGCTAGGGGAAGGACTGGCC TGGCTCCAGAATGTTGTTGCCTTTT |
| 3542 | Table 3A | Hs.100896 | R18757 | 772387 | yg17e04.r1 cDNA, 5' end/clone = IMAGE:32522/clone _end = 5' | 1 | GGGAAGGAAAAGGGGTGTGGCAGCT GGGAGCGTTTATTTATGTTCTTTCT |
| 3543 | RG housekeeping genes | Hs.82927 | AK025706 | 10438309 | cDNA:FLJ22053 fis, clone HEP09502, highly similar to HUMAMPO2 AMP deaminase (AMPD2) mRNA/cds = UNKNOWN | 1 | GAGTGGTGTTCCAGTGTGGCTCCC AGAGCTTTGACCAGATTGTGATCCC |
| 3544 | RG | Hs.240013 | R44202 | 822065 | mRNA; cDNA DKFZp547A166 (from | 1 | CTTTGCATTTAGGGACACAGCCCGGA |

TABLE 8-continued

| SEQ ID | Origin | Unigene | Locus | GI | Nominal Description | Strand | Probe Sequence |
|---|---|---|---|---|---|---|---|
| | house-keeping genes | | | | clone DKFZp547A166)/cds = UNKNOWN | | GCCGCAGAAGGTCAGCAGGGAGCA |
| 3545 | RG house-keeping genes | Hs.12163 | NM_003908 | 4503504 | DNA sequence from clone RP1-64K7 on chromosome 20q11.21-11.23. Contains the EIF2B2 gene for eukaryotic translation initiation factor 2 subunit 2 (beta, 38kD), a putative novel gene, the gene for heterogenous nuclear ribonucleoprotein RALY or autoantigen P542, an RPS2 (RPS4) (40S ribosomal protein S2) pseudogene, ESTs, STS, GSSs and two CpG islands/cds = (138, 1139) | 1 | CATTGCCTACTTTAACACCTGTCAGA GAAACGTGATATGGGGTAAGGAGG |
| 3546 | RG house-keeping genes | Hs.26320 | R56088 | 826194 | mRNA for TRABID protein (TRABID) gene)/cds = (406, 2532) | 1 | GCAATCTGGGAGCAGCACATTGTTGA TGGAGTCCAAGTGAGCACATTTCA |
| 3547 | Table 3A | Hs.208603 | R64054 | 835933 | 7f01d11.x1 cDNA, 3' end/clone = IMAGE:3293397/clone_end = 3' | 1 | CTCTCCTGGACTGTTGCAGTTGGGTG TGGCTGATTTGAAATTGTGCTTCA |
| 3548 | Table 3A | Hs.181400 | R67739 | 840377 | 602650370T1 cDNA, 3' end/clone = IMAGE:4761353/clone_end = 3' | 1 | TAACAAGAATTGCATTGAGGAAACAA GGCTCCACAGGGCCAATCTTCTGG |
| 3549 | Table 3A | Hs.161043 | R84314 | 942720 | 602415728F1 cDNA, 5' end/clone = IMAGE:4523958/clone_end = 5' | 1 | AAGAAGTTACATCTTCAATGTCCAGG GATGATCGTTTGAAGAGAACCTCT |
| 3550 | Table 3A | NA | R85137 | 943543 | brain N2b4HB55Y cDNA clone IMAGE:180492 5' | 1 | AAAACATTGCCAGACCATTTAGTCCT CTTGGAAGGGCCTCTCCGGTGGGG |
| 3551 | Table 3A | Hs.134025 | R88126 | 946939 | UL-H-B12-agp-a-07-0-UL.s1 cDNA, 3' end/clone = IMAGE:2724781/clone_end = 3' | 1 | AGGGATAATAAGGTTAGCTGTTAACC AAGCAACTGAGCTTTTAACCAAAG |
| 3552 | Table 3A | Hs.85289 | S53911 | 264768 | CD34 antigen (CD34), mRNA/cds = (90, 1076) | 1 | CAAGACACTGTGGACTTGGTCACCAG CTCCTCCCTTGTTCTCTAAGTTCC |
| 3553 | Table 3A | Hs.246381 | S57235 | 298664 | CD68 antigen (CD68), mRNA/cds = (15, 1079) | 1 | TCTTTGACGGGGTTTTCCTTGCTCCT GCCAGGATTAAAAGTCCATGAGTT |
| 3554 | Table 3A | Hs.75258 | S59049 | 299704 | regulator of G-protein signalling 1 (RGS1), mRNA/cds = (14, 604) | 1 | CTTAAAGTATATGTTTTCAAATTGCCA TTGCTACTATTGCTTGTCGGTGT |
| 3555 | Table 3A | Hs.279518 | S60099 | 300168 | amyloid beta (A4) precursor-like protein 2 (APLP2), mRNA/cds = (72, 2363) | 1 | CTCCTGTCACCGGCCTTGTGACATTC ACTCAGAGAAGACCACACCAAGGA |
| 3556 | Table 3A | Hs.300697 | S62140 | 386156 | mRNA for immunoglobulin lambda heavy chain/cds = (65, 1498) | 1 | GTCGGACTATGTAATTGTAACTATAC CTCTGGTTCCCATTAAAAGTGACC |
| 3557 | Table 3A | Hs.249247 | S63912 | 399757 | heterogeneous nuclear ribonucleoprotein A3 (HNRPA3), mRNA/cds = (30, 839) | 1 | GCTAGTGTTTGAATATGCTCTCTTGTT GCTCTAATTCTGTGCCTCCGTGC |
| 3558 | Table 3A | Hs.155924 | S68271 | 545204 | cAMP responsive element modulator (CREM), mRNA/cds = (0, 998) | 1 | AGAGGAACTTGAAACCTTGAAA GACATTTGTTCTCCCAAAACTGAT TACT |
| 3559 | Table 3A | Hs.89545 | S71381 | 551546 | proteasome (prosome, macropain) subunit, beta type, 4 (PSMB4), mRNA/cds = (23, 817) | 1 | ACTGGGATATTGCCCACATGATCAGT GGCTTTGAATGAAATACAGATGCA |
| 3560 | Table 3A | Hs.179526 | S73591 | 688298 | upregulated by 1,25-dihydroxyvitamin D-3 (VDUP1), mRNA/cds = (221, 1396) | 1 | CCAGAAAGTGTGGGCTGAAGATGGT TGGTTTCATGTGGGGGTATTATGTA |
| 3561 | Table 3A | Hs.155396 | S74017 | 693841 | nuclear factor (erythroid-derived 2)-like 2 (NFE2L2), mRNA/cds = (39, 1808) | 1 | TTTCTTAGGACACCATTTGGGCTAGT TTCTGTGTAAGTGTAAATACTACA |
| 3562 | Table 3A | Hs.274401 | S75463 | 833998 | mRNA, cDNA DKFZp434P086 (from clone DKFZp434P086); partial cds/cds = (798, 1574) | 1 | GAAGGGTTGGCCTGCCTGGCTGGGG AGGTCAGTAAACTTTGAATAGTAAG |
| 3563 | Table 3A | Hs.73090 | S76638 | 243420 | p50-NF-kappa B homolog (human peripheral blood T cells, mRNA, 3113 nt)/cds = 250, 2952) | 1 | TTAACACCCCACACCCACCCCTCAGT TGGGACAAATAAAGGATTCTCATG |
| 3564 | Table 3A | Hs.252136 | S80990 | 1911529 | ficolin (collagen/fibrinogen domain-containing) 1 (FCN1), mRNA/cds = (92, 1072) | 1 | CAAGCCGCCACATGCCCACAACCTC ACCAGAGGGAGAATTATGTTTCTAA |
| 3565 | Table 3A | Hs.301497 | T77017 | 694220 | arginine-tRNA-protein transferase 1-1p (ATE1) mRNA, alternatively spliced product, partial cds/cds = (0, 1544) | 1 | GTGTATTGATCCAAGTAGTCAAAGTG TCTTAAAGGGCACCTATTTGTCCT |
| 3566 | Table 3A | Hs.158183 | T78173 | 696682 | yd79c05.r1 cDNA, 5' end/clone = IMAGE:114440/clone_end = 5' | 1 | AGTGCTTTCCAAATGTGATTGTTCTG GGTGATGGGACATATGGGCAGTTG |
| 3567 | Table 3A | NA | T80378 | 698887 | 1NIB cDNA clone IMAGE:24693 5' | 1 | CGGGGGAATAGGAGGAAAAACATGG CATGGAACAAACCAACATAAAAGGT |
| 3568 | Table 3A | NA | T80854 | 703539 | spleen 1NFLS cDNA clone IMAGE:108950 5' | 1 | ACTAATTCTGCTCTTTGGACAAGTGC CTGACATCTGCTTCATTGGGTTTT |
| 3569 | Table 3A | Hs.189744 | T85880 | 714232 | qz25e11.x1 cDNA, 3' | 1 | AGGAATAAAGTTAAGTATTTCCCACTT |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:2027948/clone_end = 3' | | GGAAATTGTACCACTCCTGGGGT |
| 3570 | Table 3A | Hs.327 | U00672 | 482802 | interleukin 10 receptor, alpha (IL10RA), mRNA/cds = (61, 1797) | 1 | CCTCTGCCAAAGTACTCTTAGGTGCC AGTCTGGTAACTGAACTCCCTCTG |
| 3571 | Table 3A | Hs.184592 | U00946 | 405048 | protein kinase, lysine deficient 1 (PRKWNK1), mRNA/cds = (0, 7148) | 1 | GTCTGGTAAGCCGATGCTAATGGCA GAACCAATAGAAGTCCAAGGCACTA |
| 3572 | Table 3A | Hs.278857 | U01923 | 460085 | heterogeneous nuclear ribonucleoprotein H2 (H') (HNRPH2), mRNA/cds = (78, 1427) | 1 | ACGGGACAATTTTAAGATGTAATACC AATACTTTAGAAGTTTGGTCGTGT |
| 3573 | Table 3A | Hs.303627 | U02019 | 433343 | heterogeneous nuclear ribonucleoprotein D (AU-rich element RNA-binding protein 1,37kD) (HNRPD), transcript variant 1, mRNA/cds = (285, 1352) | 1 | CTCTCAGTTCCCAAGATGGCCCCACA TTCCCATTGTTTTCCCCAAGAGAA |
| 3574 | Table 3A | Hs.239138 | U02020 | 404012 | pre-B-cell colony-enhancing factor (PBEF), mRNA/cds = (27, 1502) | 1 | GGTTGTTGTATTGTACCAGTGAAATG CCAAATTTGAAAGGCCTGTACTGC |
| 3575 | Table 3A | Hs.172081 | U02882 | 433348 | rolipram-sensitive 3', 5'-cyclic AMP phosphodiesterase mRNA, complete cds/cds = (108, 1922) | 1 | TTGTTTGCCATCTGTTGATCAGGAAC TACTTCAGCTACTTGCATTTGATT |
| 3576 | Table 3A | Hs.75969 | U03105 | 476094 | proline-rich protein with nuclear targeting signal (B4-2), mRNA/cds = (113, 1096) | 1 | AATCTACATTTTCTTACCAGGAGCAG CATTGAGGTTTTTGAGCATAGTAC |
| 3577 | Table 3A | Hs.89421 | U03644 | 476104 | CBF1 interacting corepressor (CIR), mRNA/cds = (0, 1352) | 1 | ACAGAGAGCACCCAGGAGGTACACA TACTAAAGTGACACAAAGAGAATGA |
| 3578 | Table 3A | Hs.154654 | U03688 | 501030 | cytochrome P450, subfamily I (dioxin-inducible), polypeptide 1 (glaucoma 3, primary infantile) (CYP1B1), mRNA/cds = (372, 2003) | 1 | TGTGTGCATAATAGCTACAGTGCATA GTTGTAGACAAAGTACATTCTGGG |
| 3579 | Table 3A | Hs.75546 | U03851 | 433307 | capping protein alpha mRNA, partial cds/cds = (16, 870) | 1 | AGCATGTTGTTTAATTTCTTTTTAAAA ATCACTGTTGGGCTTTGAAAGCA |
| 3580 | Table 3A | Hs.196384 | U04636 | 496975 | prostaglandin-endoperoxide synthase 2 (prostaglandin G/H synthase and cyclooxygenase) (PTGS2), mRNA/cds = (134, 1948) | 1 | GCTGACAAAACCTGGGAATTTGGGTT GTGTATGCGAATGTTTCAGTGCCT |
| 3581 | Table 3A | Hs.118962 | U05040 | 460151 | far upstream element (FUSE) binding protein 1 (FUBP1), mRNA/cds = (26, 1960) | 1 | TCACTTTCCAAATGCCTGTTTTGTGCT TTACAATAAATGATATGAAACCT |
| 3582 | Table 3A | Hs.79630 | U05259 | 452561 | MB-1 gene, complete cds | 1 | TTTATGCGTATTTAAGCCTTGGAAAC ACAGGGACTATCTTGTGGATTGGG |
| 3583 | Table 3A | Hs.177559 | U05875 | 463549 | interferon gamma receptor 2 (interferon gamma transducer 1) (IFNGR2), mRNA/cds = (648, 1661) | 1 | GTCTTGACTTTGGCAAATGAGCCGGA GCCCCTTGGGCAGGTCACACAACC |
| 3584 | Table 3A | Hs.1197 | U07550 | 469170 | heat shock 10kD protein 1 (chaperonin 10) (HSPE1), mRNA/cds = (41, 349) | 1 | ACATCCAGTGTCTCCAAAATTGTTTC CTTGTACTGATATAAACACTTCCA |
| 3585 | Table 3A | Hs.78909 | U07802 | 984508 | Tis11d gene, complete cds/cds = (291, 1739) | 1 | GGTACAGTTGGAGCACTATATGTACT CTCTGGACTACTTTGGACAGAAGT |
| 3586 | Table 3A | Hs.173965 | U08316 | 475587 | ribosomal protein S6 kinase, 90kD, polypeptide 3 (RPS8KA3), mRNA/cds = (0, 2222) | 1 | AAAATCACCTCAACAGCCCTGTGAAG TGACCTCAGTGAGATATTTGGATC |
| 3587 | Table 3A | Hs.170171 | U08626 | 551473 | glutamine synthetase pseudogene | 1 | TTAAAGTGCACCTTCCAAAATGTCTC CCATAAGTAGGTAAGACCAACCTG |
| 3588 | Table 3A | Hs.333513 | U10117 | 498909 | small inducible cytokine subfamily E. member 1 (endothelial monocyte-activating) (SCYE1), mRNA/cds = (49, 987) | 1 | AATGATGAGTGTGTGGCTACATACAA AGGAGTTCCCTTTGAGGTGAAAGG |
| 3589 | Table 3A | Hs.40202 | U10485 | 505685 | lymphoid-restricted membrane protein (LRMP), mRNA/cds = (574, 2241) | 1 | GGGAAAGTATAGCATGAAACCAGAG GTTCTCAGAATGACCGTAAGATAGC |
| 3590 | Table 3A | Hs.79022 | U10550 | 762886 | GTP-binding protein overexpressed in skeletal muscle (GEM), mRNA/cds = (213, 1103) | 1 | TGGTTGACCCTTGTATGTCACAGCTC TGCTCTATTTATTATTATTTTGCA |
| 3591 | Table 3A | Hs.194776 | U11870 | 511804 | interleukin B receptor, alpha (ILBRA), mRNA/cds = (100, 1152) | 1 | TTGTCCACAAGTAAAAGGAAATCCTC CTCCAGGGAGTCTCAGCTTCACCC |
| 3592 | Table 3A | Hs.80561 | U12767 | 924281 | mitogen induced nuclear orphan receptor (MINOR) mRNA, complete cds/cds = (209, 1972) | 1 | CATTGCTCTTTAGTGTGTGTTAACCT GTGGTTTGAAAGAAATGCTCTTGT |
| 3593 | Table 3A | Hs.184411 | U13044 | 531892 | albumin (ALB), mRNA/cds = (39, 1888) | 1 | GTCTGGCTTAACTATTTTTGAAAATAT AACTGTTTCCCCTCTCTGCTGCT |
| 3594 | Table 3A | Hs.78915 | U13045 | 531894 | GA-binding protein transcription factor, beta subunit 1 (53kD) (GABPB1), transcript variant beta, mRNA/cds = (169, 1356) | 1 | AAAAGCAATTACCCTTAAAACTG TACTCTGGCCTACTTTTCTATTT TGCA |
| 3595 | Table 3A | Hs.1162 | U15085 | 557701 | major histocompatibility complex, class II, DM beta (HLA-DMB), mRNA/cds = (233, 1024) | 1 | GGCTCTCAGTGTGCCATAGAGGACA GCAACTGGTGATTGTTTCAGAGAAA |
| 3596 | Table 3A | Hs.155596 | U15173 | 558843 | BCL2/adenovirus E1B 19kD-interacting protein 2 (BNIP2), | 1 | AAACTGTTTCTTTGGTGTCCTTTACAT TGAAATAAATTGTGTTTGTGCCT |

TABLE 8-continued

| SEQ ID | Origin | Unigene | Locus | GI | Nominal Description | Strand | Probe Sequence |
|---|---|---|---|---|---|---|---|
| 3597 | Table 3A | Hs.2128 | U15932 | 9911129 | dual specificity phosphatase 5 (DUSP5), mRNA/cds = (210, 1364) mRNA/cds = (211, 1155) | 1 | ACCCGTGTGAATGTGAAGAAAAGCAG TATGTTACTGGTTGTTGTTGTTGT |
| 3598 | Table 3A | Hs.64639 | U16307 | 1100927 | glioma pathogenesis-related protein (RTVP1), mRNA/cds = (128, 928) | 1 | AGAGAGGGAACATCAAATGCTGGCA CTATATACATACGATCAGCCTGATT |
| 3599 | Table 3A | Hs.183105 | U17989 | 805094 | nuclear autoantigen (GS2NA), mRNA/cds = (204, 2345) | 1 | GTCTTCCGAGAAACTTTTCTGATCAG TTTGCGAGTTTTGATGAGTTTTGT |
| 3600 | Table 3A | Hs.155188 | U18062 | 842794 | TATA box binding protein (TBP)-associated factor, RNA polymerase II, F, 55kD (TAF2F), mRNA/cds = (740, 1789) | 1 | GCTGCTGTTGCTGCTTTGTGATGACG TGAGATCAATAAGAAGAACCTAGT |
| 3601 | Table 3A | Hs.2488 | U20158 | 806765 | lymphocyte cytosolic protein 2 (SH2 domain-containing leukocyte protein of 76kD) (LCP2), mRNA/cds = (207, 1808) | 1 | AGGACTGAACTGAACCCCTCCCCATG AACACAAGGGTTTTATCCTTTCCT |
| 3602 | Table 3A | Hs.78913 | U20350 | 665580 | G protein-coupled receptor V28 mRNA, complete cds/cds = (87, 1154) | 1 | GATGTGGTAACTGTTAAATTGCTGTG TATCTGATAGCTCTTTGGCAGTCT |
| 3603 | Table 3A | Hs.154230 | U22897 | 984296 | nuclear domain 10 protein (NDP52), mRNA/cds = (54, 1394) | 1 | GATCAAAAGGGCTATGGGAAGGGCA GACCCCGCCAATGATTTCTCTTCAC |
| 3604 | Table 3A | Hs.2437 | U23028 | 806853 | eukaryotic initiation factor 2B-epsilon mRNA, partial cds/cds = (0, 1925) | 1 | GAACAGCTTTGTGCTCCGGCTTTCCC TCAGGGAACAGCAGAGAGCAGTTG |
| 3605 | Table 3A | Hs.93304 | U24577 | 1314245 | phospholipase A2, group VII (platelet-activating factor acetylhydrolase, plasma) (PLA2G7), mRNA/cds = (161, 1486) | 1 | TCCAGGGACCAACATTAACACAACCA ATCAACACATCATGTTACAGAACT |
| 3606 | Table 3A | Hs.278625 | U24578 | 1125049 | RP1 and complement C4B precursor (C4B) genes, | 1 | TATTAAAGGCTTTTGGCAGCAAAGTG TCAGTGTTGGCAGCGAAGTGTCAG |
| 3607 | Table 3A | Hs.3144 | U26710 | 862406 | Cas-Br-M (murine) ectropic retroviral transforming sequence b (CBLB), mRNA/cds = (322, 2634) | 1 | TTCACAAGATGCTTTGAAGGTTCTGA TTTTCAACTGATCAAACTAATGCA |
| 3608 | Table 3A | Hs.1724 | U29607 | 903981 | interleukin 2 receptor, alpha (IL2RA), mRNA/cds = (159, 977) | 1 | ACTAATTTGATGTTTACAGGTGGACA CACAAGGTGCAAATCAATGCGTAC |
| 3609 | Table 3A | Hs.75981 | U30888 | 940181 | ubiquitin specific protease 14 (tRNA-guanine transglycosylase) (USP14), mRNA/cds = (91, 1575) | 1 | ACTGTACAATTTCTGAAGATGGTTATT AACACTGTGCTGTTAAGCATCCA |
| 3610 | Table 3A | Hs.845 | U31120 | 1045451 | interleukin-13 (IL-13) precursor gene, complete cds | 1 | CTGTGTCTGGCACCACCCACACATCC ATGTCTCCCTCACAACCCAGGAGG |
| 3611 | Table 3A | Hs.64310 | U32324 | 975336 | interleukin 11 receptor, alpha (IL11RA), mRNA/cds = (5, 1273) | 1 | CATGTATGTAGGTGCCTGGGAGTGT GTGTGGTCCTTGCTCTGGCCCTTTC |
| 3612 | Table 3A | Hs.41724 | U32659 | 1155222 | interleukin 17 (cytotoxic T-lymphocyte-associated serine esterase 8) (IL17), mRNA/cds = (53, 520) | 1 | ATTCAATTCCAGAGTAGTTTCAAGTTT CACATCGTAACCATTTTCGCCCG |
| 3613 | Table 3A | Hs.108327 | U32986 | 1136227 | damage-specific DNA binding protein 1 (127kD) (DDB1), mRNA/cds = (109, 3531) | 1 | TCTTCGGAAAGAAGAAGGTGGGAGG ATGTGAATTGTTAGTTTCTGAGTTT |
| 3614 | Table 3A | Hs.32970 | U33017 | 984968 | signaling lymphocytic activation molecule (SLAM), mRNA/cds = (133, 1140) | 1 | ATCAAGCCTCTGTGCCTCAGTTTCTC TCTCAGGATAAAGAGTGAATAGAG |
| 3615 | Table 3A | Hs.2533 | U34252 | 1049218 | aldehyde dehydrogenase 9 (gamma-aminobutyraldehyde dehydrogenase, E3 isozyme) (ALDH9), mRNA/cds = (377, 1858) | 1 | GCGATAGAGGAAATCTACTCCCTATC TTGGGTCCTTGAACTACAGCCTGC |
| 3616 | Table 3A | Hs.169476 | U34995 | 1497857 | Homo sapiens, glyceraldehyde-3-phosphate dehydrogenase, clone MGC:10926 IMAGE:3828129, mRNA, complete cds/cds = (2306, 3313) | 1 | CTAGGGAGCCGCACCTTGTCATGTAC CATCAATAAAGTACCCTGTGCTCA |
| 3617 | Table 3A | Hs.289107 | U37547 | 1145292 | baculoviral IAP repeat-containing 2 (BIRC2), mRNA/cds = (1159, 3015) | 1 | TTTCTCCCCCTAGTTTGTGAGAAACA TCTCAATAAAGTGCTTTCCAAAAA |
| 3618 | Table 3A | Hs.154057 | U38320 | 2228241 | matrix metalloproteinase 19 (MMP19), transcript variant rasi-3, mRNA/cds = (1642, 1899) | 1 | TCCCATCAAAAAGGTATCAAATGCCT TGGAAGCTCCCTGATCCTACAAAA |
| 3619 | Table 3A | Hs.151518 | U38847 | 1184691 | TAR (HIV) RNA-binding protein 1 (TARBP1), mRNA/cds = (0, 4865) | 1 | TGCCAAAAGTTTGCCATGTGCCTTAA ACATATTACTATATATTTTCCCCT |
| 3620 | Table 3A | Hs.75916 | U41371 | 1173904 | splicing factor 3b, subunit 2, 145kD (SF3B2), mRNA/cds = (48, 2666) | 1 | CAGTTCCCAAGGACTTGTCATTTCAT GTTCTTATTTTAGACCTGTTTTGT |
| 3621 | Table 3A | Hs.169531 | U41387 | 1230563 | DEAD/H (Asp—Glu—Ala—Asp/His) box polypeptide 21 (DDX21), mRNA/cds = (265, 2412) | 1 | TTACCAAGAAGGACTTAAGGGAGTAA GGGGCGCAGATTAGCATTGCTCAA |
| 3622 | Table 3A | Hs.57304 | U41654 | 2058395 | Ras-related GTP-binding protein (RAGA), mRNA/cds = (31, 972) | 1 | GATATGCACATCAAAGCCTTTACCAG TATCTTCCTGTATTCCGTATCAGA |
| 3623 | Table 3A | Hs.167503 | U43185 | 1151169 | signal transducer and activator of transcription 5A (STAT5A), mRNA/cds = (640, 3024) | 1 | CTCTGAGGCGTGAGGACTCGCAGTC AGGGGCAGCTGACCATGGAAGATTG |
| 3624 | Table 3A | Hs.54460 | U46573 | 1280140 | small inducible cytokine subfamily A (Cys—Cys), member 11 (eolaxin) (SCYA11), mRNA/cds = (53, 346) | 1 | CCTCTCTTCCTCCCTGGAATCTTGTA AAGGTCCTGGCAAAGATGATCAGT |
| 3625 | Table 3A | Hs.279891 | U46751 | 3077821 | truncated calcium binding protein | 1 | GCCTCCTGGTCTCTTCACCACTGTAG |

TABLE 8-continued

| SEQ ID | Origin | Unigene | Locus | GI | Nominal Description | Strand | Probe Sequence |
|---|---|---|---|---|---|---|---|
| 3626 | Table 3A | Hs.155637 | U47077 | 13570016 | (LOC51149), mRNA/cds = (219, 695) DNA-dependent protein kinase catalytic subunit (DNA-PKcs) mRNA, complete cds/cds = (57, 12443) | 1 | TTCTCTCATTTCCAAACCATCAGC TTTTCCTTCTAACACTTGTATTTGGAG GCTCTTCTGTGATTTTGAGAAGT |
| 3627 | Table 3A | Hs.306359 | U50078 | 4220427 | clone 25038 mRNA sequence/cds = UNKNOWN | 1 | TGAATTGCCTGTTCAGGGTTCCTTAT GCAGAGAAATAAAGCAGATTCAGG |
| 3628 | Table 3A | Hs.173824 | U51166 | 1378106 | thymine-DNA glycosylase (TDG), mRNA/cds = (399, 1631) | 1 | GGACATCCACTAGAGTGGGTTTGAG GATTTTCCAAGCGTGTAATAATGA |
| 3629 | Table 3A | Hs.78993 | U51903 | 1262925 | IQ motif containing GTPase activating protein 2 (IQGAP2), mRNA/cds = (222, 4949) | 1 | TTGCACGCAGAGCCTTTAAGTGACTA AGGAACAACATAGATAGTGAGCAT |
| 3630 | Table 3A | Hs.74170 | U52054 | 1377850 | 602708243F1 cDNA, 5' end/clone = IMAGE:4844914/clone_end = 5' | 1 | ACTTTAATCTGATCTTGTGTCTTAGAG AAGCCCCCATACCTGGTAGAGCA |
| 3631 | Table 3A | Hs.82132 | U52682 | 1378108 | interferon regulatory factor 4 (IRF4), mRNA/cds = (105, 1460) | 1 | TGTAGGAAAGGATGCTTCACAAACTG AGGTAGATAATGCTATGCTGTCGT |
| 3632 | Table 3A | Hs.82132 | U52682 | 1378108 | interferon regulatory factor 4 (IRF4), mRNA/cds = (105, 1460 | 1 | TGTAGGAAAGGATGCTTCACAAACTG AGGTAGATAATGCTATGCTGTCGT |
| 3633 | Table 3A | Hs.183556 | U53347 | 1478280 | solute carrier family 1 (neutral amino acid transporter), member 5 (SLC1A5), mRNA/cds = (590, 2215) | 1 | CTGGGGAGAGGCTGAGGACAAATAC CTGCTGTCACTCCAGAGGACATTTT |
| 3634 | Table 3A | Hs.333527 | U53530 | 1314642 | cDNA FLJ13685 fis, clone PLACE2000039, highly similar to DYNEIN HEAVY CHAIN, CYTOSOLIC/cds = UNKNOWN | 1 | CATTACTTGTGAGCTGCTGAACAAAC AAGTCAAGGTGAGCCCGGACATGG |
| 3635 | Table 3A | Hs.58189 | U54559 | 2351379 | eukaryotic translation initiation factor 3, subunit 3 (gamma, 40kD) (EIF3S3), mRNA/cds = (5, 1063) | 1 | AAGAAGTTAACATGAACTCTTGAAGT CACACCAGGGCAACTCTTGGAAGA |
| 3636 | Table 3A | Hs.44585 | U58334 | 1399804 | tumor protein p53-binding protein, 2 (TP53BP2), mRNA/cds = (756, 3773) | 1 | GAAACTTGCTACAGACTTACCCGTAA TATTTGTCAAGATCATAGCTGACT |
| 3637 | Table 3A | Hs.169191 | U58913 | 4204907 | small inducible cytokine subfamily A (Cys—Cys), member 23 (SCYA23), mRNA/cds = (71, 433) | 1 | TGGACACACGGATCAAGACCAGGAA GAATTGAACTTGTCAAGGTGAAGGG |
| 3638 | Table 3A | Hs.11383 | U59808 | 4097420 | small inducible cytokine subfamily A (Cys—Cys), member 13 (SCYA13), mRNA/cds = (75, 371) | 1 | TGCTAAATATGTTATTGTGGAAAGAT GAATGCAATAGTAGGACTGCTGAC |
| 3639 | Table 3A | Hs.79089 | U60800 | 1663568 | sema domain, immunoglobulin domain (Ig), transmembrane domain (TM) and short cytoplasmic domain, (semaphorin) 4D (SEMA4D), mRNA/cds = (87, 2875) | 1 | AGCAATAAACTCTGGATGTTTGTGCG CGTGTGTGGACAGTCTTATCTTCC |
| 3640 | Table 3A | Hs.238648 | U60805 | 1794210 | oncostatin M receptor (DSMR), mRNA/cds = (367, 3306) | 1 | TCCTCTTTTCTTTCAAGAACTATATAT AAATGACCTGTTTTCACGCGGCC |
| 3641 | Table 3A | Hs.77256 | U61145 | 1575348 | enhancer of zeste (Drosophila) homolog 2 (EZH2), mRNA/cds = (57, 2297) | 1 | AGCTGCAAAGTGTTTTGTACCAGTGA ATTTTTGCAATAATGCAGTATGGT |
| 3642 | Table 3A | Hs.30035 | U61287 | 1418285 | splicing factor, arginine/serine-rich (transformer 2 Drosophila homolog) 10 (SFRS10), mRNA/cds = (121, 987) | 1 | TTGCTTACCAAAGGAGGCCCAATTTC ACTCAAATGTTTTGAGAACTGTGT |
| 3643 | Table 3A | Hs.155935 | U82027 | 1511643 | complement component 3a receptor 1 (C3AR1), mRNA/cds = (0, 1448) | 1 | ACATAGTGAAAGTTTATAAGAGGATG AAGTGATATGGTGAGCAGCGGACT |
| 3644 | Table 3A | Hs.177584 | U62981 | 1519051 | 3-oxoacid CoA transferase (OXCT), nuclear gene encoding mitochondrial protein, mRNA/cds = (98, 1660) | 1 | AACAGCCTTTCTGGCTGACCACATGG TTAAATGCATACCTTCCCAGTACT |
| 3645 | Table 3A | Hs.75498 | U64197 | 1778716 | small inducible cytokine subfamily A (Cys—Cys), member 20 (SCYA20), mRNA/cds = (58, 348) | 1 | TGTGCCTCACCTGGACTTGTCCAATT AATGAAGTTGATTCATATTGCATC |
| 3646 | Table 3A | Hs.73165 | U64198 | 1685027 | interleukine 12 receptor, beta 2 (IL12RB2), mRNA/cds = (640, 3228) | 1 | CTATAGATGAAGACATAAAAGACACT GGTAAACACCAATGTAAAAGGGCC |
| 3647 | Table 3A | Hs.279939 | U65590 | 1794218 | mitochondrial carrier homolog 1 (MTCH1), nuclear gene encoding mitochondrial protein, mRNA/cds = (0, 1118) | 1 | AGCTGTTGATGCTGGTTGGACAGGTT TGAGTCAAATTGTACTTTGCTCCA |
| 3648 | Table 3A | Hs.73172 | U67369 | 1898891 | growth factor independent 1 (GFI1), mRNA/cds = (267, 1535) | 1 | TGGGAAGGAAGGCTCTGTCTTCAACT CTTTGACCCTCCATGTGTACCATA |
| 3649 | Table 3A | Hs.84264 | U70439 | 1698782 | *Homo sapiens*, acidic protein rich in leucines, clone MGC:8650 IMAGE:2961642, mRNA, complete cds/cds = (211, 966) | 1 | GATTCTTGCTGTAGCGTGGATAGCTG TGATTGGTGAGTCAACCGTCTGTG |
| 3650 | Table 3A | Hs.82116 | U70451 | 1763090 | myeloid differentiation primary response protein My088 mRNA, complete cds/cds = (32, 922) | 1 | TGGGCATTTTAAAGCCATCTCAAGAG GCATCTTCTACATGTTTTGTACGC |
| 3651 | Table 3A | Hs.117005 | U71383 | 2411474 | sialic acid binding Ig-like lectin 5 (SIGLEC5), mRNA/cds = (142, 1797) | 1 | AAGTCAGGGACCACTTGCTGAAGCA CGAAGAGCCCTTGTGGCAATGTTAA |
| 3652 | Table 3A | Hs.12045 | U72514 | 2276395 | *Homo sapiens*, Similar to gene rich cluster, C2f gene, clone MGC:16358 | 1 | GACTGCTGGAAGATGATCTTTCTGCA CTGAGACTGTGGAGTTTGGGGAAG |

TABLE 8-continued

| SEQ ID | Origin | Unigene | Locus | GI | Nominal Description | Strand | Probe Sequence |
|---|---|---|---|---|---|---|---|
| 3653 | Table 3A | Hs.183684 | U73824 | 1857236 | IMAGE:3927564, mRNA, complete cds/cds = (278, 733) eukaryotic translation initiation factor 4 gamma, 2 (EIF4G2), mRNA/cds = (306, 3029) | 1 | TTGTGGGTGTGAAACAAATGGTGAGA ATTTGAATTGGTCCCTCCTATTAT |
| 3654 | Table 3A | NA | U75686 | 2801402 | Poly(A)-binding protein, cytoplasmic 4 (inducible form) | 1 | AATTCCAGCTGAGCGCCGGTCGCTA CCATTACCGTTGGTCTTGGTGTCAA |
| 3655 | Table 3A | Hs.20191 | U76248 | 2673967 | hSIAH2 mRNA, complete cds/cds = (526, 1500) | 1 | CCCCAACCCTCAAATTAAAACTAGAA CTATAGATCCACATGAACGCACGC |
| 3656 | Table 3A | Hs.81361 | U76713 | 1814273 | heterogeneous nuclear ribonucleoprotein A/B (HNRPAB), transcript variant 1, mRNA/cds = (224, 1219) | 1 | AGCTTTTGAAATAAAATTTAAAAACCC CAAGCCTGGGTGAGTGTGGGAAA |
| 3657 | Table 3A | Hs.76507 | U77396 | 1684871 | LPS-induced TNF-alpha factor (PIG7), mRNA/cds = (233, 919) | 1 | TCTGTAATCAAATGATTGGTGTCATTT TCCCATTTGCCAATGTAGTCTCA |
| 3658 | Table 3A | Hs.78103 | U77456 | 1879778 | nucleosome assembly protein 1-like 4 (NAP1L4), mRNA/cds = (149, 1276) | 1 | GCCCCACCATTCATCCTGTCTGAAGG TCCTGGGTTTGGTGTGACCGCTTG |
| 3659 | Table 3A | Hs.80205 | U77735 | 1750275 | pim-2 oncogene (PIM2), mRNA/cds = (185, 1189) | 1 | TTCCTGCCTGGATTATTTAAAAAGCC ATGTGTGGAAACCCACTATTTAAT |
| 3660 | Table 3A | Hs.55481 | U78722 | 1699000 | zinc finger protein 165 (ZNF165), mRNA/cds = (567, 2024) | 1 | AGCCTTCAGTCAGAGCTCAAACCTTA GTCAACACCAGAGAATTCACATGA |
| 3661 | Table 3A | Hs.71848 | U79277 | 1710245 | clone 23548 mRNA sequence/cds = UNKNOWN | 1 | GAATTTTCAGTTTGTGCTTACATTTTC TAACATTGGATGTTTGCTTTGGC |
| 3662 | Table 3A | Hs.173854 | U80735 | 2565045 | CAGF28 mRNA, partial cds/cds = (0, 2235) | 1 | TATGACTTTAAGAGCCCACATTAGGT TTTATGATTCATTTGCCAGGTTTT |
| 3663 | Table 3A | Hs.306094 | U80743 | 2565060 | mRNA for KIAA1818 protein, partial cds/cds = (0, 3473) | 1 | GGCGTGCCGTTGAGGGGGAAAACGA AGCCCAGTATTTGCTACTGTTTTTC |
| 3664 | Table 3A | Hs.181466 | U81002 | 4580010 | cDNA FLJ14502 fis, clone NT2RM1000244, highly similar to TRAF4 associated factor 1 mRNA/cds = (UNKNOWN) | 1 | CTCTTGGGCATAAAATCTCAGAGGAA GCTACTTAGGACATCATCTTGGCC |
| 3665 | Table 3A | Hs.181002 | U82828 | 2072424 | non-lens beta gamma-crystallin like protein (AIM1) mRNA, parital cds/cds = (0, 4913) | 1 | TCTACAGTAGCCTGTGCTGAACTGAT CTCTTAAATAAACTTGCTTCTGGT |
| 3666 | Table 3A | Hs.334457 | U83115 | 2623760 | Aac11 (aac11) mRNA, complete cds/cds = (77, 1663) | 1 | TTCTCAAGTTTGATACTGAGTTGACT GTTCCCTTATCCCTCACCGTTCCC |
| 3667 | Table 3A | Hs.80420 | U83857 | 1888522 | small inducible cytokine subfamily D (Cys-X3-Cys), member 1 (fractalkine, neurotactin) (SCYD1), mRNA/cds = (79, 1272) | 1 | AGACTTTTCCAACCCTCATCACCAAC GTCTGTGCCATTTTGTATTTTACT |
| 3668 | Table 3A | Hs.154685 | U84487 | 2218086 | phosphomannomutase 2 (PMM2), mRNA/cds = (48, 788) | 1 | CCAGCGGCATCTTTCCTTGTCGAATG ATACTGTAATGACCTTCCAAAGTG |
| 3669 | Table 3A | Hs.50404 | U85773 | 2388626 | small inducible cytokine subfamily A (Cys—Cys), member 25 (SCYA25), mRNA/cds = (0, 452) | 1 | TCTGGTCATTCAAGGATCCCCTCCCA AGGCTATGCTTTTCTATAACTTTT |
| 3670 | Table 3A | Hs.162808 | U86453 | 2317893 | phosphatidylinositol 3-kinase catalytic subunit p110della mRNA, complete cds/cds = (195, 3329) | 1 | TGTGGGTTGAGACCAGCACTCTGTGA AACCTTGAAATGAGAAGTAAAGGC |
| 3671 | Table 3A | Hs.74407 | U88602 | 1835785 | nucleolar protein p40; homolog of yeast EBNA1-binding protein (P40), mRNA/cds = (142, 1082) | 1 | TGAATACAAAGAACCAAGAAAA AGGAATGAAGACTCGCAATTTCAC GACA |
| 3672 | Table 3A | Hs.5181 | U87954 | 4099505 | proliferation-associated 2G4, 38kD (PA2G4), mRNA/cds = (97, 1281) | 1 | CTGAATTTGGTTTTGGGAGGTGAGGC TTCCCAACCACGGAAGACTACTTT |
| 3673 | Table 3A | Hs.173334 | U88629 | 1946346 | ELL-RELATED RNA POLYMERASE II, ELONGATION FACTOR (ELL2), mRNA/cds = (0, 1922) | 1 | GGCTCACATCAAAAGGCTAATAGGTG AATTTGACCAACAGCAAGCAGAGT |
| 3674 | Table 3A | Hs.169963 | U90543 | 2062887 | butyrophilin, subfamily 2, member A1 (BTN2A1), mRNA/cds = (210, 1793) | 1 | GACGCCTTACAAATGATGGAGGATTC CAAAGAGTTTTTGTTTATTTGGGT |
| 3675 | Table 3A | Hs.167741 | U90548 | 2062697 | butyrophilin, subfamily 3, member A3 (BTN3A3), mRNA/cds = (171, 1925) | 1 | CCTGGTCATTGGTGGATGTTAAACCC ATATTCCTTTCAACTGCTGCCTGC |
| 3676 | Table 3A | Hs.284283 | U90552 | 2062705 | butyrophilin (BTF5) mRNA, complete cds/cds = (359, 1900) | 1 | TGGTGGATGTTAAACCAATATTCCTTT CAACTGCTGCCTGCTAGGGAAAA |
| 3677 | Table 3A | Hs.83724 | U90904 | 1913882 | *Homo sapiens*, clone IMAGE:3451448, mRNA, partial cds/cds = (0, 901) | 1 | CAGCTCTGGAAATAGAAGACTAGG GTTGTTTCTTAAATTTAGCTCATGT |
| 3678 | Table 3A | Hs.279948 | U93243 | 6649661 | HSPC205 mRNA, complete cds/cds = (190, 681) | 1 | TGACTTATGAGCTGTGACTCAACTGC TTCATTAAACATTCTGCATTGGGT |
| 3679 | Table 3A | Hs.7811 | U94856 | 2055430 | eukaryotic translation initiation factor 3, subunit 5 (epsilon, 47kD) (EIF3S5), mRNA/cds = (8, 1079) | 1 | ACACTGAGATAGTCAGTTGTGTGTGA CTCTAATAAACGGAGCCTACCTTT |
| 3680 | Table 3A | Hs.328248 | U98828 | 2343084 | cDNA:FLJ22071 fis, clone HEP11691/cds = UNKNOWN | 1 | TTTGTAAGCGAAGGAGATGGAGGTC GTCTTAAACCAGAGAGCTACTGAAT |
| 3681 | Table 3A | Hs.195175 | U97075 | 2253880 | mRNA for CASH alpha protein/cds = (481, 1923) | 1 | GGATGATAACACCCTATGCCCATTGT CCTGATCTGAAAATTCTTGGAAAT |
| 3682 | Table 3A | Hs.308026 | V00522 | 32122 | major histocompatibility complex, class II, DR beta 5 (HLA-DRB5), mRNA/cds = (29, 829) | 1 | CTTTGCCTAAACCCTATGGCCTCCTG TGCATCTGTACTCACCCTGTACCA |

TABLE 8-continued

| SEQ ID | Origin | Unigene | Locus | GI | Nominal Description | Strand | Probe Sequence |
|---|---|---|---|---|---|---|---|
| 3683 | Table 3A | Hs.25647 | V01512 | 29903 | cellular oncogene c-fos (complete sequence) | 1 | AAAAGCATTTAAGTTGAATGCGACCA ACCTTGTGCTCTTTTCATTCTGGA |
| 3684 | Table 3A | Hs.44189 | W00466 | 1271875 | yz99f01.r1 cDNA, 5' end/clone = IMAGE:291193/clone_end = 5' | 1 | CCTTGAGAAACACCCATCTCCACTCC TAGACAAACCAATGAACATTAGTC |
| 3685 | Table 3A | NA | W00491 | 1271910 | 2NbHM cDNA clone IMAGE:291255 5' similar to | 1 | TCTTAAGGTGTGGCAGAGACAGGGT ATTTGGGATATACTTTTCAGACTCC |
| 3686 | Table 3A | NA | W02600 | 1274578 | spleen 1NFLS cDNA clone IMAGE:296099 5' | 1 | AACAATAAAATATGGCTAGACTGGCC TCTGGTTGCCTAAACAGAGCATCA |
| 3687 | Table 3A | NA | W03955 | 1275820 | za62d04.rf cDNA, 5' end/clone = IMAGE:297127/ | 1 | CTTAACTGAGGGCTTGTCCTGGTTAT AAATGTCTGGGTGGGGGTGGGCAC |
| 3688 | Table 3A | Hs.306117 | W16552 | 1290934 | capicua protein (CIC) mRNA, complete cds/cds = (40, 4866) | 1 | AACTGTGAGGCAAATAAAATGCTTCT CAAACTGTGTGGCTCTTATGGGGT |
| 3689 | Table 3A | Hs.17778 | W19201 | 1295429 | neuropilin 2 (NRP2), mRNA/cds = (0, 2780) | 1 | GTGGCTAAGTCATTGCAGGAACGGG GCTGTGTTCTCTGCTGGGACAAAAC |
| 3690 | Table 3A | Hs.235883 | W19487 | 1295576 | 602626774F1 cDNA, 5' end/clone = IMAGE:4753483/clone_end = 5' | 1 | ATTGCGACTGTATGGAGAAGAACTGT TTGTCATTCAGTGCCGTGGGATAT |
| 3691 | Table 3A | Hs.340717 | W25068 | 1302933 | we58c01.x1 cDNA, 3' end/clonde = IMAGE:2345280/clone_end = 3' | 1 | TTTATAGAACAATTCCTTTCTCTTCTC TTGAATGTGGCAGTCATTACTGC |
| 3692 | Table 3A | Hs.173334 | W47229 | 1331889 | ELL-RELATED RNA POLYMERASE II, ELONGATION FACTOR (ELL2), mRNA/cds = (0, 1922) | 1 | TTGATTAGAGCAATGGGAAGCATACT GTGGCCTACCAGCATCTGGAAGTG |
| 3693 | Table 3A | NA | W56487 | 1358345 | zc59c07 rf Soares_parathyroid_tumor_NbHPA cDNA clone | 1 | TCAATTGAGGCCCCTTCCCTAAGATT ACAACATTGATAACCTGTCCTTTT |
| 3694 | Table 3A | Hs.21812 | W74397 | 1384683 | AL562895 cDNA/clone = CS0DC021YO20- (3-prime) | 1 | CAGCCCTCCGTCGCTTTTTATAAAAC TTTGTGTGAGAAGAATATATTGAT |
| 3695 | Table 3A | Hs.163846 | W79598 | 1390869 | putative N6-DNA-methyltransferase (N6AMT1), mRNA/cds = (29, 673) | 1 | ACTTCAGATCCTTTTGTGTTTAAATAA AGGAAAAGCTGCACATCCAAAAA |
| 3696 | Table 3A | Hs.8294 | W80882 | 1391906 | KIAA0196 gene product (KIAA0196), mRNA/cds = (273, 3752) | 1 | AGCCTACCTCCTACCCCAGCTGTCTG TTGAGAGCAGTGCTGACCCCAGCA |
| 3697 | Table 3A | Hs.303157 | X00437 | 36748 | mRNA for T-cell specific protein/cds = (37, 975) | 1 | GAAGAGCTGCTCTCACCTCTCTGCAT CCCAATAGATATCCCCCTATGTGC |
| 3698 | Table 3A | Hs.75514 | X00737 | 35564 | nucleoside phosphorylase (NP), mRNA/cds = (109, 978) | 1 | GGGCTCAGTTCTGCCTTATCTAAATC ACCAGAGACCAAACAAGGACTAAT |
| 3699 | Table 3A | Hs.1724 | X01057 | 33812 | interleukin-2 receptor | 1 | AAATACAAACATTCTAATTAAAGGCTT TGCAACACATGCCTTGTCTGTTT |
| 3700 | Table 3A | Hs.95327 | X01451 | 36774 | CD3D antigen, delta polypeptide (TIT3 complex) (CD3D), mRNA/cds = (0, 515) | 1 | GCCATTACCAACTGTACCTTCCCTTC TTGCTCAGCCAATAAATATATCCT |
| 3701 | Table 3A | Hs.1103 | X02812 | 37092 | tranforming growth factor, beta 1 (TGFB1), mRNA/cds = (841, 2016) | 1 | CACCAGGAACCTGCTTTAGTGGGGG ATAGTGAAGAAGACAATAAAAGATA |
| 3702 | Table 3A | Hs.1217 | X02994 | 28379 | adenosine deaminase (ADA), mRNA/cds = (95, 1186) | 1 | TGGGCATGGTTGAATCTGAAACCCTC CTTCTGTGGCAACTTGTACTGAAA |
| 3703 | Table 3A | Hs.2233 | X03656 | 31687 | gene for granuloctye colony-stimulating factor (G-CSF) | 1 | CTGGGGAGGAGGTCCAGGGAGGAG GAGGAAAGTTCTCAAGTTCGTCTGAC |
| 3704 | Table 3A | Hs.174142 | X03663 | 29899 | colony stimulating factor 1 receptor, formerly McDonough feline sarcoma viral (v-fms) oncogene homolog (CSF1R), mRNA/cds = (300, 3218) | 1 | AACTAACAGTCACGCCGTGGGATGTC TCTGTCCACATTAAACTAACAGCA |
| 3705 | Table 3A | Hs.14376 | X04098 | 28338 | actin, gamma 1 (ACTG1), mRNA/cds = (74, 1201) | 1 | GGTTTTCTACTGTTATGTGAGAACATT AGGCCCCAGCAACACGTCATTGT |
| 3706 | Table 3A | Hs.74451 | X04106 | 35327 | calpain 4, small subunit (30K) (CAPN4), mRNA/cds = (158, 964) | 1 | TTTGTCTATATTCTGCTCCCAGCCTG CCAGGCCAGGAGGAAATAAACATG |
| 3707 | Table 3A | Hs.198365 | X04327 | 29480 | 2,3-bisphosphoglycerate mutase (BPGM), mRNA/cds = (110, 889) | 1 | TTCCTCTTTGGCCACAAGAATAAGCA GCAAATAAACAACTATGGCTGTTG |
| 3708 | Table 3A | Hs.58685 | X04391 | 37186 | CD5 antigen (P56-62) (CD5), mRNA/cds = (72, 1559) | 1 | CTCATCTAAAGACACCTTCCTTTCCA CTGGCTGTCAAGCCACAGGGCACC |
| 3709 | Table 3A | Hs.93913 | X04430 | 32673 | interleukine B (interferon, beta 2) (IL6), mRNA/cds = (62, 700) | 1 | GCAGTTTGAATATCCTTTGTTTCAGA GCCAGATCATTTCTTGGAAAGTGT |
| 3710 | Table 3A | Hs.2253 | X04481 | 34627 | complement component 2 (C2), mRNA/cds = (36, 2294) | 1 | CCCTGGTTGACTTGACTCATGCTTGT TTCACTTTCACATGGAATTTCCCA |
| 3711 | Table 3A | Hs.2247 | X04688 | 33835 | interleukin 5 (colony-stimulating factor, eosinophil) (IL5), mRNA/cds = (44, 448) | 1 | TCAGAGGGAAAGTAAATATTTCAGGC ATACTGACACTTTGCCAGAAAGCA |
| 3712 | Table 3A | Hs.79015 | X05323 | 34742 | MRC OX-2 gene signal sequence | 1 | CACAAGGTAAAGAAACTCAATTCCCC TGCTTGGAGCCCAGCAAACACAAT |
| 3713 | Table 3A | Hs.78225 | X05908 | 34387 | annexin A1 (ANXA1), mRNA/cds = (74, 1114) | 1 | TGTGGAGGAAACTAAACATTCCCTTG ATGGTCTCAAGCTATGATCAGAAG |
| 3714 | Table 3A | Hs.36972 | X06180 | 29819 | CD7 antigen (p41) (CD7), mRNA/cds = (0, 722) | 1 | GGAGGAGACCAGTCCCCCACCCAGC CGTACCAGAAATAAAGGCTTCTGTG |
| 3715 | Table 3A | Hs.81665 | X06182 | 34084 | v-kit Hardy-Zuckerman 4 feline sarcoma viral oncogene homolog (KIT), mRNA/cds = (21, 2951) | 1 | TGTGTAAATACATAAGCGGCGTAAGT TTAAAGGATGTTGGTGTTCCACGT |
| 3716 | Table 3A | Hs.173255 | X06347 | 37540 | small nuclear ribonucleoprotein | 1 | CGCTGTTAGGCCGGAATTAAAGTGG |

TABLE 8-continued

| SEQ ID | Origin | Unigene | Locus | GI | Nominal Description | Strand | Probe Sequence |
|---|---|---|---|---|---|---|---|
| | | | | | polypeptide A (SNRPA), mRNA/cds = (125, 973) | | CTTTTTGAGGTTTGGTTTTTCACAA |
| 3717 | db mining | Hs.2014 | X06557 | 37003 | mRNA for T-cell receptor delta/cds = UNKNOWN | 1 | GGGGTTTATGTCCTAACTGCTTTGTA TGCTGTTTTATAAAGGGATAGAAG |
| 3718 | Table 3A | Hs.153003 | X06956 | 32014 | serine/threonine kinase 16 (STK16), mRNA/cds = (118, 1050) | 1 | ACACCAACCTGCTTCCACTTTATTCTT GTTTACACATTCTCCTGCTCCCA |
| 3719 | Table 3A | Hs.77202 | X07109 | 35492 | protein kinase C, beta 1 (PRKCB1), mRNA/cds = (136, 2151) | 1 | AAGATGTTTGTGGAAATGTTCATTTGT ATCTGGATCTCTGTTATGTGCCA |
| 3720 | Table 3A | Hs.89751 | X07203 | 29775 | membrane-spanning 4-domains, subfamily A, member 2 (Fc fragment of IgE, high affinity I, receptor for; beta polypeptide) (MS4A2), mRNA/cds = (90, 983) | 1 | GAGTTACCACACCCCATGAGGGAAG CTCTAAATAGCCAACACCCATCTGT |
| 3721 | Table 3A | Hs.77438 | X07743 | 35517 | pleckstrin (PLEK), mRNA/cds = (60, 1112) | 1 | TTCCTGAAGCTGTTCCCACTCCCAGA TGGTTTTATCAATAGCCTAGAGGT |
| 3722 | Table 3A | Hs.318885 | X07834 | 36517 | superoxide dismutase 2, mitochondrial (SOD2), mRNA/cds = (4, 672) | 1 | TACTTTGGGGACTTGTAGGGATGCCT TTCTAGTCCTATTCTATTGCAGTT |
| 3723 | Table 3A | Hs.78056 | X12451 | 29714 | cathepsin L (CTSL), mRNA/cds = (288, 1289) | 1 | TCGAATCATTGAAGATCCGAGTGTGA TTTGAATTCTGTGATATTTTCACA |
| 3724 | Table 3A | Hs.193400 | X12830 | 33845 | interleukin 6 receptor (IL6R), mRNA/cds = (437, 1843) | 1 | ATATCCAATATTCGCTGTGTCAGCAT AGAAGTAACTTACTTAGGTGTGGG |
| 3725 | Table 3A | Hs.856 | X13274 | 32691 | interferon, gamma (IFNG), mRNA/cds = (108, 608) | 1 | TTGTTGACAACTGTGACTGTACCCAA ATGGAAAGTAACTCATTTGTTAAA |
| 3726 | Table 3A | Hs.2299 | X13444 | 29826 | CD8 antigen, beta polypeptide 1 (p37) (CD881), mRNA/cds = (50, 682) | 1 | AAGTTTCTCAGCTCCCATTTCTACTCT CCCATGGCTTCATGCTTCTTTCA |
| 3727 | Table 3A | Hs.234489 | X13794 | 34314 | lactate dehydrogenase B gene exon 1 and 2 (EC 1.1.1.27) | 1 | TCTCCATGTTGTCAAAATCATGCCGT TTATAGCTATTTTCACCTCAGTGG |
| 3728 | literature | Hs.89137 | X13916 | 34338 | low density lipoprotein-related protein 1 (alpha-2-macroglobulin receptor) (LRP1), mRNA/cds = (466, 14100) | 1 | GCCCCGTTTTGGGGACGTGAACGTTT TAATAATTTTTGCTGAATTCTTTA |
| 3729 | Table 3A | Hs.82120 | X14008 | 34433 | nuclear receptor subfamily 4, group A, member 2 (NR4A2), mRNA/cds = (317, 2113) | 1 | AGGTGGGCACAAGTATTACACATCAG AAAATCCTGACAAAAGGGACACAT |
| 3730 | Table 3A | Hs.77424 | X14356 | 31331 | Fc fragment of IgG, high affinity Ia, receptor for (CD64) (FCGR1A), mRNA/cds = (0, 1124) | 1 | GTTCAACAACACCAGAACTGTGTGTC TCATGGTATGTAACTCTTAAAGCA |
| 3731 | Table 3A | Hs.87409 | X14787 | 37464 | thrombospondin 1 (THBS1), mRNA/cds = (111, 3623) | 1 | TTGACCTCCCATTTTTACTATTTGCCA ATACCTTTTTCTAGGAATGTGCT |
| 3732 | Table 3A | Hs.289088 | X15183 | 32487 | heat shock 90kD protein 1, alpha (HSPCA), mRNA/cds = (60, 2258) | 1 | AAAGCTGTTCAAATACTCGAGCCCAG TCTTGTGGATGGAAATGTAGTGCT |
| 3733 | Table 3A | Hs.339703 | X16277 | 35137 | zv26f06.r1 cDNA, 5' end/clone = IMAGE:754787/clone_end = 5' | 1 | CTTAAGTCTGACGGACCTGTCCTGTC CAGGCCAGTGCCCAGGGAAGGTGT |
| 3734 | Table 3A | Hs.50964 | X16354 | 37197 | mRNA for transmembrane carcinoembryonic antigen BGPa (formerly TM1-CEA)/cds = (72, 1652) | 1 | TTTCTAACCCTGACACGGACTGTGCA TACTTTCCCTCATCCATGCTGTGC |
| 3735 | Table 3A | Hs.154672 | X16396 | 35070 | methylene tetrahydrofolate dehydrogenase (NAD+ dependent), methenyltetrahydrofolate cyclohydrolase (MTHFD2), nuclear gene encoding mitochondrial protein, mRNA/cds = (76, 1110) | 1 | CAGCAGCTGCCTGCTTTTCTGTGATG TATGTATCCTGTTGACTTTTCCAG |
| 3736 | Table 3A | Hs.14601 | X16663 | 32054 | hematopoietic cell-specific Lyn substrate 1 (HCLS1), mRNA/cds = (42, 1502) | 1 | TCCCTGAAGAAATATCTGTGAACCTT CTTTCTGTTCAGTCCTAAAATTCG |
| 3737 | Table 3A | Hs.176663 | X16883 | 31321 | leukocyte IgG receptor (Fc-gamma-R) mRNA, complete cds/cds = (17, 718) | 1 | ATGGGAGTAATAAGAGCAGTGGCAG CAGCATCTCTGAACATTTCTCTGGA |
| 3738 | Table 3A | Hs.271986 | X17033 | 33906 | integrin, alpha 2 (CD49B, alpha 2 subunit of VLA-2 receptor) (ITGA2), mRNA/cds = (42, 3587) | 1 | ACCCATTTCTACTTTTTGCACCTTATT TTCTCTGTTCCTGAGCCCCCACA |
| 3739 | Table 3A | Hs.1908 | X17042 | 32432 | proteoglycan 1, secretory granule (PRG1), mRNA/cds = (24, 500) | 1 | TGTGTTTGCAGAGCTAGTGGATGTGT TTGTCTACAAGTATGATTGCTGTT |
| 3740 | Table 3A | Hs.342863 | X17094 | 31477 | Ig48108.x1 cDNA, 3' end/clone = IMAGE:2112035/clone_end = 3' | 1 | GGCCCAGCATTGCTGGTTCTATTTAA TGGACATGAGATAATGTTAGAGGT |
| 3741 | Table 3A | Hs.198951 | X51345 | 34014 | jun B proto-oncogene (JUNB), mRNA/cds = (253, 1296) | 1 | TGAATATAAATATATTTGTGTATTTAAC AGGGAGGGGAAGAGGGGGCGATC |
| 3742 | Table 3A | Hs.3288 | X51757 | 35221 | heat shock 70kD protein 6 (HSP70B') (HSPA6), mRNA/cds = (0, 1931) | 1 | TGGCACTTTAACATTGCTTTCACCTAT ATTTTGTGTACTTTGTTACTTGC |
| 3743 | Table 3A | Hs.76053 | X52104 | 35219 | DEAD/H (Asp—Glu—Ala—Asp/His) box polypeptide 5 (RNA helicase, 68kD) (DDX5), mRNA/cds = (170, 2014) | 1 | AGTAAATGTACAGTGATTTGAAATAC AATAATGAAGGCAATGCATGGCCT |
| 3744 | Table 3A | Hs.323098 | X52142 | 30292 | cDNA:FLJ23458 fis, clone HIS107327/cds = UNKNOWN | 1 | CTTAATGTGACCTAGCAATAGGCATA GCTACGTGGCACTATATTCTGGCC |
| 3745 | literature | Hs.99987 | X52221 | 31215 | ERCC2 gene, exons 1 & 2 (partial)/cds = UNKNOWN | 1 | AGGAGCACCTCACAGATGCCAACCT CAACCTGACCGTGGACGAGGGTGTC |

TABLE 8-continued

| SEQ ID | Origin | Unigene | Locus | GI | Nominal Description | Strand | Probe Sequence |
|---|---|---|---|---|---|---|---|
| 3746 | Table 3A | Hs.278544 | X52882 | 311380 | acetyl-Coenzyme A acetyltransferase 2 (acetoacetyl Coenzyme A thiolase) (ACAT2), mRNA/cds = (37, 1230) | 1 | CCACGACTTCTGCCCATTCTCTCCAG TGTGTGTAACAGGGTCACAAGAAT |
| 3747 | Table 3A | Hs.85266 | X53587 | 33950 | integrin, beta 4 (ITGB4), mRNA/cds = (126, 5384) | 1 | GGCCCAAACCTATTTGTAACCAAAGA GCTGGGAGCAGCACAAGGACCCAG |
| 3748 | Table 3A | Hs.117950 | X53793 | 28383 | multifunctional polypeptide similar to SAICAR synthetase and AIR carboxylase (ADE2H1), mRNA/cds = (24, 1301) | 1 | GCGAGCAAGCATTTTGAACACATGGA TTTCCTTGAAGCAGGCTGACAAGA |
| 3749 | Table 3A | NA | X53795 | 35832 | R2 mRNA for an inducible membrane protein | 1 | TCGGATGGGCTGTTTAGATGTTATAT AATCCACAAAAGGTTCATTGAGCT |
| 3750 | Table 3A | Hs.105938 | X53961 | 34415 | lactotransferrin (LTF), mRNA/cds = (294, 2429) | 1 | GGATTGCCCATCCATCTGCTTACAAT TCCCTGCTGTCGTCTTAGCAAGAA |
| 3751 | Table 3A | Hs.55921 | X54326 | 31957 | glutamyl-prolyl-tRNA synthetase (EPRS), mRNA/cds = (58, 4380) | 1 | AAAATGAAGTCACACAGGACAATTAT TCTTATGCCTAAGTTAACAGTGGA |
| 3752 | Table 3A | Hs.789 | X54489 | 34625 | GRO1 oncogene (melanoma growth stimulating activity, alpha) (GRO1), mRNA/cds = (79, 402) | 1 | GCCTTGTTTAATGGTAGTTTTACAGT GTTTCTGGCTTAGAACAAAGGGGC |
| 3753 | Table 3A | Hs.74085 | X54870 | 35062 | DNA segment on chromosome 12 (unique) 2489 expressed sequence (D12S2489E), mRNA/cds = (338, 988) | 1 | AGTGCCTTCCCTGCCTGTGGGGGTC ATGCTGCCACTTTTAATGGGTCCTC |
| 3754 | Table 3A | Hs.83758 | X54942 | 29978 | CDC28 protein kinase 2 (CKS2), mRNA/cds = (95, 334) | 1 | TTCCAGTCAGTTTTTCTCTTAAGTGCC TGTTTGAGTTTACTGAAACAGTT |
| 3755 | Table 3A | Hs.283330 | X56733 | 8924082 | hypothetical protein PRO1843 (PRO1843), mRNA/cds = (964, 1254) | 1 | TCCAATGCAGTCCCATTCTTTATGGC CTATAGTCTCACTCCCAACTACCC |
| 3756 | Table 3A | Hs.312670 | X55740 | 23896 | xn42c03.x1 cDNA, 3' end/clone = IMAGE:2696356/clone_end = 3' | 1 | TGGTATAAGAAATGACTTTGAACCAC TTTGCAATTGTAGATTCCCAACAA |
| 3757 | Table 3A | Hs.85112 | X57025 | 33007 | IGF-I mRNA for insulin-like growth factor I/cds = (166, 627) | 1 | CCCCTGCTACTTTGAAACCAGAAAAT AATGACTGGCCATTCGTTACATCT |
| 3758 | Table 3A | Hs.279920 | X57346 | 23113 | tyrosine 3-monooxygenase/tryptophan 5-monooxygenase activation protein, beta polypeptide (YWHAB), mRNA/cds = (372, 1112) | 1 | TGATCTGTCCAGTGTCACTCTGTACC CTCAACATATATCCCTTGTGCGAT |
| 3759 | Table 3A | Hs.74405 | X57347 | 32463 | tyrosine 3-monooxygenase/tryptophan 5-monooxygenase activation protein, beta polypeptide (YWHAQ), mRNA/cds = (100, 837) | 1 | AAAAGCCTTGTGAAAATGTTATG CCCCTATGTAACAGCAGAGTAACA TAAA |
| 3760 | Table 3A | Hs.289110 | X57809 | 33714 | rearranged immunoglobulin lambda light chain mRNA/cds = (9, 710) | 1 | CCACCACGGGAGACTAGAGCTGCAG GATCCCGGGGGAGGGGTCTCTCCTC |
| 3761 | Table 3A | Hs.289110 | X57812 | 33723 | rearranged immunoglobulin lambda light chain mRNA/cds = (9, 710) | 1 | CAGTGGAAGTCCCACAGAAGCTACA GCTGCCAGGTCACGCATGAAGGGAG |
| 3762 | Table 3A | Hs.302063 | X58529 | 33480 | rearranged immunoglobulin mRNA for mu heavy chain enhancer and constant region/cds = UNKNOWN | 1 | CCCACACTGCTTTGCTGTGTATACGC TTGTTGCCCTGAAATAAATATGCA |
| 3763 | Table 3A | Hs.302063 | X58529 | 33480 | rearranged immunoglobulin mRNA for mu heavy chain enhancer and constant region/cds = UNKNOWN | 1 | CCCACACTGCTTTGCTGTGTATACGC TTGTTGCCCTGAAATAAATATGCA |
| 3764 | Table 3A | Hs.155101 | X59066 | 28937 | Homo sapiens ATP synthase, H+ transporting, mitochondrial F1 complex, alpha subunit, isoform 1, cardiac muscle | 1 | ACAAATTTCTTGGCTGGATTTGAAGC TTAAACTCCTGTGGATTCACATCA |
| 3765 | Table 3A | Hs.83532 | X59405 | 34508 | H. sapiens, gene for Membrane cofactor protein/cds = UNKNOWN | 1 | AGAGACCAGTTTTCTCTGGAAGTTG TTTAAATGACAGAAGCGTATATGA |
| 3766 | literature | Hs.861 | X60188 | 31220 | ERK1 mRNA for protein serine/threonine kinase/cds = (72, 1211) | 1 | CGCCCCTGCCACCTCCCTGACCCGT CTAATATATAAATATAGAGATGTGT |
| 3767 | Table 3A | Hs.81634 | X60221 | 509290 | ATP synthase, H+ transporting, mitochondrial F0 complex, subunit b, isoform 1 (ATP5F1), mRNA/cds = (32, 802) | 1 | GCCAGTCAGATGTTTCTCATCCTTCT TGCTCTGCCTTTGAGTTGTTCCGT |
| 3768 | Table 3A | Hs.44926 | X60708 | 35335 | dipeptidylpeptidase IV (CD26, adenosine deaminase complexing protein 2) (DPP4), mRNA/cds = (75, 2375) | 1 | AAATACTGATGTTCCTAGTGAAAGAG GCAGCTTGAAACTGAGATGTGAAC |
| 3769 | Table 3A | Hs.81226 | X60992 | 29817 | CD6 mRNA for T cell glycoprotein CD6/cds = (120, 1526) | 1 | AGAAGCTGCACTAGGCCCCGAGTCC CCATGTGTCTCCTTGAATTGATGAG |
| 3770 | Table 3A | Hs.77054 | X61123 | 29508 | B-cell translocation gene 1, anti-proliferative (BTG1), mRNA/cds = (308, 823) | 1 | AAGTCTTTTCCACAAACCACCATCTAT TTTGTGAACTTTGTTAGTCATCT |
| 3771 | Table 3A | Hs.76913 | X61970 | 296739 | proteasome (prosome, macropain) subunit, alpha type, 5 (PSMA5), mRNA/cds = (21, 746) | 1 | AAATTTTATTTCCAGCTCCTGTTCCTT GGAAAATCTCCATTGTATGTGCA |
| 3772 | Table 3A | Hs.276770 | X62466 | 29645 | CDW52 antigen (CAMPATH-1 antigen) (CDW52), mRNA/cds = (24, 209) | 1 | CCTGAAACAGCTGCCACCATCACTCG CAAGAGAATCCCCTCCATCTTTGG |
| 3773 | Table 3A | Hs.80684 | X82534 | 32332 | high-mobility group (nonhistone | 1 | TTCTGTGTGTATGGTAGCACAGCAAA |

TABLE 8-continued

| SEQ ID | Origin | Unigene | Locus | GI | Nominal Description | Strand | Probe Sequence |
|---|---|---|---|---|---|---|---|
| | | | | | chromosomal) protein 2 (HMG2), mRNA/cds = (190, 819) | | CTTGTAGGAATTAGTATCAATAGT |
| 3774 | Table 3A | Hs.172690 | X62535 | 30822 | diacylglycerol kinase, alpha (80kD) (DGKA), mRNA/cds = (103, 2310) | 1 | ACACACATACACACACCCCAAAACAC ATACATTGAAAGTGCCTCATCTGA |
| 3775 | Table 3A | Hs.77522 | X62744 | 36062 | major histocompatibility complex, class II, DM alpha (HLA-DMA), mRNA/cds = (45, 830) | 1 | GATCTCCTCTTAGGGTAGAAGAAGTC TCTGGGACATCCCTGGGGTGTGTG |
| 3776 | Table 3A | Hs.296014 | X63563 | 36121 | polymerase (RNA) II (DNA directed) polypeptide B (140kD) (POLR2B), mRNA/cds = (43, 3567) | 1 | GGCTGCCGCAATAAAACCCAGATTTC TTTGGTGCGAATGCCTTACGCATG |
| 3777 | Table 3A | Hs.82359 | X53717 | 28741 | tumor necrosis factor receptor superfamily, member 6 (TNFRSF6), mRNA/cds = (220, 1227) | 1 | TCATCATCTGGATTTAGGAATTGCTC TTGTCATACCCCCAAGTTTCTAAG |
| 3778 | db mining | Hs.2490 | X65019 | 33792 | caspase 1, apoptosis-related cysteine protease (interleukin 1, beta, convertase) (CASP1), mRNA/cds = (0, 1151) | 1 | TGCCCACCACTGAAAGAGTGACTTTG ACAAGATGTTTCTACCTCTTCCCA |
| 3779 | Table 3A | Hs.75248 | X68060 | 37230 | topoisomerase (DNA) II beta (180kD) (TOP2B), mRNA/cds = (0, 4865) | 1 | TTTGATCAGGATTCAGATGTGGACAT CTTCCCCTCAGACTTCCCTACTGA |
| 3780 | Table 3A | Hs.652 | X68550 | 37269 | tumor necrosis factor (ligand) superfamily, member 5 (hyper-IgM syndrome) (TNFSF5), mRNA/cds = (39, 824) | 1 | TCTACCTGCAGTCTCCATTGTTTCCA GAGTGAACTTGTAATTATCTTGTT |
| 3781 | Table 3A | Hs.116774 | X68742 | 33949 | mRNA for integrin, alpha subunit/cds = UNKNOWN | 1 | CGGATTGTTGCTGTTAATGCTGCTCA TTTTAGCACTGTGGAAGATTGGAT |
| 3782 | Table 3A | Hs.77502 | X68836 | 36326 | Homo sapiens, methionine adenosyltransferase II, alpha, clone MGC:4537 IMAGE:3010820, mRNA, complete cds/cds = (116, 1303) | 1 | TAGAGATTGTGAAGAAGAATTTCGAT CTCCGCCCTGGGGTCATTGTCAGG |
| 3783 | Table 3A | Hs.192760 | X69392 | 36114 | kinesin family member 5A (KIF5A), mRNA/cds = (148, 3246) | 1 | CTCCTGTTGGGTAAGGGTGTTGAGTG TGACTTGTGCTGAAAACCTGGTTC |
| 3784 | Table 3A | Hs.83715 | X69804 | 1015499 | Sjogren syndrome antigen B (autoantigen La) (SSB), mRNA/cds = (72, 1298) | 1 | AAAAGGAAAACCGAATTAGGTCCACT TCAATGTCCACCTGTGAGAAAGGA |
| 3785 | Table 3A | Hs.309952 | X69819 | 32627 | mRNA; cDNA DKFZp434E0516 (from clone DKFZp434E0516)/cds = UNKNOWN | 1 | GGAAGAACCGTCCAGAGCTGAGTGA CGCTGGGATCCGGGATCAAAGTTGG |
| 3786 | Table 3A | Hs.170009 | X70340 | 37069 | transforming growth factor, alpha (TGFA), mRNA/cds = (31, 513) | 1 | TGTGCATTGTTATTGAGTTGTACTGTA CCTTATTTGGAAGGATGAAGGAA |
| 3787 | Table 3A | Hs.180610 | X70944 | 38457 | splicing factor proline/glutamine rich (polypyrlmidine tract-binding protein-associated) (SFPQ), mRNA/cds = (85, 2208) | 1 | CCCATTTCTTGTTTTTAAAAGACCAAC AAATCTCAAGCCCTATAAATGGC |
| 3788 | Table 3A | Hs.106876 | X71490 | 313011 | Homo sapiens, clone MGC:15351 IMAGE:4126712, mRNA, complete cds/cds = (87, 1142) | 1 | AGAAGCATGTCACTTTCATGTTCCTC CCTAACTCCCTGACCTGAGAACCC |
| 3789 | Table 3A | Hs.251526 | NM_006273 | 13435401 | gene for monocyte chemotactic protein 3 (MCP-3)/cds = (0, 329) | 1 | GGATGCTCCTCCCTTCTCTACCTCAT GGGGGTATTGTATAAGTCCTTGCA |
| 3790 | Table 3A | Hs.156110 | X72475 | 441418 | cDNA:FLJ21321 fis, clone COL02335, highly similar to HSA010442 mRNA for immunoglobulin kappa light chain/cds = UNKNOWN | 1 | GCACCATCTGTCTTCATCTTCCGCCA TCTGATGAGCAGTTGAAATCTGGA |
| 3791 | Table 3A | Hs.156110 | X72475 | 441418 | cDNA:FLJ21321 fis, clone COL02335, highly similar to HSA010442 mRNA for immunoglobulin kappa light chain/cds = UNKNOWN | 1 | GCACCTCTGTCTTCATCTTCCGCCA TCTGATGAGCAGTTGAAATCTGGA |
| 3792 | Table 3A | Hs.79081 | X74008 | 402777 | protein phosphatase 1, catalytic subunit, gamma isoform (PPP1CC), mRNA/cds = (154, 1125) | 1 | AAAAGAAATCTGTTTCAACAGATGAC CGTGTACAATACCGTGTGGTGAAA |
| 3793 | Table 3A | Hs.331328 | X74262 | 397375 | intermediate filament protein syncoilin (SYNCOILIN), mRNA/cds = (168, 623) | 1 | GGCCTGTTACTCTCCATGACTAACTG TGTAAGTGCTTAAAATGGAATAAA |
| 3794 | Table 3A | Hs.1708 | X74801 | 671526 | chaperonin containin TCP1, subunit 3 (gamma) (CCT3), mRNA/cds = (0, 1634) | 1 | GGCAGCCCCCAGTCCCTTTCTGTCC CAGCTCAGTTTTCCAAAAGACACTG |
| 3795 | Table 3A | Hs.44313 | X75042 | 402648 | v-rel avian reticuloendotheliosis viral oncogene homolog (REL), mRNA/cds = (177, 2036) | 1 | TCTTGATACCACCTATATAGATGCAG CATTTTGTATTTGTCTAACTGGGG |
| 3796 | Table 3A | Hs.73965 | X75755 | 455418 | splicing factor, arginine/serine-rich 2 (SFRS2), mRNA/cds = (155, 820) | 1 | CGGGCCTTGCATATAAATAACGGAGC ATACAGTGACCACATCTAGCTGAT |
| 3797 | Table 3A | Hs.74637 | X75861 | 456258 | testis enhanced gene transcript (TEGT), mRNA/cds = (40, 753) | 1 | CTGTGCTTTTTGCTTGGGATAATGGA GTTTTTCTTTAGAAACAGTGCCAA |
| 3798 | Table 3A | Hs.79362 | X75918 | 415822 | p130 mRNA for 130K protein/cds = (69, 3488) | 1 | TTGAGGGGATTAATATGAAAACTTAT GACCTCTTCCTTTAGGAGGGAGTT |
| 3799 | Table 3A | Hs.79362 | X76061 | 416030 | p130 mRNA for 130K protein/cds = (69, 3488) | 1 | TGTTAAAACCCCTATAGCCACCTTTT GGGAATGTTTTAAATTCTCCAGTT |
| 3800 | Table 3A | Hs.83347 | X76302 | 431952 | angio-associated, migratory cell | 1 | TGGCAGGCGTCAACCCCATTTTATTT |

TABLE 8-continued

| SEQ ID | Origin | Unigene | Locus | GI | Nominal Description | Strand | Probe Sequence |
|---|---|---|---|---|---|---|---|
| 3801 | Table 3A | Hs.85226 | X76488 | 434305 | protein (AAMP), mRNA/cds = (0, 1358) lipase A, lysosomal acid. cholesterol esterase (Wolman disease) (LIPA), mRNA/cds = (40, 1239) | 1 | GTCCTTATTCCTGTGGAAGCAGTA AATACACCTGCTTCACGTCCCTATGT TGGGAAGTCCATATTTGTCTGCTT |
| 3802 | Table 3A | Hs.334648 | X76770 | 556782 | PAP mRNA/cds = UNKNOWN | 1 | CAGGAAATGCAGCAACTTCAGGAAAT GCAGCAACAAAAATACCTACTCCT |
| 3803 | Table 3A | Hs.76136 | X77584 | 453963 | thioredoxin (TXN), mRNA/cds = (63, 380) | 1 | AAACCCAGTTGCCATCTGCGTGACAA TAAAACATTAATGCTAACACTTTT |
| 3804 | Table 3A | Hs.85155 | X79067 | 483524 | ERF-1 mRNA 3' end/cds = UNKNOWN | 1 | TGCTGTATTACTTCTGAAAAGACTGT GCAGTGTGTTAGTTGTTGGCTGAA |
| 3805 | Table 3A | Hs.153221 | X79201 | 531105 | synovial sarcoma translocation, chromosome 18 (SS18), mRNA/cds = (3, 1176) | 1 | GTGTATGAGAGAGAGAGTGTGTGTTT GTGTGTTTCAAGGTCAGAACAGGT |
| 3806 | Table 3A | Hs.179943 | X79234 | 495125 | ribosomal protein L11 (RPL11), mRNA/cds = (0, 538) | 1 | TGGTTCCAGCAGAAGTATGATGGGAT CATCCTTCCTGGCAAATAAATTCC |
| 3807 | Table 3A | Hs.74576 | X79353 | 695584 | GDP dissociation inhibitor 1 (GDI1), mRNA/cds = (80, 1423) | 1 | TGTCCCCTTCCCCACCCTCTAGTGTA TTTCACAGAAAACAAAACCTCCCA |
| 3808 | Table 3A | Hs.7957 | X79448 | 2326523 | adenosine deaminase, RNA-specific (ADAR), transcript variant ADAR-e, mRNA/cds = (187, 3867) | 1 | AGTCCAGTTTTATGATTCTGCTTTTAT GTGTCCCTTGATAACAGTGACTT |
| 3809 | Table 3A | Hs.249495 | X79536 | 496897 | heterogeneous nuclear ribonucleoprotein A1 (HNRPA1), transcript variant 2, mRNA/cds = (104, 1222) | 1 | AAACTCATCTGTCCAAGTTCGTGGCA GAAAGAACGTCCTTGTGAAGACC |
| 3810 | Table 3A | Hs.151134 | X80695 | 619490 | oxidase (cytochrome c) assembly 1-like (OXA1L), mRNA/cds = (0, 1487) | 1 | AGAGCACTGGGTAGCCAAGTGATCTT CCCATTCACAGAGTTAGTAAACCT |
| 3811 | Table 3A | Hs.77897 | X81789 | 551449 | splicing factor 3a, subunit 3, 60kD (SF3A3), mRNA/cds = (8, 1513) | 1 | CCCCCAGAGACCCCATTTGCCTCTCA ACACTCAGACCTTCAACTGTTTTT |
| 3812 | Table 3A | Hs.318501 | X82200 | 899299 | stimulated trans-acting factor (50 kDa) (STAF50), mRNA/cds = (122, 1450) | 1 | CCAGTGACACCCCATATTCATCACAA AATTAAAGCAAGAAGTCCATAGTA |
| 3813 | Table 3A | Hs.153961 | X82206 | 563882 | ARP1 (actin-related protein 1, yeast) homolog A (centractin alpha) (ACTR1A), mRNA/cds = (57, 1187) | 1 | TGACACCAAGACCCACCCCAATCCAG ACTTCACACAGTATTCTCCCCCAC |
| 3814 | Table 3A | Hs.289103 | X83300 | 603028 | SMA4 mRNA/cds = (66, 488) | 1 | GACTGCAAGTCACTCTTAGGGGCTGT ACTTCCTTAGTACTGGTAGCATTA |
| 3815 | Table 3A | Hs.160483 | X85116 | 1161561 | epb72 gene exon 1/cds = (61, 927) | 1 | AACTGAGCATCACGAACCCTGTTTGG CAGACTGAGGTCACGATGGAGGGG |
| 3816 | Table 3A | Hs.24143 | X86019 | 2760482 | Wiskott-Aldrich syndrome protein interacting protein (WASPIP), mRNA/cds = (108, 1619) | 1 | TCCTCCATTGAAGAAGAATGTCAACA AGAAAGGAAAAATAGACAAACTGG |
| 3817 | Table 3A | Hs.75410 | X87949 | 1143491 | mRNA for BiP protein/cds = (222, 2183) | 1 | AAGTCTCGAATGTAATTGGAATCTTC ACCTCAGAGTGGAGTTGAACTGCT |
| 3818 | Table 3A | Hs.2007 | X89102 | 887455 | tumor necrosis factor (ligand) superfamily member 6 (TNFSF6), mRNA/cds = (157, 1002) | 1 | CCATCGGTGAAACTAACAGATAAGCA AGAGAGATGTTTGGGGACTCATT |
| 3819 | Table 3A | Hs.180433 | X89602 | 1150420 | rTS beta protein (HSRTSBETA), mRNA/cds = (17, 1267) | 1 | ACAAAAATAGCTATATCAAGGGCTGG CACCTAGACATTAAACTGTACTTT |
| 3820 | Table 3A | Hs.13046 | X91247 | 1237037 | thioredoxin reductase 1 (TXNRD1), mRNA/cds = (439, 1932) | 1 | GTCCACCAGTCTCTGAAATTAGAACA GTAGGCGGTATGAGATAATCAGGC |
| 3821 | Table 3A | Hs.335328 | X91348 | 1418768 | predicted non coding cDNA (DGCR5)/cds = UNKNOWN | 1 | GAAATGTAGCTGGAGTCATCATTTAG CAGAGCACGGTGTCCCTGGGTTGG |
| 3822 | Table 3A | Hs.2726 | X92518 | 1225979 | mRNA for HMGI-C protein/cds = (848, 1177) | 1 | GCCTCTGTGATCCCCATGTGTTTTGA TTCCTGCTCTTTGTTACAGTTCCA |
| 3823 | Table 3A | Hs.78335 | X94232 | 1292887 | microtubulo-associated protein, RP/EB family, member 2 (MAPRE2), mRNA/cds = (112, 1095) | 1 | AAAACAAGAAACAAATGTGCCCACCC CACTTTCCGCTTAACTGAAAAGCT |
| 3824 | Table 3A | Hs.75841 | X94910 | 3413292 | chromosome 12 open reading frame 8 (C12orfB), mRNA/cds = (11, 796) | 1 | GTAAAAAGGCTGTCTGTGATTTTCCA GGGTTTGGTGGGGGTAGGGAGGGG |
| 3825 | Table 3A | Hs.3416 | X97324 | 1806039 | adipose differentiation-related protein (ADFP), mRNA/cds = (0, 1313) | 1 | CTGACTGAGTCTCAGAATGCTCAGGA CCAAGGTGCAGAGATGGACAAGAG |
| 3826 | Table 3A | Hs.100555 | X98743 | 1498228 | DEAD/H (Asp—Glu—Ala—Asp/His) box polypeptide 18 (Myc-regulated) (DDx18), mRNA/cds = (71, 2083) | 1 | AGCTTCTTGGGTTCCTAATTCCTGGT GTTTAATAATTCTCTCCACGATCA |
| 3827 | Table 3A | Hs.139262 | X99699 | 1869900 | XIAP associated factor-1 (HSXIAPAF1), mRNA/cds = (0, 953) | 1 | TACTTGCTGTGGTGGTCTTGTGAAAG GTGATGGGTTTATTCGTTGGGCT |
| 3828 | Table 3A | Hs.170121 | Y00062 | 34275 | protein tyrosine phosphatase receptor type, C (PTPRC), mRNA/cds = (66, 4000) | 1 | ATTTCCAGTGAGCTTATCATGCTGTC TTTACATGGGGTTTTCAATTTTGC |
| 3829 | Table 3A | Hs.51077 | Y00093 | 35175 | integrin, alpha X (antigen CD11C (p150), alpha polypeptide) (ITGAX), mRNA/cds = (58, 3549) | 1 | TGCAGCTCACCAGCCCCAGGGGCAG AAGAGACCCAACCACTTCCTATTTT |
| 3830 | Table 3A | Hs.169476 | Y00262 | 36048 | *Homo sapiens*, glyceraldehyde-3-phosphate dehydrogenase, clone MGC:10926 IMAGE:368129, mRNA, complete cds/cds = (2306, 3313) | 1 | ACTTACCCAGATGTTGCTTTTGAAAA GTTGAAATGTGTAATTGTTTTGGA |
| 3831 | Table 3A | Hs.76473 | Y00285 | 33054 | insulin-like growth factor 2 receptor | 1 | TGTATATAGACTCTGGTGTTCTATTG |

TABLE 8-continued

| SEQ ID | Origin | Unigene | Locus | GI | Nominal Description | Strand | Probe Sequence |
|---|---|---|---|---|---|---|---|
| 3832 | Table 3A | Hs.172182 | Y00345 | 35569 | (IGF2R), mRNA/cds = (147, 7622) poly(A)-binding protein, cytoplasmic 1 (PABPC1), mRNA/cds = (502, 2403) | 1 | CTGAGAAGCAAACCGCCCTGCAGC ATGTCAGTTCTGTTTTAAGTAACAGAA TTGATAACTGAGCAAGGAAACGT |
| 3833 | Table 3A | Hs.180414 | Y00371 | 32466 | hsc70 gene for 71 kd heat shock cognate protein | 1 | TTGGAGCTAAGCTGCCACCTGGTTAA TTAAGGTCCCAACAGTGAGTTGTG |
| 3834 | Table 3A | Hs.233950 | Y00503 | 34038 | serine protease inhibitor, Kunitz type 1 (SPINT1), mRNA/cds = (175, 1716) | 1 | CTTTGGAGGGTGTCTTCTGGGTAGAG GGATGGGAAGGAAGGGACCCTTAC |
| 3835 | Table 3A | Hs.75716 | Y00630 | 35267 | serine (or cysteine) proteinase inhibitor, clade B (ovalbumin), member 2 (SERPINB2), mRNA/cds = (72, 1319) | 1 | TGCCTTTAATTGTTCTCATAATGAAGA ATAAGTAGGTACCCTCCATGCCC |
| 3836 | Table 3A | Hs.79368 | Y07909 | 1542882 | epithelial membrane protein 1 (EMP1), mRNA/cds = (218, 691) | 1 | ATTTGCATTACTCTGGTGGATTGTTCT AGTACTGTATTGGGCTTCTTCGT |
| 3837 | Table 3A | Hs.113503 | Y08890 | 2253155 | Homo sapiens mRNA for Ran_GTP binding protein 5 (RanBP5(Importin5) gene)/cds = (236, 3529) | 1 | TTTGGCTTAGTGTTTTCATTGCAAATT ATAATTGCTGTAGAGCCACACAC |
| 3838 | Table 3A | Hs.227817 | Y09397 | 1694788 | BCL2-related protein A1 (BCL2A1), mRNA/cds = (183, 710) | 1 | TTGATGATGTAACTTGACCTTCCAGA GTTATGGAAATTTTGTCCCCATGT |
| 3839 | Table 3A | Hs.43913 | Y09631 | 3925684 | PIBF1 gene product (PIBF1), mRNA/cds = (0, 2276) | 1 | AACAAAAGATGAAGACCTAGTGTTTT GGATGGGAAGCACCTGTAGACCAT |
| 3840 | Table 3A | Hs.44499 | Y09703 | 4581462 | pinin, desmosome associated protein (PNN), mRNA/cds = (30, 2261) | 1 | ACATGTGCAAATAAATGTGGCTTAGA CTTGTGTGACTGCTTAAGACTAAA |
| 3841 | Table 3A | Hs.47007 | Y10256 | 1841433 | mitogen-activated protein kinase kinase kinase 14 (MAP3K14), mRNA/cds = (232, 3075) | 1 | TCTGGGTTGTAGAGAACTCTTTGTAA GCAATAAAGTTTGGGGTGATGACA |
| 3842 | Table 3A | Hs.7879 | Y10313 | 2708510 | interferon-related developmental regulator 1 (IFRD1), mRNA/cds = (219, 1580) | 1 | CGAACCAAAGCTAGAAGCAAATGTCG AGATAAGAGAGCAGATGTTGGAGA |
| 3843 | Table 3A | Hs.51957 | Y11251 | 1848180 | splicing factor, arginine/serine-rich 2, interacting protein (SFRS2IP), mRNA/cds = (1210, 4656) | 1 | CACTCTTCACCTATTGTATGACCAAAT AAAGGTTATGCTGCTTGTTACGC |
| 3844 | Table 3A | Hs.129953 | Y11289 | 2808510 | Ewing sarcoma breakpoint region 1 (EWSR1), transcript variant EWS, mRNA/cds = (43, 2013) | 1 | TGCTAGGTGATGGAGTAGAAATGGAT TCCCTCTGGGAATGGTTTCTTGGT |
| 3845 | Table 3A | Hs.106019 | Y13247 | 2117158 | protein phosphatase 1, regulatory subunit 10 (PPP1R10), mRNA/cds = (539, 3361) | 1 | TATGAAAACAGTGGATTGGTTGGGTT TTGTGCAGGGTCTTGGGTTAGAGC |
| 3846 | Table 3A | Hs.16530 | Y13710 | 2326515 | small inducible cytokine subfamily A (Cys—Cys), member 18, pulmonary and activation-regulated (SCYA16), mRNA/cds = (70, 339) | 1 | TGCATGGATCAATCAGTGTGATTAGC TTTCTCAGCAGACATTGTGCCATA |
| 3847 | Table 3A | Hs.17883 | Y13936 | 2315201 | protein phosphatase 1G (formerly 2C), magnesium-dependent, gamma isoform (PPM1G), mRNA/cds = (24, 1664) | 1 | CTCATCACCGGTTCTGTGCCTGTGCT CTGTTGTGTTGGAGGGAAGGACTG |
| 3848 | Table 3A | Hs.195175 | Y14039 | 2653415 | mRNA for CASH alpha protein/cds = (481, 1923) | 1 | GCAGCACACTCTGAGAAAGAAACTTA TCCTCTCCTACACATAAGAAACCA |
| 3849 | Table 3A | Hs.227913 | Y15906 | 5327056 | API5-like (API5L1), mRNA/cds = (132, 1646) | 1 | TGCAAGCACACCTGTTTATCATCTTGTT TAAATGTAAATGTCCCCTTATGC |
| 3850 | Table 3A | Hs.85951 | Y16414 | 2924334 | exportin, tRNA (nuclear export receptor for tRNAs) (XPOT), mRNA/cds = (0, 2888) | 1 | TCAACGCCAATATGTATTCTACAAAA GAGAATGGTTTAGGCTCCAGTGT |
| 3851 | Table 3A | Hs.271387 | Y16645 | 2916795 | mRNA for monocyte chemotactic protein-2/cds = (472, 771) | 1 | TGGATCATCAAGGTGAAACACTTTGG TATTCTTTGGCAATCAGTGCTCCT |
| 3852 | Table 3A | Hs.337737 | Y17829 | 4128042 | Homer, neuronal immediate early gene, 1B (SYN47), mRNA/cds = (75, 1139) | 1 | GATACACTGTCTCTCTTCATAGGACT GTTTAGGCTCTGCATCAAGATTGC |
| 3853 | Table 3A | Hs.247792 | Z00013 | 33149 | germline gene for the leader peptide and variable region of a kappa immunoglobulin (subgroup V kappa I) | 1 | AAGGCAGGGATCATGACACCTGAGG AGTCTAGTTTATGGCTTCAGTTGGA |
| 3854 | Table 3A | Hs.173936 | Z17227 | 393378 | mRNA for transmembrane receptor protein/cds = (43, 1020) | 1 | ATGGATGGACTGATCTGAAAATCGAC CTCAACTCAAGGGTGGTCAGCTCA |
| 3855 | Table 3A | Hs.211577 | Z22551 | 296163 | kinectin 1 (kinesin receptor) (KTN1), mRNA/cds = (83, 3985) | 1 | TGCTAATGTAATCGGTTTTTGTAATG GCGTCACAAATAAAAGGATGCTTA |
| 3856 | Table 3A | Hs.82401 | Z22578 | 397938 | CD69 antigen (p60, early T-cell activation antigen) (CD69), mRNA/cds = (81, 680) | 1 | TGCAAGACATAGAATAGTGTTGGAAA ATGTGCAATATGTGATGTGGCAAA |
| 3857 | Table 3A | Hs.74078 | Z22970 | 312145 | mRNA for M130 antigen cytoplasmic variant 2/cds = (101, 3571) | 1 | AAGTTTGTGAATGTGACTACTTAGTG GTGTATATGAGACTTTCAAGGGAA |
| 3858 | Table 3A | Hs.146381 | Z23064 | 3256006 | RNA binding motif protein, X chromosome (RBMX), mRNA/cds = (11, 1186) | 1 | CCATTTTGCCTTTCTGACATTTCCTTG GGAATCTGCAAGAACCTCCCCTT |
| 3859 | Table 3A | Hs.225160 | Z23090 | 433597 | hypothetical protein FLJ13102 (FLJ13102), mRNA/cds = (80, 1084) | 1 | CTGTGCCTCCCCGCCACCTGTGTG TTCTTTTGATACATTTATCTTCTGT |
| 3860 | Table 3A | Hs.4934 | Z24724 | 505034 | polyA site DNA/cds = UNKNOWN | 1 | TGTATATTTATGGTGGAGGTGGTTG GGAACTTTTAACAAAATGGGGTGT |
| 3861 | Table 3A | Hs.2236 | Z29067 | 479172 | nek3 mRNA for protein | 1 | TCCTTTGGAAACAGAATGAAGCAGAG |

TABLE 8-continued

| SEQ ID | Origin | Unigene | Locus | GI | Nominal Description | Strand | Probe Sequence |
|---|---|---|---|---|---|---|---|
| 3862 | Table 3A | Hs.109918 | Z35227 | 609016 | kinase/cds = (0, 1379) ras homolog gene family, member H (ARHH), mRNA/cds = (579, 1154) | 1 | GAAACTCTTAATACTTAAAATCGT TTGCCCAGGCCAGTTAGAAAATCCCT TGGGGAACTGTGATGAATATTCCA |
| 3863 | Table 3A | Hs.198427 | Z46378 | 587201 | hexokinase 2 (HK2), mRNA/cds = (1490, 4243) | 1 | CTAGTCATAGAAATACCTCATTCGCC TGTGGGAAGAGAAGGGAAGCCTCT |
| 3864 | Table 3A | Hs.171626 | Z47087 | 860989 | transcription elongation factor B (SIII), polypeptide 1-like (TCEB1L), mRNA/cds = (101, 592) | 1 | ATGTGGTAAAACCCAGAAAGCATCCA TCATGAATGCAAGATACTTTCAAT |
| 3865 | Table 3A | Hs.180877 | Z46950 | 761715 | clone PP781 unknown mRNA/cds = (113, 523) | 1 | TGCTTGATTAAGATGCCATAATAGTG CTGTATTTGCAGTGTGGGCTAAGA |
| 3866 | Table 3A | Hs.83465 | Z49995 | 895841 | homeo box D1 (HOXD1), mRNA/cds = (223, 1209) | 1 | TCTTCTGTTTCATCCTGCGGTTCTGG AACCAGATTTTGACTTGCGTGTCA |
| 3867 | Table 3A | Hs.78683 | Z72499 | 1545951 | ubiquitin specific protease 7 (herpes virus-associated) (USP7), mRNA/cds = (199, 3507) | 1 | CCTTCAGTTATACTTTCAATGACCTTT TGTGCATCTGTTAAGGCAAAACA |
| 3868 | | Hs.51077 | M81695 | 487829 | integrin, alpha X (antigen CD11C (p150), alpha polypeptide) (ITGAX), mRNA/cds = (58, 3549) | 1 | ATGCATCTACCGCTCCTTGGGAAATA ATCTGAAAGGTCTAAAAATAAAAA |
| 3869 | Table 3A | Hs.113029 | BF025727 | 10733439 | ribosomal protein S25 (RPS25), mRNA/cds = (63, 440) | 1 | CGCAAGAAGCAGGAAGAGGAAAGAG AAGAAAAGCACAACGGGGAAAGATA |
| 3870 | Table 3A | Hs.150675 | BF028489 | 10738201 | polymerase (RNA) II (DNA directed) polypeptide K (7.0kD) (POLR2K), mRNA/cds = (66, 242) | 1 | GTAGTGTGTTGCATCCCTCTCACCCT CTGATCTTCGTCAGTCGTGTCATG |
| 3871 | Table 3A | Hs.74170 | BF028896 | 10736608 | 602708243F1 cDNA, 5' end/clone = IMAGE:4844914/clone_end = 5' | 1 | GAGGGAAACCCGGTAATAGGCTGGG AGTAATCCACACACGTGCTAACATT |
| 3872 | Table 3A | Hs.199061 | BF029654 | 10737366 | p300/CBP-associated factor (PCAF), mRNA/cds = (458, 2956) | 1 | CACACACTGCTACGTGACGTACCACT ACTGCCAGCGCAGCACTAGCTCAC |
| 3873 | Table 3A | Hs.13268 | BF029796 | 10737508 | 602634117F1 cDNA, 5' end/clone = IMAGE:4779149/clone_end = 5' | 1 | GGATCGTGACACACCGGGTTACACA CTTTCCACACCGTAATTCCATCAAT |
| 3874 | Table 3A | Hs.149595 | BF029894 | 10737606 | 601557058F1 cDNA, 5' end/clone = IMAGE:3827172/clone_end = 5' | 1 | GGTTGCACCAAGGCTGCCTAGGAGA AGTGCCTGACTGGACTACCCCGATC |
| 3875 | Table 3A | Hs.118303 | BF030930 | 10738642 | 601558648F1 cDNA, 5' end/clone = IMAGE:3828706/clone_end = 5' | 1 | TCTGCCATCTGTCTATTTCCCAATTTT CCTTCTGACTGTTCCTTTCTCCT |
| 3876 | Table 3A | Hs.337988 | BF033741 | 10741453 | Homo sapiens, clone MGC:17431 IMAGE:2984883, mRNA, complete cds/cds = (1336, 1494) | 1 | CTGTGATATTTTGGTCATGGGCTGGT CTGGTCGGTTTCCCATTTGTCTGG |
| 3877 | Table 3A | Hs.144559 | BF036688 | 10744746 | 601459771F1 cDNA, 5' end/clone = IMAGE:3863248/clone_end = 5' | 1 | TACGACATTTGCGAAATTCGCTAAAA ACAAGGGGAGTTCACGCGGCCAT |
| 3878 | Table 3A | Hs.39457 | BF103848 | 10886287 | 602537152F1 cDNA, 5' end/clone = IMAGE:4656037/clone_end = 5' | 1 | GCGCAGGTTACCGGAACCCAAGGTC CTTTGAAATTCACAACTCTCTTTGG |
| 3879 | Table 3A | Hs.279009 | BF105172 | 10887698 | matrix Gla protein (MGP), mRNA/cds = (46, 357) | 1 | AGCTGTGGAAAGGGCAACCTGTGGT TTCTCTGTACTGGTGTTTAATGGGG |
| 3880 | Table 3A | Hs.95388 | BF107010 | 10889635 | 602619064F1 cDNA, 5' end/clone = IMAGE:4733030/clone_end = 5' | 1 | CACAAACACCCGCCCGAGCAACCAC AGACACAGGACACGACACCACACAC |
| 3881 | Table 3A | Hs.171595 | BF130300 | 10969340 | HIV TAT specific factor 1 (HTATSF1), mRNA/cds = (57, 2321) | 1 | AAAGGGTTACTTTTCAAACAGTCTC CTTTCGACCGGGGTCAGGGTGGCC |
| 3882 | Table 3A | Hs.129872 | BF131060 | 10970089 | sperm associated antigen 9 (SPAG9), mRNA/cds = (110, 2410) | 1 | GGTGGACAGTATAAGGCGGTTAAGAT CCGTTGATGGCGAAGGTGAGAATG |
| 3883 | Table 3A | Hs.75428 | BF131654 | 10970694 | superoxide dismutase 1, soluble (amyotrophic lateral sclerosis 1 (adult)) (SOD1), mRNA/cds = (0, 464) | 1 | GACAGAGCGAGTAGACGGGAGGCGG AGAAGGAAGAGGAGACGAGACGAGG |
| 3884 | Table 3A | Hs.9614 | BF131656 | 10970696 | nucleophosmin (nucleolar phosphoprotein B23, numatrin) (NPM1), mRNA/cds = (0, 884) | 1 | CAAGACACAGAGGCAACGGAGAGAC ACGCAGACAAGCAAGGCCACGGAAC |
| 3885 | Table 3A | NA | BF184881 | 11063302 | ESTs | 1 | AGGGATAGGATAATTACAGAGGTACT GAGACTCCTGGCGTGGGTGACTCT |
| 3886 | Table 3A | Hs.160954 | BF207290 | 11100876 | 602759615F1 cDNA, 5' end/clone = IMAGE:4895042/clone_end = 5' | 1 | CCCATCATGAAAAAACGCCTTAGGAG CCGAAGAAGAAAACCTCGGGAAAA |
| 3887 | Table 3A | Hs.78064 | BF214148 | 11107732 | ribosomal protein L27a (RPL27A), mRNA/cds = (22, 468) | 1 | GACACAGCGAGAGTCCAGGAACAGG CAGACAAGCGAGAAAGAGGAGAAGC |
| 3888 | Table 3A | Hs.169248 | BF214508 | 11108094 | 601845758F1 cDNA, 5' end/clone = IMAGE:4076510/clone_end = 5' | 1 | GTAGGAGGCGAGAAGGAAGAACAAG GCACACCGAAGGAGCAAGACCAGAC |
| 3889 | Table 3A | Hs.75968 | BF217687 | 11111273 | thymosin, beta 4, X chromosome (TMSB4X), mRNA/cds = (77, 211) | 1 | CAAGAAGCAGAAGCAGCAACCAGAG ACAGAGAGACAAACGCAGAACAACA |
| 3890 | Table 3A | Hs.111611 | BF219474 | 11113299 | ribosomal protein L27 (RPL27), mRNA/cds = (17, 427) | 1 | CAACAAGCAGACGAACAACAAC AAATATCAACGAGGCGCAGCAGCT CAAA |

TABLE 8-continued

| SEQ ID | Origin | Unigene | Locus | GI | Nominal Description | Strand | Probe Sequence |
|---|---|---|---|---|---|---|---|
| 3891 | Table 3A | Hs.112318 | BF237710 | 11151628 | cDNA FLJ14633 fis, clone NT2RP2000938/cds = UNKNOWN | 1 | AACACACAAGAGAAACATAACCACTA AATCACTACAAACACACACAGAAT |
| 3892 | Table 3A | Hs.182937 | BF242969 | 11158897 | peptidylprolyl isomerase A (cyclophilin A) (PPIA), mRNA/cds = (44, 541) | 1 | AAACGAATTCTTGCACTGAGAGTGTT CACAGCGCCACTTTCCTCCTCCTC |
| 3893 | Table 3A | Hs.171774 | BF243010 | 11156938 | hypothetical protein (HSPC016), mRNA/cds = (38, 232) | 1 | CGAGAAGCAGAAGATGACAGCAGAG CGAAAGCAGAGAACGAACAGACAAG |
| 3894 | Table 3A | Hs.296251 | BF243724 | 11157654 | programmed cell death 4 (neoplastic transformation inhibitor) (PDCD4), mRNA/cds = (84, 1493) | 1 | TTGGATTTATTAAAGTCCCTTTGGAA GTCTTCTACCATTACTGTAGACCA |
| 3895 | Table 3A | Hs.109697 | BF244603 | 11158534 | 601862620F1 cDNA, 5' end/clone = IMAGE:4080412/clone_end = 5' | 1 | TCACATACCCTATGCCGACTGAGTGG AACGAGCCGACTATCACACAGAGC |
| 3896 | Table 3A | Hs.294110 | BF245076 | 11159008 | 601863910F1 cDNA, 5' end/clone = IMAGE:4082235/clone_end = 5' | 1 | CACATGCGCAATAAACCCCGGCGAAG ACGCCACTCTGCGGCAAAGGACACA |
| 3897 | Table 3A | Hs.182825 | BF245224 | 11159156 | ribosomal protein L35 (RPL35), mRNA/cds = (27, 398) | 1 | CCGCAGACACGAAAGCACCAACCAC CGACCGCCACCAGAAGGAACAACAG |
| 3898 | Table 3A | Hs.199248 | BF245892 | 11159734 | prostagtandin E receptor 4 (subtype EP4) (PTGER4), mRNA/cds = (388, 1854) | 1 | GGGCACTTAAATGGTCACCTGTGTAA CAGTTTGGTGTAACTCCCAGTGAT |
| 3899 | Table 3A | Hs.108124 | BF303895 | 11250572 | cDNA:FLJ23088 fis, clone LNG07026/cds = UNKNOWN | 1 | ACAACACGAAAACGAACAAGCA AAGAAAGAAAACGGACACGAGCGA ACCA |
| 3900 | Table 3A | Hs.296251 | BF303931 | 11250608 | programmed cell death 4 (neoplastic transformation inhibitor) (PDCD4), mRNA/cds = (84, 1493) | 1 | TTGGATTTATTAAAGTCCCTTTGGAA GTCTTCTACCATTACTGTAGACCA |
| 3901 | Table 3A | NA | BF306204 | 11253289 | cDNA clone IMAGE:4138980 5' | 1 | CAGCCATGTCCATGACAACCAGAGC CTGGGAGGAGCTGGATGGCGGCCTG |
| 3902 | Table 3A | Hs.5174 | BF307213 | 11254322 | ribosomal protein S17 (RPS17), mRNA/cds = (25, 432) | 1 | AAACACACAGCAAGAACCACGA AAAGAGCAACCCAAAATAGGAAAA GCGG |
| 3903 | Table 3A | Hs.84883 | BF307871 | 11255039 | mRNA for KIAA0864 protein, partial cds/cds = (0, 3856) | 1 | ACAGCGTGGATATAAGGACCAAGAG ACTAGGGCGCATACTATGATTCGCA |
| 3904 | Table 3A | Hs.63906 | BF309911 | 11257388 | hypothetical protein MGC14726 (MGC14726), mRNA/cds = (21, 653) | 1 | ATGGACACGAGGACGGAACTGGGGG TACTAGAACAACCCTTCTCTGAAAA |
| 3905 | Table 3A | Hs.292457 | BF310168 | 11257703 | Homo sapiens, clone MGC:16362 IMAGE:3927795, mRNA, complete cds/cds = (498, 635) | 1 | AGACCAAACGAGAAGGAGAAAAAGC AAGACCACAAAAGACAACAACAGCG |
| 3906 | Table 3A | NA | BF313856 | 11261925 | 601902261F1 5' end/clone = IMAGE:4134998 | 1 | AAAAAATCGGGCTTTTTCTGGGGGAA AGGGAAGGGCGGGGAATGCTGGCC |
| 3907 | Table 3A | NA | BF315059 | 11263244 | 601899090F1 5' end/clone = IMAGE:4128334 | 1 | CTACAACAATACAGCACACAGCATAA GCGCACAGGGCATAGACTAGGCAA |
| 3908 | Table 3A | Hs.99858 | BF315159 | 11263380 | ribosomal protein L7a (RPL7a), mRNA/cds = (31, 831) | 1 | CAAGAGAGTGGGAGACGAGTACGCGA GAACGCACGACACAGAGCGCAAGAA |
| 3909 | Table 3A | Hs.268177 | BF339088 | 11285508 | phospholpase C, gamma 1 (formerly subtype 148) (PLCG1), mRNA/cds = (76, 3948) | 1 | TCTGCTGCCCTCTTAAGATCTGACTG CCAAATAAATCATCCTCATGTCCT |
| 3910 | Table 3A | Hs.296317 | BF340402 | 11286776 | mRNA for KIAA1789 protein, partial cds/cds = (3466, 4899) | 1 | GATGAGAAACAACCACAAGGAAGAG GGCAGCGCCGGAGACCTACAGAAAG |
| 3911 | Table 3A | Hs.116567 | BF341330 | 11287821 | 602013274F1 cDNA, 5' end/clone = IMAGE:4149066/clone_end = 5' | 1 | GCGGGGGCACTGGCTCTTCACATTT GGTTGCGAGTTGCACACACCACAAC |
| 3912 | Table 3A | Hs.2554 | BF341359 | 11287850 | sialyltransferase 1 (beta-galactoside alpha-2,6-sialyltransferase) (SIAT1), mRNA/cds = (310, 1530) | 1 | GGGGGAAGCGGAAGGGTTGGATTGG GTGAAAAAAGAATTGTTCGTGTTTA |
| 3913 | Table 3A | Hs.28788 | BF341640 | 11288136 | 602016073F1 cDNA, 5' end/clone = IMAGE:4151706/clone_end = 5' | 1 | ATAATAGAGGAGAGATATTGTAAATA GAGACTGGCAGCAGTTTCCACAAA |
| 3914 | Table 3A | Hs.33905 | BF342246 | 11289148 | 602041247F1 cDNA, 5' end/clone = IMAGE:4179250/clone_end = 5' | 1 | AGTGGCAGGTGCAATTGTCGGTTCG ATTTGTGTTCCCAACAGTCTGAAAT |
| 3915 | Table 3A | Hs.127863 | BF342439 | 11289452 | 601898969F1 cDNA, 5' end/clone = IMAGE:4128112/clone_end = 5' | 1 | GAGCCCACGGGGAAGGGAACCCAGC AACACGGAAATAAGTTGGACCGATC |
| 3916 | Table 3A | Hs.205442 | BF377518 | 11339543 | 601439689F1 cDNA, 5' end/clone = IMAGE:3924407/clone_end = 5' | 1 | ACAACCTGAGAAATAATTCGGTCAAT ACCAGACTCCAACATTCCTGATCT |
| 3917 | Table 3A | Hs.319825 | BF380732 | 11389857 | 602021477F1 cDNA, 5' end/clone = IMAGE:4156915/clone_end = 5' | 1 | GTCTATTACAAAGTAAAGAGAGTCAA TTACTCCAGGAGGAGAATTGCAGG |
| 3918 | Table 3A | Hs.5174 | BF381953 | 11363256 | ribosomal protein S17 (RPS17), mRNA/cds = (25, 432) | 1 | ACCAGACACGGACACACACGAACAC AAGAAAACACAAAACAAGAGCAACC |
| 3919 | Table 3A | Hs.112237 | BF525720 | 11613081 | 602321076F1 cDNA, 5' end/clone = | 1 | CGGTTGGGTCCTCAAAATATGCCTGT TTGGTTAACAAAAGCGGTTGTGAA |

TABLE 8-continued

| SEQ ID | Origin | Unigene | Locus | GI | Nominal Description | Strand | Probe Sequence |
|---|---|---|---|---|---|---|---|
| 3920 | Table 3A | Hs.136537 | BF526066 | 11613527 | 602071176F1 cDNA, 5' end/clone = IMAGE:4424130/clone_end = 5' | 1 | GATAAAGAAGGGGCGCGGGAAACAG CGAGGGAAGGACGGGCTGGGAGAAC |
| 3921 | Table 3A | Hs.274472 | BF526421 | 11613784 | high-mobility group (nonhistone chromosomal) protein 1 (HMG1), mRNA/cds = (52, 699) | 1 | ATCTCTGGCAATACTGTCTGATTACG GGGGTGATGCCGACGGTTAAAAAC |
| 3922 | Table 3A | Hs.334825 | BF530382 | 11617745 | cDNA FLJ14752 fis, clone NT2RP3003071/cds = (205, 1446) | 1 | GAACACAAAAAACCTCTTCTATAACG GGGACACACGCCAAGGGGACAAGT |
| 3923 | Table 3A | Hs.255390 | BF531016 | 11616379 | 602072345F1 cDNA, 5' end/clone = IMAGE:4215251/clone_end = 5' | 1 | TTGGGTGCAACAACCAATACACTTAT ACTTGGAAACCACGGGCCATATTA |
| 3924 | Table 3A | Hs.146426 | BF569545 | 11642925 | pro-alpha-1 (V) collagen mRNA, complete cds/cds = (229, 5745) | 1 | AGGAGGAACAAAAACCGCAGCGTGG ATTTCAAATTTCTGGAAGTAAGTCT |
| 3925 | Table 3A | Hs.22265 | BF571362 | 11645074 | pyruvate dehydrogenase phosphatase (PDP), mRNA/cds = (131, 1855) | 1 | AAATTCGCGCACCCTTTGTTTTATTG CCCCGGTTACAAGGTTTTGAACTG |
| 3926 | Table 3A | Hs.301183 | BF572855 | 11646567 | molecule possessing ankyrin repeats induced by lipopolysaccharide (MAIL), homolog of mouse (MAIL), mRNA/cds = (48, 2204) | 1 | CGGGCCAGTATGAATGTAGGGTCAA GGAACGCCGAGGGTTTCACAAAAGG |
| 3927 | Table 3A | Hs.79530 | BF663116 | 11937011 | M5-14 protein (LOC51300), mRNA/cds = (186, 1043) | 1 | CTCAGTGTAGGGCAGAGAGGTCTAA CACCAACATAAGGTACTAGCAGTGT |
| 3928 | Table 3A | Hs.11356 | BF665055 | 11938950 | 602119856F1 cDNA, 5' end/clone = IMAGE:4276860/clone_end = 5' | 1 | AGAATATATGTATTTTGAAAGGAAAG GACTTGGGGATTTTTAACAGGGCA |
| 3929 | Table 3A | Hs.3585 | BF666961 | 11940856 | 602121608F1 cDNA, 5' end/clone = IMAGE:4278768/clone_end = 5' | 1 | GAGACTCTCGTTGTCTCCTCTTCTGC TCTCTTCTCTGTTGGAGGGGAGGA |
| 3930 | Table 3A | Hs.46877 | BF667821 | 11941516 | PRO2000 protein (PRO2000), mRNA/cds = (650, 1738) | 1 | AGGTTGTGGGGAGTATGTTTGGACCA AAAATTAAAATATTGTGGGAGGGA |
| 3931 | Table 3A | Hs.343615 | BF668050 | 11941945 | 602621493F1 cDNA, 5' end/clone = IMAGE:4755166/clone_end = 5' | 1 | GACCTTACCTGGTGGTTTTGTGGTTT GTTCTCCCGAAAAATGCGGGGTTT |
| 3932 | Table 3A | Hs.12035 | BF668230 | 11942125 | 602122419F1 cDNA, 5' end/clone = IMAGE:4279300/clone_end = 5' | 1 | CACCCTGGGTTTTAAAGTGTGGGAGA AAAGCGCCCGGAAGAAGGAAACAA |
| 3933 | Table 3A | Hs.324342 | BF688584 | 11942479 | 602123634F1 cDNA, 5' end/clone = IMAGE:4280408/clone_end = 5' | 1 | GAGGGGACCGGCCATCTGGGCAAGC AGATATGCTAATTGGGAATTATAGG |
| 3934 | Table 3A | Hs.285729 | BF670567 | 11944559 | 602013364F1 cDNA 5' end/clone = IMAGE:4149351/clone_end = 5' | 1 | ATGACTTGTGAATACCTGAGTTATAC TTTCCCAACAGATGTGCCTAACAC |
| 3935 | Table 3A | Hs.27590 | BF671020 | 11944915 | histone acetyltransferase (MORF), mRNA/cds = (315, 6536) | 1 | TGATAGCTCACTTAGTTAATTGTTTTG AAGCAAATTTTTGGGTTGGATGGG |
| 3936 | Table 3A | Hs.99858 | BF673951 | 11947846 | ribosomal protein L7a (RPL7A), mRNA/cds = (31, 831) | 1 | GACACAGAAGAGAGACAGAAGAGAA ACGGTCGAGGAGAAGAAGCAGGAGC |
| 3937 | Table 3A | Hs.96566 | BF673956 | 11947851 | 602137338F1 cDNA 5' end/clone = IMAGE:4274048/clone_end = 5' | 1 | AAAGACCAGAGACAGGGAGACACGG CAGACAGAGCGCCCACAAAGAAGAG |
| 3938 | Table 3A | Hs.181357 | BF676042 | 11949937 | laminin receptor 1 (87kD, ribosomal protein SA) (LAMR1), mRNA/cds = (85, 972) | 1 | CAAGGCGACATGGGAGAGCGAGAAG GCTAGGAGGACGACAGACAAGGAAA |
| 3939 | Table 3A | Hs.122408 | BF677944 | 11951839 | 602084766F1 cDNA 5' end/clone = IMAGE:4248905/clone_end = 5' | 1 | GAATTTTGGGGAGGTTACTGGTCGG GGGAAATAACAGGGTTGGACAAACG |
| 3940 | Table 3A | Hs.131887 | BF676298 | 11952193 | 602415225F1 cDNA 5' end/clone = IMAGE:4523725/clone_end = 5' | 1 | CTCCACATATGGGTAACACACTCGGT CCTTACAAGCACCTAGTCACTTCC |
| 3941 | Table 3A | Hs.205319 | BF679831 | 11953640 | 602154415F1 cDNA 5' end/clone = IMAGE:4295595/clone_end = 5' | 1 | GGGACCAGACTGCTTTCTAAATGCAC AGCTCTTTCACTATCAGAATGTGT |
| 3942 | Table 3A | Hs.34549 | BF680988 | 11954883 | 602620683F1 cDNA 5' end/clone = IMAGE:4746422/clone_end = 5' | 1 | TGTGGTCACTTGGGAAATAAATTCCA TCTGGCTTACCCAATGGGTGGTGG |
| 3943 | Table 3A | Hs.10702 | BF684382 | 11969790 | hypothetical protein DKFZp761H221 (DKFZp761H221), mRNA/cds = (776, 1714) | 1 | CCACAGCCACAACACCAGACAAGCC GACCAACAGACAGATACAGACCACC |
| 3944 | Table 3A | Hs.164675 | BF689700 | 11975108 | 602186609F1 cDNA 5' end/clone = IMAGE:4298402/clone_end = 5' | 1 | ACCACAGCAAGACAACAAGGACGAG AAAGAGAACAGACAATGAGCAACGA |
| 3945 | Table 3A | Hs.71331 | BF691178 | 11976586 | hypothetical protein MGC5350 (MGC5350), mRNA/cds = (189, 995) | 1 | ACTACTGCTTGCGTACCTCTCCGCTT TCCCTCTCCTTACTATCGACCATA |
| 3946 | Table 3A | Hs.173965 | BF691895 | 11977303 | ribosomal protein S6 kinase, 90kD, polypeptide 3 (RPS6KA3), mRNA/cds = (0, 2222) | 1 | TCCGTTTATATTAGCACTGTATCCCTT GTGCCATCCAACATTTGTATGT |
| 3947 | Table 3A | Hs.233936 | BF694761 | 11980263 | myosin, light polypeptide, regulatory, | 1 | CGGGCGCAGGACAGTAGCAGAGAAG |

TABLE 8-continued

| SEQ ID | Origin | Unigene | Locus | GI | Nominal Description | Strand | Probe Sequence |
|---|---|---|---|---|---|---|---|
| | | | | | non-sarcomeric (20kD) (MLCB), mRNA/cds = (114, 629) | | AGAGGTGGAGAGCCGGACAACGCAG |
| 3948 | Table 3A | Hs.318782 | BF696330 | 11981738 | 602808489F1 cDNA 5' end/clone = IMAGE:4940633/clone_end = 5' | 1 | CTTCAGTCATTATGGGCTCAGTTTCC TCACTATTGGTTCCTCGCAAGGGA |
| 3949 | Table 3A | Hs.103180 | BF698884 | 11984292 | 602126455F1 cDNA 5' end/clone = IMAGE:4283340/clone_end = 5' | 1 | AAGAGCAACAACGAGGCGAAGAGGA AGGAGGAGGCAAGACAGAAGAGGAA |
| 3950 | Table 3A | Hs.252723 | BF698920 | 11984328 | ribosomal protein L19 (RPL19), mRNA/cds = (28, 618) | 1 | GAGGAGCAACGACCAGAGAGACGAA CTGACATCAACCATAGAAGACGACA |
| 3951 | Table 3A | Hs.323662 | BF700502 | 11985910 | hypothetical protein MGC14595 (MGC14595), mRNA/cds = (101, 850) | 1 | AAGCATGAAGAAGACCTGGATGAGG CTCAGGGAGGTTCCCCCAGTTTAAA |
| 3952 | Table 3A | Hs.253550 | BF750565 | 12077241 | RC1-BN0410-261000-014-(11 cDNA | 1 | ATCAGTCAATCAGTCAGCTTCTCAGA GTAGCAATCCATGTGTCCAGAGGA |
| 3953 | Table 3A | Hs.10957 | BF793378 | 12098432 | 602254823F1 cDNA 5' end/clone = IMAGE:4347076/clone_end = 5' | 1 | AAATCCAATCCTTCGGAGAGGGAATG GGCGGTATTAATTAAGGGAAGTCC |
| 3954 | Table 3A | Hs.293658 | BF794089 | 12099143 | 602255649F1 cDNA 5' end/clone = IMAGE:4338732/clone_end = 5' | 1 | ATGACAAGACAAGCCAGACGAAGAA GACAAACAAGGGAGACACAGCAGAC |
| 3955 | Table 3A | Hs.206761 | BF794256 | 12099310 | 602255454F1 cDNA 5' end/clone = IMAGE:4338949/clone_end = 5' | 1 | TGCGCCCCAATATTTGTGGAACAGCG TTTTGTTCGAATAAAACGATCGGT |
| 3956 | Table 3A | Hs.246818 | BF796642 | 12101696 | 602259646F1 cDNA 5' end/clone = IMAGE:4343171/clone_end = 5' | 1 | CTCGAGGTGTAACTCAGGAAGGCCT AGCGAATCCCGACTCGGATGGTGTC |
| 3957 | Table 3A | Hs.54452 | BF797348 | 12102402 | zinc finger protein, subfamily 1A, 1 (Ikaros) (ZNFN1A1), mRNA/cds = (188, 1727) | 1 | TTCACCTACTCTGTTCTTTTCATCCAT CCCCTGAGTCAGTTGGTTGGAGG |
| 3958 | Table 3A | NA | BF821451 | 12160669 | RT0038 cDNA | 1 | CTGTTGTCTGGAGTGTGGAGTCTCTT GTCTGGATTGTGGAGTCTCTTGTC |
| 3959 | Table 3A | NA | BF889206 | 12280465 | RC6-TN0073-041200-013-H02 cDNA/gb = BF889208 | 1 | CAAGATGATGCTTGCTGTCTTTTTCCT CTCGGCTACCCAGAATGGCATTTG |
| 3960 | Table 3A | Hs.38664 | BF892532 | 12283991 | IL0-MT0152-061100-501-e04 cDNA | 1 | AGTACTCATGACTTGAGAGACGTGGA CGGAGCCAGCTTCTACCTTGCTTG |
| 3961 | Table 3A | Hs.337534 | BF965088 | 12332283 | 602268833F1 cDNA 5' end/clone = IMAGE:4356776/clone_end = 5' | 1 | GGTCCGACCAATTAATGACTCCATGA TCGGCCTCGGTTTTCACAAACCTT |
| 3962 | Table 3A | Hs.334691 | BF965438 | 12332653 | hypothetical protein FLJ22427 (FLJ22427), mRNA/cds = (40, 2631) | 1 | AGACAAAGAGAGCATAAATATAGCTC TACTCATGGGTACCATACCAGTGT |
| 3963 | Table 3A | Hs.133864 | BF965766 | 12332981 | 602276890F1 cDNA 5' end/clone = IMAGE:4364495/clone_end = 5' | 1 | TTACATTTGTGGACCATGTTACAGTTA AAGAAAAATCCTGTTTCAGTCCT |
| 3964 | Table 3A | Hs.279681 | BF965960 | 12333175 | heterogeneous nuclear ribonucleOprotein H3 (2H9) (HNRPH3), transcript variant 2H9, mRNA/cds = (118, 1158) | 1 | GCAGGTTATCGCAAGATGTCTTAGAG TAGGGTTAAGGTTCTCAGTGACAC |
| 3965 | Table 3A | Hs.5324 | BF966028 | 12333243 | hypothetical protein (CL25022), mRNA/cds = (157, 1047) | 1 | ATTTTTAAATGGCTTTACCAAACATTG TCAGTACCTTTACGTGTTAGAAG |
| 3966 | Table 3A | Hs.179902 | BF966049 | 12333264 | transporter-like protein (CTL1), mRNA/cds =0 (0, 1964) | 1 | CTTTCCACAGCAATTGTTTTGTACGA GGGGCCTTACAGCGCGGTCCACTT |
| 3967 | Table 3A | Hs.48320 | BF966269 | 12333484 | mRNA for ring-IBR-ring domain containing protein Dorfin, complete cds/cds = (317, 2833) | 1 | TTCTACAGCACGATGCCTGGATCTAC TGACCTGTCAACCACGAATCTTGA |
| 3968 | Table 3A | Hs.171802 | BF966361 | 12333576 | RST31551 cDNA | 1 | GAAACAGCAACAAGCAAACAGG ATCTCAGCATTACCAACAGCCAGC ACTA |
| 3969 | Table 3A | Hs.22790 | BF968270 | 12335485 | 602269653F1 cDNA 5' end/clone = IMAGE:4357740/clone_end = 5' | 1 | TGAGCCTGAACTTTTTTAGCAAATTAT TATTCTCAGTTTCCATTACCTGT |
| 3970 | Table 3A | NA | BF968628 | 12335843 | cDNA clone IMAGE:4359351 5' | 1 | CCTTCCAAAGCGGTCACCTGATAGG GAAGTCTTACGGCTAGGAAGTTACA |
| 3971 | Table 3A | Hs.5064 | BF968963 | 12336178 | 602490910F1 cDNA 5' end/clone = IMAGE:4619835/clone_end = 5' | 1 | GAATGGTGGGGAGAAAAAAGGGGGG CACAGTCATGATCGGCTCTTATAAT |
| 3972 | Table 3A | Hs.24143 | BF969990 | 12337205 | Wiskott-Aldrich syndrome protein interacting protein (WASPIP), mRNA/cds = (108, 1619) | 1 | GTCACATAATCCGGGGACCCAAAGAA AGTTCTCCAGAGTGGTTTCACGAG |
| 3973 | Table 3A | Hs.23703 | BF970427 | 12337642 | 602272760F1 cDNA 5' end/clone = IMAGE:4360767/clone_end = 5' | 1 | ACAACAACACATCACGTAACCACAAC ACGCATAAACAGCAAATCATCCTA |
| 3974 | Table 3A | Hs.102647 | BF970875 | 12338090 | 602271535F1 cDNA 5' end/clone = IMAGE:4359609/clone_end = 5' | 1 | CAGAACACCAACAAGCAGGGACGGA AGCCGACCGAGCAAACAGCGAAGGG |
| 3975 | Table 3A | Hs.321477 | BF970928 | 12338143 | 602270204F1 cDNA 5' end/clone = | 1 | GTGGACGGCCTGGGAATGTGCCCCC CGGTGTAACATCGAGCCCACAATGG |

TABLE 8-continued

| SEQ ID | Origin | Unigene | Locus | GI | Nominal Description | Strand | Probe Sequence |
|---|---|---|---|---|---|---|---|
| 3976 | Table 3A | Hs.79101 | BF971075 | 12338290 | IMAGE:4358425/clone_end = 5' cyclin G1 (CCNG1), mRNA/cds = (187, 1074) | 1 | AGGATTAGGAGAGGGTCACAGAACA GAAAGCAGATTACACTTGGGATGGA |
| 3977 | Table 3A | Hs.33026 | BF971984 | 12339199 | mRNA for FLJ00037 protein, partial cds/cds = (3484, 3921) | 1 | CTCTGTTTGTCTGGCCGCCTCCGTGA TCAAACCGTGTCGTCGGCGTGTTC |
| 3978 | Table 3A | Hs.146550 | BF976590 | 12343805 | DNA sequence from clone RP1-68O2 on chromosome 22 Contains the 5' end of the APOL2 gene for apolipoprotein L 2, the APOL gene for applipoprotein L, the MYH9 gene for nonmuscle type myosin heavy chain 9, ESTs, STSs and GSSs/cds = (0, 5882) | 1 | GGCTTGGACATTGCTCTCAAGAAGAT TAAGAACCCTGGAGGAACACTAGG |
| 3979 | Table 3A | Hs.7905 | BF981080 | 12383892 | 602310311F1 cDNA 5' end/clone = IMAGE:4401411/clone_end = 5' | 1 | TGTACAGCTAAATTTCTCCAAAGCAC TTTTTCAAAACCAAAAAAGAAAAA |
| 3980 | Table 3A | Hs.182740 | BF981263 | 12384075 | ribosomal protein S11 (RPS11), mRNA/cds = (33, 509) | 1 | TTTGCACACTGAACACTTACAGATGT GGCAGATGTGAAATTTGTCATCAA |
| 3981 | Table 3A | Hs.289721 | BF981634 | 12384446 | cDNA:FLJ22193 fis, clone HRC01108/cds = UNKNOWN | 1 | ACAGAGAGTCACCCGCGAGTACGAA ACAGGCACATTTTAGAAACTCACA |
| 3982 | Table 3A | Hs.83583 | BG024761 | 12410861 | actin related protein 2/3 complex, subunit 2 (34 kD) (ARPC2), mRNA/cds = (84, 986) | 1 | AGGTTCTTACCACCACTTTTGTGCCC ATCTTTCCCTTCGTTCCCAATGTG |
| 3983 | Table 3A | Hs.1432 | BG026279 | 12413729 | protein kinase C substrate 80K-H (PRKCSH), mRNA/cds = (138, 1719) | 1 | CCGGGGTGGCCCTCTCAAATTTGGC ATGGGGTCCTCTTTCAATGTTGTGG |
| 3984 | Table 3A | Hs.279009 | BG028577 | 12417672 | matrix Gla protein (MGP), mRNA/cds = (46, 357) | 1 | CACGAGCGGCTGGAGGACACCCATT TTGTGCAGTGCCCGTCCGTCCCTTC |
| 3985 | Table 3A | Hs.5122 | BG028906 | 12418001 | 602293015F1 cDNA 5' end/clone = IMAGE:4387778/clone_end = 5' | 1 | GCCCTATGGCGTTGTTAAACACGAGC GTATGCTAGTAAGTATCATTCATA |
| 3986 | Table 3A | Hs.143554 | BG033028 | 12424903 | Pur-beta (PURB) mRNA, complete cds/cds = (13, 951) | 1 | GGTGTGTCTCGCGGCTGGCCCAGTC TATTCTCGGTGTTTATCTTCATCAC |
| 3987 | Table 3A | Hs.118787 | BG033294 | 12425446 | transforming growth factor, beta-induced, 68kD (TGFB1), mRNA/cds = (47, 2098) | 1 | GACAACGGAAACTCTGTCTCTACCAC CATGTGACAGACGCGTTGATGCGT |
| 3988 | Table 3A | Hs.103902 | BG033732 | 12426494 | 602301101F1 cDNA 5' end/clone = IMAGE:4402465/clone_end = 5' | 1 | CAAGACACAAACAGCACGACTC ACACAGAGAAAGCAACCATGCCGA GGAG |
| 3989 | Table 3A | Hs.306155 | BG033909 | 12426670 | chorionic somatomammotropin hormone 1 (placental lactogen) (CSH); transcript variant 2, mRNA/cds = (116, 886) | 1 | CGCGTCGAACTTCGGGACATTCCCG TAAACCACAAACAGATAAAGAATTA |
| 3990 | Table 3A | Hs.332404 | BG033953 | 12426761 | CDA02 protein (CDA02), mRNA/cds = (2, 1831) | 1 | GCGTAAAGTGATCAAAAGGCCCTGAA GGGGAAAATGATAAAACCCGTGGT |
| 3991 | Table 3A | Hs.12396 | BG034192 | 12427253 | 602302446F1 cDNA 5' end/clone = IMAGE:4403868/clone_end = 5' | 1 | AGAGGAAGCGTGTGAATACAACAATC TAAAAAGGAGGAGAGGTCGAGCAC |
| 3992 | Table 3A | Hs.125819 | BG034799 | 12428456 | putative dimethyldenosine transferase (HSA9761), mRNA/cds = (78, 1019) | 1 | ACACATTCCCCATACCATTTCGTGTT ATTCACATTCCCCGTACCATTTCT |
| 3993 | Table 3A | Hs.16488 | BG035120 | 12428935 | calreticul (CALR), mRNA/cds = (68, 1321) | 1 | TAAAAAGGGGGTGGCGGCTGTAGTA AGGAGGAGCGAGTAATGTATAGCAC |
| 3994 | Table 3A | Hs.17719 | BG035218 | 12429131 | EBP50-PDZ interactor of 64 kD (EPI64) mRNA/cds = (24, 1550) | 1 | CCATGAGCAGGCGCAACCATAACAG TTAGAGACGGCACACAGCACGACAC |
| 3995 | Table 3A | Hs.319825 | BG036101 | 12430901 | 602021477F1 cDNA 5' end/clone = IMAGE:4156915/clone_end = 5' | 1 | ACTCACGCAAGAGCAGGGGACTAT AACAGAAATAAACAAGTAAATAAAT |
| 3996 | Table 3A | Hs.192965 | BG036938 | 12432665 | 602287708F1 cDNA 5' end/clone = IMAGE:4375153/clone_end = 5' | 1 | TACACAGGCAGCTATGCGGATCATCA GACGAGCACATATTCTAACAGAGA |
| 3997 | Table 3A | Hs.144924 | BG037042 | 12432874 | serine/threonine protein kinase SSTK (SSTK), mRNA/cds = (122, 943) | 1 | CGTCGCCGTAGGACGCCTCCGTCGT CGTCTGGTCTGTCTCCTGCATCGAG |
| 3998 | Table 3A | Hs.318893 | BG106948 | 12600794 | 602291361F1 cDNA 5' end/clone = IMAGE:4386159/clone_end = 5' | 1 | AAAGGCAAGAGTCCGGGGTGGCAGA AGAGTGAAAAATGAAAGAGAGAAGG |
| 3999 | Table 3A | Hs.109007 | BG110599 | 12604105 | 602342214F1 cDNA 5' end/clone = IMAGE:4452602/clone_end = 5' | 1 | TTCTGCCCAGAGTGTATTTGTGAAGA GTCTCTTATATTATGTTTTGTGGA |
| 4000 | Table 3A | Hs.173737 | BG110835 | 12604341 | ras-related C3 botiulinum toxin substrate 1 (rho family, small GTP binding protein Rac1) (RAC1), transcript variant Rac1b, mRNA/cds = (0, 635) | 1 | GTGCGAATGTGGAGTGTTTACATTG ATCTTTGCTAATGAATTAGCATCA |
| 4001 | Table 3A | Hs.323950 | BG111212 | 12604718 | zinc finger protein 6 (CMPX1) (ZNF6), mRNA/cds = (1265, 3361) | 1 | CATTACGCATATTGGTAAGACGCAAA ATGAGACAGATCGACACTGGGACG |
| 4002 | Table 3A | Hs.37908 | BG111773 | 12605279 | 601820448F1 cDNA 5' end/clone = | 1 | CACAACGGGTCTTAATGACGACGGAA AGATACATCCATCGGTATGAACGC |

TABLE 8-continued

| SEQ ID | Origin | Unigene | Locus | GI | Nominal Description | Strand | Probe Sequence |
|---|---|---|---|---|---|---|---|
| 4003 | Table 3A | Hs.74313 | BG112085 | 12605591 | IMAGE:4052578/clone_end = 5' mRNA for KIAA1265 protein, partial cds/cds = (68, 2573) | 1 | ACCAGCAATCCGCAGCAGAGTCATAA GTGGGGTAGGTGATATGTACTAAC |
| 4004 | Table 3A | Hs.320972 | BG112503 | 12606009 | 602282105F1 cDNA 5' end/clone = IMAGE:4369633/clone_end = 5' | 1 | GAAAAAACAAGCTAACAAACAC ACACGCCCACACCAACATGCCAGA ACGC |
| 4005 | Table 3A | Hs.7589 | BG112505 | 12606011 | 602282107F1 cDNA 5' end/clone = IMAGE:4369729/clone_end = 5' | 1 | TGAACATGGGTGGGTTTGATCACGAG GATTCCGCTGAAAAGATTAGAGGG |
| 4006 | Table 3A | NA | BG118529 | 12612035 | cDNA clone IMAGE:4443519 5' | 1 | CGCGTTCATAACGGCGTCGACTGTTC TTGTGCTGCTGTTATCTATACTAT |
| 4007 | Table 3A | NA | BG121288 | 12614797 | cDNA clone IMAGE:4450407 5' | 1 | GGGACCAGACTACACGGAATACCAG AGTTGAAGAAAATTAAGATTTAAGC |
| 4008 | Table 3A | Hs.285729 | BG163237 | 12669951 | 602013384F1 cDNA 5' end/clone = IMAGE:4149351/clone_end = 5' | 1 | TATACTGAGAGTGAAGGTCTGGGTGC CAACTTGAGACAGGTGGTCTAGGA |
| 4009 | Table 3A | Hs.111554 | BG164898 | 12671532 | ADP-ribosylation factor-like 7 (ARL7), mRNA/cds = (14, 592) | 1 | CCCCTGGTTTTCTCGTTCTGCCTCCT TTGGACCTGTGTTTGTTTTCTGCT |
| 4010 | Table 3A | Hs.193482 | BG165998 | 12672701 | cDNA FLJ11903 fis, clone HEMBB1000030/cds = UNKNOWN | 1 | CCCTTAGAATGGTTACTGCCCTTGAA TTAACTTGACACAACTTGGGTTGG |
| 4011 | Table 3A | NA | BG166279 | 12672982 | cDNA clone IMAGE:4455496 5' | 1 | CGAATAATCCCTATTTGATTACCTCA GAAAGTTTTGTCTTCCGCCAAGG |
| 4012 | Table 3A | Hs.87113 | BG188139 | 12674842 | 602341526F1 cDNA 5' end/clone = IMAGE:4449343/clone_end = 5' | 1 | TTGGACCCCAGGGTAAGGCGGATAT TGGTTGGGACGTTCGGGGAGTGTAT |
| 4013 | Table 3A | Hs.182695 | BG170647 | 12677350 | mitochondrial ribosomal protein 63 (MRP63), mRNA/cds = (215, 523) | 1 | AATTACGTTCGGAGGTATATAAAAAG GGATCGGCGCAGTGGATAGGGGGT |
| 4014 | Table 3A | Hs.204959 | BG180098 | 12886801 | hypothetical protein FLJ14886 (FLJ14888), mRNA/cds = (111, 1169) | 1 | GGAGATCCACAGTGATCTCAGGCCC TGGACCGGAAAAGGCAGCAAGATCA |
| 4015 | Table 3A | NA | BG249224 | 12759040 | cDNA clone IMAGE:4470038 5' | 1 | AAGACGAGTACACCAAGACCAAAGA GCGCCAACGAGCACGACCGAGTGAA |
| 4016 | Table 3A | Hs.6682 | BG254117 | 12763933 | solute carrier family 7, (cationic amino acid transporter, y+ system) member 11 (SLC7A11), mRNA/cds = (235, 1740) | 1 | AACGCCGACTAGACGTCACAAAGACT TAATAAGAAACACACTGATATCCA |
| 4017 | Table 3A | NA | BG254292 | 12764108 | cDNA clone IMAGE:4477042 5' | 1 | CGCAACATTATCCATTTAAACCCCTG CATAACCCATTACCAAAGCCCTCT |
| 4018 | Table 3A | Hs.30724 | BG260954 | 12770770 | 602372582F1 cDNA 5' end/clone = IMAGE:4480647/clone_end = 5' | 1 | GGCACCCCAATCCCCGGCAAAAACA TTTGTTAACCTCTTGGGAATTTCTT |
| 4019 | Table 3A | Hs.217493 | BG282346 | 13031273 | annexin A2 (ANXA2), mRNA/cds = (49, 1068) | 1 | CTCGTCTGCACCGAGTCTCACAAAT TTAGCATCTGGGTCTTGAGCATTA |
| 4020 | Table 3A | Hs.71243 | BG283002 | 13032445 | 602406192F1 cDNA 5' end/clone = IMAGE:4518214/clone_end = 5' | 1 | CCCTCCGGGGTCTCTATACCCACAAC CTTCTATCACTCAATCAGTTGGTA |
| 4021 | Table 3A | Hs.322653 | BG283132 | 13032707 | 602406784F1 cDNA 5' end/clone = IMAGE:4518957/clone_end = 5' | 1 | AACAAGATAGAGAGAAGACGAA GATCGACACAGACAAACAACCACA ACCG |
| 4022 | Table 3A | Hs.246818 | BG283706 | 13033918 | 602259846F1 cDNA 5' end/clone = IMAGE:4343171/clone_end = 5' | 1 | TGTTGGGACCCCTCATCTCACGGGTC ATTTCCACCACTAAACGCCCTTTT |
| 4023 | Table 3A | Hs.151239 | BG286500 | 13039430 | 602382992F1 cDNA 5' end/clone = IMAGE:4500527/clone_end = 5' | 1 | CCCTGAAATCCTAAATTCCGTCACCC CTCCAACATGACCATAAAAGTCCC |
| 4024 | Table 3A | Hs.323950 | BG286649 | 13039715 | zinc finger protein 6 (CMPX1) (ZNF6), mRNA/cds = (1265, 3361) | 1 | GACCACGTTATGTGCCTGACTTCGAG GACACCCTCTCTGGTTTGGTATTT |
| 4025 | Table 3A | Hs.278428 | BG286817 | 13040034 | progestin induced protein (DD5), mRNA/cds = (33, 8432) | 1 | TCTCCTTTCAGTTCCTTTGTAGGATTT CTGGCCTTGAGGATAGTCTTCA |
| 4026 | Table 3A | NA | BG288308 | 13043014 | cDNA clone IMAGE:45127006 5' | 1 | TCTCATCAACATTTGACTCTCAGAAG AGCCTCCATTTGCCCTTTCTCTCT |
| 4027 | Table 3A | Hs.115467 | BG288391 | 13043387 | 602388053F1 cDNA 5' end/clone = IMAGE:4517076/clone_end = 5' | 1 | GCAGAGCAGACCTTATTACGCACAAT TGCCGGTAACATGTAACACCAGTT |
| 4028 | Table 3A | Hs.11637 | BG288429 | 13043463 | 602388093F1 cDNA 5' end/clone = IMAGE:4517086/clone_end = 5' | 1 | ATTGGGCATGGTTGGTCAATGCCTC ACATGGCCGGGATAACAGGACGCA |
| 4029 | Table 3A | Hs.79101 | BG288554 | 13043326 | cyclin G1 (CCNG1), mRNA/cds = (187, 1074) | 1 | CAAAGGGTGTAATTCCACATTGACAC TCCTGTCATGCGGTGGGCGGGAAC |
| 4030 | Table 3A | Hs.44577 | BG288837 | 13044076 | 602388170F1 cDNA 5' end/clone = IMAGE:4517129/clone_end = 5' | 1 | CTAGCTCACTAGTTGTGCCTATATGC CACACCGGGGACCCAACAAGGGT |
| 4031 | Table 3A | Hs.173830 | BG289048 | 13044499 | 602383668F1 cDNA 5' end/clone = IMAGE:4512712/clone_end = 5' | 1 | ATACTGTGTGATTTGCCCTTGCTGTC CAACCCTGTTCTTGCTGCCATTTA |
| 4032 | Table 3A | Hs.169363 | BG289347 | 13045100 | GLE1 (yeast homolog)-like, RNA export mediator (GLE1L), | 1 | GTGGCCTGAAGTGACCCATTCTATGA ATTGTTAATTAAGGTGCCAAAAA |

TABLE 8-continued

| SEQ ID | Origin | Unigene | Locus | GI | Nominal Description | Strand | Probe Sequence |
|---|---|---|---|---|---|---|---|
| 4033 | Table 3A | Hs.79914 | BG290141 | 13046637 | lumican (LUM), mRNA/cds = (87, 2066) mRNA/cds = (84, 1100) | 1 | GGGTTTGAGACTTGGGTATGGAAACA GAACCGGAAATTGTGTGCTCTGGT |
| 4034 | Table 3A | Hs.125872 | BG290577 | 13047679 | sperm associated antigen 9 (SPAG9), mRNA/cds = (110, 2410) | 1 | ATTTCTATTATGGAATCCCTGGGGTT CAGAATGTAACTTTGTACATGAGA |
| 4035 | Table 3A | Hs.95835 | BG291649 | 13049588 | RST8356 cDNA | 1 | GACAGTACACCTCAGGGAAGGGACA AACAAACACGATAAATCGACACACG |
| 4036 | Table 3A | Hs.289088 | BG291970 | 13050316 | heat shock 90kD protein 1, alpha (HSPCA), mRNA/cds = (60, 2258) | 1 | TCAGACCCAGTCTTGTGGATGGAAAT GTAGTGCTCGAGTCACATTCTGCT |
| 4037 | Table 3A | Hs.322804 | BG311130 | 13112931 | ia55a08.yt cDNA, 5' end/clone_end = 5' | 1 | TCCTGAGCCCCACACGCCCGAAGCA ATAAAGAGTCCACTGACTTCCAAAA |
| 4038 | Table 3A | Hs.190219 | BG326781 | 13133218 | 602425659F1 cDNA 5' end/clone = IMAGE:4563471/clone_end = 5' | 1 | ACGAATATCGAATCTCCCACGCGGG GGGTGAGACCCGAATCTGCGGCTGC |
| 4039 | Table 3A | Hs.292457 | BG339050 | 13145488 | Homo sapiens, clone MGC:16362 IMAGE 3927795, mRNA, complete cds/cds = (498, 635) | 1 | AGACACACGAGCAAAACGACGCAGC AAGAATCAGATAGCATAGCAAACAT |
| 4040 | Table 3A | Hs.170980 | BG387694 | 13281140 | cell cycle progression 2 protein (CPR2), mRNA/cds = (126, 1691) | 1 | GCAGTGGGACGGAACGGGTGAAGCC TGATGGCTGATGCGGCACGATCTTG |
| 4041 | Table 3A | Hs.268175 | BG391695 | 13285143 | cDNA FLJ20673 fis, clone KAIA4464/cds = (104, 1402) | 1 | CTTTAAATCTTAGATTGCTCCGCACA GATAAAGAGAACCAGGATTGGGGC |
| 4042 | Table 3A | Hs.301226 | BG396292 | 13289740 | mRNA for KIAA1085 protein, partial cds/cds = (0, 1755) | 1 | TTTATTTGGGTACTTTTCCCCAACACA AGTCCTTTTATCCCACCCTTGGG |
| 4043 | Table 3A | Hs.58643 | BG397564 | 13291012 | 602438603F1 cDNA 5' end/clone = IMAGE:4564968/clone_end = 5' | 1 | AAAAGATCTCGGAAAATAGCATTTTG TTAAAACCTTGGGGGGTAAAACCC |
| 4044 | Table 3A | Hs.26670 | BG403635 | 13297083 | PAC clone RP3-515N1 from 22q11.2-q22/cds = (0, 791) | 1 | AACCTTCATGCAAGTGGAGACGGGTA GGGGGTTCTATGGGGCATTGGTTG |
| 4045 | Table 3A | Hs.292457 | BG424974 | 13331480 | Homo sapiens, clone MGC:16362 IMAGE:3927795, mRNA, complete cds/cds = (498, 635) | 1 | TGTGAAAAGCTGATAAGAAAACCATC CAGAAAAAGCTCTTCGTTTTACA |
| 4046 | Table 3A | NA | BG427404 | 13334006 | cDNA clone IMAGE:4612518 5' | 1 | TCATTATAATTCTGTCCTAGGAAATCA AATTAGAACGCTCCACAAGCCGG |
| 4047 | Table 3A | NA | BG432194 | 13338700 | cDNA clone IMAGE:4610035 5' | 1 | CGCAGAGCTGGGCCTTACAAATGGG TTCCAAATCGGGCTTCTCACTCAGG |
| 4048 | Table 3A | Hs.28491 | BG434865 | 13341371 | spermidine/spermine N1-acetyltransferase (SAT), mRNA/cds = (165, 880) | 1 | TACAACTGTACCACACTGGGTTACTC TAGAAGTCTCTGGTCGGATCCTTC |
| 4049 | Table 3A | Hs.281397 | BG438232 | 13344738 | hypothetical protein AD034 (AD034), mRNA/cds = (195, 1880) | 1 | CATAGAGCACAAGAGACACATGGAC CGGCACGCGACCCGACCCAAAGCGC |
| 4050 | Table 3A | Hs.301226 | BG468330 | 13400600 | mRNA for KIAA1085 protein, partial cds/cds = (0, 1755) | 1 | TTTACCTCATTTATTTGGTACTTTCCC CACACAGTCCTTTATCCACCTGG |
| 4051 | Table 3A | Hs.334787 | BG473226 | 13405503 | Homo sapiens, clone MGC:19556 IMAGE:4304831, mRNA, complete cds/cds = (1505, 1666) | 1 | CCATTTTTAGTGGGGAGAAAACTGT CACTGTGCTGGCGAAAGAGGTCCA |
| 4052 | Table 3A | Hs.292457 | BG473813 | 13406090 | Homo sapiens, clone MGC:18362 IMAGE:3927795, mRNA, complete cds/cds = (498, 635) | 1 | CCGCACCGATTAACGGCCAGAGAAG CAACAAGCAAATAAAAAGTGGGAAA |
| 4053 | Table 3A | Hs.173737 | BG482796 | 13415077 | ras-related C3 bolulinum toxin substrate 1 (rho family, small GTP binding protein Rac1) (RAC1), transcript variant Rac1b, mRNA/cds = (0, 635) | 1 | AACTTAACTCACTGGCGAGAATACAG CGTGGGACCCTTCAGCCACTACAA |
| 4054 | Table 3A | Hs.24054 | BG489375 | 13450885 | hypothetical protein GL009 (GL009), mRNA/cds = (77, 628) | 1 | AGGACTTAACGGGAATACGGGAATAA CTCCAATTACTTCATCTCTAGGGC |
| 4055 | Table 3A | Hs.166254 | BG493253 | 13454765 | hypothetical protein DKFZp5661133 (DKFZP5661133), mRNA/cds = (133, 1353) | 1 | AAGGAGGTTGCTCACCAGTAGTGCTT GTTACCAAAATGTCACCAGGAGTT |
| 4056 | Table 3A | Hs.29131 | BG497765 | 13459262 | nuclear receptor coactivator 2 (NCOA2), mRNA/cds = (162, 4556) | 1 | TGAATTAAGTGCATTATCAATTAACCT TATGGTGGTTGGAATAGTGATCA |
| 4057 | Table 3A | Hs.172089 | BG501063 | 13482580 | mRNA:cDNA DKFZp58612022 (from clone DKFZp58812022)/cds = UNKNOWN | 1 | AAACACACAGGAAAAGGGCAAAGGG GGCACCAGGAGAACCGGGAGACAAA |
| 4058 | Table 3A | NA | BG501895 | 13463412 | cDNA clone IMAGE:4654344 5' | 1 | CGGAGAAACGGGGCCAAAAGGTTGC CGAGAGACCCGGCGAAAAGGACAGG |
| 4059 | Table 3A | Hs.279009 | BG503693 | 13465210 | matrix Gla protein (MGP), mRNA/cds = (46, 357) | 1 | ACAAAGCATCAAACAGCAGGGAGCTA GTGGAGAGGTCTATTGTCCCAGTG |
| 4060 | Table 3A | Hs.86437 | BG505271 | 13488788 | 602411368F1 cDNA 5' end/clone = IMAGE:4540096/clone_end = 5' | 1 | GGGTGCATGCCAAGAAAGTATGGTT GGAATTCCTGGTACACTGAAGTGGA |
| 4061 | Table 3A | Hs.237868 | BG505379 | 13466896 | interleukin 7 receptor (IL7R), mRNA/cds = (22, 1401) | 1 | ATGTTATCTTGGGAATTAGTGTCTTG AGCCTCTGTCTGTTACCGTAGTTT |
| 4062 | Table 3A | Hs.3280 | BG505961 | 13467478 | caspase 6, apoptosis-related cystaine protease (CASP6), transcript variant alpha, mRNA/cds = (78, 959) | 1 | TGACCGAGTAAAAAACATCTATCAAT TACACAAATGAACAAGAATGTGAG |
| 4063 | Table 3A | Hs.293842 | BG506472 | 13467989 | 601571679F1 cDNA 5' | 1 | ACAAGAAATGGTTGAGGCGAATATTG |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:3838675/clone_end = 5' | | GAAACACATGGGCTTAATGCTGAA |
| 4064 | Table 3A | Hs.111911 | BG527060 | 13518597 | 602540462F1 cDNA 5' end/clone = IMAGE:4671519/clone_end = 5' | 1 | GGTATTGATGCTTGGTTTTTCCTGCC AGTCCGAAATTCCTGTATTTGTCA |
| 4065 | Table 3A | Hs.12396 | BG527658 | 13519195 | 602302446F1 cDNA 5' end/clone = IMAGE:4403868/clone_end = 5' | 1 | TCATGCTACTTGTCCTGGTTTTGTCAT TGATACTCTCATAGCCCTTTTGA |
| 4066 | Table 3A | NA | BG531486 | 13523023 | cDNA clone IMAGE:4899409 5' | 1 | GCCTGGCGGACCGGCAGCCTATATG ACGGACTTCCTCATTACTTACCACG |
| 4067 | Table 3A | Hs.279009 | BG532345 | 13523883 | matrix Gla protein (MGP), mRNA/cds = (46, 357) | 1 | AAACTGTTTGGAGAATTTAAGCACTC TCTGATGGGGGACAACTCTATGGA |
| 4068 | Table 3A | Hs.129872 | BG532470 | 13524009 | sperm associated antigen 9 (SPAG9), mRNA/cds = (110, 2410) | 1 | TCTTTGTGCAGATACGTTCACCACAT AAGTGTGAGCCATTTAAACCTGGT |
| 4069 | Table 3A | Hs.343475 | BG533994 | 13525534 | 601558208T1 cDNA 3' end/clone = IMAGE:3826392/clone_end = 3' | 1 | CACCAAAGTGGAGACAAATACATGAT CTCAAAGATACACAGTACCTACTT |
| 4070 | Table 3A | Hs.74647 | BG536394 | 13527940 | T-cell receptor active alpha-chain mRNA from JM cell line, complete cds/cds = (138, 969) | 1 | AATAATTGGTCTTTTAAACAAACACG GAAGTTTGGTGGAATCGGTCATGT |
| 4071 | Table 3A | Hs.343475 | BG536841 | 13528187 | 601556208T1 cDNA 3' end/clone = IMAGE:3826392/clone_end = 3' | 1 | TGTTCGTGCCTTCCTTCTGGGTTCCA CAAAGGTGGGACCTTACTTATCTA |
| 4072 | Table 3A | Hs.72988 | BG537502 | 13529734 | signal transducer and activator of transcription 2 113kD (STAT2), mRNA/cds = (57, 2612) | 1 | AGGGAAAAACGCAGGGGGTTCAAAA ACTCTCTCACTCTATGCAGTGTATA |
| 4073 | Table 3A | NA | BG538731 | 13530964 | cDNA clone IMAGE:4691392 5' | 1 | AAGCAGCTCAATAGCAGCATAGAGGA TTAGATTAATGGAACAGCACTGCA |
| 4074 | Table 3A | Hs.124675 | BG541679 | 13533912 | 602571258F1 cDNA 5' end/clone = IMAGE:4695805/clone_end = 5' | 1 | ACATATACAAGGACACAGAGGAAAGG CGGGAACAACGGGAAGAGGTTTTG |
| 4075 | Table 3A | NA | BG542394 | 13534627 | cDNA clone IMAGE:4696046 5' | 1 | TGTGGCGATTAAGAGAGGTGAAGCAT AACTGATTTGCAGGATATGGTTTG |
| 4076 | Table 3A | Hs.198427 | BG547561 | 13546239 | hexokinase 2 (HK2), mRNA/cds = (1490, 4243) | 1 | AAAAGCCAAAAGGTTTCATGTAGATT TTAGTTCACTAAAGGGTGCCCACA |
| 4077 | Table 3A | Hs.83077 | BG547627 | 13546292 | interleukin 18 (interferon-gamma-inducing factor) (IL18), mRNA/cds = (177, 756) | 1 | GCAGAACTCTAATTGTACGGGGTCAC AGAGGCGTGATATGGTATCCCAAA |
| 4078 | literature | Hs.227656 | XM_001289 | 14732543 | xenotropic polytropic murine leukemia virus receptor (X3) mRNA, complete cds/cds = (165, 2255) | 1 | CTTAACCATACAGAATGATATAACTC CTGTGCAATGAAGGTGATAACAGT |
| 4079 | literature | Hs.55468 | XM_001939 | 11426048 | H4 histone, family 2 | 1 | CTTCGGAGGCTAGGCCGCCGCTCCA GCTTTGCACGTTTCGATCCCAAAGG |
| 4080 | Table 3A | Hs.170171 | XM_002068 | 14732456 | mRNA; cDNA DKFZp434MO813 (from clone DKFZp434MO813); partial cds/cds = (430, 768) | 1 | CAAAGTCAAATAACTCCTCATTGTAAA CAAACTGTGTAACTGCCCAAAGC |
| 4081 | literature | Hs.181097 | XM_002135 | 11428074 | tumor necrosis factor (ligand) superfamily, member 4 (tax-transcriptionally activated glycoprotein 1,34kD) (TNFSF4), mRNA/cds = (36, 587) | 1 | CCAATCCCGATCCAAATCATAATTTG TTCTTAAGTATACTGGGCAGGTCC |
| 4082 | Table 3A | Hs.76913 | XM_002158 | 13839010 | proteasome (prosome, macropain) subunit, alpha type, 5 (PSMA5), mRNA/cds = (21, 746) | 1 | TCCAGCTCCTGTTCCTTGGAAAATCT CCATTGTATGTGCATTTTTTAAAT |
| 4083 | Table 3A | Hs.10927 | XM_002269 | 13636009 | HSZ78330 cDNA/clone = 2.49-(CEPH) | 1 | AACTGATGCCTGCTAGTGCTTTCTGA TTACTCGCATTCTGTTTCTTGCTT |
| 4084 | literature | Hs.81424 | XM_002513 | 13646509 | ubiquitin-like 1 (sentrin) (UBL1), mRNA/cds = (66, 371) | 1 | TCAGGTTGAAGTCAAGATGACAGATA AGGTGAGAGTAATGACTACTCCAA |
| 4085 | Table 3A | Hs.173912 | XM_003189 | 14735115 | eukaryotic translation initiation factor 4A, isoform 2 (EIF4A2), mRNA/cds = (15, 1238) | 1 | TCCTAGGTAGGGTTTAATCCCCAGTA AAATTGCCATATTGCACATGTCTT |
| 4086 | Table 3A | Hs.63668 | XM_003304 | 14720715 | toll-like receptor 2 (TLR2), mRNA/cds = (129, 2483) | 1 | AGCGGGAAGGATTTTGGGTAAATCTG AGAGCTGCGATAAAGTCCTAGGTT |
| 4087 | Table 3A | Hs.89714 | XM_003507 | 14731038 | small inducible cytokine subfamily B (Cys-X-Cys), member 5 (epithelial-derived neutrophil-activating peptide 78) (SCYB5), mRNA/cds = (106, 450) | 1 | GAGGCCCTAGCATTTCTCCTTGGATA GGGGACCAGAGAGAGCTTGGAATG |
| 4088 | Table 3A | Hs.66052 | XM_003593 | 13646753 | CD38 antigen (p45) (CD38), mRNA/cds = (69, 971) | 1 | CTCCACAATAAGGTCAATGCCAGAGA CGGAAGCCTTTTTCCCCAAAGTCT |
| 4089 | Table 3A | Hs.251664 | XM_004020 | 11417288 | DNA for insulin-like growth factor II (IGF-2); axon 7 and additional ORF/cds = (0, 233) | 1 | CCAATGTTTCTCTTTTGGCCCTATACA AAGGCAAGAAGGAAAGACCAAGA |
| 4090 | Table 3A | Hs.79197 | XM_004500 | 13631147 | CD83 antigen (activated B lymphocytes, immunoglobulin superfamily) (CD83), mRNA/cds = (41, 656) | 1 | TTTACCTCTGTCTTGGCTTTCATGTTA TTAAACGTATGCATGTGAAGAAG |

TABLE 8-continued

| SEQ ID | Origin | Unigene | Locus | GI | Nominal Description | Strand | Probe Sequence |
|---|---|---|---|---|---|---|---|
| 4091 | db mining | Hs.159651 | XM_004585 | 14758499 | tumor necrosis factor receptor superfamily, member 21 (TNFRSF21), mRNA/cds = (0, 1967) | 1 | GGGAAGTTGGTTTATAAGCCTTTGCC AGGTGTAACTGTTGTGAAATACCC |
| 4092 | Table 3A | Hs.279903 | XM_004611 | 14740071 | Ras homolog enriched in brain 2 (RHEB2), mRNA/cds = (23, 577) | 1 | CCCTCCCTTCAGATTATGTTAACTCT GAGTCTGTCCAAATGAGTTCACTT |
| 4093 | Table 3A | Hs.302981 | XM_004720 | 14745195 | hypothetical protein FLJ11000 (FLJ11000), mRNA/cds = (223, 780) | 1 | TTATTCATATATTCCTGTCCAAA GCCACACTGAAAACAGAGGCAGA GACA |
| 4094 | Table 3A | Hs.239138 | XM_004839 | 13629023 | pre-B-cell colony-enchancing factor (PBEF), mRNA/cds = (27, 1502) | 1 | TGCACCTCAAGATTTTAAGGAGATAA TGTTTTTAGAGAGAATTTCTGCTT |
| 4095 | Table 3A | Hs.79022 | XM_005182 | 14746130 | GTP-binding protein overexpressed in skeletal muscle (GEM), mRNA/cds = (213, 1103) | 1 | TATGGCCTTCAAGCTCAAGTCCAAAT CCTGCCATGACCTCTCTGTACTCT |
| 4096 | Table 3A | Hs.234842 | XM_005543 | 13841011 | aquaporin 3 (AQP3), mRNA/cds = (64, 942) | 1 | TCCATCTGTGCATAAGGAGAGGAAAG TTCCAGGGTGTGTATGTTTTCAGG |
| 4097 | Table 3A | Hs.124029 | XM_005693 | 14737168 | inositol polyphosphate-5-phosphatase, 40kD (INPP5A), mRNA/cds = (101, 1192) | 1 | GGACCATTCCGGAGCAGCCCCACAT ACCTCACTGTCTCGTCTGTCTATGT |
| 4098 | Table 3A | Hs.326248 | XM_005698 | 13627052 | cDNA; FLJ22071 fis, clone HEP11691/cds = UNKNOWN | 1 | TTTGTAAGCGAAGGAGATGGAGGTC GTCTTAAACCAGAGAGCTACTGAAT |
| 4099 | Table 3A | Hs.287797 | XM_005799 | 13629831 | mRNA for FLJ00043 protein, partial cds/cds = (0, 4246) | 1 | ACCACTGTATGTTTACTTCTCACCATT TGAGTTGCCCATCTTGTTTCACA |
| 4100 | Table 3A | Hs.1395 | XM_005883 | 14740090 | early growth response 2 (Krox-20 (Drosophila) homolog) (EGR2), mRNA/cds = (338, 1768) | 1 | AAATCTATTCTAACGCAAAACCACTAA CTGAAGTTCAGATAATGGATGGT |
| 4101 | Table 3A | Hs.1908 | XM_005980 | 14748566 | proteoglycan 1, secretory granule (PRG1), mRNA/cds = (24, 500) | 1 | TGTTATAAAAGAGGATTTTCCCACCTT GACACCAGGCAATGTAGTTAGCA |
| 4102 | db mining | Hs.73958 | XM_006283 | 14763523 | recombination activating gene 1 (RAG1), mRNA/cds = (124, 3255) | 1 | ACCAGGATGCAATGGATTTATTTGAT TCAGGGGACCTGTATTTCCATGTC |
| 4103 | Table 3A | Hs.146589 | XM_006741 | 14783662 | mRNA for MOP-3, complete cds/cds = (0, 4178) | 1 | AACAGAAACAGCTATGGCAACAGCAT CACCCTCAGAGCATCACCAACTTG |
| 4104 | db mining | Hs.99954 | XM_006840 | 14763859 | activin A receptor, type IB (ACVR1B), transcript variant 1, mRNA/cds = (39, 1556) | 1 | TATTTAACCTGAGTATAGTATTTAACG AAGCCTAGAAGCACGGCTGTGGG |
| 4105 | Table 3A | Hs.287369 | XM_006881 | 13650909 | interleukin 22 (IL22), mRNA/cds = (71, 610) | 1 | AACTAACCCCTTTCCCTGCTAGAAA TAACAATTAGATGCCCCAAAGCGA |
| 4106 | literature | Hs.159 | XM_006950 | 13652420 | tumor necrosis factor receptor superfamily, member 1A (TNFRSF1A), mRNA/cds = (255, 1622) | 1 | ATAGCAAGCTGAACTGTCCTAAGGCA GGGGCGAGCACGGAACAATGGGGC |
| 4107 | Table 3A | Hs.159492 | XM_007156 | 12737945 | sacsin (SACS) gene, complete cds/cds = (76, 11565) | 1 | TGACAGGTTCACTTCTGAGGTTGCTA TGAGGGTGATGGAATGTACTGCCT |
| 4108 | Table 3A | Hs.170133 | XM_007189 | 14755876 | forkhead box O1A (rhabdomyosarcoma) (FOXO1A), mRNA/cds = (385, 2352) | 1 | TGTTTAAATGGCTTGGTGTCTTTCTTT TCTAATTATGCAGAATAAGCTCT |
| 4109 | Table 3A | Hs.87409 | XM_007606 | 14749307 | thrombospondin 1 (THBS1), mRNA/cds = (111, 3623) | 1 | TTGAAATTGGTGGCTTCATTCTAGAT GTAGCTTGTGCAGATGTAGCAGGA |
| 4110 | Table 3A | Hs.75415 | XM_007650 | 14785206 | cDNA; FLJ22810 fis, clone KAIA2933, highly similar to AB021288 mRNA for beta 2-microglobulin/cds = UNKNOWN | 1 | ACTTCTTATACATTTGATAAAGTAAGG CATGGTTGTGGTTAATCTGGTTT |
| 4111 | Table 3A | Hs.17279 | XM_008062 | 13627121 | tyrosylprotein sulfotransferase 1 (TPST1), mRNA/cds = (81, 1193) | 1 | CATGAAGAAGCAAGACGAAAAC ACACAGGAGGGAAAATCCTGGGAT TCTT |
| 4112 | Table 3A | Hs.5344 | XM_008082 | 14779810 | adaptor-related protein complex 1, gamma 1 subunit (AP1G1), mRNA/cds = (28, 2505) | 1 | GCCTGGCTTGGACCTTGGCATTCCGT TTGAATTCCTTCTAACTGGAACAT |
| 4113 | Table 3A | Hs.75703 | XM_008449 | 13852724 | small inducible cytokine A4 (homologous to mouse Mip-1b) (SCYA4), mRNA/cds = (108, 386) | 1 | GTCCACTGTCACTGTTTCTCTGCTGT TGCAAATACATGGTAACACATTT |
| 4114 | literature | Hs.79241 | XM_008738 | 13846672 | B-cell CLL/lymphoma 2 (BCL2), nuclear gene encoding mitochondrial protein, transcript variant alpha, mRNA/cds = (31, 750) | 1 | TTGTGTTGTTGGAAAAAGTCACATTG CCATTAAACTTTCCTTGTCTGTCT |
| 4115 | db mining | Hs.9731 | XM_008901 | 11432998 | nuclear factor of kappa light polypeptide gene enhancer in B-cells inhibitor, beta (NFKBIB), mRNA/cds = (0, 1016) | 1 | CAGTAGCGACAGCGACGGCGGAGAC GAGGGCGTGAGTCAGGAGGAGAGAC |
| 4116 | db mining | Hs.69747 | XM_009101 | 11425196 | fucosyltransferase 1 (galactoside 2-alpha-L-fucosyltransferase, Bombay phenotype included) (FUT1), mRNA/cds = (103, 1200) | 1 | AGCTGCCACGGGTGAGAGAGCAGGA GGTATGAATTAAAAGTCTACAGCAC |
| 4117 | db mining | Hs.46328 | XM_009103 | 14760495 | mRNA for alpha (1,2)fucosyltransferase, complete cds/cds = (111, 1142) | 1 | CTTTCCTCAAAATCTTTAAGCCAGAG GCAGCCTTCCTGCCGGAGTGGACA |
| 4118 | Table 3A | Hs.84038 | XM_009533 | 14771190 | CGI-06 protein (LOC51604), mRNA/cds = (6, 1730) | 1 | TCTGCCTCACGTGCACTGTGGTGGC CGTGTGCTACGGCTCCTTCTACAAT |
| 4119 | Table 3A | Hs.296585 | XM_009574 | 14771391 | nucleolar protein (KKE/D repeat) | 1 | CCATAGCCCAAGGTGACATTTCCCAC |

TABLE 8-continued

| SEQ ID | Origin | Unigene | Locus | GI | Nominal Description | Strand | Probe Sequence |
|---|---|---|---|---|---|---|---|
| 4120 | Table 3A | Hs.198298 | XM_009641 | 14770741 | (NOP56), mRNA/cds = (21, 1829) cDNA FLJ14219 fis, clone NT2RP3003800, highly similar to *Rattus norvegicus* tyrosine protein kinase pp60-c-src mRNA/cds = (501, 1256) | 1 | CCTGTGCCGTGTTCCCCAATAAAA GGGGTATCCAGAATTGGTTGTAAATA CTTTGCATATTGTCTGATTAAACA |
| 4121 | Table 3A | Hs.334691 | XM_009917 | 13648023 | hypothetical protein FLJ22427 (FLJ22427), mRNA/cds = (40, 2631) | 1 | GAGGCTTTGCCTTGCCTGCATATTTG TTTCGCTCTTACTCAGTTTGGGAA |
| 4122 | Table 3A | Hs.278027 | XM_009929 | 11417988 | LIM domain kinase 2 (LIMK2), transcript variant 2b, mRNA/cds = (315, 2168) | 1 | GCAAGTGTAGGAGTGGTGGGCCTGA ACTGGGCCATTGATCAGACTAAATA |
| 4123 | Table 3A | Hs.32970 | XM_010593 | 14727775 | signaling lymphocytic activation molecule (SLAM), mRNA/cds = (133, 1140) | 1 | TTGCAAAACCCAGAAGCTAAAAAGTC AATAAACAGAAAGAATGATTTTGA |
| 4124 | Table 3A | Hs.155595 | XM_010897 | 13837965 | neural precursor cell expressed, developmentally down-regulated 5 (NEDD5), mRNA/cds = (258, 1343) | 1 | CCCACACTGCTACACTTCTGATCCCC TTTGGTTTTACTACCCAAATCTAA |
| 4125 | Table 3A | NA | XM_011080 | 14738482 | T cell activation, increased late expression | 1 | AAAAGAAGCCCTAATAAACCACCCGG ATAATAACCCTGTCTACCATCTTT |
| 4126 | Table 3A | Hs.302014 | XM_011062 | 13626304 | interleukin 21 (IL21), mRNA/cds = (46, 534) | 1 | GTGAAGATTCCTGAGGATCTAACTTG CAGTTGGACACTATGTTACATACT |
| 4127 | Table 3A | Hs.78687 | XM_011714 | 14749491 | neutral sphingomyelinase (N-SMase) activation associated factor (NSMAF), mRNA/cds = (12, 2765) | 1 | AGAAGGATTAGCAGTTCTTAGTAAGT TTACTGTGTATAGGAACGGTTTGT |
| 4128 | literature | Hs.91390 | XM_011844 | 14739654 | poly (ADP-ribose) glycohydrolase (PARG), mRNA/cds = (166, 3096) | 1 | CGGCTGCCTCTCTTGAGACCATCTGC CAATCACACAGTAACTATTCGGGT |
| 4129 | Table 3A | Hs.76038 | XM_011865 | 14737830 | isopentenyl-diphosphate delta isomerase (ID11), mRNA/cds = (50, 738) | 1 | CCCAACTGAGGACCACTGTCTACAGA GTCAGGAAATATTGTAGGGAGAA |
| 4130 | Table 3A | Hs.180450 | XM_011914 | 13828205 | ribosomal protein S24 (RPS24), transcript variant 1, mRNA/cds = (37, 429) | 1 | CTGGCAAAAAGCCCGAAGGAGT AAAGGTGCTGCAATGATGTTAGCTG TGGC |
| 4131 | Table 3A | Hs.154938 | XM_012059 | 14771044 | hypothetical protein MDS025 (MDS025), mRNA/cds = (5, 769) | 1 | TGTTTGCTTGAACAGTTGTGTAAATC ATACAGGATTTTGTGGGTATTGGT |
| 4132 | Table 3A | Hs.1051 | XM_012328 | 14750596 | granzyme B (granzyme 2, cytotoxic T-lumphocyte-associated serine esterase 1) (GZMB), mRNA/cds = (33, 776) | 1 | GGAGCCAAGTCCAGATTTACACTGG GAGAGGTGCCAGCAACTGAATAAAT |
| 4133 | Table 3A | Hs.251526 | XM_012649 | 13833583 | gene for monocyte chemotactic protein-3 (MCP-3)/cds = (0, 329) | 1 | GGATGCTCCTCCCTTCTCTACCTCAT GGGGGTATTGTATAAGTCCTTGCA |
| 4134 | db mining | Hs.278454 | AF285431 | 12741752 | killer cell immunoglobulin-like receptor, two domains, long cytoplasmic tail, 2 (KIR2DL2), mRNA/cds = (14, 1060) | 1 | TAACTTCAATGTAGTTTTCCATCCTTC AAATAAACATGTCTGCCCCCATG |
| 4135 | Table 3A | Hs.334437 | XM_015180 | 14778515 | hypothetical protein MGC4248 (MGC4248), mRNA/cds = (70, 720) | 1 | GAGTCCTTTTGATTTTAACTTATTCC CCATGTCCCTATACTCGTGTGC |
| 4136 | Table 3A | Hs.137555 | XM_015921 | 1760439 | putative chemokine receptor, GTP-binding protein (HM74), mRNA/cds = (60, 1223) | 1 | TGCACGTTCCTCCTGGTTCCTTCGCT TGTGTTTCTGTACTTACCAAAAAT |
| 4137 | Table 3A | Hs.164371 | XM_016136 | 13835810 | cDNA FLJ1315 fis, clone NT2RP3003842/cds = UNKNOWN | 1 | CAGCTTCAGCTAGGAGTTTGTAAGCA AGGACTTTGTGACACATTTGTCCC |
| 4138 | Table 3A | Hs.323463 | XM_016481 | 14721648 | mRNA for KIAA1693 protein, partial cds/cds = (0, 2707) | 1 | AATTGAAAAGTACCAAGAAGTG GAAGAAGACCAAGACCCATCATGC CCCA |
| 4139 | Table 3A | Hs.15220 | XM_016721 | 14784971 | zinc finger protein 106 (ZFP106), mRNA/cds = (335, 5986) | 1 | ACTTCCTAGACACTTGTTTCTGAGAC AGTTCTTTGCCTTCACTTCCCTGC |
| 4140 | Table 3A | Hs.323463 | XM_016972 | 14726508 | mRNA for KIAA1693 protein, partial cds/cds = (0, 2707) | 1 | ACAACTGACCTGTCTCCTTCACATAG TCCATATCACCACAAATCACACAA |
| 4141 | Table 3A | Hs.180946 | XM_018498 | 14723691 | ribosomal protein L5 pseudogene mRNA, complete cds/cds = UNKNOWN | 1 | GCTCAGGAGCGGGGCTGCTGAGAGCT AAACCCAGCAATTTCTATGATTTT |
| 4142 | Literature | Hs.194382 | U67093 | 2072143 | ataxia telangiectasia (ATM) gene, complete cds/cds = (795, 9965) | 1 | AAAGAAAGCCAGTATATTGGTTTGAA ATATAGAGATGTGTCCCAATTTCA |
| 4143 | Literature | Hs.184167 | NM_006276 | 6857827 | splicing factor, arginine/serine-rich 7 (35kD) (SFRS7) mRNA/cds = (105, 490) | 1 | ACTGGCAGGCTTATTTATCTGTTGCA CTTGGTTAGCTTTAATTGTTCTGT |
| 4144 | Literature | Hs.79037 | NM_002156 | 4504520 | *Homo sapiens*, heat shock 60kD protein 1 (chaperonin), clone MGC:19755 IMAGE:3830225, mRNA, complete cds/cds = (1705, 3396) | 1 | AGCAGCCTTTCTGTGGAGAGTGAGAA TAATTGTGTACAAAGTAGAGAAGT |
| 4145 | Literature | Hs.206984 | U15177 | 988207 | cosmid CRI-JC2015 at D10S289 in 10sp13/cds = (0, 1214) | 1 | CAACTGTGCTGGCCGGGAGGAGAGC AGAGACGCAGTCCTGCCCAGTGTAG |
| 4146 | Literature | Hs.395 | XM_002923 | 13643499 | chamokine (C—C motif) receptor 2 (CCR2), mRNA/cds = (39, 1163) | 1 | CACATGGCTAAAGAAGGTTTCAGAAA GAAGTGGGGACAGAGCAGAACTTT |
| 4147 | Literature | NA | NC_001807 | 13959823 | mitochondrion, complete genome | 1 | CCGACATCTGGTTCCTACTTCAGGGT CATAAAGCCTAAATAGCCCACACG |
| 4148 | Literature | Hs.32017 | NM_020645 | 11034818 | ASCL3 gene, CEGP 1 gene, C11orf14 gene, C11orf15 gene, C11orf16 gene and C11orf17 gene/cds = (66, 791) | 1 | CTCATTTGTATTCAAGCCTTTAACAG GAGGGCAAAGAGGTGAGAATGTGT |

TABLE 8-continued

| SEQ ID | Origin | Unigene | Locus | GI | Nominal Description | Strand | Probe Sequence |
|---|---|---|---|---|---|---|---|
| 4149 | Literature | Hs.74621 | U29185 | 2865216 | prion protein (p27-30) (Creutzfeld-Jakob disease, Gersimann-Strausler-Scheinker syndrome, fatal familial insomnia) (PRMP), mRNA/cds = (49, 810) | 1 | GCACTGAATCGTTTCATGTAAGAATC CAAAGTGGACACCATTAACAGGTC |
| 4150 | Literature | NA | X04948 | 36891 | T-cell receptor alpha-chain HAP05 V(e)3.1/J(a)P | 1 | GCAGACACTGCTTCTTACTTCTGTGC TACGGATGGGAACAGAGATGACAA |
| 4151 | Literature | NA | X92768 | 1054779 | mRNA for T-cell receptor alpha (clone XPBP531) | 1 | GGGGAAACTGGAGGCTTCAAAACTAT CTTTGGAGCAGGAACAAGACTATT |
| 4152 | Literature | Hs.75064 | NM_003192 | 4507372 | tubulin-specific chaperone (TBCC), mRNA/cds = (23, 1063) | 1 | GGGGAAGGAGGGTGATTATATTGCTT TGTAATGGTTTGTGATACTTGAAA |
| 4153 | Literature | Hs.99093 | 8G179517 | 12686220 | chromosome 19, cosmid R28379/cds = (0, 633) | 1 | GTACGAATGGGAGGTCCTCGACACC TGGGGAACTGCGGACTATGCGGCAG |
| 4154 | Literature | Hs.77356 | NM_003234 | 4507456 | transferrin receptor (p90, CD71) (TFRC), mRNA/cds = (263, 2545) | 1 | TATCAGACTAGTGACAAGCTCCTGGT CTTGAGATGTCTTCTCGTTAAGGAA |
| 4155 | Literature | Hs.194638 | U89387 | 2253834 | polymerase (RNA) II (DNA directed) polypeptide D (POLR2D), mRNA/cds = (30, 458) | 1 | TGACCTCCACCAAAGCCCATATAAGG AGCGGAGTTGTTAAGGACTGAAGA |
| 4156 | Literature | Hs.15220 | NM_022473 | 14764971 | zinc finger protein 106 (ZFP106), mRNA/cds = (335, 5986) | 1 | TTTCTCCGGACTCATCAGTAAACCTG TAGAAGTGTCGCTTTCCAGCCTTT |
| 4157 | Literature | Hs.326248 | NM_014456 | 7657448 | cDNA; FLJ22071 fis, clone HEP11691/cds = UNKNOWN | 1 | TTTGTAAGCGAAGGAGATGGAGGTC GTCTTAAACCAGAGAGCTACTGAAT |
| 4158 | Literature | Hs.182447 | BC003394 | 13097278 | heterogeneous nuclear ribonucleoprotein C (C1/C2) (HNRPC), transcript variant 1, mRNA/cds = (191, 1102) | 1 | AAAGTTGATACTGTGGGTTATTTTTGT GAACAGCCTGATGTTTGGGACCT |
| 4159 | Literature | Hs.31314 | X72841 | 297903 | relinoblastoma-binding protein 7 (RBBP7), mRNA/cds = (287, 1564) | 1 | AACTTTTACACTTTTTCCTTCCAACAC TTCTTGATTGGCTTTGCAGAAAT |
| 4160 | Literature | Hs.177592 | NM_001003 | 4506668 | ribosomal protein, large, P1 (RPLP1), | 1 | ACAGCCAAGACTTAGGTTACAGGGCA ACGCACTACTGTTCAGCTTTGAAT |
| 4161 | Literature | Hs.81361 | M65028 | 337450 | heterogeneous nuclear ribonucleoprotein A/B (HNRPAB), transcript variant 1, mRNA/cds = (224, 1219) | 1 | ACGTGTCCTGATTTTGCCACAACCTG GATATTGAAGCTATCCAAGCTTTT |
| 4162 | Literature | Hs.279939 | BC004560 | 13528726 | mitochondrial carrier homolog 1 (MTCH1), nuclear gene encoding mitochondrial protein, mRNA/cds = (0, 1118) | 1 | AGCTGTTGATGCTGGTTGGACAGGTT TGAGTCAAATTGTACTTTGCTCCA |
| 4163 | Literature | Hs.241567 | NM_002897 | 8400725 | RNA binding motif, single stranded interacting protein 1 (RBMS1), transcript variant MSSP-2, mRNA/cds = (265, 1434) | 1 | ATAAGGTGCATAAAACCCTTAAATTC ATCTAGTAGCTGTTCCCCCGAACA |
| 4164 | Literature | NA | BE874440 | 10323216 | NIH_MGC_69 cDNA clone IMAGE:3891187 5', | 1 | CCAATGACAGCCTACCTATTACCAAG GGCTCCCCTACAACTCTGAACCTT |
| 4165 | Literature | Hs.1074 | BC005913 | 13543508 | surfactant, pulmonary-associated protein C (SFTPC), mRNA/cds = (27, 620) | 1 | GACAAACCCTGGAGAAATGGGAGCT TGGGGAGAGGATGGGAGTGGGCAGA |
| 4166 | Literature | Hs.56205 | BC001880 | 12804864 | insulin induced gene 1 (INSIG1), mRNA/cds = (414, 1247) | 1 | GTGTCAGTGCCCAAAGGAGGGAGGT TGATGGTGCTTAACAAACATGAAGT |
| 4167 | Literature | Hs.77356 | BC001188 | 12654696 | transferrin receptor (p90, CD71) (TFRC), mRNA/cds = (263, 2545) | 1 | TCATTGTATAAAAGCTGTTATGTGCAA CAGTGTGGAGATTCCTTGTCTGA |
| 4168 | Literature | Hs.194638 | BC002958 | 12804200 | polymerase (RNA) II (DNA directed) polypeptide D (POLR2D), mRNA/cds = (30, 458) | 1 | TGACCTCCACCAAAGCCCATATAAGG AGCGGAGTTGTTAAGGACTGAAGA |
| 4169 | Literature | Hs.35406 | AA057484 | 1550124 | 602675161F1 cDNA, 5' end/clone = IMAGE:4797783/clone_end = 5' | 1 | TTGGCTTCATTACGAGAGAGAAACAT AACAGAGGCAGTGATGGTTTCAGA |
| 4170 | Literature | Hs.74451 | X04106 | 35327 | calpain 4, small subunit (30K) (CAPN4), mRNA/cds = (158, 964) | 1 | TTTGTCTATATTCTGCTCCCAGCCTG CCAGGCCAGGAGGAAATAAACATG |
| 4171 | Literature | Hs.13231 | H17596 | 883836 | od15d12.s1 cDNA/clone = IMAGE:1368023 | 1 | AGCACATTGGGAGATACATGATAAAT TTCTATCTGCAGTTGCTATTTGCA |
| 4172 | Literature | Hs.74002 | U40396 | 1117914 | mRNA for steroid receptor coactivator 1e/cds = (201, 4400) | 1 | GGCCCAGCAGAAGAGCCTCCTTCAG CAGCTACTGACTGAATAACCACTTT |
| 4173 | Literature | NA | X17403 | 59591 | CMV HCMVTRL2 = IRL2 | 1 | AATAATAGATTAGCAGAAGGAATAAT CCGTGCGACCGAGCTTGTGCTTCT |
| 4174 | Literature | NA | X17403 | 59591 | CMV HCMVUL27 | 1 | ACATTCAAAAGTTTGAGCGTCTTCAT GTACGCCGTTTTCGGCCTCACGAG |
| 4175 | Literature | NA | X17403 | 59591 | CMV HCMVUL106 | 1 | ACGAACAGAAATCTCAAAAGACGCTG ACCCGATAAGTACCGTCACGGAGA |
| 4176 | Literature | NA | X17403 | 59591 | CMV HCMVTRL7 = IRL7 | 1 | AGGAACCAGCAAGTCAACAAAA GACTAACAAAGAAAAACCATCTTG GAAT |
| 4177 | Literature | NA | X17403 | 59591 | CMV HCMVUL33 | 1 | CCAACGACACATCCACAAAAATCCCC CATCGACTCTCACAATCGCATCAT |
| 4178 | Literature | NA | X17403 | 59591 | CMV HCMVUL123 | 1 | CCTCTGGAGGCAAGAGCACCCACCC TATGGTGACTAGAAGCAAGGCTGAC |

TABLE 8-continued

| SEQ ID | Origin | Unigene | Locus | GI | Nominal Description | Strand | Probe Sequence |
|---|---|---|---|---|---|---|---|
| 4179 | Literature | NA | X17403 | 59591 | CMV HCMVUL75 Glycoprotein H | 1 | GATGTCCGTCTACGCGCTATCGGCC ATCATCGGCATCTATCTGCTCTACC |
| 4180 | Literature | NA | X17403 | 59591 | CMV HCMVUS28 | 1 | TTCGTGGGCACCAAGTTTCGCAAGAA CTACACTGTCTGCTGGCCGAGTTT |
| 4181 | Literature | NA | X17403 | 59591 | CMV HCMVUL21 | 1 | GAGATCGACATCGTCATCGACCGAC CTCCGCAGCAACCCCTACCCAATCC |
| 4182 | Literature | NA | X17403 | 59591 | CMV HCMVUL54 | 1 | CTTTGAGCAGGTTCTCAAGGCTGTAA CTAACGTGCTGTCGCCCGTCTTTC |
| 4183 | Literature | NA | X17403 | 59591 | CMV HCMVUL83 | 1 | TCTTCTGGGACGCCAACGACATCTAC CGCATCTTCGCCGAATTGGAAGGC |
| 4184 | Literature | NA | X17403 | 59591 | CMV HCMVUL109 | 1 | AGAGAACAACAAACCACCACGACGA TGAAACAAAACGCTCAACCAAACA |
| 4185 | Literature | NA | X17403 | 59591 | CMV HCMVUL113, spliced to HCMVUL112 | 1 | GAGAAAAGATTGTGCGATCTCCCCCT GGTTTCCAGCAGACTCTTGCCAGA |
| 4186 | Literature | NA | X17403 | 59591 | CMV HCMVUL122 | 1 | CATCTTCTCCACCAACCAGGGTGGGT TCATGCTGCCTATCTACGAGACGG |
| 4187 | db mining | Hs.164427 | AI307795 | 4002399 | tb28c03.x1 cDNA 3' end/clone = IMAGE:2055852/clone_end = 3' | −1 | TCCCATGTTCCCTTTATTTGTCTTTTG GTTCTGCTTTTTGGGAGATTTTT |
| 4188 | Table 3A | Hs.169168 | AA977148 | 3154594 | oq24g08.s1 cDNA 3' end/clone = IMAGE:1587326/clone_end = 3' | −1 | TGGTGCGCTTTTGTGTGCGGTGGAG GAGTTCCTAACCCTCGGCTTGTTTT |
| 4189 | Table 3A | Hs.117333 | AI023714 | 3238758 | mRNA for KIAA1093 protein, partial cds/cds = (179, 5362) | −1 | GCCGTTGGTTGGCTTAAACTTGGTTT CGTCACTTCGGGCACTTTGGTTTT |
| 4190 | Table 3A | NA | AI380955 | 4190797 | lg18b08.x1 cDNA, 3' end/clone = IMAGE:2109111 | −1 | CTGGCCTCCCCTGGCTCTTTAAGCTC CCCTTTGGTTAAAAACTGGGTTTT |
| 4191 | Table 3A | Hs.93870 | AA976045 | 3151837 | cDNA; FLJ22664 fis, clone HS108202/cds = UNKNOWN | −1 | AAAAGGCCAAGGGTGTTGTTGGGGC GTCTGTCTAATGTGGTGGGTCTTTT |
| 4192 | Table 3A | Hs.332583 | AA788623 | 2874972 | yc77a06.s1 cDNA 3' end/clone = IMAGE:21844/clone_end = 3' | −1 | GCTGTAAATCTCTGTCTCATCATCCTT CTCTTTTGTTTCCATAGCCTTTT |
| 4193 | Table 3A | Hs.71433 | AA131524 | 1693030 | zl31h02.s1 cDNA 3' end/clone = IMAGE:503571/clone_end = 3' | −1 | GTGTGTGCTGGCTGAGAAGCCACTG TGAATTGATTCTTCTTCTGAAGTTT |
| 4194 | Table 3A | Hs.309127 | AI380687 | 4190540 | tg03e04.x1 cDNA 3' end/clone = IMAGE:2107710/clone_end = 3' | −1 | AATAAGGGTGTTGCCCTTTGTTCCCT CACATAATCGTGAAAGGCTGCTTT |
| 4195 | Table 3A | Hs.102630 | AA808085 | 2877491 | 602440867F1 cDNA 5' end/clone = IMAGE:4556561/clone_end = 5' | −1 | TTCCTCAGTCCCTGTTCATACCATCT CTGCACCCACAATCACACTGATTT |
| 4196 | Table 3A | Hs.134473 | AI074016 | 3400660 | oy66g02.x1 cDNA 3' end/clone = IMAGE:1870834/clone_end = 3' | −1 | GACCACAGATATGCACTCCTTACATT AACCTCAGCCTTGATGTATCATTT |
| 4197 | Table 3A | Hs.158653 | AI370965 | 4149718 | ta29b11.x1 cDNA 3' end/clone = IMAGE:2045489/clone_end = 3' | −1 | CCCCCTGTTATGAAAAGGGTTAAACT TGAACCCACCCATTTTAAAAATTT |
| 4198 | Table 3A | Hs.243029 | AA424812 | 2106917 | UI-H-B14-aow-c-10-0-UI.s1 cDNA 3' end/clone = IMAGE:3086226/clone_end = 3' | −1 | TTATAGCTACCAGAAGCCACCAGGGC CTTAGCCCAGCAGTAGAAACCTCT |
| 4199 | Table 3A | Hs.188777 | AA432384 | 2114747 | zw76a09.s1 cDNA 3' end/clone = IMAGE:782104/clone_end = 3' | −1 | GATCAGTAGACACACCCCTCAATGCT GCGAAGAAAATGAAGGCCACTCTT |
| 4200 | Table 3A | Hs.132237 | AI031656 | 3249868 | ow48e06.x1 cDNA 3' end/clone = IMAGE:1650082/clone_end = 3' | −1 | AGCAGACAATGGACAACTGTAGTTTT TGAATTGACTTCTATAGCCATCTT |
| 4201 | db mining | Hs.123445 | AA813728 | 2882413 | 602623874F1 cDNA 5' end/clone = IMAGE:4748515/clone_end = 5' | −1 | TCCACCACAGTGCATGATAATTCCGA CAGAACGGCCTTTTATTTGTACCT |
| 4202 | Table 3A | Hs.143049 | AI126688 | 3595202 | *Homo sapiens*, Similar to DKFZP727C091 protein, clone MGC:10677 IMAGE:3948445, mRNA, complete cds/cds = (79, 1530) | −1 | TGTTCTCTGAACTGTCTGGATGAACC GGTCAACGGCACTCATCATACCTT |
| 4203 | Table 3A | Hs.108327 | AA701667 | 2704832 | damage-specific DNA binding protein 1 (127kD) (DDB1), mRNA/cds = (109, 3531) | −1 | GCTTCACTCTGCTTTCTGTATAAAGG GCAGTCTGTGGTCACGCAAGACTT |
| 4204 | Table 3A | Hs.270264 | AA813224 | 2464262 | no19d06.s1 cDNA 3' end/clone = IMAGE:1101131/clone_end = 3' | −1 | AGCAAAGACCAAATTCTCCTTGGGAA GTGTGGGAGCAGGCTGACATTATT |
| 4205 | Table 3A | Hs.158978 | AI380390 | 4190243 | UI-H-B12-ahi-a-03-0-UI.s1 cDNA 3' end/clone = IMAGE:2726692/clone_end = 3' | −1 | GTCCTTTGATAGCAGAACAAGAGGCT CTGTGATCCTCTGGACCTCAGATT |
| 4206 | Table 3A | Hs.204214 | AA826926 | 2900923 | EST389900 cDNA | −1 | TCCACGACATGGTACAGCTCTTCACT TTTTCAGCTTTTTAAATGTCCATT |
| 4207 | Table 3A | Hs.326392 | AA974839 | 3150631 | son of sevenless (Drosophila) homolog 1 (SOS1), | −1 | GACAAGGCAATGCTACTGATCACCTG AGGATAATGGTGAAGGACTTTTGT |

TABLE 8-continued

| SEQ ID | Origin | Unigene | Locus | GI | Nominal Description | Strand | Probe Sequence |
|---|---|---|---|---|---|---|---|
| 4208 | Table 3A | Hs.53542 | AI084224 | 3422647 | mRNA/cds = (0, 3998) chorea-ecanthocytosis (CHAC) mRNA, complete cds/cds = (260, 2784) | −1 | TCAATAGTTGTGAAATTCTTCTCAGG CTCCTTAAACCCTCGCTTTGTTGT |
| 4209 | Table 3A | Hs.173334 | AA284232 | 1928532 | ELL-RELATED RNA POLYMERASE II, ELONGATION FACTOR (ELL2), mRNA/cds = (0, 1922) | −1 | AGGCTTACGTTTATCCAAAAGCATTT CACCTTGCACATTACTGTTGTTGTT |
| 4210 | db mining | Hs.86437 | AI300700 | 3960048 | 602411368F1 cDNA 5' end/clone = IMAGE:4540096/clone_end = 5' | −1 | ACAAGCATTTAGATCATAACATGGTA AAGCCTATTACCAGCCAATGTTGT |
| 4211 | db mining | Hs.61558 | AI220970 | 3803173 | hz63d07.x1 cDNA 3' end/clone = IMAGE:3212653/clone_end = 3' | −1 | TGTTTTGGCATAGAGCTTTACTTAAAA TGCTGCTTCATTTTACACATTGT |
| 4212 | Table 3A | Hs.239489 | AA639796 | 2563575 | TIA1 cytotoxic granule-associated RNA-binding protein (TIA1), transcript variant 2, mRNA/cds = (185, 1345) | −1 | TGGAGCTCAATTCTATGCAGTTGTGC TGATATTTCATTAAGTCACTGTGT |
| 4213 | Table 3A | Hs.228795 | AI094726 | 3433702 | qa08f05.x1 cDNA 3' end/clone = IMAGE:1688177/clone_end = 3' | −1 | TTTCCCCTTGGCCTGAGTTTTTATAAA ATTTCCATTAATTGGGGCAGTGT |
| 4214 | db mining | Hs.62699 | AA740964 | 2779556 | EST386140 cDNA | −1 | TGCAGCTAAATTCGAAGCTTTTGGTC TATATTGTTAATTGCCATTGCTGT |
| 4215 | Table 3A | Hs.124675 | AA858297 | 2948599 | ob13b08.s1 cDNA 3' end/clone = IMAGE:1323543/clone_end = 3' | −1 | GGATTTGGAAGATGCTTTCAGAAATA TGGCATAGGTTTTTGTCGAAATGT |
| 4216 | Table 3A | NA | AI281442 | 3919675 | cDNA clone IMAGE:1967452 3' | −1 | AAAGAAAAATTCAGCCTGAACCCTAC CCTTATAAAACAGGTTAATTGGGT |
| 4217 | Table 3A | Hs.228817 | AI199388 | 3751994 | qs75e05.x1 cDNA 3' end/clone = IMAGE:1943936/clone_end = 3' | −1 | TGTAAGTCCCATGCCCGAATTTGGAG ATTTGGGTTTTTCTTTTCAGGGGT |
| 4218 | Table 3A | Hs.291003 | AA504269 | 2240429 | hypothetical protein MGC4707 (MGC4707), mRNA/cds = (72, 1067) | −1 | CGGATTCCAAATTACTTAAAGCCTTTA TGGGAACACGGTAGATTGTAGGT |
| 4219 | Table 3A | Hs.299416 | AA132448 | 1694015 | zo20a03.s1 cDNA 3' end/clone = IMAGE:587404/clone_end = 3' | −1 | GCCTTCTGGCCTCTGAGGCAAAGGT CAGTGATACTGATGGGAGGGTAGGT |
| 4220 | Table 3A | Hs.6733 | AI057025 | 3330814 | phosphoinositide-specific phospholipase C PLC-epsilon mRNA, complete cds/cds = (235, 7146) | −1 | GCTCAAGATCACCTCTTTGTCATCTT GAACAATGTTTTCTCTTCTAGGT |
| 4221 | db mining | Hs.177712 | AA251806 | 1886786 | zs09c03.s1 cDNA 3' end/clone = IMAGE:684676/clone_end = 3' | −1 | TGTTTCCACTTCATGGGATATGACTC CATCACAATGAAAATGGGTCCAGT |
| 4222 | Table 3A | Hs.133175 | AI51673 | 3307207 | oy77g06.x1 cDNA 3' end/clone = IMAGE:1671898/clone_end = 3' | −1 | TTGTGATTGTAAATCATGTATGTACAA ATGCCATGAAAATTAAAGCCAGT |
| 4223 | Table 3A | Hs.203041 | AI271437 | 3890604 | 602417270F1 cDNA, 5' end/clone = IMAGE:4538737/clone_end = 5' | −1 | TTTCCCTTATGCACCTTCCAGTCTTTG GCAGGACATGATTTATGGACAGT |
| 4224 | Table 3A | Hs.56205 | AA846378 | 2932518 | insulin induced gene 1 (INSIG1), mRNA/cds = (414, 1247) | −1 | TGCACTCTACCAGATTTGAACATCTA GTGAGGTTCACATTCATACTAAGT |
| 4225 | Table 3A | NA | AA873734 | 2969856 | Vanin 2 | −1 | TCAACTGCAGGGAATCTCCTAGGAAG CGGATAAATCTGGCAATTGGAAGT |
| 4226 | Table 3A | NA | AA482019 | 2209697 | cDNA clone IMAGE:746048 3' | −1 | ACCACCAGCTATTTGTAATTCCTTCTT CTAAGGCATAGTGAAAACTTGCT |
| 4227 | db mining | Hs.182594 | AA806247 | 2875516 | oc21f01.s1 cDNA, 3' end/clone = IMAGE:1341529 | −1 | TCGCTTTCTAACTGATTCCATTCCAC CATGTCAGATACTCCTGGGCTGCT |
| 4228 | Table 3A | Hs.210727 | AI075288 | 3401879 | oy69h10.x1 cDNA, 3' end/clone = IMAGE:1671139/clone_end = 3' | −1 | CAGCAATGAGGGGATATTTTGATGA GCTGGAATATCCAATTGAACAGCT |
| 4229 | Table 3A | Hs.252300 | AI383340 | 4196121 | tc76g05.x1 cDNA, 3' end/clone = IMAGE:2070584/clone_end = 3' | −1 | CCCCCTAAGTTAAAAGCTCTGTCTTT TTGGGGTTTGCCCTATGTAAAGCT |
| 4230 | Table 3A | Hs.191958 | AI347054 | 4084260 | immunoglobulin superfamily receptor translocation associated 2 (IRTA2), mRNA/cds = (158, 3091) | −1 | GAAGCCTCTACTCTTGAGTCTCTTTC ATTACTGGGGATGTAAATGTTCCT |
| 4231 | Table 3A | Hs.283410 | AI253134 | 3849663 | 602635144F1 cDNA, 5' end/clone = IMAGE:4780090/clone_end = 5' | −1 | ACACTTGATCTCTTCCTTATTTCTCTC AGAAAACCTGTAGGATTGTGCCT |
| 4232 | Table 3A | Hs.44189 | AI361839 | 4113460 | yz99f01.s1 cDNA, 3' end/clone = IMAGE:291193/clone_end = 3' | −1 | AGTAGATATTTTGCCGGTGTACTTGG AATACCTTCAGAAGCCAAACCCT |
| 4233 | Table 3A | Hs.148288 | AA908367 | 3047772 | og76c11.s1 cDNA, 3' end/clone = IMAGE:1454228/clone_end = 3' | −1 | AATTCCAATCCTGGTATATAGCACCT GGTATTATGGGTACCAAAAACCCT |
| 4234 | Table 3A | Hs.143534 | AI095189 | 3434165 | 602466053F1 cDNA, 5' end/clone = IMAGE:4594260/clone_end = 5' | −1 | ACTGCTCCAAATATCAACCCCATGTA GGCAGGATGTTTGATCTTGGTACT |
| 4235 | Table 3A | Hs.23349 | AI357493 | 4109114 | nab70e03.x1 cDNA, 3' | −1 | TGTTGTTGGATACGTACTTAACTGGT |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:3273292/clone_end = 3' | | ATGCATCCCATGTCTTTGGGTACT |
| 4236 | db mining | Hs.292235 | AI057035 | 3330824 | oy75b11.x1 cDNA, 3' end/clone = IMAGE:1671645 | −1 | TTAGGATTGCTCAGTTTCATCAAGGT TTGAAGGATAGGCAGGCTCTCACT |
| 4237 | Table 3A | Hs.337986 | AA101212 | 1647866 | *Homo sapiens*, clone MGC:17431 IMAGE:2984883, mRNA, complete cds/cds = (1336, 1494) | −1 1 | GGCCAGTCTCTGTGTGTCTTAATCCC TTGTCCTTCATTAAAAGCAAAACT |
| 4238 | Table 3A | Hs.60088 | AA004799 | 1448296 | hypothetical protein MGC11314 (MGC11314), mRNA/cds = (221, 673) | −1 | GCATTCCCGGTCACTCCCTCCCTAAT CTGAGCATCACTCAAGCTCTTTAT |
| 4239 | db mining | Hs.177376 | AA44590 | 2783354 | zb85a06.s1 cDNA, 3' end/clone = IMAGE:310354/clone_end = 3' | −1 | CTGAATGCCAAGAGCTTCAAGAGTGT GTGTAAATAAAGCCACACCTTTAT |
| 4240 | Table 3A | Hs.163787 | AA627122 | 2540166 | nq70g02.s1 cDNA, 3' end/clone = IMAGE:1157714/clone_end = 3' | −1 | CCCGAGGAGGAAGACGAATCGTTAA ACATCTGAAAGGGTCAGGTGAGTAT |
| 4241 | Table 3A | Hs.332992 | AA760848 | 2809778 | nz14f06.s1 cDNA, 3' end/clone = IMAGE:1287779/clone_end = 3' | −1 | CAAACTTGTTCTGAAGACAATTTCCA AGGTTGTCAGCCATGTCACCATAT |
| 4242 | Table 3A | Hs.129572 | AA746320 | 2786306 | ob08f01.s1 cDNA, 3' end/clone = IMAGE:1323097/clone_end = 3' | −1 | TCAGGTTCGTGTTAAACGCTGTATGT TAACTATGACTGGAATTCTGTGAT |
| 4243 | Table 3A | Hs.233383 | AA745714 | 2785700 | RC2-CT0434-310700-013-c08 cDNA | −1 | ATGGAGATCCAGAGACGTTGGTTTTC AAATGGAGCAAACAGCACTGTGAT |
| 4244 | Table 3A | Hs.156601 | AI146787 | 3874489 | qb83f02.x1 cDNA, 3' end/clone = IMAGE:1706715/clone_end = 3' | −1 | AGCTTTAGGCTGAGGGCATGGAAACT GTTACGCTTTTCCTTTTATGTGAT |
| 4245 | Table 3A | Hs.273775 | AA527312 | 2269381 | ng38a08.s1 cDNA, 3' end/clone = IMAGE:936854/clone_end = 3' | −1 | TCACTCCAGAATAGAAATTAGAGTAT AGGTAGGCAGTCCAACCTCTGCAT |
| 4246 | Table 3A | Hs.159316 | AI380278 | 4190131 | cDNA; FLJ21572 fis, clone COL06851/cds = UNKNOWN | −1 | TCAGATGCCACACTTATGAGACCCTC ATCCTTCTGCTCACTCTCTTCCAT |
| 4247 | Table 3A | Hs.159424 | AI380255 | 4190106 | 602589478F1 cDNA, 5' end/clone = IMAGE:4723722/clone_end = 5' | −1 | CCCTGCCTTTACCTCTCTACTTGTAG TGTTCTTTCAGAGCCTGCTCCCAT |
| 4248 | Table 3A | Hs.114931 | AA702108 | 2705221 | zi85e01.s1 cDNA, 3' end/clone = IMAGE:447576/clone_end = 3' | −1 | CAAAACAAGATGTGCCAGGGCCTGG GGGATGGGATAATTTCAGAGAGAAT |
| 4249 | Table 3A | Hs.179779 | AI004582 | 3214092 | ribosomal protein L37 (RPL37), mRNA/cds = (28, 321) | −1 | ACCCAAGAGGGCAGCAGTTGTGTCA TCCAGTTCATCTTAAGAATTTCAAT |
| 4250 | Table 3A | Hs.100555 | AI352690 | 4089896 | DEAD/H (Asp—Glu—Ala—Asp/His) box polypeptide 18 (Myc-regulated) (DDX18), mRNA/cds = (71, 2083) | −1 | GGGGTAGGAAGAGGATGGAATTGAG ATGTTTGAGCCTCATTTACATCAAT |
| 4251 | Table 3A | Hs.157213 | AI351144 | 4088350 | qt23f10.x1 cDNA, 3' end/clone = IMAGE:1948459/clone_end = 3' | −1 | GCTCTCTGATGCTGGTGGCTGTTCCC CCAGAATGGAAGCATTGATTAAAT |
| 4252 | Table 3A | Hs.77399 | AI337347 | 4074274 | caudal type homeo box transcription factor 2 (CDX2), mRNA/cds = (360, 1301) | −1 | GGGGAGAAGTGTATATGGTGAAGGGA AGTGGGGAGTATTTGAACACAGTTG |
| 4253 | Table 3A | Hs.128630 | AI222805 | 3805008 | qp39c07.x1 cDNA, 3' end/clone = IMAGE:1925388/clone_end = 3' | −1 | CACCATGCCTCACTTTTAGCGCAGTG TGATCCTACACAAATTGCCCTGTG |
| 4254 | Table 3A | Hs.270341 | AI270476 | 3889643 | 602307338F1 cDNA, 5' end/clone = IMAGE:4398848/clone_end = 5' | −1 | TATGGTTTTTAGGCTATGCAGATATTC TGTTGGTTTTGAGACAGCTCTG |
| 4255 | Table 3A | Hs.190229 | AA582958 | 2360318 | nn80d08.s1 cDNA, 3' end/clone = IMAGE:1090191/clone_end = 3' | −1 | CCTTCCTTTCTAAGGCATAAGTGCGA CGTTCGCTGCTGTGCGTGGAACTG |
| 4256 | Table 3A | Hs.170333 | AI373163 | 4153029 | qz13a07.x1 cDNA, 3' end/clone = IMAGE:2021364/clone_end = 3' | −1 | GAGAGGAAGGCAGACAGGCAGCCAT TTTAAGAGAGAAGAGCCAGACAATG |
| 4257 | Table 3A | Hs.158289 | AI199223 | 3751829 | qi47c06.x1 cDNA, 3' end/clone = IMAGE:1859626/clone_end = 3' | −1 | GTTATCAAAGGTGGAATCGGAAACAC CAGGCTCCTAGTGCCACGGAAATG |
| 4258 | Table 3A | Hs.29282 | AA748714 | 2788672 | mitogen-activated protein kinase kinase kinase 3 (MAP3K3), mRNA/cds = (83, 1963) | −1 | AAATGTGCCTATTGCTAGAGCTCCTC CCTCTCAACACCCAGTTTCCTTGG |
| 4259 | Table 3A | Hs.230752 | AI025427 | 3241040 | ow27g06.s1 cDNA, 3' end/clone = IMAGE:1648090/clone_end = 3' | −1 | CAATCGTCTTATCTCTACAGAGAGAA GTGGAAAATTCTTTTTCAAGGGGG |
| 4260 | Table 3A | Hs.131560 | AI024984 | 3240597 | ov39d11.x1 cDNA, 3' end/clone = IMAGE:1839701/clone_end = 3' | −1 | CTATGGAAGGCAGTTGGTGGGCAAA AGTCCGGTTTTTACGCTTTGAGGGG |
| 4261 | Table 3A | Hs.98306 | AA418743 | 2080544 | mRNA for KIAA1862 protein, partial cds/cds = (0, 1874) | −1 | GTCTGATCCTTAGACCGTCTCATCAC AGCAACCCTAACTGCAGAGCAGGG |
| 4262 | Table 3A | Hs.337307 | AA719537 | 2732636 | zh40g12.s1 cDNA, 3' | −1 | AATGGTAAGAAATGCCTTGTGTGGGT |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:414598/clone_end = 3' | | GGCCCTCCAGTCCCCAGTCCAGGG |
| 4263 | Table 3A | NA | AA136584 | 1697794 | fetal retina 937202 cDNA clone IMAGE:565899 3' | −1 | AACATATCCAGGGAGGACAAACTCTG GGCTGGACAATGTATCCACAAGGG |
| 4264 | Table 3A | Hs.339990 | AI263141 | 3871344 | qw90c01.x1 cDNA, 3' end/clone = IMAGE:1998338/clone_end = 3' | −1 | GCCCATGGTCCTAGAATTAATTCCCC TAAAAATTTTTGAAATAGGGGCGG |
| 4265 | Table 3A | Hs.309122 | AI380449 | 4190302 | tg02f12.x1 cDNA, 3' end/clone = IMAGE:2107631/clone_end = 3' | −1 | GCCAACTGCTTAGAAGCCCAACACAA CCCATCTGGTCTCTTGAATAAAGG |
| 4266 | Table 3A | Hs.290535 | AA719103 | 2732202 | zh33d10.s1 cDNA, 3' end/clone = IMAGE:413875/clone_end = 3' | −1 | GAGCCCTTAAAATTACTGTATCTCCT CTAAAGTGTGATTTAATGGCTGCG |
| 4267 | Table 3A | Hs.188886 | AA576947 | 2354421 | nm82b04.s1 cDNA, 3' end/clone = IMAGE:1074703/clone_end = 3' | −1 | CTTTTGCTGGAGACTCATCGCTTTGG GAAGTGCATTTGCTTCGTCGTCCG |
| 4268 | Table 3A | Hs.130232 | AI089359 | 3428418 | qb05h03.x1 cDNA, 3' end/clone = IMAGE:1695413/clone_end = 3' | −1 | CCCAGTTCACAGTAGAGAGGTGGAG CTTAGTACTTCCTGCTGCCCATTAG |
| 4269 | Table 3A | Hs.44828 | AI384128 | 4196909 | EST389740 cDNA | −1 | CTGGGCTGTAGGTACTGCTGGGTCA CTGTTGCTATAAATGGTCACTGAGG |
| 4270 | db mining | Hs.184284 | AI434146 | 4294137 | ti36g07.x1 cDNA, 3' end/clone = IMAGE:2132604/clone_end = 3' | −1 | CTTTAGATGTCCCACGTCCCTTCAAG CACATGAAAGAGCTCACACTGGAG |
| 4271 | Table 3A | Hs.173720 | AA534537 | 2278790 | nf80h10.s1 cDNA, 3' end/clone = IMAGE:926275/clone_end = 3' | −1 | GACTCTGGAACTCGAGCGTGTGGCT GCTGCGCCGACAGCTGAATCTAGAG |
| 4272 | Table 3A | Hs.120891 | AA677952 | 2658474 | zi14a06.s1 cDNA, 3' end/clone = IMAGE:430738/clone_end = 3' | −1 | CCTTAGAGATCGTGACCCTTCCTGCT TGCCTCCCTGGTGGGCTCTTTCAG |
| 4273 | Table 3A | Hs.142838 | AI299573 | 3959158 | nucleolar protein interacting with the FHA domain of pKI-67 (NIFK), mRNA/cds = (54, 935) | −1 | AGAGTGAGAAGGCAGTTCCAGTTTTA GCACAGATTTGTTTATGTGTTCAG |
| 4274 | Table 3A | Hs.8724 | AI298509 | 3958245 | serine threonine protein kinase (NDR), mRNA/cds = (595, 1992) | −1 | TCTCAAGAGAGAACGCCACAGCAGA GAGACCCAATCCGCCTAAGTTGCAG |
| 4275 | db mining | Hs.204873 | AI086035 | 3424458 | oy70h04.x1 cDNA, 3' end/clone = IMAGE:1671223/clone_end = 3' | −1 | AGGTTTGGGGAGGGGTCCCAGTCTG CGATCCTTTCTCCCTCTTCGTGCAG |
| 4276 | Table 3A | Hs.323950 | AA916990 | 3056382 | zinc finger protein 6 (CMPX1) (ZNF6), mRNA/cds = (1265, 3361) | −1 | CCTCAGCTTCCAACTCTGATTCCAGG ACAGGATGGAAAACCTTTGGACAG |
| 4277 | Table 3A | Hs.144114 | AI074020 | 3400664 | oy66g06.x1 cDNA, 3' end/clone = IMAGE:1670842/clone_end = 3' | −1 | AATCCCTTGTACCATGTATACAAATG AGACAAGTGAGCTTGACATTCAAG |
| 4278 | Table 3A | Hs.235042 | AI076222 | 3405400 | oy65b09.x1 cDNA, 3' end/clone = IMAGE:1670681/clone_end = 3' | −1 | GCTACAGCCCGGAACACAAAAGAAG ACACCCATGCAAATACCATTAAAAG |
| 4279 | Table 3A | Hs.158975 | AI380388 | 4190241 | tt96a03.x1 cDNA, 3' end/clone = IMAGE:2107084/clone_end = 3' | −1 | ATTAACCCTTTATTGCCCTAGCCAGT GGGGTGGGAGGGAGAGATTGTTTC |
| 4280 | Table 3A | NA | AI361642 | 4113263 | qy86d04.x1 cDNA, 3' end/clone = IMAGE:2018887 | −1 | GTTATCCTTAGGCCAGGTCTCCCACC TTTGAGCCGGACAAAACCAGAGTC |
| 4281 | Table 3A | Hs.34549 | AI123826 | 3539592 | 602620663F1 cDNA, 5' end/clone = IMAGE:4746422/clone_end = 5' | −1 | TGCTGCTACAGTTGCAAAACACTGGA GCTAGAGAAAATAAAGTACTGATC |
| 4282 | Table 3A | Hs.185062 | AI085568 | 3423991 | oy68b05.x1 cDNA, 3' end/clone = IMAGE:1670961/clone_end = 3' | −1 | CGAGAGTCTTGCTGAGCCAGGACTT GAGTGCCTCGAAGTTTTCAATGATC |
| 4283 | Table 3A | Hs.180201 | AA516406 | 2253788 | hypothetical protein FLJ20671 (FLJ20671), mRNA/cds = (72, 494) | −1 | ATCAGGAGAGGGAGATAATTAGTTGC TTCCTCCTTCACACTGTTTGAATC |
| 4284 | Table 3A | Hs.54452 | AI041828 | 3281022 | zinc finger protein, subfamily 1A, 1 (Ikaros) (ZNFN1A1), mRNA/cds = (168, 1727) | −1 | TTGCCCTTTCCTCTCACTGCCTTTAT AGCCAATATCAATGTCTCTTTGC |
| 4285 | db mining | Hs.206654 | AA705316 | 2715234 | EST368531 cDNA | −1 | ATCCCTATTGCCAGACACATCATTCT CTCCATCCAGAAAGCCAACTTTGC |
| 4286 | Table 3A | Hs.147040 | AI187423 | 3738061 | ql31d04.x1 cDNA, 3' end/clone = IMAGE:1751623/clone_end = 3' | −1 | CTCTCTTCATCTTCTGATTGGGATTGT GTCCAGTCCTCTGCTTCTTCTGC |
| 4287 | Table 3A | Hs.105230 | AA489227 | 2218829 | aa57f07.s1 cDNA, 3' end/clone = IMAGE:825061/clone_end = 3' | −1 | GAGGGTTCTAGCAACTTAATCCCATT AGCATGTTAGCTGAAGACTACTGC |
| 4288 | db mining | Hs.309108 | AI378046 | 4187899 | te67h12.x1 cDNA, 3' end/clone = IMAGE:2091815/clone_end = 3' | −1 | GTCCCAAGGGTCAGTATATTGGAGGA AAGTAAAGGAGTGAATCAGACTGC |
| 4289 | Table 3A | Hs.209203 | AI343473 | 4080879 | tb97a08.x1 cDNA, 3' end/clone = | −1 | CTGGAATTACTAATGTGGAGGTGATC TGAGAACTGGGAACAAAGTAGGGC |

TABLE 8-continued

| SEQ ID | Origin | Unigene | Locus | GI | Nominal Description | Strand | Probe Sequence |
|---|---|---|---|---|---|---|---|
| 4290 | Table 3A | Hs.158966 | AI380236 | 4190089 | IMAGE:2082262/clone_end = 3' tf94b10.x1 cDNA, 3' end/clone = IMAGE:2106907/clone_end = 3' | −1 | TCCAGGGACTGACAAGAGTGAGTGG TGTCAACCTAAAGAGAAACTCAGGC |
| 4291 | Table 3A | Hs.50477 | AA923567 | 3070876 | Rab27a mRNA, complete cds/cds = (245, 910) | −1 | CAGAACTCCATAGACAGCCTCACTTT GTGCTCGGGGGGCCTGTCCCAAGGC |
| 4292 | Table 3A | Hs.133230 | AA984890 | 3163415 | Homo sapiens, ribosomal protein S15, clone MGC:2295 IMAGE:3507983, mRNA, complete cds/cds = (14, 451) | −1 | GCACTTCTCCCGGTTCATCCCTCTCA AGTAATGGCTCAGCTAATAAAGGC |
| 4293 | Table 3A | Hs.165051 | AI248204 | 3843601 | qh64h11.x1 cDNA, 3' end/clone = IMAGE:1849509/clone_end = 3' | −1 | TCCATCTCCTTTCTACTGTAGCGGAG ACTACAAGTCCCAGGATGCCCCGC |
| 4294 | Table 3A | NA | AA663244 | 2669135 | schizo brain S11 cDNA clone IMAGE:971252 3' | −1 | CCACATTCTTGCTGTCCACATCCTGC TGGGTGAAATTGTGTTGAAGTAGC |
| 4295 | Table 3A | NA | AA826572 | 2898398 | cDNA clone IMAGE:1416447 3' | −1 | TGACTGTCTTGGTAATTTTCTTCCTTG TTTTACTTCTGGAAACTGGGAGC |
| 4296 | Table 3A | Hs.11637 | AI275205 | 3897479 | 602388093F1 cDNA, 5' end/clone = IMAGE:4517086/clone_end = 5' | −1 | TGACTTTCAGGAATGTCAGCATTGAC CTCTCCTTGCCACTGTTACTCAGC |
| 4297 | Table 3A | Hs.21812 | AI131018 | 3601034 | AL562895 cDNA/clone = CS0DC021YO20-(3-prime) | −1 | AAGTTTGTGCAGCACATTCCTGAGTG TACGATATTGACCTGTAGCCCAGC |
| 4298 | Table 3A | Hs.21812 | AI888714 | 5593878 | AL562895 cDNA/clone = CS0DC021YO20-(3-prime) | −1 | AAGTTTGTGCAGCACATTCCTGAGTG TACGATATTGACCTGTAGCCCAGC |
| 4299 | Table 3A | Hs.59459 | AA889552 | 3016431 | ak20d12.s1 cDNA, 3' end/clone = IMAGE:1406519/clone_end = 3' | −1 | ACCAGACTTCAGGAAGAATAAAGGTC GCCAACTCAATAAAACCACCAAGC |
| 4300 | Table 3A | Hs.230805 | AI087055 | 3425478 | oy70c09.x1 cDNA, 3' end/clone = IMAGE:1671184/clone_end = 3' | −1 | ACTTGCCACATAAACAGTTCCATCAT AAAAACTCTTCCCCTTCTTGTTCC |
| 4301 | Table 3A | Hs.125608 | AI380443 | 4190298 | tg02f04.x1 cDNA, 3' end/clone = IMAGE:2107615/clone_end = 3' | −1 | GCTTCCTTGAACCACCCAGAAATCCA CTCAAATTTGGGGATTGTCATTCC |
| 4302 | Table 3A | Hs.229385 | AI354231 | 4094384 | qv12c04.x1 cDNA, 3' end/clone = IMAGE:1981350/clone_end = 3' | −1 | GGGGGTGATGGGTTAATTAAATAAGT CCATTCCTGGGATTTGAGGGGGCC |
| 4303 | Table 3A | Hs.330928 | AI371227 | 4149980 | 601659234R1 cDNA, 3' end/clone = IMAGE:3895641/clone_end = 3' | −1 | ATGCCCCTCGTCCTAGAATTAATTCC CCTAAAAATCTTTGAAATAGGGCC |
| 4304 | db mining | Hs.141153 | AI39639 | 3645611 | tx43b11.x1 cDNA, 3' end/clone = IMAGE:2272317/clone_end = 3' | −1 | TCAAACTAAGACCAGGGTTGAAAACT ATGGCCCAGGGACCACTTCCAGCC |
| 4305 | Table 3A | Hs.134342 | AI363001 | 4114622 | mRNA for LanC-like protein 2 (lancl2 gene)/cds = (186, 1538) | −1 | GACGCGCACACACCTTGAGTGACAG CGACCTCTTCTCTACAGGTTTTCCC |
| 4306 | Table 3A | Hs.226755 | AA909983 | 3049273 | RC1-UT0033-250800-022-h02 cDNA | −1 | ATCCAAGCTTTAATTCTGCCATCTCA GAATGGTGATAAACCATTTCTCCC |
| 4307 | Table 3A | Hs.158894 | AI378457 | 4188310 | tc79d10.x1 cDNA, 3' end/clone = IMAGE:2072371/clone_end = 3' | −1 | TACTTCATTGCTATTGTAAACCAAAAA TAAAATTTGAAGCCCCCTGCCCC |
| 4308 | Table 3A | Hs.127327 | AI084064 | 3422487 | EST390862 cDNA | −1 | CTTCATCACTCAGGAAACAGAAAAGG CTTCAGAAGGAGCGGCCATGCCCC |
| 4309 | Table 3A | Hs.295945 | AW081320 | 6036472 | xc30f12.x1 cDNA, 3' end/clone = IMAGE:2585807/clone_end = 3' | −1 | AGAACCCGTATTCATAAAATTTAGAC CAAAAAGGAAGGAATCGAACCCCC |
| 4310 | Table 3A | Hs.143410 | AA825245 | 2898544 | oe59g09.s1 cDNA, 3' end/clone = IMAGE:1415968/clone_end = 3' | −1 | TTTTCTATTTTCATCTGTCATTTTCAC TGCAGAGCGCACCTCCCGGACCC |
| 4311 | db mining | Hs.228874 | AI356505 | 4108126 | qz22b04.x1 cDNA, 3' end/clone = IMAGE:2027599/clone_end = 3' | −1 | AGACTGAAGGGGTTGAAAGACCCGT AGACGCTCCTTTCCTCTTTTAGACC |
| 4312 | Table 3A | NA | AI364936 | 4124625 | qz23c12.x1 cDNA, 3' end/clone = IMAGE:2027734 | −1 | CTCTGCGGCCCTAGAGTTAATCCCAT CAGCCGAGGTGAGGCACCTGTTAC |
| 4313 | Table 3A | Hs.125892 | AI378032 | 4187885 | ta67g08.x1 cDNA, 3' end/clone = IMAGE:2091806/clone_end = 3' | −1 | CCAATTCCGCAGTACAGAGCATTCAG CAGGTAGTGGTGACCCTGGGTGAC |
| 4314 | Table 3A | Hs.158943 | AI379953 | 4189806 | tc81a07.x1 cDNA, 3' end/clone = IMAGE:2072532/clone_end = 3' | −1 | GGCTCCAGCCACCGGCAGCTCTGAA AGAGTTTGAAGAATTTATTGTTCAC |
| 4315 | Table 3A | Hs.108124 | AI362793 | 4114414 | cDNA; FLJ23088 fis, clone LNG07026/cds = UNKNOWN | −1 | GCTCGCTACCAGAAATCCTACCGATA AGCCCATCGTGACTCAAAACTCAC |
| 4316 | db mining | Hs.129332 | AA992299 | 3179055 | ol53b06.s1 cDNA, 3' end/clone = IMAGE:1820467/clone_end = 3' | −1 | CACTGGAACACAACCCAGCCATGAAA AGGAAGAAGCTCTGACTCAGGCAC |
| 4317 | Table 3A | NA | AI318342 | 4034222 | ta73c09.x1 3' | −1 | CATCTCATGCGTAGCACTGATCAATG |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:2049712 | | TGCCCCAGGGTGTGTATTCGCCAC |
| 4318 | Table 3A | Hs.157447 | AI028478 | 3245787 | EST388739 cDNA | −1 | CAATCAGAGCGCGAGTTACAAGCGC GGTGGAGTGGGGAAGCGAATGAAAC |
| 4319 | Table 3A | Hs.205175 | AA885473 | 2994550 | am10c12.s1 cDNA, 3' end/clone = IMAGE:1466422/clone_end = 3' | −1 | GACATTGCACATTTTTGAACCTGTCT ACAGCAGCCTGGGTTGGTCACAAC |
| 4320 | Table 3A | NA | AI370412 | 4149165 | cDNA, clone IMAGE:1987587 3' | −1 | ACACTGGCAGAGTCCAGAAAAGCAG CAGAAGAAAAATTCAGAGCAAAAAC |
| 4321 | Table 3A | Hs.132594 | AI346336 | 4083542 | qp50b04.x1 cDNA, 3' end/clone = IMAGE:1926415/clone_end = 3' | −1 | TTTAACGTGCTTCTGAGACAGCCACC ACCGAAAGGCACCTTTAGCGGTTA |
| 4322 | Table 3A | Hs.50252 | AA984245 | 3162770 | mitochondrial ribosomal protein L32 (MRPL32), mRNA/cds = (46, 612) | −1 | TCAGCCAACCTGAATCTGGTATCTTT ACTTAAACACAGCAGTTGTAGTTA |
| 4323 | Table 3A | NA | AA744774 | 2783538 | cDNA clone IMAGE:1283731 3' | −1 | AAAAGGAGACGATGTCAGGCAAACA CTCCTTACCCTGCCATTTCTAGTTA |
| 4324 | db mining | Hs.15200 | AW190635 | 6465115 | EST379783 cDNA | −1 | TCACAATCAGTCTCAGATTCCCAGCA GCAGAGAGTGAATTGTATGTTGTA |
| 4325 | Table 3A | Hs.276766 | AI380791 | 4190844 | tg04b12.x1 cDNA, 3' end/clone = IMAGE:2107775/clone_end = 3' | −1 | TAAAGACAATGCTATTTAAGTGCACA GTTCCAGGGGCGCTTGTGGCTCTA |
| 4326 | Table 3A | NA | AA573427 | 2347955 | cDNA clone IMAGE:1028913 3' | −1 | GAAGACCAAGTCTACGCCTGCAAGCT CTCAGACCGGGAACATCCACTCTA |
| 4327 | Table 3A | Hs.127557 | AA953396 | 3117543 | on63h10.s1 cDNA, 3' end/clone = IMAGE:1561411/clone_end = 3' | −1 | CTGAAGAGACAGAAAGGGAGACACC AAAACTTTAATGGCAGTTATTCCTA |
| 4328 | Table 3A | Hs.124391 | AA831838 | 2904937 | oc85h08.s1 cDNA, 3' end/clone = IMAGE:1358539/clone_end = 3' | −1 | GCCGCCCCATGAAGCCCTTTCTTAC TGTAAGTGCTCAAGAACAAAGATA |
| 4329 | Table 3A | Hs.210943 | AI823511 | 5444182 | wh54h10.x1 cDNA, 3' end/clone = IMAGE:2384611/clone_end = 3' | −1 | GCTAGCACGACTCTGCCTTGTTCTT TGGAGACAATTGTTATCATCAATA |
| 4330 | Table 3A | NA | AA757952 | 2805815 | zg49e07.s1 cDNA, 3' end/clone = IMAGE:396708/ | −1 | ATTGGGAATATAGATCATCAACAGAC ACAGCCCTGGACGCATAAATTTGA |
| 4331 | Table 3A | Hs.10056 | AA576946 | 2354420 | hypothetical protein FLJ14821 (FLJ14621), mRNA/cds = (525, 1307) | −1 | ACTAACGTATTTCATCATGGAAGGTC CTGTGGTGATGGTTTTCCCTGGGA |
| 4332 | Table 3A | Hs.132156 | AI042377 | 3281571 | ox62c03.x1 cDNA, 3' end/clone = IMAGE:1660900/clone_end = 3' | −1 | AAGTAATAGCTCCCTGTTTGTGCCTT GTTAGGGCTAGGGATGTTAAGGA |
| 4333 | Table 3A | Hs.173125 | AI052431 | 3308422 | peptidylprolyl isomerase F (cyclophilin F) (PPIF), mRNA/cds = (83, 706) | −1 | AGCTCCTCCCCTTAGTGACCCCAAGT CTGTTTCCTCAGCTGCATAAGGA |
| 4334 | Table 3A | Hs.122983 | AI081246 | 3418038 | oy67b06.x1 cDNA, 3' end/clone = IMAGE:1670867/clone_end = 3' | −1 | CCCTCAAATCTCCCAATCTACTCCAG GGAAAAGACACTTCAAGTGAGAGA |
| 4335 | db mining | Hs.85923 | AA194310 | 1784006 | zq04g12.s1 cDNA, 3' end/clone = IMAGE:628774/clone_end = 3' | −1 | ACATGCAAACAGTGACTTACTTAGTG CTTCTGAAAAATTTCTGAGTCAGA |
| 4336 | Table 3A | Hs.118659 | AI052447 | 3308438 | oz07g04.x1 cDNA, 3' end/clone = IMAGE:1674678/clone_end = 3' | −1 | AATGCCCATTGGTAAGTCAACATTGT TTTCCCTGAAAGTCCTGAGACAGA |
| 4337 | Table 3A | Hs.231154 | AA761571 | 2818898 | oa30h07.s1 cDNA, 3' end/clone = IMAGE:1306525/clone_end = 3' | −1 | CCATGTTTGCTGCTGCTGTTGAGTTT CTGTGCTTTGGGAGTATAATAAGA |
| 4338 | Table 3A | Hs.57787 | AW029440 | 5888196 | 602381381F1 cDNA, 5' end/clone = IMAGE:4498845/clone_end = 5' | −1 | TGTGTTTGGTTGGGTGTAATGAGGAA AATACCTGATAAAATGTCTGAAGA |
| 4339 | Table 3A | Hs.57787 | AA588755 | 2402486 | 602381381F1 cDNA, 5' end/clone = IMAGE:4498845/clone_end = 5' | −1 | TGGATAAGTGAAGACAGTAATAACAT TGAAGCAGTGAACCAGTGGAAAGA |
| 4340 | Table 3A | NA | AA974991 | 3150783 | Soares_NFL_T_GBC_S1 cDNA clone IMAGE:1560953 3' | −1 | AGCACAAAAATGTTGAAGTATTAGGC CCAAGCTCCATGTTTGGTTAGTCA |
| 4341 | Table 3A | Hs.127514 | AI028267 | 3245576 | ow01d06.x1 cDNA, 3' end/clone = IMAGE:1645547/clone_end = 3' | −1 | CGTTTAACAATAATAAAGGTTGACTGC TTCATCTAAGGAATCCGAGCCGCA |
| 4342 | Table 3A | Hs.88130 | AI184553 | 3735191 | qd60a05.x1 cDNA, 3' end/clone = IMAGE:1733840/clone_end = 3' | −1 | GGGCATTCCACCGAAATTCTTGGGGA AATTTAGTAGCCTTCATTTTAGCA |
| 4343 | Table 3A | Hs.158965 | AI380220 | 4190073 | tf94a04.x1 cDNA, 3' end/clone = IMAGE:2106894/clone_end = 3' | −1 | TCCATGTTCTGTGCAAGAAGGAGACA CATTTTCAGTTGAGGTTCCCAGCA |
| 4344 | Table 3A | Hs.235823 | AI379474 | 4189327 | 602631538F1 cDNA, 5' end/clone = IMAGE:4776728/clone_end = 5' | −1 | AGCTCAACACTGTGGTAGGAAAAATAG CCACTAGAAAGAAAATAAAAAGCA |
| 4345 | db mining | Hs.229560 | AI373169 | 4153035 | qz13b11.x1 cDNA, 3' end/clone = | −1 | GCATCTCCAGGGTTTAGCATCAGGAC AGAGGATTAAGTAAATTCTTTCCA |

TABLE 8-continued

| SEQ ID | Origin | Unigene | Locus | GI | Nominal Description | Strand | Probe Sequence |
|---|---|---|---|---|---|---|---|
| 4346 | Table 3A | Hs.146627 | AI141004 | 3648461 | IMAGE:2021373/clone_end = 3' oy68f02.x1 cDNA, 3' end/clone = IMAGE:1671003/clone_end = 3' | -1 | GAGACTACAGAGCCTTAGCCCCTTTA AAGCCCTTAAAGTTACTACTTCCA |
| 4347 | Table 3A | NA | AA431959 | 2115667 | cDNA clone IMAGE:782188 3' | -1 | AGAGCAAGTCTCAGAAATAATGCTGT ATCTACACTGTCATGTATTTGCCA |
| 4348 | db mining | Hs.56156 | AA257976 | 1894471 | 601463367F1 cDNA, 5' end/clone = IMAGE:3866512/clone_end = 5' | -1 | TGGTTCTCTGATTTGTAATGAGCACC TGGATATGTCAATTAAAATGCCCA |
| 4349 | Table 3A | Hs.264298 | AI380111 | 4189964 | tf98a11.x1 cDNA, 3' end/clone = IMAGE:2107292/clone_end = 3' | -1 | GCAAGACTGTTCAGTATTATGTTAGC ATTGATATAAAAAGAAGCAGACCA |
| 4350 | Table 3A | Hs.40411 | AI266255 | 3884413 | qx69f01.x1 cDNA, 3' end/clone = IMAGE:2008617/clone_end = 3' | -1 | AATGTTCCCAAAGGCCAAATTTGTTG CCAGGTTTTATACGCAGGTCACCA |
| 4351 | Table 3A | Hs.90753 | AI223400 | 3805603 | Tat-interacting protein (30kD) (TIP30), mRNA/cds = (98, 826) | -1 | TGCCTATTGTGATTATCGCTATCACTA CATCCCCTGACTAAGGGAAACCA |
| 4352 | Table 3A | Hs.192427 | AI380016 | 4189869 | 602296277F1 cDNA, 5' end/clone = IMAGE:4390770/clone_end = 5' | -1 | ACAAAATTCACTGCAGGTCGGTGGAA TGATAGAATGCATTTAAATCACA |
| 4353 | Table 3A | NA | AA524720 | 2265648 | cDNA clone IMAGE:937468 3' | -1 | GGACGGTTGGCTGAATGGCAACAGT GATGGAATATTTATATTTAGCCACA |
| 4354 | Table 3A | Hs.92909 | AA187234 | 1773460 | NREBP mRNA, complete cds/cds = (49, 7209) | -1 | ACATTGCACATTTAATAGCTGCACCA GACACTAAGAGTTCCTCTCACACA |
| 4355 | Table 3A | Hs.158877 | AI378113 | 4187968 | tc80c12.x1 cDNA, 3' end/clone = IMAGE:2072470/clone_end = 3' | -1 | CGCTTGTCCTGTGAGTAGCTCGTCAC CTGAGGCCTTGTCGTGAATATTAA |
| 4356 | Table 3A | Hs.314941 | AI039890 | 3279084 | 602381893F1 cDNA, 5' end/clone = IMAGE:4499447/clone_end = 5' | -1 | TGGAGCAAACCACAGTTTCATGCCCA TCGTCCTAGAATTAATTCCCCTAA |
| 4357 | Table 3A | Hs.157813 | AI361761 | 4113382 | qz19a07.x1 cDNA, 3' end/clone = IMAGE:2021940/clone_end = 3' | -1 | GGGACAACACAGTGGATTTGAAATCT GAAGGGGCATTGGTGGTACTGGAA |
| 4358 | Table 3A | Hs.205079 | AA742400 | 2784400 | EST388750 cDNA | -1 | ACCTCCATATCTTCTCGTACTTGTTCC TGCTGGTCTCTTAGCTCTCCGAA |
| 4359 | Table 3A | Hs.87908 | AI381588 | 4194367 | Snf2-related CBP activator protein (SRCAP), mRNA/cds = (210, 9125) | -1 | CGAGGATGGTTTCCTGATAGCTTTCA AACACCTTTGCCATCTCTTCGCAA |
| 4360 | Table 3A | Hs.208854 | AI766620 | 5233129 | nab69e11.x1 cDNA, 3' end /clone = IMAGE:3272949/clone_end = 3' | -1 | ACTCCTGACAGCTCATCCTGCAAAAT TAAAATCCAAAATTTAAGTCGCAA |
| 4361 | Table 3A | Hs.157556 | AI356405 | 4108026 | qz26g04.x1 cDNA, 3' end /clone = IMAGE:2028054/clone_end 3' | -1 | GCTGGATCTCTGCCTAAAGTCACGGT AGGATGAGAAGTAGAAACGAGCAA |
| 4362 | Table 3A | Hs.182594 | AA806222 | 2874997 | wd43h11.x1 cDNA, 3' end /clone = IMAGE:2330949/clone_end = 3' | -1 | TCAGACCATAGGTGGGTGTTGTTTCT TTTAAGTGTGTGTACTGTGTCCAA |
| 4363 | Table 3A | Hs.164168 | AA806766 | 2880855 | ob58h11.s1 cDNA, 3' end /clone = IMAGE:1335621/clone_end = 3' | -1 | TCATCTATGTAGCTTAATCTCATCGAC GTTTCGGTTCATTTCCTGCACAA |
| 4364 | Table 3A | Hs.291129 | AA581115 | 2358887 | oe10d02.s1 cDNA /clone = IMAGE:1385475 | -1 | TTCCTTTTCCGCTAATCAAGAGTCCA GGGAGGTGGGAACAGCCTCAACAA |
| 4365 | Table 3A | Hs.33757 | AI114852 | 8359997 | HA1247 cDNA | -1 | CCGGCAGCTGTGTTTAGCCCCTCCA GATGGAAGTTTCACTTGAATGTAAA |
| 4366 | Table 3A | Hs.121709 | AA767883 | 2824475 | ai35b09.s1 cDNA, 3' end /clone = 1358969/clone_end = 3' | -1 | ACAAAGGAATGAAGCTTTATGACAGG GCACGTGAAATGTTTATAGTGAA |
| 4367 | Table 3A | NA | AI335004 | 4071831 | tb21e09.x1 cDNA, 3' end /clone = IMAGE:2055016/clone_end = 3' | -1 | ACTAAAGGTCACAACCCATTAACAAC CATGAAATTGGTGTTGGGAAGAAA |
| 4368 | Table 3A | Hs.157815 | AI361849 | 4113470 | qz19h11.x1 cDNA, 3' end /clone = IMAGE:2022021/clone_end = 3' | -1 | TGCTCAGGAACCAAAAAGGATGTCT GCATGGAGGACAAAAAGGCACAAA |
| 4369 | Table 3A | Hs.98903 | AA913840 | 3053232 | 602680377F1 cDNA, 5' end /clone = IMAGE:4813147/clone_end = 5' | -1 | TGAGAACCGCGCACCCTACCCATCG GCCACGTGACCAGTCCTTTTTAAAA |
| 4370 | Table 3A | Hs.292276 | AI184710 | 3735348 | qd64a01.x1 cDNA, 3' end /clone = IMAGE:1734216/clone_end = 3' | -1 | GTCTTTGGGTCAGTGTCATCATTCTC TTCAAGTCTGGGGCTTGGGGAAAA |
| 4371 | Table 3A | Hs.143314 | AI357640 | 4109261 | qy15b06.x1 cDNA, 3' end /clone = IMAGE:2012051/clone_end = 3' | -1 | CTCCACACAGGAGAATCTCGGCGATT TACACCCACAGGCTACGCAGAAAA |
| 4372 | Table 3A | Hs.259084 | AI144328 | 3666137 | hg02g06.x1 cDNA, 3' end /clone = IMAGE:2944474/clone_end 3' | -1 | GCGCTGCTCCCAAAATCTATCTGCTG TTTAATAGTTTTTACCTTTCAAA |
| 4373 | db mining | Hs.327454 | AI378123 | 4187976 | tc80e02.x1 cDNA, 3' end /clone IMAGE:2072474/clone_end = 3' | -1 | GGGTTCAGGGGGTTTCCCTTTGCCC GTTTGGCCCTGGGTTTAATAAAAA |
| 4374 | db mining | Hs.132775 | AI028477 | 3245786 | ti02c07.x1 cDNA, 3' end /clone = IMAGE:2129292/clone_end = 3' | -1 | CCAACTCCTCACAGGGCAGGCTAGC GGGCACCAGGTCGCCGGGGAAGTG G |
| 4375 | db mining | Hs.283392 | AI052781 | 3308772 | oy78h07.x1 cDNA, 3' end | -1 | CGGCTGAGAGCCCGGTAGGGCCCAG |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:1671997/clone_end = 3' | | GGGCCAAGCGCAGGCAGAGGCCGCG |
| 4376 | db mining | Hs.270564 | AI361877 | 4113498 | qz25d07.x1 cDNA, 3' end /clone = IMAGE:2027917/clone_end = 3' | −1 | CTTGGGGTCCAGGGCACAGCGGTGC CGGGGACACAGCAGTTCCGAGGGTC |
| 4377 | db mining | Hs.110059 | AA82600 | 2898912 | 601763318F1 cDNA, 5' end /clone = IMAGE:4026173/clone_end = 5' | −1 | AGTATGGTAATTAGAAAGCATGTTAG AACATGTGGAAAAAGGGGGAAAAA |
| 4378 | Table 3A | NA | AI027844 | 3246543 | cDNA clone IMAGE:1671612 3' | −1 | CATCAGTCCTCATCAGCTGAAGTGGC TTCCCAAGGATTTAAATAAATAGT |
| 4379 | Table 3A | Hs.229374 | AI380491 | 4190344 | 602851994F1 cDNA, 5' end /clone = IMAGE:4993678/clone_end = 5' | −1 | AGACATTGACTACAGGGTAATTTCTA TGATTATATTATTTAGAAGTATGA |
| 4380 | Table 3A | Hs.124344 | H12462 | 877282 | MR1-GN0173-071100-009-g10 cDNA | −1 | CCAGTGAACTGTTAGCAACAATGCAG AAGAATCTGCATGTAATAAACTGA |
| 4381 | Table 3A | Hs.144119 | AI090305 | 3429384 | oy61b01.s1 cDNA, 3' end /clone = IMAGE:1672201/clone_end = 3' | −1 | ACTTAAATGCCTTTTAATTTTTGTCGA TGTAATAGTTTAATACCAGTAA |
| 4382 | Table 3A | Hs.333513 | AI379735 | 4189588 | small inducible cytokine subfamily E. member 1 (endothelial monocycte-activating) (SCYE1), mRNA /cds = (49, 987) | −1 | TTTTTAATTCTAGCTTCTTTTTAAGA TTATTTGGGTACCTAATAAAGGA |
| 4383 | Table 3A | Hs.135339 | AI051664 | 3307198 | oy77f06.x1 cDNA, 3' end /clone = IMAGE:1671875/clone_end = 3' | −1 | CAAAGCCTCCACAGGAGACCCCACC CAGCAGCCCAGCCCCTACCCAGGAG |
| 4384 | db mining | Hs.2186 | AA182528 | 1766227 | *Homo sapiens*, eukaryolic translation elongation factor 1 gamma, clone MGC:4501 IMAGE:2964623, mRNA, complete cds/cds = (2278, 3231) | 1 | CGAGTGACATTGGCTGACATCACAGT TGTCTGAACCTGTTGTGGCTCTAT |
| 4385 | db mining | Hs.101370 | AA287260 | 1932959 | AL583391 cDNA /clone = CS0DL012YA12-(3-prime) | 1 | TGAATTGCTTCAAAACCTCTTCCATCT CAGAAGACCAGACCCTGGGAACT |
| 4386 | Table 3A | Hs.238514 | AA613460 | 2464498 | xy5208.x1 cDNA, 3' end /clone = IMAGE:2856808/clone_end = 3' | 1 | GCTGAAGTGGCAATAGAGAGTCT GCTAGAAAGACGGAAGTCACCATCT |
| 4387 | Table 3A | NA | AA665359 | 2880102 | nt89f05.s1 NCI_CGAP_Pr12 cDNA clone IMAGE:1205697 similar to SW:ATP6_HUMAN P00846 ATP SYNTHASE A CH | 1 | TCTACTGACTATCCTAGAAATCGCTG TCGCCTTAATCCAAGCCTACGTTT |
| 4388 | db mining | Hs.98507 | AB011115 | 3043609 | mRNA for KIAA0543 protein, partial cds/cds = (0, 3338) | 1 | GTGTGTGCTTAGCCAAATACAGTAAC TGTGACTGGCCCAGGGATGTTCTC |
| 4389 | db mining | Hs.129268 | AB037809 | 7243156 | mRNA for KIAA1388 protein, partial cds/cds = (572, 2371) | 1 | GTGAGTCCAATGTATGCTTTAGAAGT AAAGACATTGACCGTCACAGACCA |
| 4390 | Table 3A | Hs.296317 | AB058692 | 14017794 | mRNA for KIAA1789 protein, partial cds/cds = (3466, 4899) | 1 | CTCAAGAAAAGACAGAAGAGAC AGTGATTTGGGAGAGTCTACTCT AGGA |
| 4391 | Table 3A | Hs.195175 | AF005775 | 2286146 | mRNA for CASH alpha protein /cds = (481, 1923) | 1 | ACCCTATGCCCATTGTCCTGATCTGA AATTCTTGGAAATTGTTCCATGT |
| 4392 | db mining | Hs.62187 | AF022913 | 2558890 | GPI transamidase mRNA complete cds/cds = (17, 1204) | 1 | TTCACAGTCTTCTATTGTTGGACCAC TTACATTGTACCAAATGTTTTCCT |
| 4393 | db mining | Hs.248077 | AF044592 | 2852420 | lymphocyte-predominant Hodgkin's disease case #4 immunoglobulin heavy chain gene, variable region | 1 | ATTAAGCCCCGTAGCCCATCCCGCA AGTTAGATACAGCTATGGTTAAGG |
| 4394 | db mining | Hs.248078 | AF044595 | 2852426 | lymphocyte-predominant Hodgkin's disease case #7 immunoglobulin heavy chain gene, variable region | 1 | TTATATTGTAGTGGTGGTATTTGCTTT CCGCCTGTTGGCTACTTCGACCC |
| 4395 | Table 3A | Hs.25812 | AF058896 | 3098674 | Nijmegen breakage syndrome 1 (nibrin) (NBS1), mRNA/cds = (52, 2316) | 1 | TTGTTCTCTGTCATGCCCACAATCCC TTTCTAAGGAAGACTGCCCTACTA |
| 4396 | db mining | Hs.300865 | AF063725 | 3142513 | clone BCSynL38 immunoglobulin lambda light chain variable region mRNA, partial cds/cds = (0, 116) | 1 | ACTGAGGACGAGGCTGACTACTACT GTCAGTCTTATGATAGCACCTATCA |
| 4397 | db mining | Hs.249208 | AF063784 | 3135618 | clone LBLG9 immunogobulin lambda light chain variable region gene, partial cds/cds = (0, 289) | 1 | AGATGGAGGATGAAGCTGACTACTAC TGTTACTCAAGAGACAGCAGTGGT |
| 4398 | db mining | Hs.293441 | AF067420 | 3201899 | SNC73 protein (SNC73) mRNA, complete cds/cds = (395, 1549) | 1 | CATGTCAATGTGTCTGTTGTCATGGC GGAGGTGGACGGCACCTGCTACTG |
| 4399 | db mining | Hs.293441 | AF067420 | 3201899 | SNC73 protein (SNC73) mRNA, complete cds/cds = (395, 1549) | 1 | GTCAATGTGTCTGTTGTCATGGCGGA GGTGGACGGCACCTGCTACTGAGC |
| 4400 | db mining | Hs.247721 | AF073705 | 3335589 | clone mcg53–54 immunoglobulin lambda light chain variable region 4a mRNA, partial cds/cds = (0, 324) | 1 | TCCAACCTCCAGTTTGAGGATGAGGC TGATTATTACTGTGAGACCTGGGA |
| 4401 | Table 3A | Hs.22380 | AF086431 | 3483776 | AL557896 cDNA /clone = CS0DJ003YD10-(5-prime) | 1 | GACTACAACTGGCAATCCCAACTCCT GGGCTAGGGCTTTTTCTACCTTTT |
| 4402 | db mining | HS.283882 | AF103295 | 4838126 | clone N97 immunoglobulin heavy chain variable region mRNA, partial cds/cds = (0, 377) | 1 | TATTTCTGTGCGAGAGTTCCCCCTAA ACATGGCGGAGGCTTCTTCTACAA |
| 4403 | Table 3A | Hs.167827 | AF116909 | 4768835 | clone HH419 unknown mRNA | 1 | TGGCTAGGAGACCTTGGGCAGTACC |

TABLE 8-continued

| SEQ ID | Origin | Unigene | Locus | GI | Nominal Description | Strand | Probe Sequence |
|---|---|---|---|---|---|---|---|
| 4404 | db mining | Hs.149235 | AF119843 | 7770122 | PR01085 mRNA, complete cds /cds = (189, 593) | 1 | TACAGTCTTGCTGTTTCTGTTTCAT GTGAGCTGAACAAATACATCATTTAA ATCTATGCTGCACTTTGAGTTGCT |
| 4405 | db mining | Hs.193053 | AF121255 | 6468774 | protein translation initiation factor 2C2 (EIF2C2) mRNA, partial cds /cds = (539, 1582) | 1 | CCCGTGTGTTTACAGCATTTCCAGGT CCAGAGAGGTTGGCAGACAAGTGC |
| 4406 | db mining | Hs.247909 | AF127125 | 4337068 | isolate 459 immunoglobulin lambda light chain variable region (IGL) gene, partial cds/cds = (0, 265) | 1 | AGCTGTGGGATATAAGTAGTGGTCAT TATGTCTTCGGAGGTGGCACCACT |
| 4407 | db mining | Hs.204588 | AF150138 | 5133574 | AF150138 cDNA/clone = CBCBOG02 | 1 | GCCCTTTGAGAAAGACTTTGTTCCTG AACTGCTCCCTTCTCTTTTAGGGT |
| 4408 | db mining | Hs.205158 | AF150141 | 5133577 | AF150141 cDNA/clone = CBCBQD03 | 1 | GGTCTGGTTCTAGATCAGCCTTTTCA GTCTGCCCTGGCCTGGTCATTAAT |
| 4409 | db mining | Hs.205438 | AF150373 | 5133809 | AF150373 cDNA/clone = CBMACE02 | 1 | GAAAAACCTGGCTAGAGCAGAGCAC AGGATGTAAAAGGGTGGGGGAGAAC |
| 4410 | db mining | Hs.283929 | AF161340 | 6841093 | HSPC077 mRNA, partial cds /cds = (0, 396) | 1 | GGTTATCTGAGCATAACAGGGACAG GGTGGGCCACAGGATACCTCTGAGG |
| 4411 | db mining | Hs.283931 | AF181351 | 6841115 | HSPC088 mRNA, partial cds /cds = (0, 305) | 1 | ACAAGCAGGAGCACATCGCTCTTTA TGAAGCCCTTCAACATTTAACGT |
| 4412 | db mining | Hs.326257 | AF161360 | 6841133 | 602288541T1 cDNA, 3' end /clone = IMAGE:4374059/clone_end = 3' | 1 | CAGGGACACCACTTATCCTGCTTCCA CTATAGCATGAATCAGTGCTCTCT |
| 4413 | db mining | Hs.283934 | AF161365 | 6841143 | HSPC102 mRNA, partial cds /cds = (0, 285) | 1 | CATCGCACACGAATTTGAATCATCTG CTCTTTGGAATCGCCTACACCCTG |
| 4414 | db mining | Hs.283935 | AF161370 | 6841153 | HSPC107 mRNA, partial cds /cds = (0, 473) | 1 | TGTATGTAGGTGTCTGAGCTTCACAA GCCTTTTATAGTCCATTCAGCACT |
| 4415 | db mining | Hs.283924 | AF168811 | 5833844 | clone case06H1 immunoglobulin heavy chain variable region gene, partial cds/cds = (0, 322) | 1 | CGACGACAACGGTGTATATTATTGTG CGAAAGATCGGGCAGATTTGACTT |
| 4416 | db mining | Hs.177461 | AF174394 | 5802906 | apoplotic-related protein PCAR mRNA, partial cds/cds = (0, 439) | 1 | CGGTGAGACTCAGTGAAAGCCATCA GCAAAACTACAGTAATGCGGCACTA |
| 4417 | Table 3A | Hs.160422 | AF218032 | 10441993 | clone PP902 unknown mRNA /cds = (693, 1706) | 1 | AAGTTAAACAAGACTCTGAAAGCCCT AAATCAACTAGTCCGTCGGCTGCA |
| 4418 | db mining | Hs.169992 | AF308298 | 12060848 | serologically defined breast cancer antigen NY-BR-84 mRNA, partial cds /cds = (0, 721) | 1 | CTTGAGTGGTCCTCTTCTGCCTGCTG CTCATTTGTCTTGGGCAACCATTT |
| 4419 | db mining | Hs.170580 | AI475577 | 4328822 | tc92e07.y1 cDNA 5' end /clone = IMAGE:2073636/clone_end = 5' | 1 | CCCAGGAATATACAGTACTTCTGTAG TGTCCAGCCATTACTTAGCAAGGG |
| 4420 | Table 3A | Hs.145668 | AI793342 | 5341058 | fmlc5 cDNA/clone = CR6-21 | 1 | TGCTCTGTCTGCTGGTTTGCATTGTT TCTGTCTGAGTTAAGAGACTGGCA |
| 4421 | Table 3A | Hs.194382 | AI904071 | 6494458 | ataxia telangiectasia (ATM) gene, complete cds/cds = (795, 9965) | 1 | TTCTTTTCTCCGTTAGCCACGCAGCT ACCTACTCCCGCTTCCGGTTCAAA |
| 4422 | db mining | Hs.333140 | AJ225092 | 3090425 | mRNA for single-chain antibody, complete cds (scFv2)/cds = (0, 806) | 1 | AAAACTCATCTCAGAAGAGGATCTGA ATGGGGCCGCACATCACCATCATC |
| 4423 | db mining | Hs.272356 | AJ275371 | 7573002 | partial IGVH3 gene for immunoglobulin heavy chain V region, case 1, clone 16 /cds = (0, 236) | 1 | GATGAACAGTCTGAGAGGCGAGGAC ACGGCCTTGTTTAACTGTGCGAGTC |
| 4424 | db mining | Hs.272357 | AJ275374 | 7573008 | >partial IGVH3 gene for immunoglobulin heavy chain V region, | 1 | TACTACTTGCCAGGTCCAAGAACGGG GCGGGTCCTGTTATCATTATTACA |
| 4425 | db mining | Hs.272358 | AJ275383 | 7573027 | partial IGVH3 gene for immunoglobulin heavy chain V region, case 1, | 1 | GCTGTGTTTTTCTGTGGGTGAAATAA AGGTTTCGGAGCCCGTTTTAGATA |
| 4426 | db mining | Hs.272359 | AJ275397 | 7573058 | partial IGVH1 gene for immunoglobulin heavy chain V region, | 1 | CATTTCTGTGCGAGAGTGAACAGGG GACCCTAGAGGATTTCGTTGTGGGA |
| 4427 | db mining | Hs.272360 | AJ275399 | 7573060 | partial IGVL2 gene for immunoglobulin lambda light chain V region | 1 | GGACTCCAGGCTGAGGACGAGGCTG ATTATTAGTGATGCTCATAAACAAG |
| 4428 | db mining | Hs.272361 | AJ275401 | 7573064 | partial IGVH3 gene for immunoglobulin heavy chain V region | 1 | CTCTTATTGTGCGAGAGACCTCCCGG AACTGCCACTGAAGGTGGAGGCTA |
| 4429 | db mining | Hs.272362 | AJ275405 | 7573073 | partial IGVL1 gene for immunoglobulin lambda light chain V region | 1 | CTCCCTGAGTATCTCGGGCCTCTAGC CTGAGGACGAGGCTGATTATTATT |
| 4430 | db mining | Hs.272364 | AJ275413 | 7573089 | partial IGVH3 DP29 gene for immunoglobulin heavy chain V region, case 1, celll Mo VII 116/cds = (0, 257) | 1 | AAGAACTCACTGTATCTGCAAATGAA CAGCCTGAAAACCGAGGACACGGC |
| 4431 | db mining | Hs.272365 | AJ275453 | 7573172 | partial IGVH4 gene for immunoglobulin heavy chain V region | 1 | CACGGCTGTGTTTAACTCTGCGACAT GCGGGGACTATGGTTCGGGGGAA |
| 4432 | db mining | Hs.50102 | AK002098 | 7023770 | mRNA for rapa-2 (rapa gene) /cds = (836, 3742) | 1 | TCAGGGTGATTGAAGGACACATATTG AAGTACCTAGAATGCCAGAAAGTG |
| 4433 | db mining | Hs.270247 | AK022039 | 10433357 | cDNA FLJ11977 fis, clone HEMBB1001254/cds = UNKNOWN | 1 | AACAAAACTGTGATTTATATCAAATAA CAATGGCTTGGAGGGGGTATGGA |
| 4434 | db mining | Hs.156110 | AK024974 | 10437403 | cDNA:FLJ21321 fis, clone COL02335, highly similar to HSAD10442 mRNA for immunoglobulin kappa light chain /cds = UNKNOWN | 1 | TTTTCCACAGGGGACCTACCCCTATT GCGGTCCTCCAGCTCATCTTTCAC |
| 4435 | db mining | Hs.156110 | AK024974 | 10437403 | cDNA:FLJ21321 fis, clone COL02335, highly similar to HSA010442 mRNA for immunoglobulin kappa light chain | 1 | TTTTCCACAGGGGACCTACCCCTATT GCGGTCCTCCAGCTCATCTTTCAC |

TABLE 8-continued

| SEQ ID | Origin | Unigene | Locus | GI | Nominal Description | Strand | Probe Sequence |
|---|---|---|---|---|---|---|---|
| 4436 | db mining | Hs.156110 | AK024974 | 10437403 | cDNA:FLJ21321 fis, clone COL02335, highly similar to HSA010442 mRNA for immunoglobulin kappa light chain /cds = UNKNOWN | 1 | TTTTCCACAGGGGACCTACCCCTATT GCGGTCCTCCAGCTCATCTTTCAC |
| 4437 | db mining | Hs.323884 | AK025398 | 10437905 | cDNA:FLJ21745 fis, clone COLF5038 /cds = UNKNOWN | 1 | TGTGGCTGTACTTAACCTTCTCCAAC ATACATCCTGCATTACATGAATGG |
| 4438 | db mining | Hs.1501 | AK025488 | 10438019 | heparan sulfate proteoglycan (HSPG) core protein, 3' end/cds = (0, 1193) | 1 | AAGCCTTTGAAGTGCCTCTGATTCTA TGTAACTTGTTGCAGACTGGTGTT |
| 4439 | db mining | Hs.267697 | AK026199 | 10438971 | cDNA:FLJ22546 fis, clone HS100290 /cds = UNKNOWN | 1 | GCATTGACCTGGAAGGAGAGAAGAT AGAGAGTGGAGGCTCTGAAGGAGAC |
| 4440 | db mining | Hs.287728 | AK026793 | 10439729 | cDNA:FLJ23140 fis, clone LNG09065 /cds = UNKNOWN | 1 | CAGTACAGGGCTGGCAAGCAGTGAT CTCTCAGGTATATTTATCAATAATT |
| 4441 | db mining | Hs.104696 | AK026832 | 10439779 | mRNA for KIAA1324 protein, partial cds/cds = (0, 1743) | 1 | CAAACCCTCCTTTCTGCTTGCCTCAA ACCTGCCAAATATACCCACACTTT |
| 4442 | db mining | Hs.24684 | AK026917 | 10439889 | mRNA for KIAA1376 protein, partial cds/cds = (143, 1456) | 1 | GGTGCTGAATATGTCCTTGTAGGCTC TGTTTTAAGAAAACAATATGTGGG |
| 4443 | db mining | Hs.152925 | AK027260 | 10440394 | mRNA for KIAA1268 protein, partial cds/cds = (0, 3071) | 1 | AGTGATTTGATTAACTCAGGGCAAGG CTGAATATCAGAGTGTATCGCACT |
| 4444 | Table 3A | Hs.301783 | AL049935 | 4884177 | mRNA; cDNA DKFZp564O1116 (from clone DKFZp584O1116) /cds = UNKNOWN | 1 | GCTTCCACTGGAGGCTTGTATTGACC TTGTAACTATATGTTAATCTCGTG |
| 4445 | db mining | Hs.18368 | AL080186 | 5262664 | mRNA; cDFNA DKFZp564BO769 (from clone DKFZp584B0769); partial cds /cds = (0, 900) | 1 | ATGCATGTTTACCAAAATGGCTGTTT ACAGTGCATTCAGTTCTGATATTT |
| 4446 | Table 3A | Hs.326292 | AL134898 | 6603085 | DNA sequence from clone RP5-1167H4 on chromosome 20 Contains ESTs, STSs, GSSs and CpG islands. Contains a novel gene, the STK15 gene for serine/threonine kinase 15, the CSTF1 gene for cleavage stimulation factor subunit 1 (50 kDa), a novel gene similar to NEDD9 for neural precursor cell expressed developmentally-down-regulated protein 9 (enhancer of filamentation 1, HEF1) (CRK-associated substrate-relateed protein, CAS-L) and a 60 S ribosomal protein, L39 (RPL39) pseudogene/cds = (44, 622) | 1 | ACATGACAGGTGTAATTAGTCTGCTG AGCCAGCTTTACCCAATGAAGGGC |
| 4447 | Table 3A | Hs.260024 | AL136842 | 6807668 | mRNA; cDNA DKEZp434A0530 (from clone DKFZp434A0530); complete cds /cds = (968, 1732) | 1 | AACAGCAACCAATAACGGATTGTAAA GTGTAAAGGCACAGGTTACTCATG |
| 4448 | db mining | Hs.298358 | AL137406 | 6807955 | mRNA; cDNA DKFZp434M162 (from clone DKFZp434M162) /cds = UNKNOWN | 1 | CCATGCCAAGGAATGGAATTTCCATC CTGAGCCAGTTCAGTTAGGTGTCA |
| 4449 | db mining | Hs.56265 | AL137736 | 6808315 | mRNA; cDNA DKFZp586P2321 (from clone DKFZp586P2321) /cds = UNKNOWN | 1 | CTAGAGTTCATCTCTGAGCTGTAAGG GTGACCAGGGGGCAGGGGGACGAT |
| 4450 | Table 3A | Hs.66151 | AL157438 | 7018513 | mRNA; cDNA DKFZp434A115 (from clone DKFZp434A115) /cds = UNKNOWN | 1 | CAAGTAGACACCAGAGTCACTGTTTG GTTGGTGGGTGATAGTGGGGTCAC |
| 4451 | Table 3A | Hs.106875 | AL355722 | 7799110 | EST from clone 35214, full insert /cds = UNKNOWN | 1 | TGTCACCCTTCCATGACGCCTCCTCT GTGCATTTGAGTTCACTGTTTATG |
| 4452 | db mining | Hs.283849 | AL359560 | 8655615 | mRNA; cDNA DKFZp762F0616 (from clone DKFZp762F0616) /cds = UNKNOWN | 1 | GGTAACATGAGCTATGGCAGTCGGTT GTGAAACCACAGGAAGTGTATGGG |
| 4453 | Table 3A | Hs.23964 | AL360135 | 8919158 | sin3-associated polypeptide, 18 kD (SAP18), mRNA/cds = (573, 1034) | 1 | CAAATCGGGCACCACCTCCTTCAGG GCGCATGAGACCATATTAATTCTA |
| 4454 | Table 3A | Hs.10927 | AL385373 | 9187358 | HSZ78330 cDNA/clone = 2.49-(CEPH) | 1 | CAGAACTGCTTTCCTATGTTTACCCA GGGGACCTCCTTTCAGATGAACTG |
| 4455 | db mining | Hs.171118 | AL583913 | 13093778 | DNA sequence from clone RP11-165F24 on chromosome 9. Contains the 3' end of the gene for a novel protein (similar to Drosophila CG6830 and CG11376, KIAA1058, rat TRG), an RPL12 (60 S ribosomal protein L12) pseudogene, ESTs, STSs, GSSs and a CpG island/cds = (0, 4617) | 1 | AGCAATAATATCTCTGTTTTCATTTCA GAACATTGTGCTGTCTGTCAGCA |
| 4456 | Table 3A | Hs.11806 | AU124763 | 10949479 | 7-dehydrocholesterol reductase (DHCR7), mRNA/cds = (194, 1621) | 1 | TTACAACTACATGATGGGCATCGAGT TTAACCCTTGGATCGGGAAGTGGG |
| 4457 | db mining | Hs.205435 | AV740518 | 10858099 | AV740518 cDNA, 5' end /clone = CBDAGC01/clone_end = 5' | 1 | AATGTTTGAGCTGACCAAGCTTCTGA GATTCTTAACAGAAAAAGCCATGT |
| 4458 | db mining | Hs.204751 | AV741208 | 10858789 | AF150335 cDNA/clone = CBLAQF05 | 1 | ACGTCAGCTTAAAACTGGAAAGAAGT CTTCTGGTGTATACTGAGATTTGA |

TABLE 8-continued

| SEQ ID | Origin | Unigene | Locus | GI | Nominal Description | Strand | Probe Sequence |
|---|---|---|---|---|---|---|---|
| 4459 | db mining | Hs.204932 | AV743878 | 10861459 | AV743878 cDNA, 5' end /clone = CBLAOC04/clone_end = 5' | 1 | GCCCAAAGGAGTAGCTCTCTGTTGTT ACTGTTGTGCTCTTCATGGATAAA |
| 4460 | db mining | Hs.205159 | AV744351 | 10861932 | AF150295 cDNA/clone = CBLADB01 | 1 | GCAAAAAGCCCAAGAGCCTGAATTTA GACCAATCTATCATCTTCCTCCTC |
| 4461 | db mining | Hs.205789 | AV758240 | 10914088 | AV756240 cDNA, 5' end /clone = BMFAUH12/clone_end = 5' | 1 | TGGAGATGTGATAACAACTCCTTATC TCTTTGTTGGCTCATCTGAAGTGT |
| 4462 | db mining | Hs.254948 | AW291284 | 6697920 | UI-H-BI2-agi-h-10-0-UI.s1 cDNA, 3' end/clone = IMAGE:2724714 /clone_end = 3' | 1 | CTTGCAGTAAAATGTAGCCCTTCCTC CTGGTTGTGCAGGAGTGGCCCTCG |
| 4463 | db mining | Hs.250605 | AW327360 | 6797855 | dq02e11.x1 cDNA, 5' end /clone = IMAGE:2846885/clone_end = 5' | 1 | TTTCTTTAGCCCAAGAGTGGAGGCTA AGCTACTTACTTCCAAGCCTGGGT |
| 4464 | Table 3A | Hs211194 | AW362304 | 6866954 | CM3-CT0275-031199-031-a08 cDNA | 1 | AGGCAAAGGGAACTTGAAATTAGAAA ACCCCAGAAACAGTCACAATGGCT |
| 4465 | Table 3A | Hs.342300 | AW389509 | 6894188 | xm47a06.x1 cDNA, 3' end /clone = IMAGE:2687314/clone_end:3' | 1 | AGGGTCCCTTCCATAGTCCTCCTGCA TCATTTTCCTCCAACTTGAATAAA |
| 4466 | Table 3A | Hs.202402 | AW390251 | 6894910 | CM4-ST0182-051099-021-b06 cDNA | 1 | GCCAACCAGTTCAGAGTGTTCCCAAG GAATTGCCACCCTTACTCTTCAAA |
| 4467 | Table 3A | Hs.192123 | AW838827 | 7932601 | CM1-LT0059-280100-e02 cDNA | 1 | ATCCCAGTCTCAAATTTCTTCATTTGG AACTGATATGTAGGCCCTCATCG |
| 4468 | Table 3A | Hs.194589 | AW945338 | 8123293 | AV703056 cDNA, 5' end /clone = ADBCAMB06/clone end = 5' | 1 | TCTCTCACTGTTATCATTTTTGCACAG GTGGTTTCAGCAGCTTGATGCCA |
| 4469 | Table 3A | Hs.83724 | BC000957 | 13111830 | Homo sapiens, clone IMAGE:3451448, mRNA, partial cds/cds = (0, 901) | 1 | ATTGTCATTTAGACTTTGAACAGCTCT GGGAAATAGAAGACTAGGGTTGT |
| 4470 | db mining | Hs.267690 | BC001224 | 12654762 | mRNA for KIAA1228 protein, partial cds/cds = (0, 2176) | 1 | TTTCCTTGTTCCCTCCCATGCCTAGC TGGATTGCAGAGTTAAGTTTATGA |
| 4471 | db mining | Hs.76932 | BC002332 | 12803062 | Homo sapiens, Similar to hypothetical protein FLJ20419, clone MGC:15417 IMAGE:3942735, mRNA, complete cds /cds = (208, 918) | 1 | GGATTCACCGTGGCCGACTCTTTTCC CTGCTTTGGTTTGTTTGAAATCTA |
| 4472 | Table 3A | Hs.343272 | BC002770 | 12803854 | Homo sapiens, clone IMAGE:3816574, mRNA, partial cds/cds = (0, 640) | 1 | CCCTCCACACCATCCTCCCCGATTTA AATATAGTCACTGCTACAAGTAAC |
| 4473 | db mining | Hs.81221 | BC002792 | 12803890 | Homo sapiens, clone MGC:3963 IMAGE:3621362, mRNA, complete cds /cds (40, 402) | 1 | TTCATCATTGCTTGCTTGCCTTCCTC CCTTCTGTCCGCTCTTACTCCCTC |
| 4474 | db mining | Hs.302063 | BC002963 | 12804210 | rearranged immunoglobulin mRNA for mu heavy chain enhancer and constant region/cds = UNKNOWN | 1 | GCAAACTAACCGTGTCAACGGGGTG AGATGTTGCATCTTATAAAATTAGA |
| 4475 | db mining | Hs.302063 | BC002963 | 12804210 | rearranged immunoglobulin mRNA for mu heavy chain enhancer and constant region/cds = UNKNOWN | 1 | GCAAACTAACCGTGTCAACGGGGTG AGATGTTGCATCTTATAAAATTAGA |
| 4476 | db mining | Hs.302063 | BC002963 | 12804210 | rearranged immunoglobulin mRNA for mu heavy chain enhancer and constant region/cds = UNKNOWN | 1 | GCAAACTAACCGTGTCAACGGGGTG AGATGTTGCATCTTATAAAATTAGA |
| 4477 | Table 3A | Hs.334787 | BC003063 | 13937660 | Homo sapiens, clone MGC:19556 IMAGE:4304831, mRNA, complete cds /cds = (1505, 1666) | 1 | AGTATCTGCTTTCCAGGCTGAAGTGA TTCATTCATTATTCTAGTCCTGCT |
| 4478 | Table 3A | Hs.334573 | BC006008 | 13937718 | Homo sapiens, clone IMAGE:4285740, mRNA/cds = UNKNOWN | 1 | AAGCTGTCTTCTTTGTTGGACAATCA GCCAGAATGATAAGCAAACCTGCA |
| 4479 | db mining | Hs.300697 | BC006402 | 13623574 | mRNA for immunoglobulin lambda heavy chain/cds = (65, 1498) | 1 | CTCTCGCGGTCGCACGAGGATGCTT GGCACGTACCCCCTGTACATACTTC |
| 4480 | db mining | Hs.300697 | BC006402 | 13623574 | mRNA for immunoglobulin lambda heavy chain/cds = (65, 1498) | 1 | CTCTCGCGGTCGCACGAGGATGCTT GGCACGTACCCCCTGTACATACTTC |
| 4481 | db mining | Hs.300697 | BC006402 | 13623574 | mRNA for immunoglobulin lambda heavy chain/cds (65, 1498) | 1 | CTCTCGCGGTCGCACGAGGATGCTT GGCACGTACCCCCTGTACATACTTC |
| 4482 | Table 3A | Hs.155101 | BC007299 | 13938338 | mRNA for KIAA1578 protein, partial cds/cds = (0, 3608) | 1 | CTCCTGTGGATTCACATCAAATACCA GTTCAGTTTTGTCATTGTTCTAGT |
| 4483 | db mining | Hs.184778 | BC007583 | 14043190 | ribosomal protein L23a (RPL23A), mRNA/cds = (23, 493) | 1 | GGCTCCTGATTACGATGCTTTGGATG TTGCCAACAAAATTGGGATCATCT |
| 4484 | db mining | Hs.250528 | BC007747 | 14043522 | Homo sapiens, clone IMAGE:4098694, mRNA, partial cds/cds = (0, 2501) | 1 | AACGCCAGCATTTTGTTAGAGGAGTT AGACTTGGAAAAGTTAAGGGAAGA |
| 4485 | Table 3A | Hs.44155 | BC008629 | 14250392 | mRNA; cDNA DKFZp588G1517 (from clone DKFZp588G1517); partial cds /cds = (0, 2755) | 1 | ATGGGGACTAAGGGATTAAGAGTGT GAACTAAAAGGTAACATTTTCCACT |
| 4486 | Table 3A | Hs.164280 | BC008737 | 14250566 | Homo sapiens, Similar to solute carrier family 25 (mitochondrial carrier, adenine nucleotide translocator), member 5, clone MGC:3042 IMAGE:3342722, mRNA, complete cds /cds = (88, 984) | 1 | ACTGGCGAGTATGTTCTATGTTGGGC CTCCTGCTGCAAAACAATAAACAG |
| 4487 | Table 3A | Hs.336425 | BC009111 | 14318625 | Homo sapiens, clone MGC:17296 IMAGE:3460701, mRNA, complete cds /cds = (3250, 3498) | 1 | GCTGATTAACTGTATTCCCCTTTCCC CTATGGCTGCTGGTGTAAATAAAC |
| 4488 | db mining | Hs.287797 | BC009469 | 14495714 | mRNA for FLJ0043 protein, partial cds/cds = (0, 4248) | 1 | CCCAGGGTTTCATGTCTGAGGCCCTC ACCAAGTGTGAGTGACAGTATAAA |
| 4489 | literature | Hs.287797 | BC009469 | 14495714 | mRNA for FLJ00043 protein, partial | 1 | CCCAGGGTTTCATGTCTGAGGCCCTC |

TABLE 8-continued

| SEQ ID | Origin | Unigene | Locus | GI | Nominal Description | Strand | Probe Sequence |
|---|---|---|---|---|---|---|---|
| 4490 | db mining | Hs.293842 | BG506472 | 13467989 | 601571679F1 cDNA, 5' end /clone = IMAGE:3838875/clone_end = 5' cds/cds = (0, 4248) | 1 | ACCAAGTGTGAGTGACAGTATAAA ACAAGAATGGTTGAGGCGAATATTG GAACCACATGGGCTTAATGCTGAA |
| 4491 | db mining | Hs.224344 | BG623174 | 13674545 | 602646078F1 cDNA, 5' end /clone = IMAGE:4769802/clone_end = 5' | 1 | ACACCTCTCTATTTTGAAGTCCCTAT GTGCCCTGTAATGTCTCGTTTTAA |
| 4492 | db mining | Hs.127128 | BI091076 | 14509406 | ok13e12.s1 cDNA, 3' end /clone = IMAGE:1507726/clone_end = 3' | 1 | GGGAGAGCTCATGTCAGTGAATATAG ATCATTCTGTTGATACCCTTCTTT |
| 4493 | db mining | Hs.330212 | D20259 | 501358 | HUMGS01233 cDNA, 3' end /clone = pm1527/clone_end = 3' | 1 | TTGAAACTTGTAACTGAGATGCTGTA GTTTTTTGCCATCTGTAGTGATGT |
| 4494 | db mining | Hs.330467 | D20413 | 501509 | HUMGS01387 cDNA, 3' end /clone = pm1535/clone_end = 3' | 1 | AAAGGGTTTTATCCACTGTCATTTCAA TTGGATAACATTTTGTCAAGTTT |
| 4495 | db mining | Hs.330223 | D20542 | 501638 | HUMGS01517 cDNA, 3' end /clone = pm1520/clone_end = 3' | 1 | TCGGAAAGAAGAAGTGGGAGGATGT GAATTTTAGTTCTGAGTTTACCAAA |
| 4496 | db mining | Hs.330255 | D20847 | 504687 | HUMGS01828 cDNA, 3' end /clone = mp1214/clone_end = 3' | 1 | GATCGGGAACTGGCTCCGTTGTGCT GAGGTCATCTTTGGTCATCAGCCTC |
| 4497 | db mining | Hs.141296 | D86979 | 6834000 | mRNA for KIAA0226 protein, partial cds/cds = (0, 3033) | 1 | TGGTGCTTGTGCAGCCTGGCAGTTCA TTGTCATCTTTAATAAACTAAGGA |
| 4498 | db mining | Hs.303450 | H13491 | 878311 | yj15f02.r1 cDNA, 5' end /clone = IMAGE:148827/clone_end = 5' | 1 | AGAAGTACAAGATTTCGTTCTTCCTT CCATTAAAGTACAATCTCCCTGGG |
| 4499 | db mining | Hs.138563 | H65914 | 1024654 | 601819705F1 cDNA, 5' end /clone = IMAGE:4051657/clone_end = 5' | 1 | TACAAGTGAAAGCTAAGATGAACACA TTTAAGTTAAATGGCAGCCTTGTT |
| 4500 | db mining | Hs.73858 | J05158 | 179935 | carboxypeptidase N mRNA, 3' end /cds = (0, 1810) | 1 | AAAAGGATGTGACAGAAGCAGAGAT GACCAGAAAGCACAGGGGCAGGGTT |
| 4501 | db mining | Hs.69771 | K01566 | 187721 | B-factor, properdin | 1 | GGGTTTTCTATAAGGGGTTTCCTGCT GAACAGGGGCGTGGGATTGAATTA |
| 4502 | literature | Hs.278625 | K02403 | 187768 | complement component 4B (C4B), mRNA/cds = (51, 5285) | 1 | CCTGGGACCAGGGCATATTAAAGGC TTTTGGCAGCAAAGTGTCAGTGTTG |
| 4503 | db mining | Hs.132807 | L29376 | 561725 | (clone 3.8-1) MHC class I mRNA fragment/cds = UNKNOWN | 1 | TTTGTGGCTTGGGGCTGCCTACTATA AACTATTGGGGGTTCGTCCATTTT |
| 4504 | db mining | Hs.274509 | M16768 | 339399 | T-cell receptor aberrantly rearranged gamma-chain mRNA from cell line HPB-MLT/cds = UNKNOWN | 1 | TTTACACGCCCTGAAGCAGTCTTCTT TGCTAGTTGAATTATGTGGTGTGT |
| 4505 | db mining | Hs.247956 | M22005 | 188300 | interleukin 2 gene, clone pATIaclL-2C/2TT, complete cds, clone pATIaclL-2C/2TT/cds = (0, 404) | 1 | AATTCCTGAACCGTTGGATCACCTTC TGTCAGTCCATCATCTCCACCCTG |
| 4506 | db mining | Hs.247923 | M31949 | 185254 | Ig rearranged mu-chain V-region gene, subgroup VH-III, exon 1 and 2 | 1 | CTTACGTTGGGACACCTAAATTCGCC GCGTCTGTAGAAGGCAGATTCGAG |
| 4507 | db mining | Hs.247930 | M55420 | 185346 | IgE chain, last 2 exons | 1 | AAAACCGTGTCTGTCCCTTCAACAGA GTCATCGAGGAGGGGTGGCTGCTA |
| 4508 | literature | NA | M73276 | 177970 | Human angiotensin I-converting enzyme (ACE) gene, 5' flank | 1 | AAACTGCCGGGTCCCCATCTTCAAAA GAGAGGAGGCCCTTTCTCCAGCTT |
| 4509 | Table 3A | Hs.154365 | M82882 | 180551 | cis-acting sequence/cds = UNKNOWN | 1 | CAAGAAAGCAACTTGAGCCTTGGGCT AATCTGGCTGAGTAGTCAGTTATA |
| 4510 | Table 3A | Hs.171699 | N31778 | 1152177 | yx70d02.r1 cDNA, 5' end /clone = IMAGE:267075/clone_end = 5' | 1 | TGTGTTCTTTGAGTTCCCCCTTTACC CAAAAGTAATTTGGGGACCAAAGT |
| 4511 | db mining | Hs.206035 | N39815 | 1163360 | yx93c06.r1 cDNA, 5' end /clone = IMAGE:269290/clone_end = 5' | 1 | GGGAAGGCAATCTGATGGGGAAGTT GGCAATTTCTGGTTTGGGTGATTTA |
| 4512 | db mining | Hs.169401 | NM_000041 | 4557324 | apolipoprotein E (APOE), mRNA /cds = (60, 1013) | 1 | CCAGCCGTCCTCCTGGGGTGGACCC TAGTTTAATAAGATTCACCAAGTT |
| 4513 | literature | Hs.38069 | NM_000066 | 4557390 | complement component 8, beta polypeptide (C8B), mRNA /cds = (27, 1802) | 1 | CATGCAAGGGCAAAAGGCAGTGCCA TGCAAGCTGTTTAAATAAAGATGT |
| 4514 | literature | Hs.317585 | NM_000088 | 14719828 | cDNA:FLJ21026 fis, clone CAE06812 /cds = (27, 677) | 1 | AGGGGTGGGAGGAAGCAAAAGACTC TGTACCTATTTTGTATGTGTATAAT |
| 4515 | db mining | Hs.1472 | NM_000173 | 4504070 | glycoprotein Ib (platelet), alpha polypeptide (GP1BA), mRNA /cds = (42, 1922) | 1 | TCAGGATGTGAGCACTCGTTGTGTCT GGATGTTACAATATGGGTGGTTT |
| 4516 | literature | Hs.180532 | NM_000175 | 4504086 | *Homo sapiens*, clone IMAGE:4098234, mRNA, partial cds/cds = (0, 904) | 1 | TGTTCACGTTGTTCACATCCCATGTA GAAAAACAAAGATGCCACGGAGGA |
| 4517 | db mining | Hs.290070 | NM_000177 | 4504164 | gelsolin (amyloidosis, Finnish type) (GSN), mRNA/cds = (14, 2362) | 1 | AGCCCTGCAAAAATTCAGAGTCCTTG CAAAATGTCTAAAATGTCAGTGT |
| 4518 | literature | Hs.227730 | NM_000210 | 1111111 | integrin, alpha 8 (ITGA6), mRNA /cds = (146, 3387) | 1 | TGTCATCTCAAGTCAAGTCACTGGTC TGTTTGCATTTGATACATTTTTGT |
| 4519 | db mining | Hs.90598 | NM_000247 | 4557750 | MHC class I polypeptide-related sequence A (MICA), mRNA /cds = (39, 1190) | 1 | GAGTGACCACAGGGATGGCACACAG CTCGGATTTCAGCCTCTGATGTCAG |
| 4520 | db mining | Hs.1817 | NM_000250 | 4557758 | myeloperoxidase (MPO), nuclear gene encoding mitochondrial protein, mRNA /cds = (177, 414) | 1 | GCCTGTTGCCCTTTCTGTACCATTTA TTTGCTCCCAATGTTTATGATAAT |
| 4521 | db mining | Hs.1817 | NM_000200 | 4567758 | myeloperoxidase (MPO), nuclear gene encoding mitochondrial protein, mRNA /cds = (177, 2414) | 1 | GCCTGTTGCCCTTTCTGTACCATTTA TTTGCTCCCAATGTTTATGATAAT |

TABLE 8-continued

| SEQ ID | Origin | Unigene | Locus | GI | Nominal Description | Strand | Probe Sequence |
|---|---|---|---|---|---|---|---|
| 4522 | db mining | Hs.75093 | NM_000302 | 4557836 | procollagen-lysine, 2-oxoglutarate 5-dioxygenase (lysine hydroxylase, Ehlers-Danios syndrome type VI) (PLOD), mRNA/cds = (200, 2383) | 1 | TCCTGGATGCCTCTGAAGAGAGGGA CAGACCGTCAGAAACTGGAGAGTTT |
| 4523 | db mining | Hs.10712 | NM_000314 | 4506248 | phosphatase and tensin homolog (mutated in multiple advanced cancers 1) (PTEN), mRNA/cds = (1034, 2245) | 1 | ACTTAACCATATAAATGTGGAGGCTA TCAACAAGAATGGGCCTGAAACA |
| 4524 | Table 3A | Hs.83848 | NM_000365 | 4507844 | triosephosphate isomerase 1 (TPI1), mRNA/cds = (34, 783) | 1 | GTGCCTCTGTGCTGTGTATGTGAACC ACCCATGTGAGGGAATAAACCTAG |
| 4525 | Table 3A | Hs.78943 | NM_000388 | 455366 | bleomycin hydrolase (BLMH), mRNA /cds = (78, 1445) | 1 | AAACAGACCTAATGCTCCTTGTTCCT AGAGTAGAGTGGAGGGAGGGTGGC |
| 4526 | literature | Hs.285401 | NM_000395 | 4559497 | colony stimulating factor 2 receptor, beta, low-affinity (granulocyte-macrophage) (CSF2RB), mRNA /cds = (26, 2721) | 1 | GAGATAGCCTTGCTCCGGCCCCCTT GACCTTCAGCAAATCACTTCTCTCC |
| 4527 | db mining | Hs.283743 | NM_000407 | 9945387 | glycoprotein ib beta mRNA, complete cds/cds = (636, 1871) | 1 | CTGCTGCGTCTCCCTTCCAAACTCTG GTGCTGAATAAACCCTTCTGATCT |
| 4528 | db mining | Hs.20019 | NM_000410 | 4504376 | hemochromatosis (HFE), mRNA /cds = (221, 1267) | 1 | CACTTGGCTGCATAAATGTGGTACAA CCATTCTGTCTTGAAGGGCAGGTG |
| 4529 | literature | Hs.8966 | NM_000491 | 11038661 | complement component 1, q subcomponent, beta polypeptide (C1QB), mRNA/cds = (63, 824) | 1 | CAGCCAATGGACACAGTAGGGCTTG GTGAATGCTGCTGAGTGAATGAGTA |
| 4530 | db mining | Hs.278430 | NM_000500 | 14550408 | cytochrome P450, subfamily XXIA (steroid 21-hydroxylase, congenital adrenal hyperplasia), polypetide 2 (CYP21A2), mRNA/cds = (118, 1605) | 1 | TGCAGAGGATTGAGGCTTAATTCTGA GCTGGCCCTTTCCAGCCAATAAAT |
| 4531 | db mining | Hs.502 | NM_000544 | 9961245 | transporter 2, ATP-binding cassette, sub-family B (MDR/TAP) (TAP2), transcript variant 1, mRNA /cds = (96, 2207) | 1 | TTGACCTTCCACTAGACCATGAGCAC CTGGGCGGAAAGCCATATATCTTA |
| 4532 | literature | Hs.93210 | NM_000562 | 4557388 | complement component 8, alpha polypeptide (C8A), mRNA /cds = (137, 1891) | 1 | ACAAGCAGACACCTGAAACAATCAAC GCCCAATAAAACAAAGTAGGATGA |
| 4533 | db mining | Hs.68876 | NM_000564 | 10835130 | interleukin 5 receptor, alpha (IL5RA), mRNA/cds = (249, 1511) | 1 | TGAGGAAGAAAGCATTTTGCATCAGC CTGGAGTGAACCATGAACTTGGAT |
| 4534 | literature | Hs.241053 | NM_000573 | 10834973 | AL572804 cDNA /clone = CSODI034YD15-(3-prime) | 1 | GGAATAAGGTGTTGCCTGGAATTTCT GGTTTGTAAGGTGGTCACTGTTCT |
| 4535 | Table 3A | Hs.89679 | NM_000586 | 10835148 | interleukin 2 (IL2), mRNA /cds = (47, 517) | 1 | TGAACAGATGGATTACCTTTTGTCAA AGCATCATCTCAACACTAACTTGA |
| 4536 | literature | Hs.78065 | NM_000587 | 4557386 | complement component 7 (C7), mRNA/cds = (0, 2531) | 1 | CCCAGAGTTTTCAGGGAGTACACAG GTAGATTAGTTTGAAGCATTGACCT |
| 4537 | literature | Hs.960 | NM_000590 | 10834979 | interleukin 9 (IL9), mRNA /cds = (11, 445) | 1 | TTCCAGAAAAGAAAAGATGAGAGGGAT GAGAGGCAAGATATGAAGATGAAA |
| 4538 | literature | Hs.1285 | NM_000606 | 4557392 | complement component 8, gamma polypeptide (C8G), mRNA /cds = (61, 669) | 1 | GGCTGCCCCAGAGGACAGTGGGTGG AGTGGTACCTACTTATTAAATGTCT |
| 4539 | literature | Hs.167988 | NM_0006151 | 0834989 | neural cell adhesion molecule 1 (NCAM1), mRNA/cds = (201, 2747) | 1 | CCGAGCAAAGATCAAAATAAAAAGTG ACACAGCAGCTTCACCAGAGCATT |
| 4540 | Table 3A | Hs.17483 | NM_000816 | 10835166 | chromosome 12p13 sequence /cds = (194, 1570) | 1 | TTTCCTTCAAGCCTAGCCCTTCTCTC ATTATTTCTCTCTGACCCTCTCCC |
| 4541 | db mining | Hs.100007 | NM_000635 | 10835184 | regulatory factor X, 2 (influences HLA class II expression) (RFX2), mRNA /cds = (159, 2330) | 1 | GGGTCAGTGTTCAAGAAGGAAAGCA GTTGTTGAAGCTACAGAAGCCCAGG |
| 4542 | db mining | Hs.25954 | NM_000640 | 10834991 | interleukin 13 receptor, alpha 2 (IL13RA2), mRNA/cds = (93, 1235) | 1 | TGAAGACTTTCGATATCAAGAGACAT GGTATTGACTCAACAGTTTCCAGT |
| 4543 | db mining | Hs.1721 | NM_000641 | 10834993 | interleukin 11 (IL11), mRNA /cds = (63, 662) | 1 | GGACTGTCATTCAGGGAGGCTAAGG AGAGAGGCTTGCTTGGGATATAGAA |
| 4544 | db mining | Hs.78712 | NM_000688 | 4502024 | aminolevulinate, delta-, synthase 1 (ALAS1), nuclear gene encoding mitochondrial protein, mRNA /cds = (76, 1998) | 1 | TCACTTAACCCCAGGCCATTATCATA TCCAGATGGTCTTCAGAGTTGTCT |
| 4545 | db mining | Hs.3003 | NM_000733 | 4502670 | CD3E antigen, epsilon polypeptide (TiT3 complex) (CD3E), mRNA /cds = (54, 677) | 1 | CCACTGGATGGTCATTTGGCATCTCC GTATATGTGCTCTGGCTCCTCAGC |
| 4546 | Table 3A | Hs.1349 | NM_000758 | 4503076 | colony stimulating factor 2 (granulocyte macrophage) (CSF2), mRNA /cds = (8, 442) | 1 | CTGGGCCACACTGACCCTGATACAG GCATGGCAGAAGAATGGGAATATTT |
| 4547 | db mining | Hs.1349 | NM_000758 | 4503078 | colony stimulating factor 2 (granulocyte macrophage) (CSF2), mRNA /cds = (8, 442) | 1 | CTGGGCCACACTGACCCTGATACAG GCATGGCAGAAGAATGGGAATATTT |
| 4548 | literature | Hs.86958 | NM_000874 | 4504600 | interleukin receptor ifnar2-1 (splice variant IFNAR2-1) mRNA, complete cds/cds = (326, 1321) | 1 | TGATAGCATTGGTCTTGACAAGCACC ATAGTGACACTGAAATGGATTGGT |
| 4549 | literature | Hs.86474 | NM_000962 | 11386140 | prostaglandin-endoperoxide synthase 1 (prostaglandin G/H synthase and cyclooxygenase) (PTGS1), mRNA | 1 | CTGAGGATGTAGAGAGAACAGGTGG GCTGTATTCACGCCATTGGTTGAA |

TABLE 8-continued

| SEQ ID | Origin | Unigene | Locus | GI | Nominal Description | Strand | Probe Sequence |
|---|---|---|---|---|---|---|---|
| 4550 | Table 3A | Hs.180450 | NM_001026 | 14918502 | ribosomal protein S24 (RPS24), transcript variant 1, mRNA /cds = (5, 1804) | 1 | CTGGCAAAAAGCCGAAGGAGTAAAG GTGCTGCAATGATGTTAGCTGTGGC |
| 4551 | Table 3A | Hs.113029 | NM_001028 | 14591916 | ribosomal protein S25 (RPS25), mRNA/cds = (63, 440) | 1 | TGGTCCAAAGGCAAAGTTCGGGACA AGCTCAATAACTTAGTCTTGTTTGA |
| 4552 | literature | Hs.161305 | NM_001057 | 4507344 | tachykinin receptor 2 (TACR2), mRNA /cds = (0, 1196) | 1 | CAACAGGTGTCACACTAAGGAGACTT TGTTCATGGCTGGGGACACAGCCC |
| 4553 | literature | Hs.1080 | NM_001058 | 7669544 | tachykinin receptor 1 (TACR1), transcript variant long, mRNA /cds = (210, 1433) | 1 | GCATGGAAATTCCCTTCATCTGGAAC CATCAGAAACACCCTCACACTGGG |
| 4554 | literature | Hs.942 | NM_001059 | 7669547 | tachykinin receptor 3 (TACR3), mRNA /cds = (143, 1540). | 1 | GGCAGCTATGGTCAAATTGAGAAAGG TAGTGTATAAATGTGACAAAGACA |
| 4555 | db mining | Hs.86947 | NM_001109 | 4557252 | a disintegrin and metalloproteinase domain 8 (ADAM8), mRNA /cds = (9, 2483) | 1 | GCTATCTTGTCTGGTTTTCTTGAGAC CTCAGATGTGTGTTCAGCAGGGCT |
| 4556 | literature | Hs.1239 | NM_001150 | 4502094 | alanyl (membrane) aminopeptidase (aminopeptidase N, aminopeptidase M, microsomal aminopeptidase, CD13, p150) (ANPEP), mRNA /cds = (120, 3023) | 1 | CCGCCCTGTACCCTCTTTCACCTTTC CCTAAAGACCCTAAATCTGAGGAA |
| 4557 | db mining | Hs.507 | NM_001264 | 4502758 | corneodesmosin (CDSN), mRNA /cds = (14, 1603) | 1 | CATATGGGAGAAGGCCAGTGCCCAG GCATAGGGTTAGCTCAGTTTCCCTC |
| 4558 | Table 3A | Hs.74441 | NM_001273 | 4557452 | chromodomain helicase DNA binding protein 4 (CHD4), mRNA /cds = (89, 5827) | 1 | TTAATACCAGGAACCCAGCGGCTCTA GCCACTGAGCGGCTAAATGAAATA |
| 4559 | db mining | Hs.5057 | NM_001304 | 8051580 | carboxypeptidase D (CPD), mRNA /cds = (15, 4148) | 1 | GTGGAGGGGTTTACCACCTTCCTAG GTCGTTCAACCAGGTTTTGTGAGGA |
| 4560 | db mining | Hs.2246 | NM_001308 | 4503010 | carboxypeptidase N, polypeptide 1, 50 kD (CPN1), mRNA/cds = (213, 1589) | 1 | GCAACCCTTCAGAAAGGCTTTGCTCC TGCTCTCAGATCAGATCAAGCATT |
| 4561 | db mining | Hs.336918 | NM_001356 | 4503258 | death-associated protein 6 (DAXX), mRNA/cds = (147, 2369) | 1 | AACATTTGGAGGAAGGTGGGAAGCA GATGACTGAGGAAGGGATGGACTAA |
| 4562 | Table 3A | Hs.268036 | NM_001402 | 4503470 | tRNA isopentenylpyrophosphate transferase (IPT), mRNA /cds = (60, 1040) | 1 | TGCCCAGAAAGCTCAGAAGGCTAAT GAATAzttATCCCTAATACCTGCCA |
| 4563 | Table 3A | Hs.129673 | NM_001416 | 4503528 | eukaryotic translation initiation factor 4A, isoform 1 (EIF4A1), mRNA /cds = (16, 1236) | 1 | AGAGGACTCTTCGAGACATTGAGACC TTCTACAACACCTCCATTGAGGAA |
| 4664 | Table 3A | Hs.99855 | NM_001462 | 4503780 | formyl peptide receptor-like 1 (FPRL1), mRNA/cds = (772, 1827) | 1 | TGGGGTAAGTGGAGTTGGGAAATAC AAGAAGAGAAAGACCAGTGGGGATT |
| 4565 | literature | Hs.198252 | NM_001504 | 4504098 | G protein-coupled receptor 9 (GPR9), mRNA/cds = (68, 1174) | 1 | AACTAAAACTTCATCTTCCCCAAGT GCGGGGAGTACAAGGCATGGCGTA |
| 4566 | db mining | Hs.113207 | NM_001505 | 4504090 | G protein-coupled receptor 30 (GPR30), mRNA/cds = (691, 1818) | 1 | AAAACCTTCCCATAAAATGTAAGAAA AGCTGATGAGGCTGGTGACGTTCA |
| 4567 | db mining | Hs.278589 | NM_001518 | 14670355 | general transcription factor II, i (GTF2I), transcript variant 1, mRNA /cds = (370, 3368) | 1 | TGACATGGTAGCAGAAATAGGCCCTT TTATGTGTTGCTTCTATTTTACCT |
| 4568 | db mining | Hs.101840 | NM_001531 | 4504416 | major histocompatibility complex, class I-like sequence (HLALS), mRNA /cds = (5, 1030) | 1 | GCCACAAAATGTTCTTTGTTCTTTGG CTCCAAAAAGACTGTCAGCTTTCA |
| 4569 | db mining | Hs.81234 | NM_001542 | 4504626 | mRNA for KIAA0466 protein, partial cds/cds = (40, 3684) | 1 | CTGAGGCTCTCCCTTTCTCTGTGATT GGACAGTTGACAGCACCCAAACTC |
| 4570 | db mining | Hs.22111 | NM_001555 | 4504624 | mRNA for KIAA0364 gene, complete cds/cds = (1144, 5127) | 1 | CCCTGTAACTCCTCACTGTACTGATT TACTGGCGCATGAAATTCTATTAA |
| 4571 | Table 3A | Hs285115 | NM_001560 | 4504648 | interleukin 13 receptor, alpha 1 (IL13RA1), mRNA/cds = (43, 1326) | 1 | CTTGAGTAAAATAAATATTGTCTTTTT GTATGTCAAGCGGGCCGCCACCG |
| 4572 | literature | Hs.1211 | NM_001811 | 6138970 | acid phosphatase 5, tartrate resistant (ACP5), mRNA/cds = (89, 1086) | 1 | GGGAGGGAGGGAGGGAAAGCTTCCT CCTAAATCAAGCATCTTTCTGTTAC |
| 4573 | literature | Hs.10247 | NM_001627 | 4502028 | mRNA for MEMD protein /cds = (0, 1748) | 1 | TCACAGATGCATATAGACACACATAC ATAATGGTACTCCCAACTGACAA |
| 4574 | db mining | Hs.268571 | NM_001645 | 5174774 | intergenic region between apoE and apoCI gene/cds = UNKNOWN | 1 | GCTGAGGACTCCCGCCATGTGGCCC CAGGTGCCACCAATAAAAATCCTAC |
| 4575 | db mining | Hs.69771 | NM_001710 | 14550403 | B-factor, properdin (BF), mRNA /cds = (129, 2423) | 1 | CAAGATGAGGATTTGGGTTTTCTATA AGGGGTTTCCTGCTGGACAGGGGC |
| 4576 | literature | Hs.1281 | NM_001735 | 4502506 | complement component 5 (C5), mRNA/cds = (12, 5042) | 1 | AAACATGGCCTTTGCTTGAAAGAAAA TACCAAGGAACAGGAAACTGATCA |
| 4577 | literature | Hs.11763 | NM_001771 | 4502650 | CD22 antigen (CD22), mRNA /cds = (56, 2599) | 1 | GTTTGAGATGGACACACTGGTGTGGA TTAACCTGCCAGGGAGACAGAGCT |
| 4578 | literature | Hs.83731 | NM_001772 | 4502654 | CD33 antigen (gp67) (CD33), mRNA /cds = (12, 1106) | 1 | GGACCAAAGGCTGATTCTTGGAGATT TAACTCCCCACAGGCAATGGGTTT |
| 4579 | Table 3A | Hs.340325 | NM_001774 | 4502682 | yf59e04.s1 cDNA, 3' end /clone = IMAGE:26202/clone_end = 3' | 1 | AATATTTGTTTAATCCCCAGTTCGCCT GGAGCCCTCCGCCTTCACATTCC |
| 4580 | literature | Hs.82685 | NM_001777 | 4502672 | CD47 antigen (Rh-related antigen, integrin-associated signal transducer) (CD47), mRNA/cds = (106, 1077) | 1 | AAAGTAACTGGTTGTCACCTATGAGA CCCTTACGTGATTGTTAGTTAAGT |

TABLE 8-continued

| SEQ ID | Origin | Unigene | Locus | GI | Nominal Description | Strand | Probe Sequence |
|---|---|---|---|---|---|---|---|
| 4581 | literature | Hs.264190 | NM_001780 | 4502678 | cDNA:FLJ22121 fis, clone HEP18876, highly similar to AF191298 vacuolar sorting protein 35 (VPS35) mRNA /cds = UNKNOWN | 1 | CTCAGCCTCCTCATCTGGGGGAGTG GAATAGTATCCTCCAGGTTTTTCAA |
| 4582 | literature | Hs.3107 | NM_001784 | 4502690 | CD97 antigen (CD97), mRNA /cds = (70, 2298) | 1 | GGCAGGAGGTTCTCACTGTTGTGAA GGTTGTAGACGTTGTGTAATGTGTT |
| 4583 | Table 3A | Hs.10029 | NM_001814 | 4503140 | cathepsin C (CTSC), mRNA /cds = (33, 1424) | 1 | AAGTGGGAATTTCTGGAAGATGGTC AGCTATGAAGTAATAGAGTTTGCT |
| 4584 | db mining | Hs.11 | NM_01815 | 4502792 | carcinoembryonic antigen-related cell adhesion molecule 3 (CEACAM3), mRNA/cds = (54, 692) | 1 | GCCTGTGGCCCACCTGGGGTCACTT GGAAAGGATCTGAATAAAGGGGACC |
| 4585 | db mining | Hs.119140 | NM_001970 | 4503544 | eukaryotic translation initiation factor 5A (EIF5A), mRNA/cds = (43, 507) | 1 | AAATAACTGGCTCCCAGGGTGGCGG TGGTGGCAGCAGTGATCCTCTGAAC |
| 4586 | db mining | Hs.99863 | NM_001972 | 4503548 | elastase 2, neutrophil (ELA2), mRNA /cds = (38, 841) | 1 | TGCCCACACCCACACTCTCCAGCATC TGGCACAATAAACATTCTCTGTTT |
| 4587 | db mining | Hs.99863 | NM_001972 | 4503548 | elastase 2, neutrophil (ELA2), mRNA /cds = (38, 841) | 1 | TGCCCACACCCACACTCTCCAGCATC TGGCACAATAAACATTCTCTGTTT |
| 4588 | literature | Hs.193122 | NM_002000 | 4503672 | Fc fragment of IgA, receptor for (FCAR), mRNA/cds = (39, 902) | 1 | GCACCCACCTTTCTGCACATAAGTTA TGGTTTTCCATCTTATCTGTCTTC |
| 4589 | db mining | Hs.8917 | NM_002001 | 4503674 | Fc fragment of IgE, high affinity I, receptor for, alpha polypeptide (FCER1A), mRNA/cds = (106, 879) | 1 | AATTGTCAAACACAGCTTGCAATATA CATAGAAACGTCTGTGCTCAAGGA |
| 4590 | db mining | Hs.77252 | NM_002012 | 4503718 | fragile histidine triad gene (FHIT), mRNA/cds = (362, 805) | 1 | TCCAGAAACATGACAAGGAGGACTTT CCTGCCTCTTGGAGATCAGAGGAG |
| 4591 | db mining | Hs.108694 | NM_002099 | 8051602 | glycophorin A (includes MN blood group) (GYPA), mRNA/cds = (55, 507) | 1 | TCATAGTTAAATTTGGTATTCGTGGG GGAAGAAATGACCATTTCCCTTGT |
| 4592 | literature | Hs.342658 | NM_002119 | 4504400 | major histocompatibility complex, class II, DN alpha (HLA-DNA), mRNA /cds = (76, 828) | 1 | ACACACATTCTTGCTCTACCCAAAGC TCTGCCTGGCAGCACTAAATGCTT |
| 4593 | literature | Hs.342658 | NM_002119 | 4504400 | major histocompatibility complex, class II, DN beta (HLA-DNA), mRNA /cds = (76, 828) | 1 | ACACACATTCTTGCTCTACCCAAAGC TCTGGCTGGCAGCACTAAATGCTT |
| 4594 | db mining | Hs.1802 | NM_002120 | 4504402 | major histocompatibility complex, class II, DO beta (HLA-DOB), mRNA /cds = (56, 877) | 1 | GCAGTCTCCACAGTCTTCAGAAGACA AATGCTCAGGTAGTCACTGTTTCC |
| 4595 | db mining | Hs.279930 | NM_002124 | 4504410 | major histocompatibility complex, class II, DR beta 3 (HLA-DRB3), mRNA /cds = (35, 835) | 1 | GCCTCCCGTGCATCTGTACTCACCCT GTACGACAAACACATTACATTATT |
| 4596 | db mining | Hs.73885 | NM_002127 | 4504414 | HLA-G histocompatibility antigen, class I, G (HLA-G), mRNA /cds = (5, 1021) | 1 | TTTCCTGTTCCAGAAAAGGGGCTGGG ATGTCTCCGTCTCTGTCTCAATT |
| 4597 | db mining | Hs.1521 | NM_002180 | 4504622 | immunoglobulin mu binding protein 2 (IGHMBP2), mRNA/cds = (49, 3030) | 1 | CGGCCTTCTCCGGTGTCCTGTACCAA CTCTTCTATTTAAGAGAACCTCAG |
| 4598 | db mining | Hs.173880 | NM_002182 | 4504660 | interleukin 1 receptor accessory protein (IL1RAP), mRNA /cds = (206, 1918) | 1 | GGGACGTTCCATGCCCAGGTTAACAA AGAACTGTGATATATAGAGTGTCT |
| 4599 | literature | Hs.172689 | NM_002183 | 13324709 | interleukin 3 receptor, alpha (low affinity) (IL3RA), mRNA /cds = (146, 1282) | 1 | ATGGGAGATGCCTGTGTAATTTCGTC CGAAGCTGCCAGGAAGAAGAACAG |
| 4600 | literature | Hs.12503 | NM_002189 | 4504648 | interleukin 15 receptor, alpha (IL15RA), mRNA/cds = (82, 885) | 1 | CCTCTCCATTGAAGGATTCAGGAAGA AGAAAACTCAACTCAGTGCCATTT |
| 4601 | literature | Hs.149609 | NM_002205 | 4504750 | integrin, alpha 5 (fibronectin receptor, alpha polypeptide) (ITGA5), mRNA /cds = (23, 3172) | 1 | CCTCACCTTGGCACCAGACACCCAG GACTTATTTAAACTCTGTTGCAAGT |
| 4602 | Table 3A | Hs.149846 | NM_002213 | 4504772 | integrin, beta 5 (ITGB5), mRNA /cds = (29, 2419) | 1 | TGCAATGTGAGTTTCCTCTCCTGTC CGTGTTTGTTTAGTACTTTTATAA |
| 4603 | db mining | Hs.78465 | NM_002228 | 7710122 | v-jun avian sarcoma virus 17 oncogene homolog (JUN), mRNA /cds = (974, 1969) | 1 | AGCAGGAATTGGTGGCAGATTTTACA AAGATGTATCCTTCCAATTTGGA |
| 4604 | db mining | Hs.169824 | NM_002258 | 4504878 | killer cell lactin-like receptor subfamily B, member 1 (KLRB1), mRNA /cds = (60, 737) | 1 | TGGATCTGCCAAAAAGAACTAACACC TGTGAGAAATAAAGTGTATCCTGA |
| 4605 | db mining | Hs.172195 | NM_002408 | 6031183 | mannosyl (alpha-1,6-)-glycoprotein, beta-1,2-N-acetylglucosaminyltransferase (MGAT2), mRNA/cds = (489, 1832) | 1 | TTCCTGTACTATTGTGTTTGAGTGTG TTTTGGAACCTTCATAGAACACA |
| 4606 | literature | Hs.77367 | NM_002416 | 4505186 | monokine induced by gamma interferon (MIG), mRNA/cds = (39, 416) | 1 | TGACCCACTTACCTTGCATCTCACAG GTAGACAGTATATAACTAACAACC |
| 4607 | Table 3A | Hs.926 | NM_002463 | 11342663 | myxovirus (influenza) resistance 2, homolog of murine (MX2), mRNA /cds = (104, 2251) | 1 | TTTCCCTGATTATGATGAGCTTCCATT GTTCTGTTAAGTCTTGAAGAGGA |
| 4608 | db mining | Hs.173084 | NM_002470 | 11342671 | myosin, heavy polypeptide 3, skeletal muscle, embryonic (MYH3), mRNA /cds = (84, 5906) | 1 | CACGAGAGTGAAGAGTGAGCCAGCC CTTCTGGAGCAGGAGCAGGACAGAA |
| 4609 | db mining | Hs.113973 | NM_002472 | 4505300 | myosin, heavy polypeptide 6, skeletal muscle, perinatal (MYH8), mRNA | 1 | AAGAAAGGCACAAAATGTGCTATTTT TGGTCACTTGCTTTATGACGTTTA |

TABLE 8-continued

| SEQ ID | Origin | Unigene | Locus | GI | Nominal Description | Strand | Probe Sequence |
|---|---|---|---|---|---|---|---|
| 4610 | db mining | Hs.275163 | NM_002512 | 4505408 | /cds = (73, 5886) non-metastatic cells 2, protein (NM23B) expressed in (NME2), nuclear gene encoding mitochondrial protein, mRNA/cds = (72, 530) | 1 | GTCCCTGGACACAGCTCTTCATTCCA TTGACTTAGAGGCAACAGGATTGA |
| 4611 | Table 3A | Hs.85844 | NM_002529 | 4585711 | neurotrophic tyrosine kinase, receptor, type 1 (NTRK1), mRNA/cds = (0, 2390) | 1 | GTACCAGCTCTCCAACACGGAGGCA ATCGACTGCATCACGCAGGGACGTG |
| 4612 | db mining | Hs.93728 | NM_002586 | 4505624 | pre-B-cell leukemia transcription factor 2 (PBX2), mRNA/cds = (0, 1292) | 1 | GGGGGCTAGTTCTCTCCTCACTTGTA AACTTGTGTAGTTTCACAGAAAAA |
| 4613 | db mining | Hs.41639 | NM_002598 | 4505854 | programmed cell death 2 (PDCD2), mRNA/cds = (29, 1063) | 1 | ACAGAAGAATTTGTGTGGAAGCAGGA TGTAACAGATACACCGTAAGGCA |
| 4614 | Table 3A | Hs.181013 | NM_002629 | 4505152 | phosphglycerate mutase 1 (brain) (PGAM1), mRNA/cds = (31, 795) | 1 | CCCTGCCACATGGGTCCAGTGTTCAT CTGAGCATAACTGTACTAAATCCT |
| 4615 | db mining | Hs.288579 | NM_002644 | 11342673 | polymeric immunoglobulin receptor (PIGR), mRMA/cds = (156, 2450) | 1 | CTTGAAGGAAGAGGGACCAGGGTGG GAGAGCTGATTGCAGAAAGGAGAGA |
| 4616 | db mining | Hs.261285 | NM_002669 | 4505894 | pleiotropic regulator 1 (PRL1, Arabidopsis homolog) (PLRG1), mRNA /cds = (0, 1544) | 1 | AAACCATTAAAGTATACAGAGAGGAT GACACAGCCACAGAAGAAACTCAT |
| 4617 | Table 3A | Hs.79402 | NM_002694 | 14702172 | polymerase (RNA) II (DNA directed) peptide C (33 kD) (POLR2C), transcript variant gamma, mRNA /cds = (57, 884) | 1 | AACATGCACAAAGCAGTTAATTAGGC AGCCTGGAGAAAACCAGAGATCCA |
| 4618 | Table 3A | Hs.77202 | NM_002738 | 4506068 | protein kinase C. beta 1 (PRKCB1, mRNA/cds = (138, 2151) | 1 | ACTTCCAGAAACTCATCAAATGAACA GACAATGTCAAAACTACTGTGTCT |
| 4619 | literature | Hs.180533 | NM_002758 | 4506098 | mitogen-activated protein kinase kinase 3 (MAP2K3), mRNA /cds = (337, 1293) | 1 | GCTTTATGGGTTTGGCTTGTTTTTCTT GCATGGTTTGGAGCTGATCGCTT |
| 4620 | literature | Hs.111825 | NM_002758 | 14589899 | mitogen-activated protein kinase kinase 6 (MAP2KB), transcript variant 1, mRNA/cds (340, 1344) | 1 | TTCTTTCTTGGCCTCAAGTTCAATATG GAGAGGATTGCTTCCCTGAATCC |
| 4621 | db mining | Hs.241561 | NM_002770 | 4506146 | protease, serine, 2 (trysin 2) (PRSS2), mRNA/cds = (6, 749) | 1 | AACTATGTGGACTGGATTAAGGACAC CATAGCTGCCAACAGCTAAAGCCC |
| 4622 | db mining | Hs.928 | NM_002777 | 7382457 | proteinase 3 (serine proteinase, neutrophil, Wegener granulomatosis autoantigen) (PRTN3), mRNA /cds = (48, 818) | 1 | CCTGACTTCTTCACGCGGGTAGCCCT CTACGTGGACTGGATCCGTTCTAC |
| 4623 | db mining | Hs.78575 | NM_002778 | 11386146 | prosaposin (variant Gaucher disease and variant metachromatic leukodystrophy) (PSAP), mRNA /cds = (38, 1612) | 1 | AGCCAGCAGGACATGAAGTTGCTATT AAATGGACTTCGTGATTTTTGTTT |
| 4624 | db mining | Hs.250655 | NM_002823 | 4506276 | prothymosin, alpha (gene sequence 28) (PTMA), mRNA/cds = (155, 487) | 1 | TTTGGCCTGTTTTGATGTATGTGTGA AACAAGTTGTCCAACAATAAACA |
| 4625 | db mining | Hs.82547 | NM_002888 | 4506424 | retinoic acid receptor responder (tazarotene induced) 1 (RARRES1), mRNA/cds = (36, 722) | 1 | AACTTGTGCCACAAGAGTTACAATCA AAGTGGTCTCCTTAGACTGAATTC |
| 4626 | db mining | Hs.106061 | NM_002904 | 14670267 | RD RNA-binding protein (RDBP), mRNA/cds = (108, 1250) | 1 | AAAGCCTTTAAAAACGGCTGTCAGGT TTGATCTCAGTGTAACAACATGGC |
| 4627 | db mining | Hs.139228 | NM_002914 | 4506488 | replication factor C (activator 1) 2 (40 kD) (RFC2), mRNA /cds = (207, 1271) | 1 | GAAAATGCGCCTTAGGCTGAGCCAA CATGACTGTCCCCCAAACTCCAGTG |
| 4628 | db mining | Hs.123638 | NM_002918 | 4506492 | regulatory factor X, 1 (influences HLA class II expression) (RFX1), mRNA /cds = (93, 3032) | 1 | CCAGCTTCGGTTCCTTCCACCTCATC CGGCTGCTCTACGACGAGTACATG |
| 4629 | db mining | Hs.166019 | NM_002919 | 4506494 | regulatory factor X, 3 (influences HLA class II expression) (RFX3), mRNA /cds = (8, 2131) | 1 | AAGATTGGTGCTCCTGATAAAGCAAA GGGCTAGGAATACAATGGAAAGGA |
| 4630 | db mining | Hs.21273 | NM_002920 | 15011897 | transcription factor NYD-sp10 mRNA, complete cds/cds = (109, 2034) | 1 | TCATTGGTACACATTCTGTATGCTGC TGTTTTCAAGTTGGCAAATTAAGC |
| 4631 | literature | Hs.73839 | NM_002935 | 4506550 | ribonuclease, RNase A family, 3 (eosinophil cationic protein) (RNASE3), mRNA/cds = (63, 545) | 1 | TATCAGCAACTGTCCTCATCAGTCTC CATACCCCTTCAGCTTTCCTGAGC |
| 4632 | Table 3A | Hs.74267 | NM_002948 | 4506602 | 60 S ribosomal protein L15 (EC45) mRNA, complete cds/cds = (34, 648) | 1 | GCAGCTTGGAGAAGGCGCAATACTC CAGCTCCACCGTTACCGCTAATATA |
| 4633 | Table 3A | Hs.74267 | NM_0020948 | 4506602 | 60 S ribosomal protein L15 (EC45) mRNA, complete cds/cds = (34, 648) | 1 | GCAGCTTGGAGAAGGCGCAATACTC CAGCTCCACCGTTACCGCTAATATA |
| 4634 | db mining | Hs.74592 | NM_002971 | 4506790 | special AT-rich sequence binding protein 1 (binds to nuclear matrix/scaffold-associating DNA's) (SATB1), mRNA/cds = (214, 2505) | 1 | CGGAGCCTCAAACAAGCATTATACCT TCTGTGATTATGATTTCCTCTCCT |
| 4635 | Table 3A | Hs.89714 | NM_002994 | 4506848 | small inducible cytokine subfamily B (Cys-X-Cys), member 5 (epithelial-derived neutrophil-activating peptide 78) (SCYB5), mRNA/cds = (106, 450) | 1 | ATGTTTCTTGGGGAATATGTTAGAGA ATTCCCTTACTCTTGATTGTGGGA |
| 4636 | db mining | Hs.82109 | NM_002997 | 4506858 | syndecan 1 (SDC1), mRNA /cds = (205, 1137) | 1 | AGAGTGATAGTCTTTGCTTTTGGCA AAACTCTACTTAATCCAATGGGTT |
| 4637 | db mining | Hs.301698 | NM_003033 | 4506950 | BAC 180I23 chromosome 8 map | 1 | GCCTCTTGCTTGGCGTGATAACCCTG |

TABLE 8-continued

| SEQ ID | Origin | Unigene | Locus | GI | Nominal Description | Strand | Probe Sequence |
|---|---|---|---|---|---|---|---|
| | | | | | 8q24.3 beta-galactoside alpha 2,3-sialyltransferase (SIAT4A) gene, complete sequence /cds = (12296, 13318) | | TCATCTTCCCAAGCTCATTTATG |
| 4638 | db mining | Hs.78403 | NM_003083 | 4507102 | small nuclear RNA activating complex, polypeptide 2, 45 kD (SNAPC2), mRNA /cds = (24, 1028) | 1 | TTCAACTGACCAGTCGTGGTTACTCC CTGCTGCCAGGTCCTTCCCCTTCC |
| 4639 | literature | Hs.80738 | NM_003123 | 4507180 | gene for sialophorin (CD43) /cds = (159, 1361) | 1 | GGCTGGCACCTCTCAACGTCTGTGG ACTGAATGAATAAACCCTCCTCATC |
| 4640 | db mining | Hs.81884 | NM_003167 | 4507306 | sulfotransferase family, cytosolic, 2A, dehydropiandrosterone (DHEA) - preferring, member 1 (SULT2A1), mRNA/cds = (52, 909) | 1 | TGGGAATAACGTCCAAAACACTCTGG ATCTTATATGGAGAATGACATTGA |
| 4641 | literature | Hs.7510 | NM_003188 | 4507360 | DNA sequence from clone RP1-154G14 on chromosome 6q15-18.3, Contains the 3' end of the MAP3K7 gene for mitogen-activated protein kinase kinase kinase 7 (TGF-beta activated kinase 1, TAK1), ESTs, STSs and GSSs/cds = (0, 1700) | 1 | AGTACTGAACTCAGTTCCATCCGTAA AATATGTAAAGGTAAGTGGCAGCT |
| 4642 | db mining | Hs.250841 | NM_003290 | 4507850 | tropomyosin 4 (TPM4), mRNA /cds = (50, 796) | 1 | GCCCAACTTCATTTCCATACTTCAGG GAACAGCAAATTGAGGATTTACTT |
| 4643 | Table 3A | Hs.178551 | NM_003316 | 10835036 | ribosomal protein L8 (RPL8), mRNA /cds = (43, 816) | 1 | CCGTTGAATGAGTGTGTTTTGTACAT AACTTCAGATACTTGTGAACATGC |
| 4644 | Table 3A | Hs.4248 | NM_003371 | 4507870 | vav 2 oncogene (VAV2), mRNA /cds = (5, 2641) | 1 | TTTCTTGGGAGAGTCACTCCAGCCCT GAAGTCTGTCTCTAGCTCCTCTGT |
| 4645 | Table 3A | Hs.89414 | NM_003467 | 4503174 | chemokine (C-X-C motif), receptor 4 (fusin) (CXCR4), mRNA /cds = (88, 1146) | 1 | TCAGGAGTGGGTTGATTTCAGCACCT ACAGTGTACAGTCTTGTATTAAGT |
| 4646 | Table 3A | Hs.100293 | NM_003605 | 6006036 | O-linked N-acetylglucosamine (GlcNAc) transferase (UDP-N-acetylglucosamine:polypeptide-N-acetylglucosaminyl transferase) (OGT), mRNA/cds = (2039, 4801) | 1 | TTAGGAGTGATTACTAATTATCAAGG GCACAGTTGTGGTACTGTCATTGA |
| 4647 | db mining | Hs.24640 | NM_003612 | 4504236 | serna domain, immunoglobulin domain (Ig), and GP1 membrane anchor, (sernaphorin) 7A (SEMA7A, mRNA /cds = (17, 2017) | 1 | CGGACGGAAGGACGGAAAAAGCTCT ATTTTTATGTTAGGCTTATTTCATG |
| 4648 | db mining | Hs.131814 | NM_003747 | 4507612 | TRF1-interacting ankyrin-related ADP-ribose polymerase mRNA, partial cds /cds = (0, 3264) | 1 | AGTCCCTGACAGCCTAGAAATAAGCT GTTTGTCTTCTATAAAGCATTGCT |
| 4649 | db mining | Hs.321231 | NM_003779 | 13929468 | UDP-Gal:betaGlcNAc beta 1,4-galactosyltransferase, polypeptide 3 (84GALT3), mRNA/cds = (262, 1443) | 1 | GCATTTTCTGCCTATGCTGGAATAGC TCCCTCTTCTGGTCCTGGCTCAGG |
| 4650 | Table 3A | Hs.151481 | NM_003797 | 14523051 | embryonic ectoderm development (EED), mRNA/cds = (34, 1317) | 1 | AGTAAGGGCACGTAGAGCATTTAGAG TTGTCTTTCAGCATTCAATCAGGC |
| 4651 | Table 3A | Hs.103755 | NM_003821 | 4506536 | receptor-interacting serine-threonine kinase 2 (RIPK2), mRNA/cds = (0, 1622) | 1 | TGGGTCTTCAGCCTTACCCGGAAATA CTTGTGGTTTCTAGATCACCATCT |
| 4652 | db mining | Hs.184376 | NM_003825 | 4507096 | Homo sapiens, synaptosomai-associated protein, 23 kD, clone MGC:5155 IMAGE:3481227, mRNA, complete cds/cds = (73, 708) | 1 | ACAAGGCTGACACCAACAGAGATCGT ATTGATATTGCCAATGCCAGAGCA |
| 4653 | db mining | Hs.158315 | NM_003853 | 4504656 | interleukin 18 receptar accessory protein (IL18RAP), mRNA /cds = (463, 2282) | 1 | AGCTACTTCTGCCTTATGGCTAGGGA ACTGTCATGTCTACCATGTATTGT |
| 4654 | db mining | Hs.102865 | NM_003854 | 4504682 | interleukin 1 receptor-like 2 (IL1RL2), mRNA/cds = (134, 1822) | 1 | TGACTTGTTTTGCTCCATGTCTCCTC ATTCCTACACCTATTTTCTGCTGC |
| 4655 | db mining | Hs.159301 | NM_003855 | 4504654 | interleukin 18 receptor 1 (IL18R1), mRNA/cds = (24, 1649) | 1 | CTGTGAAACCGTCAGTTCGGAAGGCT GGTTAGAACATGTGGGAGCAACAT |
| 4656 | db mining | Hs.35947 | NM_003925 | 4505120 | methyl-CpG binding domain protein 4 (MBD4), mRNA/cds = (176, 1918) | 1 | GCCTAGTGTGTGTGCTTTCTTAATGT GTGTGCCAATGGTGGATCTTTGCT |
| 4657 | db mining | Hs.287832 | NM_003953 | 4506356 | myelin protein zero-like 1 (MPZL1), mRNA/cds = (132, 941) | 1 | ACCAAACTGGACTCTCGTGCAGAAAA TGTAGCCCATTACCACATGTAGCC |
| 4658 | Table 3A | Hs.108371 | NM_003973 | 4506600 | E2F transcription factor 4, p107/p130-binding (E2F4), mRNA/cds = (62, 1303) | 1 | GCACCTGCTCCAAAGGCATCTGGCA AGAAAGCATAAGTGGCAATCATAA |
| 4659 | Table 3A | Hs.155101 | NM_004046 | 4757809 | mRNA for KIAA1578 protein, partial cds/cds = (0, 3608) | 1 | CTCCTGTGGATTCACATCAAATACCA GTTCAGTTTTGTCATTGTTCTAGT |
| 4660 | Table 3A | Hs.238990 | NM_004064 | 4757961 | Homo sapiens, Similar to cyclin-dependent kinase inhibitor 1B (p27, Kip1), clone MGC:5304 IMAGE:3458141, mRNA, complete cds /cds = (377, 973) | 1 | GCCAACAGAACAGAAGAAAATGTTTC AGACGGTTCCCCAATGCCGGTTC |
| 4661 | Table 3A | Hs.239760 | NM_004077 | 4758075 | Homo sapiens, clone MGC:19593 IMAGE:3542491, mRNA, complete cds /cds = (118, 1518) | 1 | CTCTAGAAAGGCCCAAGTCCATGAGC ACAGAGGGTCTGATGAAGTTTGTG |

TABLE 8-continued

| SEQ ID | Origin | Unigene | Locus | GI | Nominal Description | Strand | Probe Sequence |
|---|---|---|---|---|---|---|---|
| 4662 | db mining | Hs.272537 | NM_004088 | 4758185 | deoxynucleotidyltransferase, terminal (DNTT), mRNA/cds = (0, 1532) | 1 | AGACCAAGAGGATATTCCTCAAAGCA GAAAGTGAAGAAGAAATTTTTGCG |
| 4663 | db mining | Hs.75450 | NM_004089 | 4758197 | mRNA for GILZ, complete cds /cds = (233, 637) | 1 | TGGAGAAGTTCCAGTCCTGTCTGAGC CCTGAAGAGCCAGCTCCCGAATCC |
| 4664 | db mining | Hs.32981 | NM_004186 | 4759089 | serna domain, immunoglobulin domain (Ig), short basic domain, secreted, (sernaphorin) 3F (SEMA3F), mRNA /cds = (78, 2435) | 1 | GAAGTAGACTTTCTGTCCTCACACCG AAGAACCCGAGTGAGCAGGAGGGA |
| 4665 | db mining | Hs.444 | NM_004197 | 4759179 | serine/threonine kinase 19 (STK19), transcript variant 2, mRNA /cds = (128, 1234) | 1 | GTGGGATTTCTGGGGAGGCTGGTGA AGGAGGGCAGGGTTCTTTTCTCTAC |
| 4666 | db mining | Hs.74115 | NM_004258 | 4758589 | immunoglobulin superfamily, member 2 (IGSF2), mRNA/cds = (21, 3086) | 1 | CTATAGCTTCATGACCGTAACATGTG ACCTGTGTGCTGGCAGGACGACTC |
| 4667 | db mining | Hs.25887 | NM_004263 | 4759093 | mRNA; cDNA DKFZp761O15121 (from clone DKFZp761O15121); complete cds/cds = (111, 2423) | 1 | ATGATCCCCATGTTGCAATATGGAGT CTCTGCCCTGAGATCTTCCCCATC |
| 4668 | Table 3A | Hs.184211 | NM_004279 | 4758733 | peptidase (mitochondrial processing) beta (PMPCB), mRNA/cds = (13, 1482) | 1 | TGGTCAGTCTTTGTTCTCTGAGAAAT TATGTTGGAAGCAGCATACTTTCA |
| 4669 | db mining | Hs.18142 | NM_004313 | 4757779 | arrestin, beta 2 (ARRB2), mRNA /cds = (53, 1282) | 1 | CCCCAAGATACACACTGGACCCTCTC TTGCTGAATGTGGGCATTAATTTT |
| 4670 | literature | Hs.54457 | NM_044356 | 4757943 | CD81 antigen (target of antiproliferative antibody 1) (CD81), mRNA/cds = (238, 948) | 1 | TTCTAACACGTCGCCTTCAACTGTAA TCACAACATCCTGACTCCGTCATT |
| 4671 | db mining | Hs.42853 | NM_004381 | 14577922 | cAMP responsive element binding protein-like 1 (CREBL1), mRNA /cds = (33, 2144) | 1 | TTTTTCATTTTGGAGCTAGTTACTGG GAGTAAGGGAGGGTGGGGTGGGGG |
| 4672 | db mining | Hs.318546 | NM_004390 | 475895 | cDNA:FLJ22499 fis, clone HRC11250, highly similar to HSCATHH mRNA for cathepsin H (EC 3.4.22.16) /cds = UNKNOWN | 1 | GGGACTGTCTTTTCTGTATTCGCTGT TCAATAAACATTGAGTGAGCACCT |
| 4673 | literature | Hs.318546 | NM_004390 | 4758095 | cDNA:FLJ22499 fis, clone HRC11250, highly similar to HSCATHH mRNA for cathepsin H (EC 3.4.22.16) /cds = UNKNOWN | 1 | GGGACTGTCTTTTCTGTATTCGCTGT TCAATAAACATTGAGTGAGCACCT |
| 4674 | Table 3A | Hs.124024 | NM_004416 | 4758201 | deltex (Drosophila) homolog 1 (DTX1), mRNA/cds = (503, 2365) | 1 | AGAGAAGACTCATCTTCACTATCGGC ACGTCCAACACCACGGGCGAGTCG |
| 4675 | Table 3A | Hs.74088 | NM_004430 | 4758251 | early growth response 3 (EGR3), mRNA/cds = (357, 1520) | 1 | AAACCGAAATATTGAAATGGTGTAAT GTTGTACCATTTGCACTGTGAGCA |
| 4676 | db mining | Hs.278611 | NM_004482 | 9945386 | UDP-N-acetyl-alpha-D-galactosamine:polypeptide N-acetylgalactosaminyltransferase 3 (GalNAc-T3) (GALNT3), mRNA /cds = (0, 1901) | 1 | AGGTGGGGGAAAATGAATTTTGTATG CTGAATTTCTAAGCGCCTATTGTT |
| 4677 | db mining | Hs.73734 | NM_004488 | 4758459 | glycoprotein V (platelet) (GP5), mRNA /cds = (270, 1952) | 1 | GTGGATGTGGAGCAGGAGAGCTGGA TCGTGGCATTTGTTTCTGGGTTCTG |
| 4678 | db mining | Hs.182447 | NM_004500 | 14110430 | heterogeneous nuclear ribonucleoprotein C (C1/C2) (HNRPC), transcript variant 1, mRNA /cds = (191, 1102) | 1 | AAAGTTGATACTGTGGGATTTTTGTG AACAGCCTGATGTTTGGGACCTTT |
| 4679 | db mining | Hs.111085 | NM_004505 | 4758563 | ubiquitin specific protease 6 (Tre-2 oncogene) (USP6), mRNA /cds = (1696, 4056) | 1 | TGTGGTTGCCTCTATGTGCTGTTTTT CCTCATACAAGTAAACACAGAAAG |
| 4680 | Table 3A | Hs.76038 | NM_004508 | 4758583 | isopentenyl-diphospate delta isomerase (IDI1), mRNA/cds = (50, 736) | 1 | CCCAACTGAGGACCACTGTCTACAGA GTCAGGAAATATTGTAGGGAGAAA |
| 4681 | db mining | Hs.296281 | NM_004514 | 4758599 | interleukin enhancer binding factor 1 (ILF1), mRNA/cds = (197, 2164) | 1 | TGTTTGTTTCTTTGTGTTGACTTTGTC CCTGGCAAAATTTTCCACTCTGA |
| 4682 | db mining | Hs.172674 | NM_004555 | 4758803 | nuclear factor of activated T-cells, cytoplasmic, calcineurin-dependent 3 (NFATC3), mRNA/cds = (210, 3416) | 1 | AGGTGACCTGGTTACTTAGCTAGGAT TGGTGATTTGTACTGCTTTATGGT |
| 4683 | Table 3A | Hs.78920 | NM_004581 | 4759015 | Rab geranylgeranyltransferase, alpha subunit (RABGGTA), mRNA /cds = (274, 1977) | 1 | CCCTACCCTTGCCCTTTAACTTATTG GGACTGAATAAAGAATGGAGAGGC |
| 4684 | db mining | Hs.90957 | NM_004620 | 4759253 | TNF receptor-associated factor 6 (TRAF6), mRNA/cds = (221, 1789) | 1 | GGGCTTTTGCTCTGGTGTATTTTATT GTCAGAAAGTCCAGACTCAAGAGT |
| 4685 | db mining | Hs.25333 | NM_0044833 | 4758597 | interleukin 1 receptor, type II (IL1R2), mRNA/cds = (61, 1257) | 1 | TGGTCTGACTGTGCTATGGCCTCATC ATCAAGACTTTCAATCCTATCCCA |
| 4686 | db mining | Hs.82222 | NM_004636 | 4759091 | serna domain, immunoglobulin domain (Ig), short basic domain, secreted, (sernaphorin) 3B (SEMA3B), mRNA /cds = (235, 2484) | 1 | GGGCGAGGCAGGCCGACTGTACTAA AGTAACGCAATAAACGCATTATCAG |
| 4687 | db mining | Hs.332229 | NM_004669 | 4758005 | zh68e05.s1 cDNA, 3' end /clone = IMAGE:417248/clone_end = 3' | 1 | GTACGCCGCTACCTGGACAGCGCGA TGCAGGAGAAAGAGTTCAAATACAC |
| 4688 | Table 3A | Hs.77324 | NM_004730 | 4759033 | eukaryotic translation termination factor 1 (ETF1), mRNA /cds = (135, 1446) | 1 | TGCAGAGAGATACTAAGCAGCAAAAT CTTGGTGTTGTGATGTACAGAAAT |
| 4689 | Table 3A | Hs.326159 | NM_004735 | 4758689 | leucine rich repeat (in FLII) interacting | 1 | GGATAACAAGTAATGTCTGAAAGCA |

TABLE 8-continued

| SEQ ID | Origin | Unigene | Locus | GI | Nominal Description | Strand | Probe Sequence |
|---|---|---|---|---|---|---|---|
| | | | | | protein 1 (LRRFIP1), mRNA /cds = (178, 2532) | | TGAGGGGCTTTATTTGCCTTTACC |
| 4690 | db mining | Hs.107526 | NM_004776 | 13929470 | UDP-Gal:betaGlcNAc beta 1,4-galactosyltransferase, polypeptide 5 (B4GALT5), mRNA/cds = (112, 1278) | 1 | TGAGCTTGCTCTTACGTTTTAAGAGG TGCCAGGGGTACATTTTTGCACTG |
| 4691 | Table 3A | Hs.49587 | NM_004811 | 4758669 | leupaxin (LPXN), mRNA /cds = (93, 1253) | 1 | ACTGGACAACTTTGAGTACTGACATC ATTGATAAATAAACTGGCTTGTGG |
| 4692 | db mining | Hs.24395 | NM_004887 | 4757869 | NJAC protein (NJAC) mRNA, complete cds/cds = (7, 306) | 1 | CGCAGGGTCTACGAAGAATAGGGTG AAAAACCTCAGAAGGGAAAACTCCA |
| 4693 | Table 3A | Hs.145696 | NM_004902 | 4757925 | splicing facfor (CC1.3) (CC1.3), mRNA /cds = (149, 1723) | 1 | AGGTTTTGTCTGGTTGCATATAATCTT TGCTCTTTTAAGCTCTGTGAGC |
| 4694 | db mining | Hs.129738 | NM_004977 | 4826787 | potassium voltage-gated channel, Shaw-related subfamily, member 3 (KCNC3), mRNA/cds = (295, 2568) | 1 | CCTTGCAGACCCCACCCCCTGCCTG CTCTCTTTCCCTACAACTAGGTCAG |
| 4695 | db mining | Hs.279946 | NM_004990 | 14043021 | methionine-tRNA synthease (MARS), mRNA/cds = (23, 2725) | 1 | GCCCCTAAAGGCAAGAAGAAAA AGTAAAAGACCTTGGCTCATAGAA AGTC |
| 4696 | db mining | Hs.927 | NM_004997 | 4826841 | myosin-binding protein H (MYBPH), mRNA/cds = (28, 1458) | 1 | GGAGTTGCACTCTGGGTGGGAAGCA CTCAATAAAGATGCGTGGTGTTAA |
| 4697 | Table 3A | Hs.180610 | NM_005066 | 4826997 | splicing factor proline/glutamine rich (polyprimidine tract-binding protein-associated) (SFPQ), mRNA /cds = (85, 2208) | 1 | AGCTTTTGAAAAGTGGAAAGGTCATT TTGTTGCATTTCCCCATTTCTTGT |
| 4698 | literature | Hs.100001 | NM_005074 | 4827009 | solute carrier family 17 (sodium phosphate), member 1 (SLC17A1), mRNA/cds = (12, 1415) | 1 | ACCTCCTTATTGAAGGGAAGAGGGAC CAGCACATGAGGCTGAGGCTGAGG |
| 4699 | db mining | Hs.81737 | NM_005155 | 6325470 | inactive palmitoyl-protein thioesterase-2i (PPT2) mRNA, complete cds /cds = (568, 1473) | 1 | GGTATCTCCCACACAGCCTGGCACTC CAACCGTACCCTTTATGAGACCTG |
| 4700 | db mining | Hs.179735 | NM_005167 | 4885066 | ras homolog gene family, member C (ARHC), mRNA/cds = (76, 657) | 1 | AAGGATGGTCACACACCAGCACTTTA TACACTTCTGGCTCACAGGAAAGT |
| 4701 | literature | Hs.113222 | NM_005201 | 13929430 | chemokine (C-C motif) receptor 8 (CCR8), mRNA/cds = (120, 1187) | 1 | ATCATCCTGCCAGCAGCACTCCTCCC GTTCCTCCAGCGTAGACTACATTT |
| 4702 | db mining | Hs.181128 | NM_005229 | 11496880 | DNA sequence from PAC 212G6 on chromosome Xp11.3–p11.4, Contains synapsin 1, brain protein 4.1, properdin, tyrosine kinase (ELK1) oncogene, ESTs, STS, GSS/cds = (9150, 10436) | 1 | AGTGCTACACTCGTCTCCACTGTTTG TTTTACTTCCCCAAAATGGACCTT |
| 4703 | Table 3A | Hs.248109 | NM_005238 | 4885218 | v-ets avian erythroblatosis virus E26 oncogene homolog 1 (ETS1), mRNA /cds = (278, 1603) | 1 | ACGCTACTATTACGACAAAAACATCA TCCACAAGACAGCGGGGAACGCT |
| 4704 | Table 3A | Hs.85146 | NM_005239 | 4865220 | chromosome 21 derived BAC containing erythroblastosis virus oncogene homolog 2 protein (ets-2) gene, complete cds/cds = (290, 1699) | 1 | TTTGAGAGGGTAGGAGGGTGGGAAG GAAACAACCATGTCATTTCAGAAGT |
| 4705 | db mining | Hs.129953 | NM_005243 | 4885224 | Ewing sarcoma breakpoint region 1 (EWSR1), transcript variant EWS, mRNA/cds = (43, 2013) | 1 | CATGCTCAGTATCATTGTGGAGAACC AAGAGGGCCTCTTAACTGTAACAA |
| 4706 | db mining | Hs.289098 | NM_005265 | 4885270 | kidney gamma-glutamyl transpeptidase type II mRNA, 3' end /cds = (0, 598) | 1 | GACCGGCTTCCCCTGTGAGCAGCAG AGCAGCAGAATAAATGAGGCCACTG |
| 4707 | Table 3A | Hs.181307 | NM_005324 | 4885384 | H3 histone, family 3A (H3F3A), mRNA /cds = (374, 784) | 1 | GAAGATACCCACCTGTGTGCCATCCA CGCTAAGAGAGTCACCATCATGCC |
| 4708 | Table 3A | Hs.79334 | NM_005384 | 4885516 | nuclear factor, interleukin 3 regulated (NFIL3), mRNA/cds = (213, 1601) | 1 | GTTATCACTCTGCCTGTGTATAGTCA GATAGTCCATGCGAAGGCTGTATA |
| 4709 | db mining | Hs.297939 | NM_005385 | 6631099 | cathepsin B (CTSB), mRNA /cds = (177, 1196) | 1 | ACTGACAGAGTGAACTACAGAAATAG CTTTTCTTCCTAAGGGGATTGTT |
| 4710 | db mining | Hs.78824 | NM_005424 | 4885630 | tyrosine kinase with immunoglobulin and epidermal growth factor homology domains (TIE), mRNA/cds = (38, 3452) | 1 | TAAGCCAGCACTCACACCACTAACAT GCCCTGTTCAGCTACTCCCACTCC |
| 4711 | Table 3A | Hs.181195 | NM_005494 | 4885494 | *Homo sapiens*, MRJ gene for a member of the DNAJ protein family, clone MGC:1152 IMAGE:3346070, mRNA, complete cds/cds = (163, 1143) | 1 | GGATGTTTTCTAGTTGTGCATGAATG CTGGCAACTTAGTAAGTTTTGACA |
| 4712 | db mining | Hs.153299 | NM_015510 | 5031670 | DOM-3 (*C. elegans*) homolog Z (DOM3Z), transcript variant 2, mRNA /cds = (129, 1319) | 1 | CCCAAATAGTAATGCTTTAGAGGGAG GCAGTCATATCTCTGTGTGCAGAT |
| 4713 | db mining | Hs.77961 | NM_005514 | 5031742 | major histocompatibility complex, class I, B (HLA-B), mRNA/cds = (0, 1088) | 1 | ATGTGTAGGAGGAAGAGTTCAGGTG GAAAAGGAGGGAGCTACTCTCAGGC |
| 4714 | literature | Hs.279853 | NM_005516 | 5031744 | HSPC018 protein (HSPC018), mRNA /cds = (148, 651) | 1 | CCCCTTCCTCACACTGACCTGTGTTC CTTCCCTGTTCTCTTTTCTATTAA |
| 4715 | db mining | Hs.60288 | NM_005527 | 5031788 | heat shock 70 kD protein-like 1 (HSPA1L), mRNA/cds = (0, 1925) | 1 | AAACTCTACCAAGGAGGATGCACTGG GCCTGCCTGCGGAACAGGGTATGT |
| 4716 | db mining | Hs.171776 | NM_005536 | 8393607 | inositol(myo)-1(or 4)-monophosphatase 1 (IMPA1), mRNA /cds = (98, 931) | 1 | CCCTTGGCACGTAAACAGACTACTAG ACTTATTGTAGGTTCGTTTGAGCT |

TABLE 8-continued

| SEQ ID | Origin | Unigene | Locus | GI | Nominal Description | Strand | Probe Sequence |
|---|---|---|---|---|---|---|---|
| 4717 | db mining | Hs.102171 | NM_005545 | 5031808 | immunoglobulin superfamily containing leucine-rich repeat (ISLR), mRNA /cds = (98,1384) | 1 | CAAAGGCCAGCCAGCTTGGGAGCAG CAGAGAAATAAACAGCATTTCTGAT |
| 4718 | literature | Hs.150101 | NM_005561 | 7669500 | lysosomal-associated membrane protein 1 (LAMP1), mRNA /cds = (190, 1440) | 1 | GTGAGATCGGTGCGTTCTCCTGATGT TTTGCCGTGGCTTGGGGATTGTAC |
| 4719 | db mining | Hs.154970 | NM_005653 | 5032174 | transcription factor CP2 (TFCP2), mRNA/cds = (508, 1860) | 1 | GAACTTTCAGGAAGAAGCATGTTTA TTCTGGACACAATGAAAGAAACCA |
| 4720 | Table 3A | Hs.82173 | NM_005655 | 5032176 | TGFB inducible early growth response (TIEG), mRNA cds = (123, 1565) | 1 | TTGGGTGTAGATTTCTGACATCAAAA CTTGGACCCTTGAAAACAAAAGT |
| 4721 | db mining | Hs.200600 | NM_005698 | 5032076 | secretory carrier membrane protein 3 (SCAMP3), mRNA/cds = (96, 1139) | 1 | CAACCCAGCTTCCCTCTGCTGTGCCA CGGCTGTTGCTTCGGTTATTTAAA |
| 4722 | db mining | Hs.157144 | NM_005819 | 5032130 | syntaxin 6 (STXB), mRNA/cds = (0, 767) | 1 | ATAGCCATCCTCTCTTTGCAGTCCTGTT GGTTGTGCTCATCCTCTTCCTAGT |
| 4723 | db mining | Hs.17704 | NM_005844 | 5031730 | PERB11 family member in MHC class I region (HCGIX), mRNA/cds = (37, 270) | | ACATGAGCTTCTACCTCCAGATGTGC CAGGGTGCATCTCAATAAACTTGG |
| 4724 | db mining | Hs.135194 | NM_005849 | 5031672 | immunoglobulin superfamily, member 6 (IGSF6), mRNA/cds = (44, 769) | 1 | ACTGAAAAGACAACTGGCTACA AAGAAGGATGTCAGAATGTAAGGA AACT |
| 4725 | db mining | Hs.4953 | NM_005895 | 5174440 | golgi autoantigen, golgin subfamily a, 3 (GOLGA3), mRNA/cds = (269, 4861) | 1 | AAGTTGTGGCTGTTCTTGGGAAAGGG GTCACCGTGTCTGACAAAGTGTAA |
| 4726 | db mining | Hs.211580 | NM_005931 | 5174564 | MHC class I polypeptide-related sequence B (MICB), mRNA /cds = (5, 1156) | 1 | CCCCTCGCCCCGTCACACCGTTATG CATTACTCTGTGTCTACTATTATGT |
| 4727 | Table 3A | Hs.68583 | NM_005932 | 5174566 | mitochondrial intermediate peptidase (MIPEP), nuclear gene encoding mitochondrial protein, mRNA /cds = (74, 2215) | 1 | GCTGTGAGAGCTTGTTTCTGATTGTT TCATTGTTCGCTTCTGTAATTCTG |
| 4728 | Table 3A | Hs.54452 | NM_006060 | 5174500 | zinc finger protein, subfamily 1A, 1 (Ikaros) (ZNFN1A1), mRNA /cds = (168, 1727) | 1 | ACCAACACTGTCCCAAGGTGAAATGA AGCAACAGAGAGGAAATTGTACAT |
| 4729 | db mining | Hs.292276 | NM_006068 | 5174720 | qd64a01.x1 cDNA, 3' end /clone = IMAGE:1734216/clone_end = 3' | 1 | TGCTCAGTTTTTCAGCTCCTCTCCAC TCTGCTTTCCCAAATGGATTCTGT |
| 4730 | db mining | Hs.131342 | NM_006072 | 5174670 | small inducible cytokine subfamily A (Cys—Cys), member 26 (SCYA26), mRNA/cds = (0, 284) | 1 | ATATTCACTACCAAAAGAGGCAAGAA AGTCTGTACCCATCCAAGGAAAAA |
| 4731 | db mining | Hs.2414 | NM_006080 | 5174672 | sema domain, immunoglobulin domain (Ig), short basic domain, secreted, (sernaphorin) 3A (SEMA3A), mRNA /cds = (15, 2330) | 1 | GCTGCATTACCTCTAGAAACCTCAAA CAAGTAGAAACTTGCCTAGACAAT |
| 4732 | db mining | Hs.2654 | NM_006081 | 5174562 | MHC binding factor, beta (MHCBFB), mRNA/cds = (90, 1286) | 1 | TCCAAGTCGAAATCGCTGCTGAGGCT GAGATGAAGAAAGAAAAGTCCAAA |
| 4733 | literature | Hs.125359 | NM_006288 | 5454117 | Homo sapiens, clone MGC:846 IMAGE:3507917, mRNA, complete cds /cds = (60, 545) | 1 | CATCTCCTCCCAGAACGTCACAGTGC TCAGAGACAAACTGGTCAAGTGTG |
| 4734 | db mining | Hs.23168 | NM_006313 | 14149626 | ubiquitin specific protease 15 (USP15), mRNA/cds = (9, 2867) | 1 | TTTGTCTGCACTTGAGTTCACTTGAG TTTACATTTGAAATGTGCATGTTT |
| 4735 | db mining | Hs.171921 | NM_006379 | 5454047 | sema domain, immunoglobulin domain (Ig), short basic domain, secreted, (sernaphorin) 3C (SEMA3C), mRNA /cds = (562, 2817) | 1 | AGTTCCCTTTATTTCACATAAGCCCAA ACTGATAGACAGTAACGGTGTTT |
| 4736 | db mining | Hs.240534 | NM_006411 | 5453717 | 1-acylglycerol-3-phosphate O-acyltransferase 1 (lysophosphatidic acid acyltrasferase, alpha) | 1 | GGAGAGGGTGGGACCCAGTTTTGCG TGGTTGGTTTTTATTAATTATCTGG |
| 4737 | db mining | Hs.181368 | NM_006445 | 5453983 | U5 snRNP-specific protein (220 kD), ortholog at S. cerevisiae Prp8p (PRP8), mRNA/cds = (41, 7048) | 1 | CCTCTTTCCCTCTGTCTGTGCCTGTG TTGTTGACCTCCTGATGGCTTGTC |
| 4738 | db mining | Hs.239506 | NM_006561 | 5729815 | mab-21 (C. elegans)-like 1 (MAB21L1), mRNA/cds = (818, 1897) | 1 | CTGATTCTTCTGTCCTCATTGTGAAC ATAACCGTGTAGTTGAAACAGTCA |
| 4739 | db mining | Hs.34526 | NM_006564 | 5730105 | G protein-coupled receptor (TYMSTR), mRNA/cds = (81, 1109) | 1 | TTTCCAATGTCTGCCACACAAACGTA TGTAAATGTATATACCCACACACA |
| 4740 | db mining | Hs.86998 | NM_006599 | 572944 | nuclear factor of activated T-cells 5, tonicity-resonsive (NFAT5), mRNA /cds = (318, 4913) | 1 | TCCTGAGAAACAACACATTTTTCCCC ATGAACGGTGCTGTTCTGAAGTCT |
| 4741 | db mining | Hs.167751 | NM_006604 | 5730012 | ret finger protein-like 3 (RFPL3), mRNA/cds = (292, 1158) | 1 | TATTGCCACCATCCAACTCATTGAGT CTTATGGTTCACATCTTGTTTCCT |
| 4742 | db mining | Hs.157427 | NM_006605 | 5730010 | ret finger protein-like 2 (RFPL2), mRNA/cds = (292, 1158) | 1 | AGTCCTATGGTTCACATCTTGTTTCCT ATAGAAATGTCCTGTATTCTGGG |
| 4743 | db mining | Hs.74861 | NM_006713 | 5729967 | activated RNA polymerase II transcription cofactor 4 (PC4), mRNA /cds = (0, 383) | 1 | AAACCAGGAAGAAAAGGTATTTCTTT AAATCCAGAACAATGGAGCCAGCT |
| 4744 | db mining | Hs.75063 | NM_006734 | 5803032 | DNA sequence from clone 67K17 on chromosome 6q24.1–24.3, Contains the HIVEP2 (Schnurri-2) gene for HIV | 1 | AAGCAGTTGGACTTTCACAGCAGCAA GGAATTATCTTCAAGCACAGAGGA |

TABLE 8-continued

| SEQ ID | Origin | Unigene | Locus | GI | Nominal Description | Strand | Probe Sequence |
|---|---|---|---|---|---|---|---|
| | | | | | type 1 Enhancer-binding Protein 2, and a possible pseudogene in an intron of this gene. Contains STSs and GSSs and an AAAT repeat polymorphism /cds = (545, 7885) | | |
| 4745 | db mining | Hs.56328 | NM_006737 | 5803051 | killer cell immunoglobuin-like receptor, three domains, long cytoplasmic tail, 2 (KIR3DL2), mRNA/cds = (2, 1369) | 1 | CTTCAGTGTAGCTCTCTCCTCTTCAA ATAAACATGTCTGCCCTCATGGTT |
| 4746 | db mining | Hs.82210 | NM_006766 | 5803097 | zinc finger protein 220 (ZNF220), mRNA/cds = (393, 6407) | 1 | TTCTCTCGTGCAACCAGTTTGCCCAT TCTCTTCCTATTACTTGCTCCAGG |
| 4747 | db mining | Hs.57692 | NM_006781 | 11321623 | chromosome 6 open reading frame 10 (C6orf10), mRNA/cds = (238, 1942) | 1 | TGCTCTTCAGAAGTTTCACCCTTTTA ATCTCTCAGCCACAAACCTCAGT |
| 4748 | db mining | Hs.84865 | NM_006790 | 5803105 | titin immunoglobulin domain protein (myotilin) (TTID), mRNA /cds = (280, 1776) | 1 | ACGTTTACTGGTACTGCTTTCTAAATA CTGTTTTACCCGTTTTCTCTTGT |
| 4749 | db mining | Hs.170027 | NM_006880 | 6031173 | mouse double minute 2, homolog of; p53-binding protein (MDM2), transcript variant MDM2, mRNA/cds = (311, 1786) | 1 | GACAACCAATTCAAATGATTGTGCTA ACTTATTTCCCCTAGTTGACCTGT |
| 4750 | literature | Hs.27954 | NM_006889 | 5901919 | CD86 antigen (CD28 antigen ligand 2, B7-2 antigen) (CD86), mRNA /cds = (147, 1118) | 1 | GGCCAAGCCCAGCTTAATGGCTCAT GACCTGGAAATAAAATTTAGGACCA |
| 4751 | Table 3A | Hs.173737 | NM_006908 | 9845510 | ras-related C3 botulinum toxin substrate 1 (rho family, small GTP binding protein Rac1) (RAC1), transcript variant RaC1b, mRNA /cds = (0, 635) | 1 | CTCAAGACAGTGTTTGACGAAGCGAT CCGAGCAGTCCTCTGCCCGCCTCC |
| 4752 | db mining | Hs.218354 | NM_006913 | 5902053 | ring finger protein 5 (RNF5), mRNA /cds = (0, 542) | 1 | CTTTTTCACCACCGTCTTCAATGCCC ATGAGCCTTTCCGCCGGGGTACAG |
| 4753 | db mining | Hs.153299 | NM_006929 | 13787218 | DOM-3 (C. elegans) homolog Z (DOM3Z), transcript variant 2, mRNA /cds = (129, 1319) | 1 | ACATCGTATTTGCGGCCAGCCTCTAC ACCCAGTGAATGCCCCATGTAAA |
| 4754 | literature | Hs.278721 | NM_006979 | 5901935 | HLA class II region expressed gene KE4 (HKE4), mRNA/cds = (326, 1615) | 1 | TATTCCTTTTATATCACTGTGTTTGAA TCGAGGGGGAGGGGTGGTAACCG |
| 4755 | Table 3A | Hs.97437 | NM_007018 | 5901923 | centrosomal protein 1 (CEP1), mRNA /cds = (472, 3456) | 1 | ATGGGAATAGTTGCATATGGGAATTT AAACCAACATGTGGCTGAGCCTTT |
| 4756 | db mining | Hs.41716 | NM_007036 | 13259505 | endothelial cell-specific molecule 1 (ESM1), mRNA/cds = (68, 622) | 1 | GGCCTTTGAATGTAAAGCTGCATAAG CTGTTAGGTTTTGTTTTAAAAGGA |
| 4757 | db mining | Hs.155150 | NM_007042 | 5902065 | ribonuclease P (14 kD) (RPP14), mRNA/cds = (169, 543) | 1 | CAGTTTGGCCTTATGCTTTATGCAGA CTTGAGTGTATGCAGGATTTCATT |
| 4758 | db mining | Hs.81743 | NM_007053 | 5901909 | natural killer cell receptor, immunoglobulin superfamily member (BY55), mRNA/cds = (215, 760) | 1 | CAGACCAAGAGCACCACAGACT ACAACTGCCCAGCTTCATCTAAAT ACTT |
| 4759 | db mining | Hs.43543 | NM_007056 | 5902129 | suppressor of white apricot homolog 2 (SWAP2), mRNA/cds = (143, 2122) | 1 | GTGGGTAAGGGGCTCAAGCTGTGAT GCTGCTGGTTTTATCTCTAGTGAAA |
| 4760 | db mining | Hs.247979 | NM_007128 | 9507238 | pre-B lymphocyte gene 1 (VPREB1), mRNA/cds = (0, 437) | 1 | ACCCTCCCAGGTTCCTGCTGAGATAT TTCTCACAATCAGACAAGAGCCAG |
| 4761 | literature | Hs.41682 | NM_007334 | 7669498 | killer cell lectin-like receptor subfamily D, member 1 (KLRD1), transcript variant 1, mRNA/cds = (260, 799) | 1 | GGGCAGAGAAGGTGGAGAGTAAAGA CCCAACATTACTAACAATGATACAG |
| 4762 | Tabe 3A | Hs.173334 | NM_012081 | 6912353 | ELL-RELATED RNA POLYMERASE II, ELONGATION FACTOR (ELL2), mRNA/cds = (0, 1922) | 1 | GGCTCACATCAAAAGGCTAATAGGTG AATTTGACCAACAGCAAGCAGAGT |
| 4763 | db mining | Hs.268555 | NM_012255 | 6912743 | 5'–3' exoribonuclease 2 (XRN2), mRNA/cds = (68, 2920) | 1 | AACACATTTGAGGAATAGGAGGTCCG GGTTTTCCATAATGGGTAAAATGG |
| 4764 | db mining | Hs.258612 | NM_012312 | 6912471 | killer cell immunoglobulin-like receptor, two domains, short cytoplasmic tail, 4 (KIR2DS4), mRNA/cds = (46, 960) | 1 | GCTGTTCCACCTCCCTTCAGACTATC TTTCAGCCTTCTGCCAGCAGTAA |
| 4765 | db mining | Hs.212414 | NM_012431 | 6912649 | serna domain, immunoglobulin domain (Ig), short basic domain, secreted, (sernaphorin) 3E (SEMA3E), mRNA /cds = (466, 2793) | 1 | ACTATAAGTCATTTTGAGTGTTGGTG TTAAGCATGAAACAAACAGCAGCT |
| 4766 | Table 3A | Hs.144519 | NM_012468 | 10947106 | T-cell leukemia/lymphoma 6 (TCL6), transcript variant TCL6a2, mRNA /cds = (1767, 2192) | 1 | GCTATTCACAGTTCTGGGGAACAACC AAAGGAGGAGGAGGACAAAGGGAA |
| 4767 | db mining | Hs.334729 | NM_013230 | 7019342 | cDNA FLJ20161 fis, clone COL09252, highly similar to L33930 CD24 signal transducer mRNA/cds = UNKNOWN | 1 | AAGCTACTGTGTGTGTGAATGAACAC TCTTGCTTTATTCCAGAATGCTGT |
| 4768 | db mining | Hs.278911 | NM_013278 | 7019434 | interleukin 17C (IL17C), mRNA /cds = (0, 593) | 1 | CTATCCACAGAAGCTGGCCTTCGCC GAGTGCCTGTGCAGAGGCTGTATCG |
| 4769 | db mining | Hs.71979 | NM_013371 | 7019574 | interleukin 19 (IL19), mRNA /cds = (47, 580) | 1 | GTCATATAGTCCATGTCTGTGATGTG AGCCAAGTGATATCCTGTAGTACA |
| 4770 | db mining | Hs.247362 | NM_013974 | 7524353 | dimethylarginine dimethylaminohydrolase 2 (DDAH2), mRNA/cds = (276, 1133) | 1 | TCCACTGGGTGAATCCTCCCTCTCAG AACCAATAAAATAGAATTGACCTT |
| 4771 | Table 3A | Hs.8360 | NM_014039 | 7662640 | PTDO12 protein (PTD012), mRNA | 1 | GAGTTTCTCTATCGCATTGGTCAACC |

TABLE 8-continued

| SEQ ID | Origin | Unigene | Locus | GI | Nominal Description | Strand | Probe Sequence |
|---|---|---|---|---|---|---|---|
| 4772 | Table 3A | Hs.6975 | NM_014086 | 7662589 | AF001542 cDNA /clone = alpha_est218/52C1 /cds = (473, 1087) | 1 | AAAAGAGACGCATTCCATTGGGCG TTCTCTGCATCTAGGCCATCATACTG CCAGGCTGGTTATGACTCAGAAGA |
| 4773 | db mining | Hs.278944 | NM_014148 | 7661751 | HSPC048 protein (HSPC048), mRNA /cds = (87, 419) | 1 | TGCGAAATTGTGGACTGTTGGACTGT GATTCTAAGTGGGGGAAATAGGCT |
| 4774 | db mining | Hs.278946 | NM_014152 | 7661759 | HSPC054 protein (HSPC054), mRNA /cds = (107, 397) | 1 | GAACCTTTCTGAAACCAGTGGCAGCC CAAGTTAGAGCCCAGCATTAAGTC |
| 4775 | db mining | Hs.278948 | NM_014163 | 7661781 | HSPC073 protein (HSPC073), mRNA /cds = (278, 649) | 1 | CCAGAATCTTCTATTCCCACTTCCCA TTTCTCAAATCATTTGACCTGTCG |
| 4776 | db mining | Hs.130101 | NM_014227 | 14140235 | solute carrier family 5 (neutral amino acid transporters, system A), member 4 (SLC5A4), mRNA/cds = (18, 1995) | 1 | CCTCCTGGCTGTGGTGGTCTTTATTC ACGGCTACTATGCCTGAACTCTAT |
| 4777 | db mining | Hs.205736 | NM_014260 | 7657161 | HLA class II region expressed gene KE2 (HKE2), mRNA/cds = (0, 389) | 1 | GAAATTAAGCGATACGAATCCCAGCT TCGGGATCTTGAGCGGCAGTCAGA |
| 4778 | db mining | Hs.241385 | NM_014271 | 7657231 | interleukin 1 receptor accessory protein-like 1 (IL1RAPL1), mRNA /cds = (510, 2600) | 1 | TCACAGTGACCACTACAGAGTACTAA GAAGAGAAGATCAAGGGCATGAAA |
| 4779 | Table 3A | Hs.211973 | NM_014285 | 7657527 | Homo sapiens, Similar to homolog of yeast RRP4 (ribosomal RNA processing 4), 3'–5'-exoribonuclease, clone MGC:2403 IMAGE:2821702, mRNA, complete cds/cds = (11, 892) | 1 | TCTTAAAGCCAGAAATAATGGAGGAG ATTGTGATGGAAACACGCCAGAGG |
| 4780 | db mining | Hs.129751 | NM_014339 | 7657229 | interleukin 17 receptor (IL17R), mRNA /cds = (32, 2632) | 1 | CTTTTCTTTGTGCAGCGGTCTGGTTA TCGTCTATCCCCAGGGGAATCCAC |
| 4781 | db mining | Hs.296429 | NM_014348 | 7657468 | similar to rat integral membrane glycoprotein, POM121 (POM121L1), mRNA/cds = (0, 1286) | 1 | CCACGTTGGGGTCACTACTGGAGTG GATGGAGGCCCTTCACATTTCTGGG |
| 4782 | db mining | Hs.21814 | NM_014432 | 7657690 | interleukin 20 receptor, alpha (IL20RA), mRNA/cds = (236, 1897) | 1 | TGACCTTTCGTGATTATCCGCAAATG CAAACAGTTTCAGATCTAATGGTT |
| 4783 | db mining | Hs.110040 | NM_014443 | 7657227 | interleukin 17B (IL17B), mRNA /cds = (41, 583) | 1 | CAGTCATGGAGACCATCGCTGTGGG CTGCACCTGCATCTTCTGAATCACC |
| 4784 | db mining | Hs.76698 | NM_014445 | 7657551 | mRNA; cDNA DKFZp434L, 1621 (from clone DKFZp434L1621); complete cds /cds = (315, 515) | 1 | AGGTTTCTTCATGAGTCATTCCAAGT TTTCTAGTCCATACCACAGTGCCT |
| 4785 | db mining | Hs.326248 | NM_014456 | 7657448 | cDNA:FLJ22071 fis, clone HEP11691 /cds = UNKNOWN | 1 | GAGGTCGTCTTAAACCAGAGAGCTAC TGAATATAAGAACTCTTGCAGTCT |
| 4786 | db mining | Hs.278441 | NM_014634 | 7661861 | KIAA0015 gene product KIAA0015), mRNA/cds = (106, 1470) | 1 | GCAGTCTCCCAAGGACCCACCATGC AGAAGTGTCAATAAACCACAAGTTC |
| 4787 | db mining | Hs.19056 | NM_014824 | 7662295 | KIAA0769 gene product (KIAA0769), mRNA/cds = (239, 2293) | 1 | GGAGGGAGCCTCTGTGCAGAATGTGC TTTCTTTACAGTGGCTGTAAAAAGT |
| 4788 | db mining | Hs.11711 | NM_014844 | 7662057 | mRNA for KIAA0297 gene, partial cds /cds = (0, 3815) | 1 | GATGCTTTTAAAGTTGTAGCTTCGTG CTTTGTACAGTTTTCTTTCTGGTT |
| 4789 | db mining | Hs.7724 | NM_014963 | 7662409 | KIAA0963 protein (KIAA0963), mRNA /cds = (215, 4315) | 1 | AATATATGCAATTCTCCCTCCCCCAG CCCTTCCCTGACCCCTAAGTTATT |
| 4790 | Table 3A | Hs.31989 | NM_015449 | 14149687 | DKFZP586G1722 protein (DKFZP586G1722), mRNA /cds = (210, 869) | 1 | AATCTGCCAGGCTATGTGACAGTAGG AAGGAATGGTTTCCCCTAACAAGC |
| 4791 | db mining | Hs.30488 | NM_015453 | 14149489 | DKFZP434F091 protein (DKFZP434F091), mRNA /cds = (334, 1857) | 1 | AGCACATACATTGATAGATGGGGTGT GGGACCAACAAACCAAATTAAAAG |
| 4792 | Table 3A | Hs.104640 | NM_015898 | 7705374 | HIV-1 inducer of short transcripts binding protein (FBI1), mRNA /cds = (0, 1754) | 1 | CAACGGCCAGGAGAAGCACTTTAAG GACGAGGACGAGGACGAGGACGTGG |
| 4793 | db mining | Hs.278428 | NM_015902 | 13435357 | progestin induced protein (DD5), mRNA/cds = (33, 8432) | 1 | TTGTGGAAACTGTTTCAGCAAAGGTT CTTGTATAGAGGGAATAGGGAATT |
| 4794 | db mining | Hs.279583 | NM_016025 | 7705788 | Homo sapiens, Similar to CGI-81 protein, clone MGC:705 IMAGE:3350598, mRNA, complete cds /cds = (248, 1099) | 1 | GGGGGAAGGAAGGCTTCAGACTTGG GGGAAGGGGAGATTATTGCAAATTG |
| 4795 | db mining | Hs.179817 | NM_016026 | 7705790 | CGI-82 protein (LOC51109), mRNA /cds = (40, 996) | 1 | CTATGGAGGAATTGAGGGCAAGCAC CCAGGACTGATGAGGTCTTAACAA |
| 4796 | db mining | Hs.236494 | NM_016131 | 7705848 | RAB10, member RAS oncogene family (RAB10), mRNA/cds = (90, 692) | 1 | ACACCAAACAGTTAAGTCCATTCTCT GGTACTAGCTACAAATTCGGTTTC |
| 4797 | db mining | Hs.115515 | NM_016184 | 7705337 | C-type (calcium dependent, carbohydrate-recognition domain) lectin, superfamily member 6 (CLECSF6), mRNA/cds = (241, 954) | 1 | TGCACACAGGGAGAGAACATGAGTC TCTCTTSSTTTTTSTCTGGTTGCTA |
| 4798 | Table 3A | Hs.7905 | NM_016224 | 7706705 | SH3 and PX domain-containing protein SH3PX1 (SH3PX1), mRNA /cds = (43, 1830) | 1 | TTCAATGGAAAATGAGGGGTTTCTCC CCACTGATATTTTACATAGAGTCA |
| 4799 | db mining | Hs.66 | NM_016232 | 11136631 | interleukin 1 receptor-like 1 (IL1RL1), mRNA/cds = (0, 1670) | 1 | GACCACATTGCCAATAAAAGzTCCCT GAATTCCAAATTCTGGAAGCACGT |
| 4800 | db mining | Hs.180403 | NM_016271 | 7706722 | STRIN protein (STRIN), mRNA /cds = (221, 958) | 1 | AGGCCCAAATCACAGAATAAGGACT AAGAGTGGATTTGCTGACATTCCA |
| 4801 | Table 3A | Hs.3059 | NM_016451 | 7705388 | coatomer protein complex, subunit beta (COPB), mRNA/cds = (178, 3039) | 1 | GCTGTCCTCAAAGTATATAATGTTTCA TGTACCAAGACCCTTTTCACAGT |

TABLE 8-continued

| SEQ ID | Origin | Unigene | Locus | GI | Nominal Description | Strand | Probe Sequence |
|---|---|---|---|---|---|---|---|
| 4802 | Table 3A | Hs.321245 | NM_016530 | 7706562 | cDNA FLJ10249 fis, clone HEMBB1000725, highly similar to Rattus norvegicus GTPase Rab8b mRNA/cds = UNKNOWN | 1 | AAGGGTATTTGGTCTGGTTCATATGG TCAAATATTACTGCCTTGGTAGCA |
| 4803 | db mining | Hs.115897 | NM_016580 | 14589925 | protocadherin 12 (PCDH12), mRNA /cds = (1211, 4765) | 1 | GGGGTGCCAGGAAATGCTCTCTGAC CTATCAATAAAGGAAAAGCAGTGAT |
| 4804 | db mining | Hs.98309 | NM_018584 | 7706701 | SGRF protein, interleukin 23 p19 subunit (SGRF), mRNA/cds = (143, 712) | 1 | TGGGAAGGGAAATTTGGGGATTATTT ATCCTCCTGGGGACAGTTTGGGGA |
| 4805 | Table 3A | Hs.273385 | NM_016592 | 7706588 | guanine nucleotide binding protein (G protein), alpha stimulating activity polypeptide 1 (GNAS1), mRNA /cds = (68, 1252) | 1 | GCCACAAAAGTTCCCTCTCACTTTCA GTAAAAATAAATAAAACAGCAGCA |
| 4806 | db mining | Hs.241567 | NM_016838 | 1111111 | RNA binding motif, single stranded interacting protein 1 (RBMS1), transcript variant MSSP-2, mRNA /cds = (265, 1434) | 1 | ATAAGGTGCATAAAACCCTTAAATTC ATCTAGTAGCTGTTCCCCCGAACA |
| 4807 | db mining | Hs.272354 | NM_01741611 | 225606 | interleukin 1 receptor accessory protein-like 2 (IL1RAPL2), mRNA /cds = (758, 2816) | 1 | GATACCCAGGAATTTCACAGGAACAG TTCTTTGCTGCCTTTATCCTCCAA |
| 4808 | db mining | Hs.105956 | NM_017436 | 8392829 | globotriaosylceramide/CD77 synthase; Gb3/CD77 synthase; alpha1,4-galactosyltransferase; 4-N-acetylglucosaminyltransferase (A14GALT), mRNA/cds = (133, 1194) | 1 | CCCACCCTGCCGCCCGCATTATAAAC ACAGGAGAATAATCAATAGAATAA |
| 4809 | db mining | Hs.283690 | NM_017548 | 6923709 | clone H41 unknown mRNA /cds = (323, 1099) | 1 | AAACCAGGCCCTTAAACTTCAGCTAG ACAACCAATATGCTGTGCTTGAAA |
| 4810 | db mining | Hs.14512 | NM_017583 | 8923748 | DIPB protein (HSA249128), mRNA /cds = (177, 1211) | 1 | CCAGATCCACAGCAGGCACATATCTC TCCAAGGGATGACCAGTTTTATGC |
| 4811 | Table 3A | Hs.288036 | NM_017646 | 8923064 | tRNA isopentenylpyrophosphate transferase (IPT), mRNA /cds = (60, 1040) | 1 | GGACTTGAAGACCAAAGACTTTGAAA TTTGCGAGCTGCTCATGTGTGAGT |
| 4812 | Table 3A | Hs.106650 | NM_017866 | 8923499 | Homo sapiens, Similar to hypothetical protein FLJ20533, clone MGC:3448 IMAGE:3831570, mRNA, complete cds /cds = (380, 865) | 1 | GAAACGGCATAAAGATGAGAAATGAG CCTATTTGTTAGTGTTCGTGCCTA |
| 4813 | Table 3A | Hs.272134 | NM_018067 | 8922367 | AL544307 cDNA /clone = CS0DI019YG13-(5-prime) | 1 | CCTGCCCTCGCCTGGAATCAGTGTTA CTGCATCTGATTAAATGTCTCCAG |
| 4814 | Table 3A | Hs 7187 | NM_018187 | 8922608 | mRNA for KIAA1757 protein, partial cds/cds = (347, 4576) | 1 | AATGAGTTGTGTTGAAGCCTCCGTCT CCCATCCTTGCCTGTAGCCCGTAG |
| 4815 | db mining | Hs.85752 | NM_018461 | 8923923 | mRNA for KIAA1541 protein, partial cds/cds = (908, 2341) | 1 | CAGAGTTGACGGACACTGCTCCCAAA AGGTCATTACTCAGAATAATGTA |
| 4816 | db mining | Hs.272373 | NM_018724 | 11036633 | interleukin 20 (L20), mRNA /cds = (0, 530) | 1 | GAACCTCAGGCAGCAGTTGTGAAGG CTTTGGGGGAACTAGACATTCTTCT |
| 4817 | db mining | Hs.110309 | NM_018950 | 9665231 | major histocompatibility complex, class I, F (HLA-F), mRNA/cds = (0, 1088) | 1 | GGACTGAGAAGCAAGATATCAATGTA GCAGAATTGCACTTGTGCCTCACG |
| 4818 | Table 3A | Hs.225674 | NM_018963 | 11321643 | mRNA for WDR9 protein (WDR9 gene), form B/cds = (79, 6888) | 1 | CAATGGTTGCACCTTATGACCTTGAG GGAAAGCCAGTTCATTTAAGAGGA |
| 4819 | db mining | Hs.278430 | NM_019105 | 14719824 | cytochrome P450, subfamily XXIA (steroid 21-hydroxylase, congenital adrenal hyperplasia), polypeptide 2 (CYP212), mRNA/cds = (118, 1805) | 1 | GGGGGAGGGGAGGGGTTCGTACAG GAGCAATAAAGGAGAAACTGAGGTAC |
| 4820 | db mining | Hs.278430 | NM_019105 | 14719824 | cytochrome P450, subfamily XXIA (steroid 21-hydroxylase, congenital adrenal hyperplasia), polypeptide 2 (CYP21A2), mRNA/cds = (118, 1605) | 1 | GGGGGAGGGGAGGGGTTCGTACAG GAGCAATAAAGGAGAAACTGAGGTAC |
| 4821 | db mining | Hs.159679 | NM_019598 | 9665235 | kallikrein 12 (KLK12), mRNA /cds = UNKNOWN | 1 | ACTTCTTGGAACTTTAACTCCTGCCA GCCCTTCTAAGACCCACGAGCGGGG |
| 4822 | db mining | Hs.247808 | NM_019602 | 9824966 | butyrophilin-like 2 (MHC class II associated) (BTNL2), mRNA /cds = (0, 1387) | 1 | TGTTCCATCAGCATCCCCTTTTTGGG CGAGGAGAAAATCGCAACTTTTTC |
| 4823 | db mining | Hs.36989 | NM_019616 | 10518502 | coagulation factor VII (serum prothrombin conversion accelerator) (F7), transcript variant 1, mRNA /cds = (51, 1451) | 1 | CAGACTATTCCCCACCTGCTTCCCAG CTTCACAATAAACGGCTGCGTCTC |
| 4824 | db mining | Hs.36989 | NM_019616 | 10518502 | coagulation factor VII (serum prothrombin conversion accelerator) (F7), transcript variant 1, mRNA /cds = (51, 1451) | 1 | CAGACTATTCCCCACCTGCTTCCCAG CTTCACAATAAACGGCTGCGTCTC |
| 4825 | db mining | Hs.289095 | NM_020056 | 11095446 | major histocompatibility complex, class II, DQ alpha 2 (HLA-DQA2), mRNA /cds = (0, 767) | 1 | GTCTGTGGGCCTCATGGGCATTGTG GTGGGCACTGTCTTCATCATCCAAG |
| 4826 | db mining | Hs.296552 | NM_020070 | 13399297 | DNA sequence from clone CTA-246H3 on chromosome 22 Contains the gene for IGLL1 (immunoglobulin lambda-like polypeptide 1, pre-B-cell specific), a pseudogene similar to LRP5 | 1 | CTCCAAACAGAGCAACAACAAG TACGCGGCCAGCAGCTACCTGAGC CTGA |

TABLE 8-continued

| SEQ ID | Origin | Unigene | Locus | GI | Nominal Description | Strand | Probe Sequence |
|---|---|---|---|---|---|---|---|
| | | | | | (Lipoprotein Receptor Related Protein), ESTs, Genomic markers (D22S414, D22S925, D22S926), CA repeats, STSs, GSSs and a CpG Island /cds = (0, 438) | | |
| 4827 | Table 3A | Hs.94395 | NM_020324 | 10947128 | ATP-binding cassette, sub-family D (ALD), member 4 (ABCD4), transcript variant 5, mRNA/cds = (51, 1544) | 1 | CCAAAGTCCTCACTCAGACCAGTGCC CCTCCAGTTCAGTTGTCTATGTAT |
| 4828 | db mining | Hs.105509 | NM_020428 | 9966908 | cDNA FLJ14613 fis, clone NT2RP1001113, highly similar to CTL2 gene/cds = UNKNOWN | 1 | TGTCTTCCACCCTCAAGAAACTCTTG AACAAGACCAACAAGAAGGCAGCG |
| 4829 | literature | Hs.248158 | NM_020530 | 10092620 | oncostatin M (OSM), mRNA /cds = (0, 758) | 1 | GCAGGACCAGACCCTCCAGGAAAGG CAAGAGACTCATGACCAGGGGACAG |
| 4830 | db mining | Hs.105052 | NM_020979 | 10280625 | adaptor protein with pleckstrin homology and src homolog 2 domains (APS), mRNA/cds = (127, 2025) | 1 | GGTGGGACACGCCAAGCTCTTCAGT GAAGACACGATGTTATTAAAAGCCT |
| 4831 | literature | Hs.1510 | NM_021068 | 10835102 | interferon, alpha 4 (IFNA4), mRNA /cds = (140, 709) | 1 | AGCTTGGTGTATACCTTGCAGGCACT AGTCCTTTACAGATGACAATGCTG |
| 4832 | db mining | Hs.76293 | NM_021103 | 1063894 | thymosin, beta 10 (TMSB10), mRNA /cds = (65, 199) | 1 | AGGAAGAGCCACCTGCAAGATGGAC ACGAGCCACAAGCTGCACTGTGAAC |
| 4833 | db mining | Hs.3254 | NM_021134 | 10863930 | mitochondrial ribosomal protein L23 (MRPL23), mRNA/cds = (54, 515) | 1 | GGGTGCAGCATGGCTCTAACAAGAG AAGAGATCACAGAAACGTGAGGATC |
| 4834 | Table 3A | Hs.7137 | NM_121188 | 10863994 | clones 23667 and 23775 zinc finger protein (LOC57862), mRNA /cds = (182, 1618) | 1 | TACATTCTCCCTTTAGCAACCTGAGT AAGAGACTCTCTGCCACTGGGCTG |
| 4835 | db mining | Hs.11090 | NM_021201 | 11139298 | high affinity immunoglobulin epsilon receptor beta subunit (CFFM4), mRNA /cds = (148, 868) | 1 | AACTCTTGGCCTCAGAGGAAGGAAAA GCAACTCAACACTCATGGTCAAGT |
| 4836 | db mining | Hs.241587 | NM_021246 | 10864054 | megakaryocyte-enhanced gene transcript 1 protein (MEGT1), mRNA /cds = (3, 1151) | 1 | AGGGAACAAGGGAGCAAGGGAACAA GGGACATCTGAACATCTAATGTGAG |
| 4837 | db mining | Hs.110915 | NM_021258 | 10864066 | interleukin 22 receptor (IL22R), mRNA /cds = (23, 1747) | 1 | GTGGCCCCTGGACGGGTACAATAAC ACACTGTACTGATGTCACAACTTTG |
| 4838 | db mining | Hs.210546 | NM_021798 | 11141868 | interleukin 21 receptor (IL21R), mRNA /cds = (68, 1684) | 1 | CCCCTACCCTGCCCCAATTCAATCCT GCCAATAAATCCTGTCTTATTTGT |
| 4839 | Table 3A | Hs.302014 | NM_021803 | 11141874 | interleukin 21 (IL21), mRNA /cds = (46, 534) | 1 | ACACGGAAGTGAAGATTCCTGAGGAT CTAACTTGCAGTTGGACACTATGT |
| 4840 | db mining | Hs.82887 | NM_021959 | 11388174 | protein phosphatase 1, regulatory (inhibitor) subunit 11 (PPP1R11), mRNA/cds = (199, 579) | 1 | CGGTCCTTTTGCCATACACAGTTACA GAGATCAGTCAAATCCATACCACC |
| 4841 | db mining | Hs.79372 | NM_021970 | 11415051 | retinoid X receptor, beta (RXRB), mRNA/cds = (179, 1780) | 1 | ATACCTGTGAGGACTGGTTGTCTCTC TTCGGTGCCCTTGAGTCTCTGAAT |
| 4842 | db mining | Hs.293934 | NM_021983 | 11875206 | major histocompatibility complex, class II, DR beta 4 (HLA-DRB4), mRNA /cds = (58, 948) | 1 | TCATCTACTTCAGGAATCAGAAAGGA CACTCTGGACTTCAGCCAACAGGT |
| 4843 | Table 3A | Hs.96560 | NM_022086 | 11545798 | Homo sapiens, Similar to hypothetical protein FLJ11656, clone MGC:5247, mRNA, complete cds/cds = (149, 271) | 1 | TGCTTCTTGAAATGGATTTAACAACA GCCAGGAGCTTCCTGTCAGTAACC |
| 4844 | db mining | Hs.288316 | NM_022107 | 11545816 | chromosome 6 open reading frame 9 (C6orf9), mRNA/cds = (373, 855) | 1 | CCCTCCCCACTGCTGCTGAGTCTGTC TGATGTTTTGGTTGTGTGAATAAA |
| 4845 | db mining | Hs.99134 | NM_022110 | 11545622 | DIR1 protein (NG7), mRNA /cds = (268, 879) | 1 | AGGAGGAACTGGGGAAGGTGGTCAT TCAGGGGAAGAACCAGGATGCAGGG |
| 4846 | Table 3A | Hs.24633 | NM_022136 | 11545870 | SAM domain, SH3 domain and nuclear localisation signals, 1 (SAMSN1), mRNA/cds = (82, 1203) | 1 | TGGGAAAGTGTGAGTTAATATTGGAC ACATTTATCCTGATCCACAGTGG |
| 4847 | literature | Hs.247885 | NM_022304 | 1111111 | histamine receptor H2 (HRH2), mRNA /cds = (525, 1604) | 1 | TTAAAAGGAGCACATTAAAATTCTCA GAGGACTTGGCAAGGGCCGCACAG |
| 4848 | db mining | Hs.271815 | NM_022352 | 11641262 | caspase recruitment domain protein 9 (LOC84170), mRNA/cds = (146, 1246) | 1 | GCACACGCCATCTGTGTAACTTCAGG ATCTGTTCTGTTTCACCATGTAAC |
| 4849 | db mining | Hs.294030 | NM_022447 | 13937360 | topoisomerase-related function protein 4-2 (TRF4-2), mRNA/cds = (338, 869) | 1 | TTTTTCCCAGCTCGCCACAGAATGGA TCATGAAGACTGACAACTGCAAAA |
| 4850 | Table 3A | Hs.15220 | NM_022473 | 11968022 | zinc finger protein 106 (ZFP106), mRNA/cds = (335, 5966) | 1 | AAGAGAAATATATGCCCTAGAGCTGC TCCAGCACCCTTGGTTTCTGATTT |
| 4851 | db mining | Hs.28921 | NM_022482 | 11968149 | DNA sequence from clone RP3-322G13 on chromosome 20p11.21-12.3 Contains the gene for NTF2-related export protein (NXT1), a gene for a novel zinc finger protein with three isoforms, two isoforms for the 3' part of a novel gene, a gene for a novel protein similar to mouse and bovine beta-soluble NSF attachment protein (SNAP-beta), a novel gene similar to cystalin, another novel gene similar to cystalin 8 (CST8) with two isoforms, ESTs, STSs, GSSs and CPG islands | 1 | ACAGACAGACTCGATGCCCACACAG CTTCACTCTTTGAGCAACATGGAAT |

TABLE 8-continued

| SEQ ID | Origin | Unigene | Locus | GI | Nominal Description | Strand | Probe Sequence |
|---|---|---|---|---|---|---|---|
| 4852 | Table 3A | Hs.161786 | NM_022570 | 13384603 | C-type (calcium dependent, carbohydrate-recognition domain) lectin, superfamily member 12 (CLECSF12), mRNA/cds = (71, 676) /cds = (0, 2135) | 1 | GCACGGTGTGTTGCCACGATTTGACC CTCAACTTCTAGCAGTATATCAGT |
| 4853 | db mining | Hs.302036 | NM_022789 | 12232484 | interleukin 17E (IL17E), mRNA /cds = (258, 791) | 1 | AGTGTAGTTACTAGTCTTTTGACATG GATGATTCTGAGGAGGAAGCTGTT |
| 4854 | Table 3A | Hs.302981 | NM_024033 | 13162284 | hypothetical protein FLJ11000 (FLJ11000), mRNA/cds = (223, 780) | 1 | TCACTGCCATACAGGTTTTCCAATAC ACAAGTGCTAGAAAATACACACAA |
| 4855 | db mining | Hs.267194 | NM_024039 | 13128993 | hypothetical protein MGC2488 (MGC2488), mRNA/cds = (553, 1170) | 1 | TTGCTTGCCCTCCATGTCTTCCTAAA GAGCAGAACTTGGAGTTTCTCCTT |
| 4856 | Table 3A | Hs.250723 | NM_024104 | 13129111 | hypothetical protein MGC2747 (MGC2747), mRNA/cds = (92, 247) | 1 | AGAATGAGCCTGAATGTTGGTGGTTT TTGAAAATCCTGACTTGGAGGTAA |
| 4857 | db mining | Hs.71746 | NM_024663 | 13375916 | hypothetical protein FLJ11583 (FLJ11583), mRNA/cds = (371, 1606) | 1 | CCTCGGCCCTGACAAACGGGGATCT TTTACCTCACTTTGCACTGATTAAT |
| 4858 | db mining | Hs.94810 | NM_024681 | 13489098 | hypothetical protein FLJ12242 (FLJ12242), mRNA/cds = (185, 1057) | 1 | TGGCTTGGCCTTCTCTTTGGTGATCC CACCCCCAGCCATTTGCATTGCTG |
| 4859 | Table 3A | Hs.180799 | NM_024835 | 13376244 | C3HC4-type zinc-finger protein (LZK1), mRNA/cds = (47, 2140) | 1 | AATGTTTCTCTTCCTGTGAGACTTACT AAAGCAACTTAGTGGCAAAAAGT |
| 4860 | db mining | Hs.183171 | NM_024838 | 13376250 | hypothetical protein FLJ22002 (FLJ22002), mRNA/cds = (115, 783) | 1 | AGTACTTGAGTAGTCTCAATAGGAGT GTATTTGTAGACAGCAGTTTCCCT |
| 4861 | db mining | Hs.212839 | NM_024879 | 13376250 | mRNA for KIAA1714 protein, partial cds/cds = (0, 3175) | 1 | ACCCTAGATGAGCTGTCCTGCTCCAG TAACATTCTTTTTCTAAAATCATT |
| 4862 | db mining | Hs.125034 | NM_025085 | 13376839 | mRNA for putative N-acetyltransferase /cds = (208, 2808) | 1 | AACTAGAAGATGTACTTCGACAGCAT CCATTTTACTTCAAGGCAGCAAGA |
| 4863 | db mining | Hs.3365937 | NM_025222 | 13489105 | mRNA; cDNA DKFZp434C0814 (from clone DKFZp434C0814) /cds = UNKNOWN | 1 | ATTTGAGTTCCTGTGTGTCCAAAACT GAGGCACCATGTTCTTTGAAAACA |
| 4864 | Table 3A | Hs.336937 | NM_025222 | 13489105 | mRNA; cDNA DKFZp434C0814 (from clone DKFZp434C0814) /cds = UNKNOWN | 1 | ATTTGAGTTCCTGTGTGTCCAAAACT GAGGCACCATGTTCTTTGAAAACA |
| 4865 | Table 3A | Hs.338937 | NM_025222 | 13489105 | mRNA; cDNA DKFZp434C0814 (from clone DKFZp434C08104) /cds = UNKNOWN | 1 | ATTTGAGTTCCTGTGTGTCCAAAACT GAGGCACCATGTTCTTTGAAAACA |
| 4866 | db mining | Hs.247879 | NM_025280 | 13376871 | G6B protein (G6B), mRNA /cds = (0, 725) | 1 | GTCCACAGCGGACCCTGCTGATGCC TCCACCATCTATGCAGTTGTAGTTT |
| 4867 | db mining | Hs.241586 | NM_025261 | 13376873 | G6C protein (G6C), mRNA /cds = (54, 431) | 1 | CAGGCTCCCATATGTACCCCATCCCC CATACTCACCTCTTTCCATTTTGA |
| 4868 | db mining | Hs.118354 | NM_025263 | 13376877 | CAT56 protein (CAT56), mRNA /cds = (284, 1025) | 1 | GTTGTATTGGCAAGAGGGAGGGGTG AGAGCTGTTGGAGAACTGAGAATGA |
| 4869 | db mining | Hs.301920 | NM_030651 | 13449284 | chromosome 6 open reading frame 31 (C6orf31), mRNA/cds = (0, 602) | 1 | GTACCATCCTCACCGTAGTCATCATC ATCGCCGCGCAGCACCACGAGAAC |
| 4870 | Table 3A | Hs.196270 | NM_030780 | 13540550 | folate transporter/carrier (LOC81034), mRNA/cds = (128, 1075) | 1 | ATTTATCGTAAACATCCACGAGTGCT GTTGCACTACCATCTATTTGTTGT |
| 4871 | db mining | Hs.107149 | NM_030934 | 13569898 | novel protein similar to archaeal, yeast and worm N2,N2-dimethylguanosine tRNA methyltransferase (C1ORF25), mRNA/cds = (194, 2395) | 1 | ATCGCTGAAATATGTTGATCAGTGATG AGTTGGGCTTAATGCAAAGATCCT |
| 4872 | literature | Hs.225946 | NM_031200 | 14043041 | chemokine (C—C motif) receptor 9 (CCR9), transcript variant A, mRNA /cds = (157, 1268) | 1 | AGGCTATTTACTTCCATGCTTCTCCTT TTCTTACTCTATAGTGGCAACAT |
| 4873 | db mining | Hs.25063 | NM_031268 | 13775167 | PRO0461 protein (PRO0461), mRNA /cds = (779, 970) | 1 | GGGACCCCCACCCAGTGAGTCAACA TAGGCTCATGTCAAGTTTGAAAATA |
| 4874 | Table 3A | Hs.301183 | NM_031419 | 13899228 | molecule possessing ankyrin repeats induced by lipopolysaccharide (MAIL), homolog of mouse (MAIL), mRNA /cds = (48, 2204) | 1 | TGGTGTGATATGAACCAGTCCATTCA CATTGGAAAAACTGATGGTTTTAA |
| 4875 | db mining | Hs.283801 | NM_032009 | 14196461 | protocadherin gamma subfamily A, 2 (PCDHGA2), transcript variant 1, mRNA/cds = (185, 2983) | 1 | TTTTTATCAGCGCCTCAATCTCTACTC GAAGAAGAAAGAGAAGAAACGTT |
| 4876 | Table 3A | Hs.301104 | NM_032236 | 14149943 | 602313002F1 cDNA, 5' end /clone = IMAGE:4422480/clone_end = 5' | 1 | CGCTGTCGCCTTAATCCAAGCCTACG TTTTCACACTTCTAGTAAGCCTCT |
| 4877 | Table 3A | Hs.193669 | NM_032270 | 14150008 | hypothetical protein DKFZp586J1119 (DKFZp586J1119), mRNA /cds = (27, 2153) | 1 | CTGTCGGGCTCTGAAGCGAGCTGGT TTAGTTGTAGAAGATGCTCTGTTTG |
| 4878 | db mining | Hs.323682 | NM_032334 | 14150117 | hypothetical protein MGC14595 (MGC14595), mRNA/cds = (101, 850) | 1 | AGAAGCAGAATGCAGAAGGAGAATG AATCCTTTGGATACTTTCAAGGACA |
| 4879 | db mining | Hs.106823 | NM_032335 | 14150119 | mRNA for KIAA1823 protein, partial cds/cds = (52, 1185) | 1 | TCTGGCACAGTCCAGCTCACAACAAC ATCAAGAGCAGAATTTGGAGACTT |
| 4880 | db mining | Hs.334639 | NM_032389 | 14150222 | SH3 domain-containing protein 6511 (LOC51165), mRNA/cds = (215, 1489) | 1 | GGGACTTGACTTTCTTTCTGGACTGT TTGTATTGAAACAAGTGGTGTCA |
| 4881 | db mining | Hs.248367 | NM_032445 | 14192940 | MEGF11 protein (MEGF11), mRNA /cds = (159, 3068) | 1 | AGCCTAAACATGTATACTGTGCATTTT ATGGGTGACTTTGAAAGATCTGT |
| 4882 | db mining | Hs.69233 | NM_032494 | 14210505 | zinc finger protein (LOC64524), mRNA /cds = (92, 967) | 1 | AGACTGGTGATTTGGAGTAGTTTACA AGATTCCTCATTCAGAGTGCCCTC |

TABLE 8-continued

| SEQ ID | Origin | Unigene | Locus | GI | Nominal Description | Strand | Probe Sequence |
|---|---|---|---|---|---|---|---|
| 4883 | db mining | Hs.28514 | NM_032597 | 14211930 | testes development-related NYD-SP21 (NYD-SP21), mRNA/cds = (76, 2115) | 1 | TTGCCTCCTCCAATCTGTGTTCTCAA CTGTGGTTGCCACCTCATTAACTT |
| 4884 | Table 3A | Hs.10056 | NM_032811 | 14249499 | hypothetical potein FLJ14621 (FLJ14621), mRNA/cds = (525, 1307) | 1 | TGGAACATACCACATGTAGAAAGGTT GAACTGGTTTTTCAGCTATAATGC |
| 4885 | Table 3A | Hs.334788 | NM_032815 | 14249507 | hypothetical protein FLJ14639 (FLJ14639), mRNA/cds = (273, 689) | 1 | TCACTTAGCCTTTCTGGTTTCCCTTC CTGTGCATTGCCCATTTTCTCATG |
| 4886 | Table 3A | Hs.11360 | NM_032839 | 14249551 | hypothetical protein FLJ14784 (FLJ14784), mRNA/cds = (133, 1569) | 1 | AGCCAAGAGGTATATCGATGATGGAA ATTAGCCACATGTACACTACATTT |
| 4887 | db mining | Hs.29206 | NM_032895 | 14249657 | hypothetical protein MGC14376 (MGC14376), mRNA/cds = (184, 255) | 1 | CTTCACCGCCCTACTTCCACCTCCGC CCAGCCTGTAATGTTTATATAAGC |
| 4888 | Table 3A | Hs.154172 | R64548 | 836427 | 602575012F1 cDNA, 5' end /clone = IMAGE:4703258/clone_end = 5' | 1 | CTTTCAGAGCCAGTTTGTCCAAGGCC AGCATCCCGTCTGGGAGATGCACC |
| 4889 | db mining | Hs.159388 | S74639 | 807023 | AL560682 cDNA /clone = CS0DL004YM19-(5-prime) | 1 | GCCGTATATTACTGTGCGAGAGGGC CGGAGTGGTTACTCGGTATGGACGT |
| 4890 | Table 3A | Hs.172762 | T75153 | 691915 | 16b3 cDNA | 1 | AGGCAAAAGCGCCTCACGCATTCTTG TTCCTTGTTTGCTTCTTCGGTTT |
| 4891 | Table 3A | Hs.294092 | T93822 | 726995 | EST375308 cDNA | 1 | TTAGAAAGAAAAGTCTTTTATTAGTAC TGTGTAGGGAAGGCTAAAGAAAT |
| 4892 | db mining | Hs.301385 | U19885 | 642583 | 602462113F1 cDNA, 5' end /clone = IMAGE:4575051/clone_end = 5' | 1 | ACTGTGCGAAACGTACTGTATTACGA TTTTTGGAGTGGCCGAAGTAGTCC |
| 4893 | db mining | Hs.318720 | U33547 | 3320135 | *Homo sapiens*, clone MGC:12387 IMAGE:3933019, mRNA, complete cds /cds = (63, 863) | 1 | CAGACCCTGGTGATGCTGGAAACAG TTCCTCGGAGTGGAGAGGTTTACAC |
| 4894 | db mining | Hs.267811 | U62624 | 1575443 | mRNA for HLA-C alpha chain (Cw*1701)/cds = (0, 1118) | 1 | GTCCAGCAACAGTGCCCAGGGCTCT GATGAGTCTCTCATCGCTTGTAAAG |
| 4895 | db mining | Hs.247987 | U80113 | 1791068 | immunoglobulin heavy chain variable region (V4-31) gene, partial cds /cds = (0, 356) | 1 | GTGTATTACTGTGCGAGAGCCTTCCG CCATCCCGGAGTACGTCCAATATG |
| 4896 | db mining | Hs.289036 | U80180 | 1791202 | immnoglobulin heavy chain variable region (VH4) mRNA, VH4-59 allele, partial cds/cds = (0, 353) | 1 | CCCGTCCCTCAAGAGTCGAGTCACC ATATCAGTAGACAAGTCCAAGAACC |
| 4897 | db mining | Hs.247898 | U96393 | 2078365 | partial mRNA for Ig lambda light chain variable region, clone MB91 (331 bp) /cds = (0, 330) | 1 | GGCTCCAGGCTCAGGATGAGGCTGA TTATTACTGCTGCTCATATACAAGC |
| 4898 | db mining | Hs.914 | X00457 | 36405 | *Homo sapiens*, Similar to major histocompatibility complex, class II, DR alpha, clone MGC:14114 IMAGE:4309471, mRNA, complete cds /cds = (40, 822) | 1 | CCCTCACTGTCACCTTCCCGAGAATA CCCTAAGACCAATAATACTTCAG |
| 4899 | db mining | Hs.296552 | X03529 | 33351 | DNA sequence from clone CTA-246H3 on chromosome 22 Contains the gene for IGLL1 (immunoglobulin lamba-like polypeptide 1, pre-B-cell specific), a pseudogene similar to LRP5 (Lipoprotein Receptor Related Protein.), ESTs, Genomic markers (D22S414, D22S925, D22S926), CA repeats, STSs, GSSs and a CpG island /cds = (0, 438) | 1 | TGAATGACTTCTATCTGGGAATCTTG ACGGTGACCTGGAAGGCAGATGGT |
| 4900 | literature | Hs.287797 | X07979 | 31441 | mRNA for FLJ00043 protein, partial cds/cds = (0, 4248) | 1 | ACCACTGTATGTTACTTCTCACCATT TGAGTTGCCCATCTTGTTTCACA |
| 4901 | db mining | Hs.247804 | X51887 | 37616 | V108 gene encoding an immunoglobulin kappa orphon | 1 | AGAACAGAGATGATTACACCTACGAA GTCTGAGTTATGGTGTGAGTTGGA |
| 4902 | db mining | Hs.81220 | X58397 | 33615 | CLL-12 transcript of unrearranged immunoglobulin V(H)5 gene /cds = (39, 425) | 1 | TTCATCATTGCTTGCTTGCCTTCCTC CCTCCTGTCCGCTCTCACTCACTC |
| 4903 | Table 3A | Hs.275959 | X60656 | 31134 | eukaryotic translation elongation factor 1 beta 2 (EEF1B2), mRNA /cds = (235, 912) | 1 | TGGATGTGGCTGCTTTCAACAAGATC TAAAATCCATCCTGGATCATGGCA |
| 4904 | db mining | Hs.90093 | X67643 | 2244651 | mRNA for heat shock protein apg-2, complete cds/cds = (278, 2800) | 1 | TGAAGAACGACCAAAATTATTTGAAG AACTAGGGAAACAGATCCAACAGT |
| 4905 | db mining | Hs.300697 | Y14737 | 2765424 | mRNA for immunoglobulin lambda heavy chain/cds = (65, 1498) | 1 | GTCTACATACTTCCCAGGCACCCAGC ATGGAAATAAAGCACCCACCACTG |
| 4906 | db mining | Hs.300697 | Y14737 | 2785424 | mRNA for immunoglobulin lambda heavy chain/cds = (65, 1498) | 1 | ATACTTCCCAGGCACCCAGCATGGAA ATAAAGGACCCACCACTGCCCTGG |
| 4907 | db mining | Hs.181125 | Y14738 | 2785426 | *Homo sapiens*, clone MGC:12849 IMAGE:4308973, mRNA, complete cds /cds = (24, 725) | 1 | CCCAAGGCATCAAGCCCTTCTCCCTG CACTCAATAAACCCTCAATAAATA |
| 4908 | Table 3A | Hs.283770 | Z00008 | 33142 | germline gene for the leader peptide and variable region of a kapppa immunoglobulin (subgroup V kappa I) | 1 | AAGGCAGAGATCTTGACACCTAAGGA GTCTAGTTTAGGGCTTTGGTTGGA |
| 4909 | db mining | Hs.37089 | Z00010 | 33146 | germ line pseudogene for immunoglobulin kappa tight chain leader peptide and variable region | 1 | GTTGACATTAGAAGCAGGATTCTCTG GTACTCCCTCAGAAAATAGAATGC |

TABLE 8-continued

| SEQ ID | Origin | Unigene | Locus | GI | Nominal Description | Strand | Probe Sequence |
|---|---|---|---|---|---|---|---|
| | | | | | (subgroup V kapppa I) | | |
| 4910 | db mining | Hs.148661 | Z00022 | 33158 | qg78c05.x1 cDNA 3' end /clone = IMAGE:1841288/clone_end = 3' | 1 | TTGGAGCGTTTTTGTGTTTGAGATATT AGCTCAGGTCAATTCCAAAGAGT |
| 4911 | Table 1 | Hs.181297 | AA010282 | 1471308 | tc35a11.x1 cDNA, 3' end /clone = IMAGE:2066588/clone_end = 3' | 1 | GGTTGTGTCTCTGGTTTCCCCTTTTC CCCGTGGTTTTAATTTTTAAGAAC |
| 4912 | Table 1 | Hs.189468 | AA069335 | 1576904 | tm30a06.x1 cDNA, 3' end /clone = IMAGE:2158068/clone_end = 3' | 1 | ACCATAGCAGACAGGGTCAGATGGA ATATTAGCGGTTTAGGTGAAGAACC |
| 4913 | Table 1 | Hs.13659 | AA115345 | 1670525 | mRNA; cDNA DKFZp586F2423 (from clone DKFZp586F2423) /cds = UNKNOWN | 1 | ATCCACATTCTTACCTTTGGTAGTCA GGTTTGGCTACTTTGCAGCTCGCC |
| 4914 | Table 1 | Hs.182278 | AA203528 | 1799239 | Homo sapiens, calmodulin 2 (phosphorylase kinase, delta), clone MGC:1447 IMAGE:3504793, mRNA, complete cds/cds = (93, 542) | 1 | TCTGTTACCACCTCTAAAATATTGGG GTGGAATAAAGCTGGGTTCTTGCA |
| 4915 | Table 1 | Hs.100651 | AA251184 | 1886149 | golgi SNAP receptor complex member 2 (GOSR2), mRNA/cds = (0, 838) | 1 | AAGGATGAAGGACTGATGGAGGGCA GAGGAACTGGAGGCAGCAGGCACAA |
| 4916 | Table 1 | NA | AA252909 | 1885512 | zr76a03.r1 Soares__NhHMPu__S1 cDNA clone IMAGE:669292 5', mRNA sequence | 1 | AGATGTCTGTATAAACAACCTTTGGG TAGCAGGTGGTCAGTTAGGCAGGA |
| 4917 | Table 1 | Hs.194480 | AA258979 | 1894266 | EST389427 cDNA | 1 | TGCTTGTCTTTTAAACACCTTCACAGA TATCATTTGCACCTTGCCAAAGG |
| 4918 | Table 1 | Hs.5241 | AA280051 | 1921589 | fatty acid binding protein 1, liver (FABP1), mRNA/cds = (42, 425) | 1 | GGGTAGGCAGCTTGCACCCAGTTCT CCTTTATCTCAACTTATTGTCCTGG |
| 4919 | Table 2 | Hs.23128 | AA282304 | 1925220 | Homo sapiens, Similar to RIKEN cDNA 4931428D14 gene, clone MGC:15407 IMAGE:4309813, mRNA, complete cds/cds = (123, 1151) | 1 | ACTTGGAACAGAAGAACTTCGGCAAC GAGAACACTATCTCAAGCAGAAGA |
| 4920 | Table 1 | NA | AA282774 | 1925825 | zt14g01.r1 NCI_CGAP_GC81 cDNA clone IMAGE:713136 5', mRNA sequence | 1 | GCGGTGTCCCTGAGTGAGGGCAAAG TTGTAATAACACTTGTTCTCTCCTT |
| 4921 | Table 1 | Hs.89072 | AA283081 | 1926050 | hypothetical protein MGC4618 (MGC4618), mRNA/cds = (107, 1821) | 1 | ACGGCGTTCTGAAATTTAGCACACTG GGAAGTCCACATGGTTCATCTGAA |
| 4922 | Table 1 | Hs.291448 | AA290921 | 1938772 | EST368168 cDNA | 1 | AATGAGATCACAGATGGTGACACTGA GCGGAAGGATGCAGTACCTCGGAG |
| 4923 | Table 1 | Hs.211866 | AA290993 | 193898 | wh99f02.x1 cDNA, 3' end /clone = IMAGE:2388891/clone_end = 3' | 1 | GGCTAGTGGTGTTCAGAGAAATACCA AAACGTGTTTTTATCATTGCTGGT |
| 4924 | Table 1 | NA | AA319163 | 1971490 | EST21341 Adrenal gland tumor cDNA 5' end, mRNA sequence | 1 | AGCTGCCTCAGGAGGTTCTTAACATA TAGGAATGTAATTATCAGATTCAA |
| 4925 | Table 1 | Hs.260238 | AA332553 | 1984806 | hypothetical protein FLJ10842 (FLJ10842), mRNA/cds = (39, 1307) | 1 | AGGAAACCAAGCCCTCACAGGAAAG AAAGCCTGATTCAAGAAAACAAAGT |
| 4926 | Table 1 | Hs.343557 | AA401648 | 2058830 | 601500320F1 cDNA, 5' end /clone = IMAGE:3902237/clone_end = 5' | 1 | GCTGGGGCTGAGAGAGGGTCTGGGT TATCTCCTTCTGATCTTCAAAACAA |
| 4927 | Table 1 | Hs.186674 | AA402069 | 2056860 | qf56f06.x1 cDNA, 3' end /clone = IMAGE:1754051/clone_end = 3' | 1 | TCATGGACACAAACTTTGGAGTATAA GCGACATCCCTTAAGCAACAGGCT |
| 4928 | Table 1 | Hs.301985 | AA412436 | 2071006 | 602435787F1 cDNA, 5' end /clone = IMAGE:4553684/clone_end = 5' | 1 | GCCATTTTCCCTCCAGAAACAAAACC AAGATAATTTATCCTGAACACGGT |
| 4929 | Table 1 | Hs.9691 | AA418765 | 2080566 | cDNA; FLJ23249 fis, clone COL04196 /cds = UNKNOWN | 1 | TGTTTGTACCACTAGCATTCTTATGTC TGTACTTGAACGTGTAGTTAGCA |
| 4930 | Table 1 | Hs.24143 | AA426506 | 2106769 | Wiskoff-Aldrich syndrome protein interacting protein (WASPIP), mRNA /cds = (108, 1619) | 1 | AGGACCATAGGGAAGAGCCAGCCTT GCCTTTTCTTATATGATTTTGTTTA |
| 4931 | Table 1 | Hs.89519 | AA429783 | 2112974 | KIAA1046 protein (KIAA1046), mRNA /cds = (577, 1782) | 1 | CCTGGGTTGCCTTGTAATGAAAAGGG AGATCGAGCCATTGTACCACCTTA |
| 4932 | Table 1 | NA | AA457757 | 2180477 | aa92c03.r1 Stratagene fatal retina 937202 cDNA clone IMAGE:836756 5', mRNA sequence | 1 | AGCTGTTTAATTGAATTGGAATCGTT CCACTTGGAACCCAAGTTTGGAAA |
| 4933 | Table 1 | Hs.82772 | AA480876 | 2185996 | collagen, type XI, alpha 1 (COL11A1), mRNA/cds = (161, 5581) | 1 | TCGTTCTACGTTATCTCATCTCCTTGT TTTCAGTGTGCTTCAATAATGCA |
| 4934 | Table 1 | Hs.13809 | AA476568 | 2204779 | mRNA for KIAA1525 protein, partial cds/cds = (0, 2922) | 1 | TGTTTTTGCTTCCTCAGAAACTTTTTA TTGCATCTGCCATCCTTCATTGG |
| 4935 | Table 1 | NA | AL047171 | 5936355 | DKFZp586F2018_r1 588 (synonym: hute1) cDNA clone DKFZp586F2018 5', mRNA sequence | 1 | TGCACTTACTCATTAGTTTTTAGTTTG AACTCTCCTGCGAGGTCTAATGT |
| 4936 | Table 1 | Hs.77868 | AL513780 | 12777274 | ORF (LOC51035), mRNA /cds = (135, 1031) | 1 | TGGTTCTTCTGATGAGCAAGGGAACA ACACTGAGAATGAGGAGGAGGAGT |
| 4937 | Table 2 | Hs.30120 | AL533737 | 12797230 | cDNA/clone = CS0DF00ZYH09-(5-prime) | 1 | AAGCAAGAGATTGTAAACCGGGTACA GATCCAAGAGATGAGAGAGGACCC |
| 4938 | Table 1 | Hs.285401 | AL540399 | 12870508 | colony stimulating factor 2 receptor, beta, low affinity (granulocyte-macrophage) (CSF2RB), mRNA | 1 | CGTCTACTGCGGAAAAGTCAGGGGA AACTGCCAAACAAAGGAAAATGCCC |

TABLE 8-continued

| SEQ ID | Origin | Unigene | Locus | GI | Nominal Description | Strand | Probe Sequence |
|---|---|---|---|---|---|---|---|
| | | | | | /cds = (26, 2721) | | |
| 4939 | Table 1 | NA | AV689330 | 10291193 | AV689330 GKC cDNA clone GKCDJE03 5', mRNA sequence | 1 | GTGTTTGACTTCACTGCTGCGAAATG ACTGTCTCCTGGCTAGTAGGATCT |
| 4940 | Table 1 | Hs.90960 | AV710415 | 10729044 | 602563938F1 cDNA, 5' end /clone = IMAGE:4688769/clone_end =5' | 1 | ATGTGGGAGGGGCATGGCAGCTATG AAGGACCTCCTACCTCTGGTTTCTG |
| 4941 | Table 1 | Hs.237868 | AV716565 | 10813717 | interleukin 7 receptor (IL7R), mRNA /cds = (22, 1401) | 1 | CCAGCCTTTGCCTCTTCCTTCAATGT GGTTTCCATGGGAATTTGCTTCAG |
| 4942 | Table 1 | Hs.127160 | AV719938 | 10817090 | AV659177 cDNA, 3' end /clone = GLCFUC08/clone_end = 3' | 1 | ACCTTGTAAGTGCCTAAGAAATGAGA CTACAAGCTCCATTTCAGCAGGAC |
| 4943 | Table 2 | Hs.21536 | AV720964 | 10818136 | yf69a03.s1 cDNA, 3' end /clone = IMAGE:27414/clone_end = 3' | 1 | GCCGAGATCTGCTCAGACTACATGG CTTCCACTATAGGGTTCTACAGTGT |
| 4944 | Table 1 | Hs.22003 | AV730135 | 10839556 | solute carrier family 6 (neurotransmitter transporter, GABA), member 1 (SLC6A1), mRNA /cds = (234, 2033) | 1 | ATGTCTATAAATGGTGTCATAACTAG AGCACGGGCGTTATGTAAGTTTCT |
| 4945 | Table 1 | Hs.339696 | AV755367 | 10913215 | ribosomal protein S12 (RPS12), mRNA/cds = (80, 478) | 1 | TGAGTCGTATTACAATTCACTGGCCG TCGTTTTACAACGTCGTGACTGGG |
| 4946 | Table 1 | Hs.301553 | AW021037 | 5874567 | karyopherin alpha 6 (importin alpha 7) (KPNA8), mRNA/cds = (55, 1685) | 1 | ACATAGGCGAAGAAAACATGGCATTG AGTGTGCTGAGTCCAGACAAATGT |
| 4947 | Table 2 | NA | AW402007 | 6920693 | UI-HF-BK0-aao-g-02-0-UI.r1 NIH_MGC_38 cDNA clone IMAGE:3054530 5', mRNA sequence | 1 | GTGCAGTCCATCAGATCCAAGCCTGT CTCTTGAGGAACAACCGCGCAGAC |
| 4948 | Table 1 | NA | AW499658 | 7111531 | UI-HF-BR0p-ajj-c-07-0-UI.r1 NIH_MGC_52 cDNA clone IMAGE:3074677 5', mRNA sequene | 1 | TGGTGGCAAATCTGATTTTTGGAAAC GAGTATTGGAGGACTATAAAACAA |
| 4949 | Table 1 | NA | AW499828 | 7111870 | UI-HF-BN0-ake-c-06-0-UI.r1 NIH_MGC_50 cDNA clone IMAGE:3076619 5', mRNA sequence | 1 | ACATTTCTTGTTGGCACTACAGCAAC CACATACAGTACAGACAACCTCCA |
| 4950 | Table 1 | Hs.145668 | AW500534 | 7113240 | fmfc5 cDNA/clone = CR6-21 | 1 | CCTGGCACATGTTGTCTGGAGTCTGG CACACTGGTTATCAATAGCACATT |
| 4951 | Table 1 | Hs.120996 | AW504293 | 7141960 | serine/threonine kinase 17b (epoptosis-inducing) (STK17B), mRNA /cds = (281, 1379) | 1 | CTGTGGTCTGTTATATGAGAGAGATC CTTTAACTAGAGCAAAGAGGGAGT |
| 4952 | Table 1 | Hs.194589 | AW945536 | 8123293 | AV703056 cDNA, 5' end /clone = ADBCMB06/clone_end = 5' | 1 | TCTCTCACTGTTATCATTTTTGCACAG GTGGTTTCAGCAGCTTGATGCCA |
| 4953 | Table 1 | NA | BE177661 | 8656813 | RC1-HT0598-020300-011-h02 HT0598 cDNA, mRNA sequence | 1 | AATCACAGCAGTAACTCCCAGTAGGA AAGATTCTCAAAGGAATAGTTCTT |
| 4954 | Table 2 | NA | BE253336 | 9123402 | 601117146F1 NIH_MGC_16 cDNA clone IMAGE:3357826 5', mRNA sequence | 1 | CCTGGCCTTCAAGAAGTCGTAGTGG CTATTTTCTTTGGACAAAGTAAGA |
| 4955 | Table 1 | Hs.343565 | BE540808 | 9769453 | 601510248F1 cDNA, 5' end /clone = IMAGE:3912034/clone end =5' | 1 | ATAGACAGACGGAGGTCCTGATATCC ATGGGCCAACGGCTTGGATTATTC |
| 4956 | Table 2 | NA | BE569141 | 9812861 | 601338954F2 NIH_MGC_53 cDNA clone IMAGE:3881180 5', mRNA sequence | 1 | GATATTGGTAGTAAAGGGGTTACCTG TGAACTTCCAAAATTCCTTGGGGC |
| 4957 | Table 1 | Hs.271272 | BE737348 | 10151340 | DKFZp434K1715_rt cDNA, 5' end /clone = DKFZp434K1715/clone_end = 5' | 1 | GGTGGAGAATCAAAACGACCCCGCA AATAAACATGGCGATTTGGCTTGGG |
| 4958 | Table 2 | Hs.20225 | BE792125 | 10213323 | tuftelin-interacting protein (TIP39), mRNA/cds = (283, 2776) | 1 | GATATCAGACAGCATCGTCTCTGCGA GCACAAAGATCTGTTTGCTGAGCA |
| 4959 | Table 1 | Hs.31314 | BE872245 | 10321021 | retinoblastoma-binding protein 7 (RBBP7), mRNA/cds = (287, 1584) | 1 | ACATTTTATAAGGCATTTGTGTTAGCC ACTCAGTCATCTTTGGGTGCTGC |
| 4960 | Table 2 | NA | BE884898 | 10333674 | 601506831F1 NIH_MGC_71 cDNA clone IMAGE:3908551 5', mRNA sequence | 1 | ATCTGGAGTGGGACCCTTCAAACCAT GTCTGTGCTTATGCGGGAACAAT |
| 4961 | Table 1 | Hs.250824 | BE887846 | 10343176 | cDNA:FLJ23435 fis, clone HRC12631 /cds = UNKNOWN | 1 | AATTAACGGCCATCACACCCACGACT GACGGTGATCAAACAAATTCACAG |
| 4962 | Table 1 | NA | BE898691 | 10361375 | 601440131F1 NIH_MGC_71 cDNA clone IMAGE:3925062 5', mRNA sequence | 1 | GACAGTACTCCTAAGACCCCTGTGTG TGTCCCGATGAGATCATGACTGGG |
| 4963 | Table 1 | Hs.337986 | BF033741 | 10741453 | *Homo sapiens*, clone MGC:17431 IMAGE:2984883, mRNA, complete 1ds /cds = (1336, 1494) | 1 | CTGTGATATTTTGGTCATGGGCTGGT CTGGTCGGTTTCCCATTTGTCTGG |
| 4964 | Table 1 | Hs.268177 | BF339088 | 11285508 | phospholipase C, gamma 1 (formerly subtype 148) (PLCG1), mRNA /cds = (76, 3948) | 1 | CTCATAGCATAGCCAGCATTCAGCAC ACACAAACCTACTGCCCACATTTG |
| 4965 | Table 1 | Hs.2554 | BF341359 | 11287850 | sialytransferase 1 (beta-galactoside alpa-2,6-sialytransferase) (SIAT1), mRNA/cds = (310, 1530) | 1 | CACATTTGAAGGCCAAAGGGAA AACGGGGAAGCGGAAGGGTTGGA TTGG |
| 4966 | Table 1 | Hs.334825 | BF530382 | 11617745 | cDNA FLJ14752 fis, clone NT2RP3003071/cds = (205, 1446) | 1 | TACGACCACTGAGAAACGGGCCACC CGGCACGGGATCTTGGAACACAAA |
| 4967 | Table 1 | Hs.79530 | BF683110 | 11937011 | M5-14 protein (LOC51300), mRNA /cds = (186, 1043) | 1 | CTCAGTGTAGGGCAGAGAGGTCTAA CACCAACATAAGGTACTAGCAGTGT |
| 4968 | Table 1 | Hs46677 | BF667621 | 11941516 | PRO2000 protein (PRO2000), mRNA /cds = (650, 1738) | 1 | AGGTTGTGGGGAGTATGTTTGGACCA AAAATTAAATATTGTGGGAGGGA |
| 4969 | Table 1 | Hs.27590 | BF671020 | 11944915 | histone acetyltransferase (MORF), | 1 | TGATAGCTCACTTAGTTAATTGTTTTG |

TABLE 8-continued

| SEQ ID | Origin | Unigene | Locus | GI | Nominal Description | Strand | Probe Sequence |
|---|---|---|---|---|---|---|---|
| 4970 | Table 1 | Hs.71331 | BF691178 | 11976586 | hypothetical protein MGC5350 (MGC5350), mRNA/cds = (189, 995) | 1 | AAGCAAATTTTGGGTTGGATGGG ACTACTGCTTGCGTACCTCTCCGCTT TCCCTCTCCTTACTATCGACCATA |
| 4971 | Table 1 | Hs.337534 | BF985068 | 12332283 | 602268833F1 cDNA, 5' end /clone = IMAGE:4356776/clone_end = 5' | 1 | GGTCCGACCAATTAATGACTCCATGA TCGGCCTCGGTTTTCACAAACCTT |
| 4972 | Table 1 | Hs.334691 | BF965438 | 12332653 | hypothetical protein FLJ22427 (FLJ22427), mRNA/cds = (40, 2631) | 1 | AGACAAAGAGAGCATAAATATAGCTC TACTCATGGGTACCATACCAGTGT |
| 4973 | Table 1 | Hs.279681 | BF985960 | 12333175 | heterogeneous nuclear ribonucleoprotein H3 (2H9) (HNRPH3), transcript variant 2H9, mRNA /cds = (118, 1158) | 1 | GCAGGTTATCGCAAGATGTCTTAGAG TAGGGTTACGGTTCTCAGTGACAC |
| 4974 | Table 1 | Hs.5324 | BF966028 | 12333243 | hypothetical protein (CL25022), mRNA /cds = (157, 1047) | 1 | AAATGGCTTTACCAAACATTGTCAGT ACCTTTACGTGTTAGAAGGCATTT |
| 4975 | Table 1 | Hs.179902 | BF966049 | 12333264 | transporter-like protein (CTL1), mRNA /cds = (0, 1964) | 1 | CTTTCCACAGCAATTGTTTTGTACGA GGGGCCTTACAGCGCGGTCCACTT |
| 4976 | Table 1 | Hs.109441 | BF969847 | 12337062 | cDNA FLJ14235 fis, clone NT2RP4000187/cds = (82, 2172) | 1 | CCCTACTTGATTAAAGATTGAGGTGG AATTCTAGATGTGGTCATTCGTGT |
| 4977 | Table 2 | Hs.289721 | BF981634 | 12384446 | cDNA:FLJ22193 fis, clone HRC01108 /cds = UNKNOWN | 1 | ACAGAGAGTCACCCGCGAGTACGAA ACAGGCACATTTTTAGAAACTCACA |
| 4978 | Table 1 | Hs.125819 | BG034799 | 12428456 | putative dimethyladenosine transfease (HSA9761), mRNA /cds = (76, 1019) | 1 | AGAAATGGTACGGGGAATGTGAATAA CACGAAATGGTATGGGGAAATGTG |
| 4979 | Table 1 | Hs.34908 | BG111773 | 12605279 | 6018204481F1 cDNA, 5' end /clone = IMAGE:4052578/clone_end = 5' | 1 | CACAACGGGTCTTAATGACGACGGAA AGATACATCCATCGGTATGAACGC |
| 4980 | Table 1 | NA | 1BG118529 | 2612035 | 602348464F1 NIH_MGC_90 cDNA clone IMAGE:4443519 5', mRNA sequence | 1 | TGTTCTTGTGCTGCTGTTATCTATACT ATTTTTGTTCGTGCCTTCTGACT |
| 4981 | Table 1 | Hs.285729 | BG163237 | 12669951 | 602013364F1 cDNA, 5' end /clone = IMAGE:4149351/clone_end = 5' | 1 | GTCTGGGTGCCAACTTGAGACAGGT GGTCTAGGAAATTGCGGTAAGAGCG |
| 4982 | Table 2 | Hs.111554 | BG164898 | 12671532 | ADP-ribosylation factor-like 7 (ARL7), mRNA/cds = (14, 592) | 1 | CCCCTGGTTTTCTCGTTCTGCCTCCT TTGGACCTGTGTTTGTTTTCTGCT |
| 4983 | Table 1 | Hs.193482 | BG165998 | 12672701 | cDNA FLJ11903 fis, clone HEMBB1000030/cds = UNKNOWN | 1 | CCCTTAGAATGGTTACTGCCCTTGAA TTAACTTGACACAACTTGGGTTGG |
| 4984 | Table 1 | Hs.83731 | BG179257 | 12685889 | CD33 antigen (gp67) (CD33), mRNA /cds = (12, 1108) | 1 | AGGCTGATTCTTGGAGATTTAACACC CCACAGGCAATGGGTTTATAGACA |
| 4985 | Table 1 | Hs.278426 | BG286817 | 13040034 | progestin induced protein (DD5), mRNA/cds = (33, 8432) | 1 | TCTCCTTTCAGTTCCTTTGTAGGATTT CTGGGCTTGAAGGATAGTCTTCA |
| 4986 | Table 1 | Hs.173830 | BG289048 | 13044499 | 602383666F1 cDNA, 5' end /clone = IMAGE:4512712/clone_end = 5' | 1 | ATACTGTGTGATTTGCCCTTGCTGTC GAACCCTGTTCTTGCTGCCATTTA |
| 4987 | Table 1 | Hs.129872 | BG290577 | 13047679 | sperm associated antigen 9 (SPAG9), mRNA/cds = (110, 2410) | 1 | AGAATGTCCCACTTGCTGTCTCTTAG AGGCTGAGCTTCATTTCTATGAGC |
| 4988 | Table 1 | Hs.170980 | BG387694 | 13281140 | cell cycle progression 2 protein (CPR2), mRNA/cds = (126, 1691) | 1 | CAACCTCTGGAGAGTGCCTACTGTTA GAAGCTGAAGGGATGTCAAAGTCA |
| 4989 | Table 1 | Hs.266175 | BG391695 | 13285143 | cDNA FLJ20673 fis, clone KAJA4464 /cds = (104, 1402) | 1 | CTTTAAATCTTAGATTGCTCCGCACA GATAAAGAGAACCAGGATTGGGGC |
| 4990 | Table 1 | Hs.58643 | BG397564 | 13291012 | 602438603F1 cDNA, 5' end /clone = IMAGE:4564968/clone_end = 5' | 1 | GCCTCAGTACAGAGGGGGCTCTGGA AGTGTTTGTTGACTGAATAACGGA |
| 4991 | Table 1 | Hs.24054 | BG489375 | 13450885 | hypothetical protein GL009 (GL009), mRNA/cds = (77, 628) | 1 | AGGACTTAACGGGAATACGGGAATAA CTCCAATTACTTCATCTCTAGGGC |
| 4992 | Table 1 | Hs.29131 | BG497765 | 13459282 | nuclear receptor coactivator 2 (NCOA2), mRNA/cds = (182, 4556) | 1 | TGCCTAAGAGCAAAGCATCCTCTGCG ACAAAAGAAAATTACTGTAGTGGC |
| 4993 | Table 2 | Hs.172089 | BG501063 | 13462580 | mRNA; cDNA DKFZp586I2022 (from clone DKFZp586I2022) /cds = UNKNOWN | 1 | AAACACACAGGAAAAGGGCAAGGG GGCACCAGGAGAACCGGGAGACAAA |
| 4994 | Table 1 | NA | BG501895 | 13463412 | 602548201F1 NIH_MGC_61 cDNA clone IMAGE:4654344 5', mRNA sequence | 1 | GACATGGAGCCCCGGAAAAGCGGG TCTGGACACCAAGTCGATGTGTGAG |
| 4995 | Table 1 | Hs.3280 | BG505961 | 13467478 | caspaso 6, apoptosis-related cysteine protease (CASP6), transcript variant alpha, mRNA/cds = (78, 959) | 1 | ACAGAATCAGATTTTGCAGGTGTCCA ACCTATAGTGGCTAAGAATTATGT |
| 4996 | Table 1 | Hs.279009 | BG532345 | 13523883 | matrix Gla protein (MGP), mRNA /cds = (46, 357) | 1 | AAACTGTTTGGAGAATTTAAGCACTC TCTGATGGGGACAACTCTATGGA |
| 4997 | Table 1 | Hs.74647 | BG536394 | 13527940 | T-cell receptor active alpha-chain mRNA from JM cell line, complete cds /cds = (136, 969) | 1 | AATAATTGGTCTTTTAAACAAACACG GAAGTTTGGTGGAATCGGTCATGT |
| 4998 | Table 1 | NA | BG542394 | 13534627 | 602571761F1 NIH_MGC_77 cDNA clone IMAGE:4696046 5', mRNA sequence | 1 | TGTGGCGATTAAGAGAGGTGAAGCAT AACTGATTTGCAGGATATGGTTTG |
| 4999 | Table 1 | Hs.83077 | BG547627 | 13546292 | interleukin 18 (interferon-gamma-inducing factor) (IL18), mRNA /cds = (177, 758) | 1 | GCAGAACTCTAATTGTACGGGGTCAC AGAGGCGTGATATGGTATCCCAAA |

TABLE 8-continued

| SEQ ID | Origin | Unigene | Locus | GI | Nominal Description | Strand | Probe Sequence |
|---|---|---|---|---|---|---|---|
| 5000 | Table 1 | Hs.301497 | BG566035 | 13573688 | arginine-tRNA-protein transferase 1-1p (ATE1) mRNA, alternatively spliced product, partial cds/cds = (0, 1544) | 1 | TGGAGATCCTTCTACTTGGCTGCTGT ATTCATGCATTATGTTGGTTTGAG |
| 5001 | Table 1 | Hs.343475 | BG566964 | 13574617 | 601556208T1 cDNA, 3' end /clone = IMAGE:3826392/clone_end = 3' | 1 | ATTTGTACCAAATCTTTGGGATTCATT GGCAAATAATTTCAGTGTGGTGT |
| 5002 | Table 1 | Hs.11050 | BG571068 | 13578721 | mRNA; cDNA DKFZp4340118 (from clone DKFZp434C0118); partial cds /cds = (0, 1644) | 1 | GGTTTTAGCAGTTCTTTAGCCCGTGG TATTTCAGTGTTGGGTTTCATAGC |
| 5003 | Table 1 | Hs.194110 | BG571747 | 13579400 | hypothetical protein PRO2730 (PRO2730), mRNA/cds = (183, 596) | 1 | GGGAGCCATAAGAACGACTCCAAAAA GAGCCCCAAGGAGGACAAGGGGG |
| 5004 | Table 1 | Hs.306155 | BG572371 | 13580024 | chorionic somatornammotropin hormone 1 (placental lactogen) (CSH1), transcript variant 2, mRNA /cds = (116, 886) | 1 | TCAGGGTCTTGGATACTCAAGAGAAA GGAGACTTGTGGTTAATGTTTGGA |
| 5005 | Table 1 | Hs.301756 | BG573202 | 1358055 | Homo sapiens, clone MGC:17544 IMAGE:3482146, mRNA complete cds /cds = (258, 894) | 1 | TCCTTAGCACACGAAAAAGCCCCTTC CCCTGGATTCATGTTTCTTATTTC |
| 5006 | Table 1 | Hs.79101 | BG575739 | 13583392 | cyclin G1 (CCNG1), mRNA /cds = (187, 1074) | 1 | AAGCAAGTAGACACCTTCATAACTAT GAATGAAGCTGCTGAAGTAGTGTT |
| 5007 | Table 1 | Hs.172780 | BG611117 | 13682488 | 602343016F1 cDNA, 5' end /clone = IMAGE:4453466/clone_end = 5' | 1 | TCCATTAAAGATCGCAAATGTTGAGG TCCTGTAGCCTGAAAACTCTCTGC |
| 5008 | Table 1 | Hs.5064 | BG614405 | 13885776 | 602490910F1 cDNA, 5' end /clone = IMAGE:4619835/clone_end = 5' | 1 | CTGATTCAAACAGGTTCCAACGTAA ACGTTCACACTTCCACCATTTCCT |
| 5009 | Table 1 | Hs.86437 | BG815272 | 13666643 | 602411368F1 cDNA, 5' end /clone = IMAGE:4540098/clone_end = 5' | 1 | TGATGTTGGTATGCTTGCCCTGTTAC TTATAGACAGTCTTTGTCATAGGC |
| 5010 | Table 1 | Hs.111911 | BG617515 | 13668888 | 602540482F1 cDNA, 5' end /clone = IMAGE:4671519/clone_end = 5' | 1 | GGTCTTTGTCCCAGTAGAGTTCATAG TCTATTTAGTGTGCATGTTTTTCC |
| 5111 | Table 1 | Hs.326392 | BG618351 | 13669722 | son of sevenless (Drosophila) homolog 1 (SOS1), mRNA /cds = (0, 3998) | 1 | TTGTGTCCAAAAGTGTTAACGAAGAC TACTTAACCCAATGATTGGCGCGA |
| 5012 | Table 1 | NA | BG622313 | 13673684 | 602646981F1 NIH_MGC_79 cDNA clone IMAGE:4768413 5', mRNA sequence | 1 | ATGCGTGGATATTGAGAACTTAGGTG TCTAATGGGGAGGATTATTGCTGT |
| 5013 | Table 1 | Hs.173334 | BG674441 | 13905837 | ELL-RELATED RNA POLYMERASE II, ELONGATION FACTOR (ELL2), mRNA/cds = (0, 1922) | 1 | AAGCATTTCCATTTCAACGAGTTTGT CAGCTTTATTAATGTTGGGCAAAA |
| 5014 | Table 1 | Hs.343615 | BG675211 | 13906607 | 602621493F1 cDNA, 5' end /clone = IMAGE:4755166/clone_end = 5' | 1 | AAACCTACCACTTTAAGAAGACAGCG ATGGGTAATTCTTTATTGGCAGGT |
| 5015 | Table 1 | Hs.250905 | BG675766 | 13907162 | hypothetical protein (LOC51234), mRNA/cds = (0, 551) | 1 | ATTCAGCATTAGTTTCTCACATCTTCC CCCAGGTATCCCCAACAGAATTA |
| 5016 | Table 1 | NA | BG676788 | 13908185 | 602623378F1 NCI_CGAP_Skn4 cDNA clone IMAGE:4748322 5', mRNA sequence | 1 | ACACCTCTCTTAGGGCTCCATCAAAC AGAACTTTTAGACTGAGTAACGCT |
| 5017 | Table 1 | Hs.21812 | BG676903 | 13908300 | AL562895 cDNA /clone = CS0DC021YO20-(3-prime) | 1 | AAGTTTGTGCAGCACATTCCTGAGTG TACGATATTGACCTGTAGCCCAGC |
| 5018 | Table 2 | Hs.171802 | BG678827 | 13910224 | RST31551 cDNA | 1 | ACCATGAACAGTGTGTTGCTTCAGAC TATTACAAAGAGAATGGGGCAGGT |
| 5019 | Table 1 | Hs.12396 | BG679427 | 13910824 | 602302446F1 cDNA, 5' end /clone = IMAGE:4403866/clone_end = 5' | 1 | TTTTTGAAAAGTATGTTTGGTAGAAAT TAGTTGTATGCCCTCAGGACGGT |
| 5020 | Table 1 | Hs.4248 | BG679662 | 13911059 | vav 2 oncogene (VAV2), mRNA /cds = (5, 2641) | 1 | GAAATTAGTGTGAACATGTGGGAAGC CCGATGCATGTGGGTCAGGGATCT |
| 5021 | Table 1 | Hs.182937 | BG681320 | 13912717 | peptidylpropyl isomerase A (cyclophilin A) (PPIA), mRNA/cds = (44, 541) | 1 | TCCCTGGGTGATACCATTCAATGTCT TAATGTACTTGTGGCTCAGACCTG |
| 5022 | Table 1 | NA | BG682704 | 13914101 | 602629666F1 NCI_CGAP_Skn4 cDNA clone IMAGE:4754273 5', mRNA sequence | 1 | CAGACAGCACAGCCTGAGGGTAGCA GCAGCCACCCATGTTCAGGTAAGTC |
| 5023 | Table 2 | Hs.250465 | BG707615 | 13984138 | mRNA; cDNA DKFZp434E2023 (from clone DKFZp434E2023) /cds = UNKNOWN | 1 | GCCATGAGGTGGAGGACGTGGACCT GGAGCTGTTCAACATCTCGGTGCAG |
| 5024 | Table 1 | Hs.235883 | BG708357 | 13985818 | 602628774F1 cDNA, 5' end /clone = IMAGE:4753483/clone_end = 5' | 1 | TCTGCACCCAAACAAATACCTTTTGA GATTTCTTATAGGCATTCCTCTCG |
| 5025 | Table 1 | Hs.119960 | BG709079 | 13987060 | mRNA; cDNA DKFZp727G051 (from clone DKFZp727G051); partial cds /cds = (0, 1423) | 1 | GAAGCTCTGCCGCAGCGCCAGGCAC TTCCTACACCACTACTACGTCCACG |
| 5026 | Table 1 | Hs.87908 | BG709315 | 13987530 | Snf2-related CBP activator protein (SRCAP), mRNA/cds = (210, 9125) | 1 | CAGCTCGGACCACCGCCACCTCCCT TTTTATTACAGATCACCCAGTAAG |
| 5027 | Table 1 | Hs.10056 | BG720359 | 13999546 | hypothetical protein FLJ14621 (FLJ14621), mRNA/cds = (525, 1307) | 1 | GGTCCCCTCCTGGAGACTCCCTCAC AAAATCTTTCCCCAAGCTGTTCCCC |
| 5028 | Table 1 | Hs.6986 | BG723274 | 14002461 | glucose transporter pseudogene | 1 | TGAATGGGCGTTTATCTTAATGACCA |

TABLE 8-continued

| SEQ ID | Origin | Unigene | Locus | GI | Nominal Description | Strand | Probe Sequence |
|---|---|---|---|---|---|---|---|
| 5029 | Table 1 | Hs.181392 | BG740787 | 14051440 | major histocompatibility complex, class I, E (HLA-E), mRNA/cds = (7, 1083) | 1 | GTTATTGACCAAAGTGTACTCAGA AGCCTATTCCTATTCTCTAGCCTATTC CTTACCACCTGTAATCTTGACCA |
| 5030 | Table 2 | Hs.86543 | BG743518 | 14054171 | 602495247F1 cDNA, 5' end /clone = IMAGE:4609330/clone_end = 5' | 1 | GCAATGGGCGGCCAACTATGAACCC TACGTGGTGGTGGCACGAGACTGTC |
| 5031 | Table 1 | Hs.77202 | BG743900 | 14054553 | protein kinase C, beta 1 (PRKCB1), mRNA/cds = (138, 2151) | 1 | GCCTGGAGCTTGGCTTTGTATCCAAG TGTATGGTTGCTTTGTCTAAGAGG |
| 5032 | Table 2 | Hs.95835 | BG747882 | 14058515 | RST8356 cDNA | 1 | AGGGAGACTCTCAGCCTTCAGCTTCC TAATTCTGTGTCTGTGACTTTCG |
| 5033 | Table 1 | Hs.204959 | BG758589 | 14069222 | hypothetical protein FLJ14886 (FLJ14888), mRNA/cds = (111, 1169) | 1 | AGCCTACAAGCCACCTCGCCACTGT GAACTTGTCGTCACTCTTGGATGTC |
| 5034 | Table 2 | Hs.37617 | BG760189 | 14070842 | 602144947F1 cDNA, 5' end /clone = IMAGE:4308683/clone_end = 5' | 1 | CCTGCTCACAGACCAGGAACTCTACA AGCTGGACCCTGACCGGCAGTACC |
| 5035 | Table 1 | Hs.182447 | BG766957 | 14077610 | heterogeneous nuclear ribonucleoprotein C (C1/C2) (HNRPC), transcript variant 1, mRNA /cds = (191, 1102) | 1 | AGCAGTTCCACAGTGTTTCACACTAC AGGATTTAAATATTTTGCTCCAGA |
| 5036 | Table 2 | Hs.301226 | BG768471 | 14079124 | mRNA for KIAA1085 protein, partial cds/cds = (0, 1755) | 1 | CCTTTATCCACCTGGATTTTAGGGAC AACACTGAAAACGAATAAGTCCA |
| 5037 | Table 2 | Hs.301226 | BG768471 | 14079124 | mRNA for KIAA1085 protein, partial cds/cds = (0, 1755) | 1 | CCTTTATCCACCTGGATTTTAGGGAC AAACACTGAAAACGAATAAGTCCA |
| 5038 | Table 1 | Hs.124675 | BG772661 | 14083314 | ob13b08.s1 cDNA, 3' end /clone = IMAGE:1323543/clone_end = 3' | 1 | CAGAGAACGAAGTCAAGTGCAGCG AGTTGGGTGGAAGCTGATAGAGCAA |
| 5039 | Table 2 | Hs.301228 | BG775621 | 14045938 | mRNA for KIAA1085 protein, partial cds/cds = (0, 1755) | 1 | CCACAAACCATTCAGATCAGGCACTT GCTGACCCTGGTTCTTAAGGACAC |
| 5040 | Table 1 | Hs.180450 | BG820627 | 14168214 | ribosomal protein S24 (RPS24), transcript variant 1, mRNA /cds = (37, 429) | 1 | AAGAAACTATGTAGCATAGTGTCTTA ACACCTCAGTAAAGTAAGCTGGCC |
| 5041 | Table 1 | Hs.1432 | BG913430 | 14293906 | protein kinase C substrate 80K-H (PRKCSH), mRNA/cds = (136, 1719) | 1 | AGCAGGAGACAGCTTCCTGATCTAGA TGTACAATTAGAGTTTAGGTTGGA |
| 5042 | Table 1 | Hs.247474 | BG913498 | 14293974 | hypothetical protein FLJ21032 (FLJ21032), mRNA/cds = (235, 1005) | 1 | TGGAACTAGTCACAATTGAAGTTCTT CATCCAGTAGGTGTTAACAGTGT |
| 5043 | Table 1 | Hs.72988 | BI086609 | 14504939 | signal transducer and activator of transcription 2, 113 kD (STAT2), mRNA /cds = (57, 2612) | 1 | CCCACACAAGTGCGCCACATAAATCT GCGAGACTCCACGACAACACAGGG |
| 5044 | Table 1 | Hs.288036 | BI086741 | 14505071 | tRNA isopentenylpyrophosphate transferase (IPT), mRNA /cds = (60, 1040) | 1 | GCAAACAAGTTCTAAAGTTGTGGAGA AAAAGTGATGTGGTCAAGAGTTGA |
| 5045 | Table 1 | Hs.131887 | BI090806 | 14509136 | 602415255F1 cDNA, 5' end /clone = IMAGE:4523725/clone_end = 5' | 1 | GCCAGAAAGAGAAACGTAAAAA CAGATAGAGATTCTGCCTGTGCTT TGGT |
| 5046 | Table 1 | Hs.287797 | BI091791 | 14510121 | mRNA for FLJ00043 protein, partial cds/cds = (0, 4248) | 1 | GAGAGTTGCTGGTGTAAAATACGTTT GAAATAGTTGATCTACAAAGGCCA |
| 5047 | Table 1 | Hs.146381 | BI092128 | 14510458 | RNA binding motif protein, X chromosome (RBMX), mRNA /cds = (11, 1186) | 1 | GGTTAACGCTTCTGTGAGGACCTTCT GGCTCTTGAGATACCCTAAATATT |
| 5048 | Table 1 | Hs.75249 | BI092568 | 14510898 | mRNA for KIAA0069 gene, partial cds /cds = (0, 680) | 1 | ACTTTCATTGGTAAATAAGCCTGTCTT CCTATCTGGATTTTTGGTGTGCA |
| 5049 | Table 1 | Hs.73965 | BI093470 | 14511800 | splicing factor, arginine/serine-rich 2 (SFRS2), mRNA/cds = (155, 820) | 1 | CAGTTATTTAAAGGCTGACAACTGCC TTCCAGACCCGCGCTGTATTAATA |
| 5050 | Table 1 | Hs.104679 | BI094249 | 14512579 | *Homo sapiens*, clone MGC:18216 IMAGE:4156235, mRNA, complete cds /cds = (2206, 2373) | 1 | TGGTGGGTACAGAAACATTGTCACAG GGATCCTGGAACAGAGGAAGAGTT |
| 5051 | Table 1 | Hs.7905 | BI193299 | 14648319 | SH3 and PX domain-containing protein SH3PX1 (SH3PX1), mRNA /cds = (43, 1830) | 1 | TTCTGACCTAATAATTACGGGAAATG GAAAGTCTGGGCCAGCATCAATAA |
| 5052 | Table 1 | Hs.217493 | BI195901 | 14650921 | annaxin A2 (ANXA2), mRNA /cds = (49, 1068) | 1 | TGGGTCGGCAAAGCTATTATAACTTT GAATGCTAACGCATGTTTGACCT |
| 5053 | Table 1 | Hs.33026 | BI198202 | 14653223 | mRNA for FLJ00037 protein, partial cds/cds = (384, 3921) | 1 | GCTGTGTCCTTTCTGGCACAATCGGG GATTCCATTCTTTAGACACTGGAA |
| 5054 | Table 1 | Hs.179661 | BI222978 | 14676422 | *Homo sapiens*, tubulin, beta 5, clone MGC:4029 IMAGE:3617988, mRNA, complete cds/cds = (1705, 3039) | 1 | TTGACAAAGATGACATCGCCCAAGA GCCAAAAATAAATGGGAATTGAAA |
| 5055 | Table 1 | Hs.23158 | BI224666 | 14678110 | 600943902F1 cDNA, 5' end /clone = IMAGE:2966352/clone_end = 5' | 1 | GTAAAGATCAGAATACCAAGGCCAGC TAAGGCAACGACTCCCTCCCCAAA |
| 5056 | Table 1 | Hs.218387 | H03298 | 866231 | tc88c11.x1 cDNA, 3' end /clone = IMAGE:2073236/clone_end = 3' | 1 | ATACGGGACAATAAAATCTGCCTTTT GCTCTGGAGGGAGATACTACCTCT |
| 5057 | Table 1 | Hs.178703 | H56344 | 1004988 | AV716627 cDNA, 5' end /clone = DCBBCH05/clone_end = 5' | 1 | ATGCTGGTGTCATGTGACATTTGTTG AGTCTCGGGCATGTTCACGGTGGG |
| 5058 | Table 1 | NA | H57221 | 1010053 | yr08e08.r1 Soares fetal liver spleen 1NFLS cDNA clone IMAGE:204710 5', | 1 | GGAAATTGTGCCAAAACCATGGAAAA TATTACTGTGTGTGGGGTGTCTGT |

TABLE 8-continued

| SEQ ID | Origin | Unigene | Locus | GI | Nominal Description | Strand | Probe Sequence |
|---|---|---|---|---|---|---|---|
| 5059 | Table 1 | Hs.74002 | H81660 | 1059749 | mRNA sequence<br>mRNA for steroid receptor coactivator 1e/cds = (201, 4400) | 1 | TTTGTGTGTGAAATATAACATTGATTG AATTGCAGTTACATTTGGTTAGT |
| 5060 | Table 1 | Hs.5122 | N31700 | 1152099 | 602293015F1 cDNA, 5' end /clone = IMAGE:4387778/clone_end = 5' | 1 | AACATTCTACATAGCACAGGAGCTTA AGAGTGGCATTATCTTCTCGCCTT |
| 5061 | Table 1 | NA | R11456 | 764191 | yf46a09.r1 Soares fetal liver spleen 1NFLS cDNA clone IMAGE:129880 5' similar to gb|M87943|HUMAALU4 | 1 | TAAGGTTAGGCAATAACTTAGGGGTA TATTCTCTTCCTGCATCCCAGTGC |
| 5062 | Table 1 | Hs.208603 | R64054 | 835933 | 7f01d11.x1 cDNA, 3' end /clone = IMAGE:3293397/clone_end = 3' | 1 | TAAGGTGTTTGCTGGGGGATGTTGTG TGTATTAGGGGAGTGTTTCCCTTG |
| 5063 | Table 1 | NA | R85137 | 943543 | yo41c07.r1 Soares adult brain N2b4HB55Y cDNA clone IMAGE:180492 5', mRNA sequence | 1 | AAAACATTGCCAGACCATTTAGTCCT CTTGGAAGGGCCTCTCCGGTGGGG |
| 5064 | Table 1 | NA | T80378 | 698887 | yd05c01.r1 Soares infant brain 1NIB cDNA clone IMAGE:24693 5', mRNA sequence | 1 | CGGGGGAATAGGAGGAAAAACATGG CATGGAACAACCAACATAAAAGGT |
| 5065 | Table 1 | NA | T80854 | 703539 | yd22a08.r1 Soares fetal liver spleen 1NFLS cDNA clone IMAGE:108950 5', mRNA sequence | 1 | ACTGGTGTTGGTGCTTTTGTCTGTCA TACCATAGTATTTTCAAAACTTCA |
| 5066 | Table 1 | Hs.44189 | W00466 | 1271875 | yz99f01.s1 cDNA, 3' end /clone = IMAGE:291193/clone_end = 3' | 1 | CCTTGAGAAACACCCATCTCCACTTC CTAGACAAACCAATGAACATTAGT |
| 5067 | Table 1 | Hs.306117 | W18552 | 1290934 | capicua protein (CIC) mRNA, complete cds/cds = (40, 4868) | 1 | AACTGTGAGGCAAATAAAATGCTTCT CAAACTGTGTGGCTCTTATGGGGT |
| 5068 | Table 1 | Hs.17778 | W19201 | 1295429 | neuroplin 2 (NRP2), mRNA /cds = (0, 2780) | 1 | CTAAGTCATTGCAGGAACGGGGCTG TGTTCTCTGCTGGGACAAAACAGGA |
| 5969 | Table 1 | Hs.340717 | W25088 | 1302933 | we58c01.x1 cDNA, 3' end /clone = IMAGE:2345280/clone_end = 3' | 1 | GCCGTTCTTTATAGAACAATTCCTTTC TCTTCTCTTGAATGTGGCAGTCA |
| 5070 | Table 1 | Hs.8294 | W80882 | 1391906 | KIAA0196 gene product (KIAA0196), mRNA/cds = (273, 3752) | 1 | AGCCTACCTCCCTACCCCAAGCTGTC TGTTGAGAGCAGTGCTGACCCCAG |
| 5071 | Table 1 | Hs.133543 | AA251316 | 1886279 | EST378950 cDNA | −1 | TTTCATAAACCCACTCCTTCCTCTTCA CCCACTTGCAATCCGCATGCTTC |
| 5072 | Table 3A | Hs.96487 | AA524555 | 2265483 | 7q23106.s1 cDNA, 3' end /clone = IMAGE:3899226/clone_end = 3' | −1 | CAAGTTGGTTTAGTTATGTAACAACC TGACATGATGGAGGAAAACAACCT |
| 5073 | Table 3A | NA | AA628833 | 2541220 | af37g04.s1 Soares_total_fetus_Nb2HF8_9w cDNA clone IMAGE:1033878 3', mRNA sequence | −1 | GACTCGTTACGCCGTAGTTTGTCCTA TCTTGTTTATCAAATGAATTTCGT |
| 5074 | db mining | NA | AA701193 | 2704358 | zj80c03.s1 Soarses_fetal_liver_spleen_1NFLS_ S1 cDNA clone IMAGE:461188 3' similar to gb:M11124 HLA C | −1 | AGCCGCCCAGCTACTTAATCCCTCAG TAACATCTATCTAAATCTCCCATG |
| 5075 | Table 3A | Hs.307486 | AA729508 | 2750867 | nx54a03.s1 cDNA /clone = IMAGE:1266028 | −1 | TGGCCTGTGCTTTTACCACACCGTCA AACCCTTGATCATTTCTGTAAACA |
| 5076 | Table 3A | Hs.104157 | AA765569 | 2816807 | EST380899 cDNA | −1 | ACATTCTCATAGTCCAGGGGCTCAAC AACTTTGGCCTTTTCCAGCACCAC |
| 5077 | db mining | Hs.220649 | AA774984 | 2834318 | QV1-GN0320-051200-552-b08 cDNA | −1 | TCAGCAGTTGTGCCTTTTCTCACAGA TCCAGCCGTCCTTCTCGCTGTCAC |
| 5078 | db mining | Hs.192078 | AA884466 | 2993996 | te30h04.x1 cDNA, 3' end /clone = IMAGE:2087479/clone_end = 3' | −1 | TGCAAGCAATAAAATCTTGCTTTAATC AGTAACCACTGTCTGACAGGACA |
| 5079 | db mining | Hs.194249 | AA907080 | 3042540 | HOA43-1-G6.R cDNA | −1 | GGTCGTAGAGAAGACAGCAAGGGAG GGGATAAAACCCAGGAGGACTTAA |
| 5080 | Table 3A | Hs.143254 | AA961072 | 3127626 | EST388440 cDNA | −1 | GGCTCACGATGACAACCGCCTACGG AAAAACTCTAATTCCTAAACATCTA |
| 5081 | db mining | Hs.163271 | AF343666 | 13591717 | translocation associated fusion protein IRTA/IGA1 (IRTA1/IGHA1) mRNA, complete cds/cds = (136, 402) | −1 | GACAAGCCAGGTCAGCCCAGATTGC CAAAGCAGCACTTGCCTACACCAGC |
| 5082 | Table 3A | Hs.46476 | AI018105 | 3232624 | EST386846 cDNA | −1 | GGTTCCCTTGAAGCAGTGCCAACCTA AATCTACCTCAGGTAAGTAGTTAG |
| 5083 | Table 3A | Hs.238954 | AI031624 | 3249836 | 602637935F1 cDNA, 5' end /clone = IMAGE:4765448/clone_end = 5' | −1 | GCTGACAGTATGGAGGCTAAAGGTG TGGAGGAACCAGGAGGAGATGAGTA |
| 5084 | db mining | Hs.133261 | AI052754 | 3308745 | oy78e01.x1 cDNA, 3' end /clone = IMAGE:1671960/clone_end = 3' | −1 | CAAGTGTGCCGGGCAAGTTTGGGAA GGTGAAGCAATCTGTGACTTAAATA |
| 5085 | db mining | Hs.292803 | AI056470 | 3330336 | oy77d03.x1 cDNA, 3' end /clone = IMAGE:1671845/clone_end = 3' | −1 | GAGCTACTCAAGGGGAAAAAAGGGC ATATAGTATGCTCTGGTAGTAAAAGT |
| 5086 | db mining | Hs.6733 | AI057025 | 3330814 | phosphoinosilide-specific phospholipase C PLC-epsilon mRNA, complete cds/cds = (235, 7146) | −1 | GCTCAAGATCACCTCTTTGTCATCTT GAACAATGTTTTTCTCTTCTAGGT |

TABLE 8-continued

| SEQ ID | Origin | Unigene | Locus | GI | Nominal Description | Strand | Probe Sequence |
|---|---|---|---|---|---|---|---|
| 5087 | db mining | Hs.133930 | AI073993 | 3400637 | oy66d03.x1 cDNA, 3' end /clone = IMAGE:1670789/clone_end = 3' | −1 | TGGTGATAATAGAGATTGTTTCTGCC CTGGGGGTAGTTCAAGGATAACAC |
| 5088 | db mining | Hs.133949 | AI074528 | 3401172 | oy79d05.x1 cDNA, 3' end /clone = IMAGE:1672041/clone_end = 3' | −1 | CTTCAGGTTTGGCCCAGCCCCTCCTT GAAGACTCCTTCCATCCAGTCAAG |
| 5089 | db mining | Hs.134018 | AI076071 | 3405249 | oy80b11.x1 cDNA, 3' end /clone = IMAGE:1672125/clone_end = 3' | −1 | CCCAAGTGAAGTCAAAGTTACTGTGT GGTTGATAGGGAACATGGCTGGAT |
| 5090 | db mining | NA | AI081253 | 3418045 | oy67c02.x1 NCI_CGAP_CLL1 cDNA clone IMAGE:1670882 3' similar to gb:X64707 BREAST BASIC CONSERVED PR | −1 | ACCCGCAGACCAGATGGTTGAAAGG AAAAATTAAAGCCTTCTTGGGGATT |
| 5091 | db mining | Hs.134590 | AI081258 | 3418050 | oy67c11.x1 cDNA, 3' end /clone = IMAGE:1870900/clone_end = 3' | −1 | GGAGTTAGATCAACCTTATGGGGAAG GGAAAGGCAGGGCTTGTGACAATT |
| 5092 | Table 3A | Hs.105621 | AI084553 | 3422976 | HNC29-1-B1.R cDNA | −1 | GATGGCTGCTTGGTTGCTAAACCCAG ACAGGGTCCTTCCAGTGCATCTGC |
| 5093 | db mining | Hs.230775 | AI085588 | 3424011 | oy68d10.x1 cDNA, 3' end /clone = IMAGE:1670995/clone_end = 3' | −1 | CATTTGTGGGTGGAGGGTTTTGAATG TCCTCTTTCCATGTCAGGCAAAGG |
| 5094 | db mining | Hs.146591 | AI086023 | 3424446 | oy70f10.x1 cDNA, 3' end /clone = IMAGE:1671211/clone_end = 3' | −1 | TTCTATGAAGGTTTCCCTGGACAAGA AACTGCCAGAGAGCCCTTAGCTCA |
| 5095 | Table 3A | Hs.23158 | AI097125 | 3446707 | 600943902F1 cDNA, 5' end /clone = IMAGE:2968352/clone_end = 5' | −1 | TGCTGAATGTACCTGAGTGTATGTAT TTAAAAGGACTCACATGGGCATCA |
| 5096 | db mining | Hs.150708 | AI122689 | 3538455 | oy79f03.x1 cDNA, 3' end /clone = IMAGE:1672061/clone_end = 3' | −1 | TCTCAACCCTAATATTCATTGTTCCAT GAGCATTGTCAGGTTTTGGATGG |
| 5097 | db mining | Hs.326995 | AI144314 | 3668123 | oy64f01.x1 cDNA, 3' end /clone = IMAGE:1672537/clone_end = 3' | −1 | ACAAGTGGAAGAGGAAGACAGAAGA ATGGGTCAGGGAGATGCAAGGATGG |
| 5098 | db mining | NA | AI144317 | 3666126 | oy84f04.x1 NCI_CGAP_CLL1 cDNA clone IMAGE:1872543 3' similar to gb:X64707 BREAST BASIC CONSERVED PR | −1 | TCCTTAGGGAAAAGAAGATTTTCAAA CCCTTCGTTAGTTTCGGTAGGGCC |
| 5099 | db mining | NA | AI187859 | 3739068 | qe7h05.x1 Soares_testis_NHT cDNA clone IMAGE:1738329 3', mRNA sequence | −1 | ACGCAATTTGTTCACATACATACACAT GCAAATCCCAAAAGAAGGTTTTA |
| 5100 | Table 3A | Hs.121210 | AI204611 | 3757217 | EST384285 cDNA | −1 | CCCAGCCCTCTATGTACCCGTGTCCC AGCCAGCAATAAATGCCATCTTGG |
| 5101 | db mining | Hs.144814 | AI220630 | 3802833 | RST44972 cDNA | −1 | AGCCTGGAATTCTAAGCAGCAGTTTC ACAATCTGTAATTGCACGTTTCTG |
| 5102 | db mining | Hs.126580 | AI222355 | 3804558 | 602691805F1 cDNA, 5' end /clone = IMAGE:4824264/clone_end = 5' | −1 | TGGTTACTCATGTCCTCAAAGACGAC TCATGATGCTGGATATGAAGAACT |
| 5103 | Table 3A | Hs.36475 | AI243620 | 3839017 | EST372075 cDNA | −1 | AGGCAAAAGTCATTTCTTCCCTATATT TTGTCATGCTTATCTCCTGTCTC |
| 5104 | db mining | NA | AI283168 | 3871371 | qh49e10.x1 Soares_NFL_T_GBC_S1 cDNA clone IMAGE:1848042 3', mRNA sequence | −1 | GTATGAAGGCAAGAAAATTTCAGGGG AAAACAAGTGGTTATTTTCTGGCC |
| 5105 | Table 3A | Hs.158501 | AI290845 | 3933819 | 7q71b07.x1 cDNA, 3' end /clone = IMAGE:3703644/clone_end = 3' | −1 | GATACCCTCTTCCTAAGACTCATCGC GTCTCTTCCAGCCTCCTCGCCCCA |
| 5106 | db mining | Hs.150175 | AI301070 | 3960416 | qo16d04.x1 cDNA, 3' end /clone = IMAGE:1908679/clone_end = 3' | −1 | TCTGTATGCTGTGGTCTCATCAGGAA CCTTTTCTCTGCACTGCATTTTCC |
| 5107 | db mining | NA | AI356349 | 4107970 | qz26d12.x1 NCI_CGAP_CLL1 cDNA clone IMAGE:2028023 3' similar to contains MER7.b2 MER7 repetitive et | −1 | AGAGCTGGTTCCAGAAGGTTCGGAT GAGTCCTGAATGTTTATGTAGGGCA |
| 5108 | db mining | Hs.157560 | AI356388 | 4108009 | qz26e07.x1 cDNA, 3' end /clone = IMAGE:2028036/clone_end = 3' | 1 | TCCTTAGTCTCCTTCAATTTCCACACA CTGAACATGACATTTTACCCTTT |
| 5109 | db mining | NA | AI356470 | 4108091 | qz27b11.x1 NCI_CGAP_CLL1 cDNA clone IMAGE:2028093 3', mRNA sequence | −1 | TTTTCTGTTTTCTGTTTTAAGAAAATC TGGAACCGCAAGGCCGTCCCTTT |
| 5110 | db mining | Hs.157808 | AI381701 | 4113322 | qz18e09.x1 cDNA, 3' end /clone = IMAGE:2021896/clone_end = 3' | −1 | CCAAAGCCTTTGTTGTTTGGTGGCGA GGCCCCTTTTTGAATGGGGTTTTT |
| 5111 | db mining | Hs.327396 | AI381729 | 4113350 | qz24a08.x1 cDNA, 3' end /clone = IMAGE:2027798/clone_end = 3' | −1 | TGCCGCCCCCAGGATTCTTTTAAGAA TAAAAAGAAATGAGTGTGGACATG |
| 5112 | db mining | Hs.157811 | AI361733 | 4113354 | qz24b02.x1 cDNA, 3' end /clone = IMAGE:2027787/clone_end = 3' | −1 | CCTACGATATCCTTTTCAAATAGGGG TGGGTCCAGCCCCCTTGTGCCCTG |
| 5113 | db mining | Hs.270193 | AI361773 | 4113394 | qz19c05.x1 cDNA, 3' end | −1 | CTGGGAGAAAGGTACTTTGGGTTAGT |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2021960/clone_end = 3' | | GGTAGGGATAGGGATGAACGGGAA |
| 5114 | db mining | NA | AI364677 | 4124366 | qz05h09.x1 NCI_CGAP_CLL1 cDNA clone IMAGE:2020673 3', mRNA sequence | −1 | AGCATAATCCTAATGAGGAACTTTGT CTGAAGTCTGAGGCTGAGTTACTT |
| 5115 | db mining | Hs.327411 | AI364926 | 4124615 | qz23b07.x1 cDNA, 3' end /clone IMAGE:2027701/clone_end = 3' | −1 | TTTTGGAACCCTTAGCCCTGTGCAAA TCAAAGGATGTGAGGGGAAAAAGG |
| 5116 | db mining | Hs.157279 | AI364931 | 4124620 | qz23c04.x1 cDNA, 3' end /clone IMAGE:2027718/clone_end = 3' | −1 | ATTTCCCCTACGGATGGGACCAAGAA ACTGATGAGAACGGCCAAGTGTTT |
| 5117 | db mining | Hs.157280 | AI364944 | 4124633 | qz23d11.x1 cDNA, 3' end /clone IMAGE:2027733/clone_end = 3' | −1 | AACACCCGAAACCGTCTTCTGTGGCA TTTGTCAGTTGAAAAAGAACACCT |
| 5118 | db mining | Hs.283433 | AI365377 | 4125066 | qz08a02.x1 cDNA, 3' end /clone = IMAGE:2020874/clone_end = 3' | −1 | CCAGTGGCTGGGATGGTGACAGTGA CATCCACAGTAAACAGATGAAATGT |
| 5119 | db mining | Hs.304043 | AI365414 | 4125103 | 7e97a03.x1 cDNA, 3' end /clone = IMAGE:3293068/clone_end = 3' | −1 | GGATTTCAGAAACAGTTGCAGATATT ATTGATTAGCTAGTTGGCAGTGGG |
| 5120 | db mining | Hs.80426 | AI385418 | 4125107 | brain and reproductive organ-expressed (TNFRSF1A modulator) (BRE), mRNA/cds = (146, 1297) | −1 | CTTGTTCCAGGCCAGCCCCACACA GTAGGCAGTCATTAAGTTTGGTGA |
| 5121 | db mining | Hs.157310 | AI365460 | 4125149 | qz09e06.x1 cDNA, 3' end /clone = IMAGE:2021026/clone_end = 3' | −1 | TTTTCCTTCAACTCTTGCGACTTTCTT GGTCTGCCTGTGTGGTTTTAATA |
| 5122 | db mining | Hs.157311 | AI365473 | 4125162 | qz09f09.x1 cDNA, 3' end /clone = IMAGE:2021033/clone_end = 3' | −1 | TTCTGTTAATAGCAAACATTGCCTTTG AGTGCTACTACTAAACCTGAGGC |
| 5123 | db mining | NA | AI367021 | 4136766 | qz23h06.x1 NCI_CGAP_CLL1 cDNA clone IMAGE:2027771 3' similar to contains MSR1.t1 MSR1 repetitive el | −1 | TCTAGGGATCTGCCCGGCTCAAAATC CCAGGCCGTTAGGCTAAGTTGTTC |
| 5124 | db mining | Hs.296281 | AI368512 | 4147265 | interleukin enhancer binding factor 1 (ILF1), mRNA/cds = (197, 2164) | −1 | CGGACAAGGGCTGGCAGGTAAATGC CTTCAGTTTGTTGTTAAATAGAGGC |
| 5125 | db mining | Hs.327453 | AI378055 | 4187908 | tc79e11.x1 cDNA, 3' end /clone-IMAGE:2072396/clone_end = 3' | −1 | AGCCTTAGCCCCTTTAAAGCACTTAA AGTTACTACTTCCAAATGTGATTT |
| 5126 | db mining | NA | AI378091 | 4187944 | tc80a09.x1 NCI_CGAP_CLL1 cDNA clone IMAGE:2072440 3', mRNA sequence | −1 | ACCTTGTCATTAACAGCTCACTTTGAT TGAACATCTACTCTGTGGCGGTT |
| 5127 | db mining | Hs.158876 | AI378095 | 4187948 | tc80b01.x1 cDNA, 3' end /clone = IMAGE:2072425/clone_end = 3' | −1 | TGGAACGGCTATTTGCCGGTTAAAA ACCAAAAACCCCGGTTTTTCCCAAA |
| 5128 | db mining | Hs.283438 | AI378109 | 4187962 | 7f19bo3.x1 cDNA, 3' end /clone = IMAGE:3295085/clone_end = 3' | −1 | GTAAGGCAGACGAGAGAGGCGGAGG TCTCACAGTGAACCACAGGATCTGG |
| 5129 | db mining | Hs.158956 | AI380117 | 4189970 | tf98bo7.x1 cDNA, 3' end /clone = IMAGE:2107285/clone_end = 3' | −1 | TTGCCTGCCATGCCCTTATAAGTGCC CTTTAATGTCATAGCATGTAAAGG |
| 5130 | db mining | Hs.158967 | AI380252 | 4190105 | tf94d05.x1 cDNA, 3' end /clone = IMAGE:2106921/clone_end = 3' | −1 | GGGTTTGTGTCCCATTTAGAATCTG ATGAAACGGTGGGCTTTCCTTCTT |
| 5131 | db mining | Hs.158969 | AI380263 | 4190136 | tf99g02.x1 cDNA, 3' end /clone = IMAGE:2107442/clone_end = 3' | −1 | CAGAGCCTCCAGAATTATGTGAACTT GTCTCAAAACATTCTCTAAATGGC |
| 5132 | db mining | Hs.158971 | AI380329 | 4190182 | tf94g05.x1 cDNA, 3' end /clone = IMAGE:2106968/clone_end = '3' | −1 | GAAAGGACCCGAGGGTTTGTATTTAA AAAGCCTCCCCTGGGCCTCAAAAA |
| 5133 | db mining | Hs.309122 | AI380449 | 4190302 | tg02f12.x1 cDNA, 3' end /clone = IMAGE:2107631/clone_end = 3' | −1 | GCCAACTGCTTAGAAGCCCAACACAA CCCATCTGGTCTCTTGAATAAAGG |
| 5134 | db mining | Hs.302447 | AI380514 | 4190367 | tg01e02.x1 cDNA, 3' end /clone = IMAGE:2107514/clone_end = 3' | −1 | TGTCTAGAACAGACTGAGAGTGACAC GCATATTTGATTGTGAGGACAGTT |
| 5135 | db mining | Hs.231261 | AI380594 | 4190447 | tf95h06.x1 cDNA, 3' end /clone = IMAGE:2107067/clone_end = 3' | −1 | GTTTGGCCCCAAAGTGTTTAGGAGA GCTTCTCCCTAGATCGCCCTGTG |
| 5136 | db mining | Hs.158988 | AI380719 | 4190572 | tg03h03.x1 cDNA, 3' end /clone = IMAGE:2107733/clone_end = 3' | −1 | CCAGGAGGGCCAGAATTTGAAAATTC CTTGGGGTTGTTCTTTTTCCAAAA |
| 5137 | db mining | Hs.159000 | AI381037 | 4190890 | tg20h01.x1 cDNA, 3' end /clone = IMAGE:2109381/clone_end = 3' | −1 | CAGTTTGAGCAAAAGCCTTTGAAATC CAAGACTTTTCCCCTTGGGGTGCT |
| 5138 | db mining | Hs.159025 | AI381601 | 4194382 | td05g03.x1 cDNA, 3' end /clone = IMAGE:2074804/clone_end = 3' | −1 | CCAGTTGGTTTTTGGACTCCAAAGCC CAGGACCCTTCCAATCCTGCTTG |
| 5139 | db mining | NA | AI382670 | 4195451 | qz05f05.x1 NCI_CGAP_CLL1 cDNA clone IMAGE:2020641 3', mRNA sequence | −1 | AGGCCCTTTTCAAAGAAAAACC CCTTTGGGGAAAAAGGGAAAGGGC AAAA |
| 5140 | db mining | Hs.192078 | AI383475 | 4196256 | tc30h04.x1 cDNA, 3' end | −1 | TTTTGCTTGCTGTCGGGAGAATAAAG |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2087479/clone_end = 3' | | CAGGGAACCTTTATGTAGTGAAAA |
| 5141 | db mining | Hs.327467 | AI383510 | 4196291 | td03c10.x1 cDNA, 3' end /clone = IMAGE:2074578/clone_end = 3' | −1 | GGGTTTGGCCCGATTATATTAGGTTG GGTGGGGGAAAAATTTTATGGGGG |
| 5142 | db mining | Hs.105125 | AI383774 | 4196555 | 602639120F1 cDNA, 5' end /clone IMAGE:4762804/clone_end = 5' | −1 | GTGAACTGGATCTTGAGGCCGTGCT GGAAACCGGAAGGTACACTGCTTGG |
| 5143 | db mining | NA | AI383803 | 4196584 | tc98f01.x1 NCI_CGAP_CLLI cDNA clone IMAGE:2074201 3' similar to gb:J03626 URIDINE 5'- MONOPHOSPHATE | −1 | CAAAACTTGAGATAAGGTTAAAACTG TGCCCAGAGGAAAACTGGTAGTCT |
| 5144 | db mining | NA | AI384024 | 4196805 | td05b02.x1 NCI_CGAP_CLL1 cDNA clone IMAGE:2074731 3' similar to contains Alu repetitive element; con | −1 | TGCAGCCAGATTGTTCCAAGGTTGCC AATTACCTAGTGGGTAAATTTCCC |
| 5145 | Table 3A | Hs.107622 | AI391443 | 4217447 | tf96e06.x1 cDNA, 3' end /clone = IMAGE:2107138/clone_end = 3' | −1 | AGTGCTTATCATGAAATGTGCTTCAC TGGTTCAGCTCTGTTGTTTCCTTA |
| 5146 | db mining | Hs.160956 | AI391451 | 4217455 | tf96f03.x1 cDNA, 3' end /clone = IMAGE:2107133/clone_end = 3' | −1 | GTTATTTGGGAGACAAATGGACGGG CAGGAAGATTGATGCTCCGCTGTTC |
| 5147 | Table 3A | Hs.160959 | AI391500 | 4217504 | 602086202F1 cDNA, 5' end /clone = IMAGE:4250424/clone_end = 3' | −1 | AGCTGAAGGGCTTCAACTTTGCTTGG ATTTTTAATATTTTCCTTGCATA |
| 5148 | Table 3A | NA | AI392705 | 4222252 | tg23b03.x1 NCI_CGAP_CLL1 cDNA clone IMAGE:2109581 3', mRNA sequence | −1 | TGCAGGCTCATTGTGCTCCTTCTTCT GGGTTTCAATTGGATTTCAGTCCT |
| 5149 | db mining | Hs.160978 | AI392745 | 4222292 | tg08b05.x1 cDNA, 3' end /clone = IMAGE:2108145/clone_end = 3' | −1 | ATCTCTAATGAAGCCTAGGATCAGAT TTGTGGCATACCAACAGCACATGT |
| 5150 | db mining | Hs.160981 | AI392793 | 4222340 | tg04g01.x1 cDNA, 3' end /clone = IMAGE:2107824/clone_end = 3' | −1 | CCACAAGGGTTAGTTTGGGCCTTAAA ACTGCCAAGGAGTTTCCAAGGATT |
| 5151 | db mining | Hs.160982 | AI392799 | 4222346 | tg04g09.x1 cDNA, 3' end /clone = IMAGE:2107840/clone_end = 3' | −1 | CGCTTTATTCCCACGAAACCTAGGAC AGTGGCCATCAAACCGAGCGCTTT |
| 5152 | Table 3A | Hs.189031 | AI392805 | 4222352 | tg04h03.x1 cDNA, 3' end /clone = IMAGE:2107829/clone_end = 3' | −1 | CCTGTTGTGGCTGGCTGCATAATAAT TTCCAGGAGGCTTTCGGAAATGTT |
| 5153 | Table 3A | Hs.221014 | AI392814 | 4222361 | MR2-HT1162-180101-007-d08 cDNA | −1 | CGGTCCAGTCGGCTGCTTCCATTCCC TGAAGAAGAGGCCCTAAAGTTAAA |
| 5154 | Table 3A | Hs.168287 | AI392830 | 4222377 | tg10b09.x1 cDNA, 3' end /clone = IMAGE:2108345/clone_end = 3' | −1 | TTAGCCTCAAAGGGGTGGGAAAAG CCCATACCTCCTGGGCCAGTCCTAG |
| 5155 | db mining | Hs.276774 | AI392845 | 4222392 | tg10d01.x1 cDNA, 3' end /clone = IMAGE:2108353/clone_end = 3' | −1 | CCTTAGAATTAAGTTGAATTTTCCTGC CTTGCTAAGCAAGACTTCCTGCA |
| 5156 | Table 3A | Hs.159855 | AI392893 | 4222440 | tg05d07.x1 cDNA, 3' end /clone = IMAGE:2107885/clone_end = 3' | −1 | CAGCCACGGCCCCTCGCGTCTTCGC GGCACGTTAAATTAATGCGGAAAAC |
| 5157 | db mining | Hs.327469 | AI392990 | 4222537 | tg22f02.x1 cDNA, 3' end /clone = IMAGE:2109531/clone_end = 3' | −1 | TTTTACCCAAATTTTAAAGGCCGGAT AAAAGGGTTTTTGTTTGGAAGGGA |
| 5158 | db mining | Hs.230848 | AI392999 | 4222546 | tg22f11.x1 cDNA, 3' end /clone = IMAGE:2109549/clone_end = 3' | −1 | GGAGGTTAGGGCCTGAAGCTCAAAG CTCCCCCTTTTTAATAGTTTTTCCC |
| 5159 | db mining | NA | AI393006 | 4222553 | tg22g06.x1 cDNA, 3' end /clone = IMAGE:2109562/clone_end = 3' | −1 | CCCCTTTGGGCCCCCGGGTTTTCC CTTTTTGGTTTCGGGTTGTTTTTTG |
| 5160 | db mining | Hs.228891 | AI393017 | 4222564 | tg22h05.x1 cDNA, 3' end /clone = IMAGE:2109561/clone_end = 3' | −1 | ACGTGGGCCTTTGGACCCCTTATAAG ATGGTCATAAGACCCCAAAACTGA |
| 5161 | db mining | Hs.159706 | AI393038 | 4222585 | tg25b07.x1 cDNA, 3' end /clone = IMAGE:2109781/clone_end = 3' | −1 | ATGGCTATAAGGCCAAAAAAAGT TTGGCGGCATGGGGGATTTTTTGC TCTT |
| 5162 | Table 3A | Hs.160273 | AI393041 | 4222588 | tg25b10.x1 cDNA, 3' end /clone = IMAGE:2109787/clone_end = 3' | −1 | AGAGACGGCCACCTGAGACCAATTA GAATATCCACACCAGTGGAAGAGAG |
| 5163 | Table 3A | Hs.126265 | AI393205 | 4222752 | Homo sapiens, Similar to RIKEN cDNA 0610006H10 gene, clone MGC:9740 IMAGE:3853707, mRNA, complete cds/cds = (171, 1130) | −1 | GCCTCCCCAACCCCTGGCCTCAATTT CCCTTTCTATAAAATGGAAGATGT |
| 5164 | db mining | Hs.159718 | AI393217 | 4222764 | tg14c09.x1 cDNA, 3' end /clone = IMAGE:2108752/clone_end = 3' | −1 | ACACCCAGCCAAAGAAAAGCATACCT GAATCCAAGAGAGTATTTACACTG |
| 5165 | db mining | Hs.240635 | AI393223 | 4222770 | tg14d03.x1 cDNA, 3' end /clone = IMAGE:2108741/clone_end = 3' | −1 | CTCAGAGAAGAACAGTGTAGAA ACCCGCGCTGTGTGAAGCGAGGTT GGGC |
| 5166 | Table 3A | Hs.160401 | AI393906 | 4223453 | tg05f08.x1 cDNA, 3' end | −1 | ACTTTCCATTGTTGAGCTGGGGAGTT |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2107911/clone_end = 3' | | GGATTTTGTCCATTTGTTTTTATG |
| 5167 | Table 3A | Hs.340891 | AI393908 | 4223455 | wt30d11.x1 cDNA, 3' end /clone = IMAGE:2391765/clone_end = 3' | −1 | TCCCAGTGATGATTCGCTCCCTTTGT TAATTACTCAGTGTTTCTTGTTTT |
| 5168 | Table 3A | Hs.274851 | AI393960 | 4223507 | tg11d04.x1 cDNA, 3' end /clone = IMAGE:2108455/clone_end = 3' | −1 | TGCGTGCTGCTAATACTTAGGTACCC ATAATAGGTCTTTACACTCAGTTT |
| 5169 | Table 3A | Hs.160405 | AI393962 | 4223509 | tg11d08.x1 cDNA, 3' end /clone = IMAGE:2108463/clone_end = 3' | −1 | CCTGACCTTGAGGCATTTTGATTGT GCAGTTACCTAGGGTATGCTTGTG |
| 5170 | Table 3A | Hs.76239 | AI393970 | 4223517 | hypothetical protein FLJ20608 (FLJ20608), mRNA/cds = (81, 680) | −1 | GAGGACTGGGACCGTGATTCCACTA ACCGGAAACCGTCGCCTTTCGGGCC |
| 5171 | Table 3A | Hs.160408 | AI393992 | 4223539 | tg06c05.x1 cDNA, 3' end /clone = IMAGE:2107976/clone_end = 3' | −1 | GGGGAAGTCAAGGAGACACACACGC TCTTTCAACAGAATCAGCTCTTAAT |
| 5172 | Table 3A | Hs.244666 | AI394001 | 4223548 | tg06d04.x1 cDNA, 3' end /clone = IMAGE:2107975/clone_end = 3' | −1 | AACTAGATCCTGCCTTAGAAAACCTT TTGCCATGAATGACAAATTCATGT |
| 5173 | db mining | Hs.160410 | AI394009 | 4223556 | tg11e02.x1 cDNA, 3' end /clone = IMAGE:2108474/clone_end = 3' | −1 | TGTCAGCATCTGGAATAGTGTAAGTA TGCAGTGGAGGAAATCTCATCCTT |
| 5174 | db mining | Hs.160423 | AI394303 | 4223850 | tg09g11.x1 cDNA, 3' end /clone = IMAGE:2108324/clone_end = 3' | −1 | TTAACAGGACCTCTGGGCCACCAAG GAGAAAGGGCTGGGAAGCCAACAG |
| 5175 | Table 3A | Hs.159678 | AI394671 | 4224218 | tg24a07.x1 cDNA, 3' end /clone = IMAGE:2109684/clone_end = 3' | −1 | GTTCTGTGATAGTTTGTTTCCCCTCAT CTCCCTCACCTCTGCCTGGGTTG |
| 5176 | db mining | Hs.228337 | AI394690 | 4224237 | tg24c06.x1 cDNA, 3' end /clone = IMAGE:2109706/clone_end = 3' | −1 | GGCCCCTCCTTTTGCTGGAGAGTTT TTATAAACTGGAGCCCGATTTCAT |
| 5177 | db mining | Hs.159682 | AI394730 | 4224277 | tg24g04.x1 cDNA, 3' end /clone = IMAGE:2109750/clone_end = 3' | −1 | GGGCTTTTTCTTCCCCTAATCAGGGT GACCTGGGCCTTTTGGGCAGGATC |
| 5178 | db mining | Hs.159683 | AI394733 | 4224280 | tg24g09.x1 cDNA, 3' end /clone = IMAGE:2109760/clone_end = 3' | −1 | AAGGAGGGGAGTGAATGATATTGCT GTCATTTCTCAGCAAATCATAGTGA |
| 5179 | db mining | Hs.177146 | AI399977 | 4243064 | tg92e06.x1 cDNA, 3' end /clone = IMAGE:2116258/clone_end = 3' | −1 | TAAATTCTCTGTGGGAAAAAGCCTG CCAATAAAATGGGGGTTTTTGGGC |
| 5180 | Table 3A | Hs.225567 | AI400714 | 4243801 | tg93g12.x1 cDNA, 3' end /clone = IMAGE:2116390/clone_end = 3' | −1 | ACAGACTAAGCTGGTTTGGTGGATTC ATCTTTCACTTATGAAGAAAGCAG |
| 5181 | db mining | NA | AI400725 | 4243812 | tg93h12.x1 NCI_CGAP_CLL1 cDNA clone IMAGE:2116391 3' similar to contains TAR1.t1 MER22 repetitive e | −1 | CCCAAAGCCTGGGGGGTTTGGCCCA AACCTTCCCCCTGGTTTTTATAAAA |
| 5182 | db mining | Hs.224409 | AI400798 | 4243883 | IL3-ET0114-011100-330-F11 cDNA | −1 | ACTGCTTTCAAGAAAGTGGGACCAGT GGCATTGTAGCCACCATAATCACT |
| 5183 | db mining | Hs.174778 | AI400826 | 4243913 | th10g11.x1 cDNA, 3' end /clone = IMAGE:2117924/clone_end = 3' end | −1 | GCCCTTGGCAAATGATTTGAGACCCC TTTTGAAAACCATGTAGGATGAAT |
| 5184 | db mining | Hs.270294 | AI401001 | 4244088 | tm29d11.x1 cDNA, 3' end /clone = IMAGE:2158005/clone_end = 3' | −1 | CACACAGCAGTGGCTTGGGGATGAG GAAGGAAGGGAGAATCTCAACGGAG |
| 5185 | db mining | Hs.224178 | AI401179 | 4244286 | tg26g11.x1 cDNA, 3' end /clone = IMAGE:2109956/clone_end = 3' | −1 | TTTTTCTGTGAGTTAGGGGCATGGAG GCGGCAGTGTTGGGAGCTGGAGCC |
| 5186 | db mining | Hs.175338 | AI401184 | 4244271 | 7o18b08.x1 cDNA, 3' end /clone = IMAGE:3574239/clone_end = 3' | −1 | AGTTGGCTCTAGTTTAAAGATATAAAT ACGTACCTCACTTAAACCCCATGT |
| 5187 | db mining | Hs.327913 | AI401303 | 4244390 | tg92d01.x1 cDNA, 3' end /clone = IMAGE:2116225/clone_end = 3' | −1 | CTTCAGGCCCAAGTTCAACGGGTAA AGAGGTCCGCTCCCAAATTATTCT |
| 5188 | db mining | Hs.159693 | AI417000 | 4260504 | th02f02.x1 cDNA, 3' end /clone = IMAGE:2117115/clone_end = 3' | −1 | GTCCCAGTAGCCCCATTTCAGGGCTT GCTAGTTACATGGGTTTGTGTTTA |
| 5189 | Table 3A | Hs.79968 | AI419082 | 4265013 | splicing factor 30, survival of motor neuron-related (SPF30), mRNA /cds = (0, 716) | −1 | GGATGTGTGATGTTTATATGGGAGAA CAAAAAGCTGATGTATAGCCCTGT |
| 5190 | Table 3A | Hs.131067 | AI421806 | 4267737 | yf85b05.s1 cDNA, 3' end /clone = IMAGE:231057/clone_end = 3' | −1 | CAATTTCCACCTCTAAGGGGGTCGG GAAAGGCACGCTGAGGGTGAATATG |
| 5191 | Table 3A | Hs.159103 | AI431873 | 4306229 | tc97d09.x1 cDNA, 3' end /clone = IMAGE:2074097/clone_end = 3' | −1 | GCTTTCAAATGAATTTCAGGGCTTTC TTTGAAGCAGTCTTGTAAAGTTGT |
| 5192 | Table 3A | Hs.254006 | AI432340 | 4309500 | tg54e06.x1 cDNA, 3' end /clone = IMAGE:2112610/clone_end = 3' | −1 | TCCTTTCTGGATACCAGGAATCACTT AAAAATCTGTGTATAATGCCCCCA |
| 5193 | db mining | Hs.283442 | AI435240 | 4301796 | ti02a80.x1 cDNA, 3' end | −1 | AAACAGGGAACGACAGGAAAAAGAT |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2129270/clone_end = 3' | | GACCGTGATACACTCTGCTAAAAGC |
| 5194 | db mining | Hs.327548 | AI435268 | 4301992 | ti02d10.x1 cDNA, 3' end /clone = IMAGE:2129299/clone_end = 3' | −1 | CCCCCCCGGCTTCCCCCTTTTTTCCC CGCCCGTTTTTTTGGGGGAATGGG |
| 5195 | Table 3A | NA | AI436418 | 4281540 | ti01h02.x1 NCI_CGAP_CLL1 cDNA clone IMAGE:2129235 3' similar to SW:SYB2_HUMAN P19065 SYNAPTOBREVIN | −1 | GGCCATGCCGGGCCAGCCCCACCTG AAGCTCAGTGAAAGCTGATTAAAAA |
| 5196 | Table 3A | Hs.165703 | AI438561 | 4282683 | ti03b03.x1 cDNA, 3' end /clone = IMAGE:2129357/clone_end = 3' | −1 | CGCAGGACTCTAAAGATCCAAGCTCA CAAAACACTCCAAATCCACCTCGA |
| 5197 | Table 3A | Hs.111377 | AI436587 | 4282890 | AL562032 cDNA /clone = CS0DL003YA06-(3-prime) | −1 | AACTTTACTTCTGTTCTTGGCAGGAC ATGGAGAGAGGGAGGGATTCCAAA |
| 5198 | db mining | Hs.283443 | AI436589 | 4282906 | 7f34g01.x1 cDNA, 3' end /clone = IMAGE:3296592/clone_end = 3' | −1 | GGGTGATAATTGAGGGTGCCGCTGG GAAGGTCCGAGAATGGGTTTTCATG |
| 5199 | Table 3A | Hs.257066 | AI438957 | 4300957 | UI-H-BI3-aka-h-10-0-UI.s1 cDNA, 3' end/clone = IMAGE:2733930 /clone_end = 3' | −1 | GTTCATTGCTGTTCAGAGTGTTGCTG CTGTGGTGCTATAAATGCTCCCAG |
| 5200 | db mining | Hs.165701 | AI438979 | 4301111 | tc89d11.x1 cDNA, 3' end /clone = IMAGE:2073333/clone_end = 3' | −1 | TATTCCACCAGTGAGCTACACTCCCG GCCCCTTTAGTGTTGTTTGTAAAC |
| 5201 | db mining | Hs.165702 | AI438980 | 4301118 | tc89d12.x1 cDNA 3' end /clone = IMAGE:2073335/clone_end = 3' | −1 | CCGTGTTGTGGCAAAATGGTCCCTG GAGTTTTTGACCCTGTGTTAAAGA |
| 5202 | db mining | Hs.327566 | AI439020 | 4301397 | tc89e05.x1 cDNA, 3' end /clone = IMAGE:2073344/clone_end = 3' | −1 | TTTTTTGGGGCCGAAAACCCCCAATG AGGGGGATTAAAGCTGTTTTCCCC |
| 5203 | db mining | Hs.327567 | AI439044 | 4301565 | tc89h03.x1 cDNA 3' end /clone = IMAGE:2073365/clone_end = 3' | −1 | GGGGTTGTCCTTTTCCCACCCTGATG GGGAATTTATGGATGGGTTTCCTT |
| 5204 | db mining | Hs.165704 | AI439060 | 4301677 | tc84f07.x1 cDNA, 3' end /clone = IMAGE:2072869/clone_end = 3' | −1 | AAATGAGTGACCAAAACACTTCTGTA CCACTTCTGTGAGCTGAGGTCCAG |
| 5205 | Table 3A | Hs.165681 | AI439580 | 4305318 | QV3-DT0043-211299-044-d03 cDNA | −1 | AGGAACCTAAAGAAACTGCCAAGTGT AGATAAGCATTGAGTATGTTACCC |
| 5206 | db mining | NA | AI439601 | 4305465 | tc85d10.x1 NCI_CGAP_CLL1 cDNA clone IMAGE:2072947 3', mRNA sequence | −1 | GGTTGTCCAGTTTTCGGTTTTTAACG CCCCCCATAGGGGATTTGGCCCCC |
| 5207 | Table 3A | Hs.192463 | AI439633 | 4305688 | 7q86c05.x1 cDNA, 3' end /clone = IMAGE:3705201/clone_end = 3' | −1 | GTTTTGGAATCAGGAATGATTTTTCTA AGCCTGACATCAGATGTCTGACA |
| 5208 | db mining | Hs.165732 | AI439643 | 4305758 | tc91e06.x1 cDNA, 3' end /clone = IMAGE:2073538/clone_end = 3' | −1 | GAAATTCTCCCCTTTTCCCCTCTCCTT CCCTTCTGCTGACCTGTTCTCAG |
| 5209 | Table 3A | Hs.255490 | AI439645 | 4305772 | tc91e08.x1 cDNA, 3' end /clone = IMAGE:2073542/clone_end = 3' | −1 | CACAGAGGGAGTGTGCAGGGCCAGA TTTCATCCTGGGGCCACGCTGAAAT |
| 5210 | Table 3A | Hs.9614 | AI440234 | 4281195 | Nucleophosmin (probe bad, mutations, wrong clone used) (nucleolar phosphoprotein B23, nurnatrin) | −1 | TGATAGGACATAGTAGTACGGGTGGT CAGACATGAAAATGGTGGGAGCC |
| 5211 | Table 3A | Hs.309279 | AI440337 | 4282020 | tc88b03.x1 cDNA, 3' end /clone = IMAGE:2073197/clone_end = 3' | −1 | CAATACCTACCCCAGTGGCAGCCG CCTGCTCCTCATGACCCAAGTAAGT |
| 5212 | Table 3A | Hs.89104 | AI440491 | 4300600 | 602590917F1 cDNA, 5' end /clone = IMAGE:4717348/clone_end = 5' | −1 | TGTTTTAACAACTCTTCTCAACATTTT GTCCAGGTTATTCCCTGTAACCA |
| 5213 | Table 3A | Hs.59844 | AI440512 | 4300747 | tc83f09.x1 cDNA, 3' end /clone = IMAGE:2072777/clone_end = 3' | −1 | TAAGTGTCAGGTTGTGGGGAAGGTT ATTCTTGCCTTGTGTATTTTGTCC |
| 5214 | Table 3A | Hs.327610 | AI452611 | 4286566 | tj27g07.x1 cDNA, 3' end /clone = IMAGE:2142760/clone_end = 3' | −1 | CAAACCCCTATCCCCCATTCTCCTCC TATCCCTCAACCCCGACATCATTA |
| 5215 | Table 3A | Hs.121973 | AI458739 | 4311318 | 602428025F1 cDNA, 5' end /clone = IMAGE:4547239/clone_end = 5' | −1 | CCTGCAACAGCTAAGGCCAAGCCAA ACTTACCGTGGACTCAAACACTTTG |
| 5216 | Table 3A | Hs.86437 | AI469584 | 4331674 | 602411368F1 cDNA, 5' end /clone = IMAGE:4540098/clone_end = 5' | −1 | TGAATTTGGAGTCCCTGGCACATAAA TCTACCTTCAAATCAGAGGTCCTT |
| 5217 | Table 3A | Hs.149095 | AI471868 | 4333956 | ti67d04.x1 cDNA, 3' end /clone = IMAGE:2137063/clone_end = 3' | −1 | TCCCACCCCTTTTCTACTGAATTTGT GGGGATCCTATAATAAAAGTGAAT |
| 5218 | Table 3A | Hs.303682 | AI472078 | 4334168 | tj85h03.x1 cDNA, 3' end /clone = IMAGE:2148341/clone_end = 3' | −1 | ACTACCAGAGCCCTAGGACTTCTGAG CACATTTAGAAAATACCAGAGGCA |
| 5219 | db mining | Hs.170772 | AI472328 | 4334416 | tj87c09.x1 cDNA, 3' end /clone = IMAGE:2148496/clone_end = 3' | −1 | CATGTCAGAGTTCTTAACAGAAAGCA AAGGTTTCCAACAGCACTTGCATT |

TABLE 8-continued

| SEQ ID | Origin | Unigene | Locus | GI | Nominal Description | Strand | Probe Sequence |
|---|---|---|---|---|---|---|---|
| 5220 | Table 3A | Hs.78746 | AI474074 | 4327119 | cAMP-specific phosphodiesterase 8A (PDE8A) mRNA, partial cds /cds = (0, 2141) | −1 | ATGAAATCTCATGGGGCCAAACTGCA CATCAGCTACTGCTACCTTCTTGC |
| 5221 | db mining | NA | AI475527 | 4328572 | tc85g07.x1 NCI_CGAP_CLL1 cDNA clone IMAGE:2072988 3', mRNA sequence | −1 | CCCTGTGGCAACTTGTGGGTACGGTT TAACTGGACCACGCTGAGCTTCT |
| 5222 | db mining | Hs.292501 | AI75611 | 4328656 | 7f03g08.x1 cDNA, 3' end /clone = IMAGE:3293630/clone_end = 3' | −1 | AGAAATAGTGTTTCTCGGAAGCTCAG TTTGGAGCTGACTGCACACGTTGC |
| 5223 | Table 3A | Hs.300759 | AI475653 | 4328698 | ribosomal protein L36 (RPL36), mRNA /cds = (145, 482) | −1 | GTTGCTGGCTGCCCTCCCCTGCACT CTCCCTGAAATAAAGAACAGCTTGG |
| 5224 | db mining | Hs.300759 | AI475653 | 4328698 | ribosomal protein L36 (RPL36), mRNA /cds = (145, 482) | −1 | GTTGCTGGCTGCCCTCCCCTGCACT CTCCCTGAAATAAAGAACAGCTTGG |
| 5225 | Table 3A | NA | AI475668 | 4326711 | tc93c06.x1 NCI_CGAP_CLL1 cDNA clone IMAGE:207310 3', mRNA sequence | −1 | ACGTGTCAGACACAATCCTGAGCCTT CTACAAGTGTTCCCTCTTACTCCT |
| 5226 | db mining | NA | AI475678 | 4328723 | tc93d10.x1 NCI_CGAP_CLL1 cDNA clone IMAGE:2073715 3' similar to gb:M92287 G1/S-SPECIFIC CYCLIN D3 ( | −1 | AAGCCCTGTTACCCAGGTTTTTCTT AAGGCGAGAAGGTTTAGGGTGGTG |
| 5227 | Table 3A | Hs.105678 | AI475680 | 4328725 | tc93d12.x1 cDNA, 3' end /clone = IMAGE:2073719/clone_end = 3' | −1 | GAGAAAGCTCCCAGTCTGTCTTTCCC AACATCCCTTCAGTTTCAATAAGC |
| 5228 | db mining | Hs.170338 | AI475882 | 4328727 | tc93e03.x1 cDNA, 3' end /clone = IMAGE:2073724/clone_end = 3' | −1 | TTCAGGTGAGTGTGCCTGGAGGTGG AGAACTATGGTTTTGATAACTTGGC |
| 5229 | Table 3A | Hs.236030 | AI475694 | 4328739 | SWI/SNF related, matrix associated, actin dependent regulator of chromatin, subfamily c. member 2 (SMARCC2), mRNA/cds = (22, 3663) | −1 | AAGGTGCCATGTATTGAAAGTGTGCG TCAAAGAACATAAATATCAGTGGA |
| 5230 | db mining | NA | AI475735 | 4328780 | tc86g02.x1 NCI_CGAP_CLL1 cDNA clone IMAGE:2073074 3', mRNA sequence | −1 | TGTAATTATTTTCTGTATGTTCAAGAA GGTAAAGGAAAGGACAGCTATGGGA |
| 5231 | db mining | Hs.327640 | AI475806 | 4328851 | tc94g03.x1 cDNA, 3' end /clone = IMAGE:2073844/clone_end = 3' | −1 | ATTTATTTGGGGTTGGTCCCCCCTTT GGGCCCCCCGGGTTTTCCCTTTTTT |
| 5232 | db mining | Hs.170586 | AI475815 | 4328860 | tc94h02.x1 cDNA, 3' end /clone = IMAGE:2073843/clone_end = 3' | −1 | AACCATAAAAGGCCCGTTTGGTTAGT TTTCCCTGTTTCCTGGTTTGGGCT |
| 5233 | Table 3A | Hs.105052 | AI475827 | 4328872 | adaptor protein with pleckstrin homolog and src homology 2 domains (APS), mRNA/cds = (127, 2025) | −1 | TTATGGGGTAACTCACTTTGGGCGGC ACGAAGAACTCCAGGCGGAAGCGT |
| 5234 | db mining | Hs.258864 | AI475833 | 4328878 | tc87b01.x1 cDNA, 3' end /clone = IMAGE:2073097/clone_end = 3' | −1 | TCTCTCCCCATCCCAAGTCATCCAGC CCTTTTTCCTACCCTCAATAAACC |
| 5235 | Table 3A | Hs.170587 | AI475884 | 4328929 | tc95c12.x1 cDNA, 3' end /clone = IMAGE:2073910/clone_end = 3' | −1 | CCCCCTGATGGACTTCAAATATGTCT CATCAACTACAGTATTAAATGCCA |
| 5236 | Table 3A | Hs.170588 | AI475905 | 4328950 | tc95f06.x1 cDNA, 3' end /clone = IMAGE:2073923/clone_end = 3' | −1 | CGAGAATGCCTAGGGAAACCAGCTA CGCTTACAAGCCAGCTACGCAGCCC |
| 5237 | db mining | Hs.170589 | AI475909 | 4328954 | tc95f10.x1 cDNA, 3' end /clone = IMAGE:2073931/clone_end = 3' | −1 | GGAAACATTGGCCTGGGGGTGTCCC CCAAAAGGGGGCCGTTTTTAAAGGG |
| 5238 | db mining | NA | AI475926 | 4328971 | tc95h10.x1 NCI_CGAP_CLL1 cDNA clone IMAGE:2073955 3' similar to gb:M59849 FIBRILLARIN (HUMAN):, mRN | −1 | TGGGTTGACATTGTTCGCACGGGGT GTTTCTTATATTAAAAAGACTCACT |
| 5239 | Table 3A | NA | AI478558 | 4371782 | tm53e03.x1 NCI_CGAP_Kid11 cDNA clone IMAGE:2161852 3', mRNA sequence | −1 | CTTTCCACAAAATAATCGATAACCTTG GGGGATTGTTTTATGGCTTGACA |
| 5240 | db mining | NA | AI479016 | 4372184 | tm29h05.x1 NCI_CGAP_CLL1 cDNA clone IMAGE:2158041 3' similar to gb:X58141_ma1 ERYTHROCYTE ADDUCIN | −1 | CCGCCTTGGGGAGACAGGTCTTGAT TGTCTTTTTCCCAGTGAACATTGTT |
| 5241 | Table 3A | Hs.170784 | AI479022 | 4372190 | tm30a05.x1 cDNA, 3' end /clone = IMAGE:2158064/clone_end = 3' | −1 | TCCCAGACTTTCAGGAAAGTAACTGT AGCACTGTTAATATCACAACAACA |
| 5242 | db mining | Hs.187200 | AI479029 | 4372197 | tm30b08.x1 cDNA, 3' end /clone = IMAGE:2158067/clone_end = 3' | −1 | TTTTAGCTGGGAGTGGGGGACTAT GGGGAATAACTTTCCTTCATTTAAT |
| 5243 | Table 3A | Hs.337139 | AI479075 | 4372243 | tm30h01.x1 cDNA, 3' end /clone = IMAGE:2158129/clone_end = 3' | −1 | ACATGTGTGTGTTTTCCATGAGGCAC TGCTTTTTATGCATTTCCCTCCCC |
| 5244 | db mining | NA | AI479094 | 4372262 | tm31b02.x1 NCI_CGAP_CLL1 cDNA clone IMAGE:2158155 3' similar to contains TAR1.t1 MER22 repetitive e | −1 | CTGTATTTGAAGTCAGCAGGGCTCAG CAGGATTTGACCGACAGTTACCTC |

TABLE 8-continued

| SEQ ID | Origin | Unigene | Locus | GI | Nominal Description | Strand | Probe Sequence |
|---|---|---|---|---|---|---|---|
| 5245 | db mining | Hs.185498 | AI479659 | 4372827 | tm32h04.x1 cDNA, 3' end /clone = IMAGE:2158327/clone_end = 3' | −1 | TGGTTTATAGATGCACTTCCTTTCATA GGCAGTCCCTGGCACTTTCTTGC |
| 5246 | Table 3A | Hs.170909 | AI492034 | 4393037 | tg06f12.x1 cDNA, 3' end /clone = IMAGE:2108015/clone_end = 3' | −1 | AGGAGCTGGTATTATTGGAGGGTATT ATAGATCCAGTGTATTGTGACTGT |
| 5247 | db mining | NA | AI492041 | 4393044 | tg06g08.x1 NCI_CGAP_CLL1 cDNA clone IMAGE:2108030 3' similar to gb:L23320 ACTIVATOR 1 140 KD SUBUNI | −1 | GCAGTAGTGCTAAGGCGTCTTTTGTA GGCTTTAGATTTTGTCGTTATGGC |
| 5248 | Table 3A | Hs.119923 | AI492068 | 4393069 | tg12b03.x1 cDNA, 3' end /clone = IMAGE:2108525/clone_end = 3' | −1 | GCTTGTCAGAACAGAAGATATTTCCA CCCTGCCTAGTAGATGTGTTTCAG |
| 5249 | db mining | Hs.327698 | AI492127 | 4393130 | tg07d04.x1 cDNA, 3' end /clone = IMAGE:2108071/clone_end = 3' | −1 | CCCCCGTTTTAGGTTAGGGCCTTGG GCAGGGGTTTGCCCCCTGTTACCCC |
| 5250 | db mining | Hs.170912 | AI492164 | 4393167 | tg12h01.x1 cDNA, 3' end /clone = IMAGE:2108593/clone_end = 3' | −1 | TTGGTTTTATTTATCCAAAACTGAGCC TTCTCATAGGCTTACACCCGGA |
| 5251 | Table 3A | Hs.341634 | AI492181 | 4393184 | wt85e01.x1 cDNA, 3' end /clone = IMAGE:2514264/clone_end = 3' | −1 | GGCAGGCTCTAGCCACCCTGTCGGT TCCCAATAAGCCATTTATTGAATAA |
| 5252 | Table 3A | Hs.276903 | AI492640 | 4393643 | qz18a06.x1 cDNA, 3' end /clone = IMAGE:2021842/clone_end = 3' | −1 | TTTTTGACCAGTCTACATTTCGTATCT GTGGGATCTGCATTTGTGAATTC |
| 5253 | db mining | Hs.170933 | AI492648 | 4393651 | qz18b06.x1 cDNA, 3' end /clone = IMAGE:2021843/clone_end = 3' | −1 | TCTGGACAATGTTGATGCTAACCTTG ATGATATCCATCCCTATTACTGGG |
| 5254 | db mining | NA | AI492653 | 4393656 | qz18c02.x1 NCI_CGAP_CLL1 cDNA clone IMAGE:2021858 3' similar to contains Alu repetitive element;, m | −1 | AGGACATGAAGGTCTGAAAAAG AAACAGGAAAATACAGACATCCCC GCTT |
| 5255 | Table 3A | Hs.170331 | AI492865 | 4393888 | th78a05.x1 cDNA, 3' end /clone = IMAGE:2124752/clone_end = 3' | −1 | AAGTCAAGGAACCCTCTCGGGTCTCT GAGATCCAGGCCAACAGTAACAG |
| 5256 | db mining | Hs.327702 | AI193426 | 4394429 | tg91a07.x1 cDNA, 3' end /clone = IMAGE:2116116/clone_end = 3' | −1 | AGGGGGCTTTAAAATTTAAAAATTGC CTTTTGTTTTAAAAAAGGCCCATGT |
| 5257 | Table 3A | Hs.276907 | AI493726 | 4394729 | qz12f08.x1 cDNA, 3' end /clone = IMAGE:2021319/clone_end = 3' | −1 | CCCCCTCCCACCCAAAGAAAAAGAAA TGGTAACTACCTGGACAAAACATT |
| 5258 | db mining | Hs.342652 | AI493740 | 4394743 | yi60c05.r1 cDNA, 5' end /clone = IMAGE:143824/clone_end = 5' | −1 | CCCTTGGCTCTTATTGTTCTTGCTGG TGTGGTATGTTCCCGGCTGAAAAA |
| 5259 | db mining | NA | AI494343 | 4395346 | qz14a10.x1 cDNA, 3' end /clone = IMAGE:2021466/clone_end = 3' | −1 | TTCCCCTTTTTTCCCCTTTTTTAAAA AGCCCCTTTTTAAATGGGGCGC |
| 5260 | db mining | Hs.283456 | AI494542 | 4395545 | 7f12b08.x1 cDNA, 3' end /clone = IMAGE:3294423/clone_end = 3' | −1 | AAGGACAGCTTGCTTGCTGATGAACA CTTCCACAGTCTTTTGAGCTAAGT |
| 5261 | Table 3A | Hs.171009 | AI494612 | 4395615 | RST42450 cDNA | −1 | ACATGAGAATTAACCATGTCCAGTAG TTAAGTTCATTTTCCTACAGTGTGC |
| 5262 | Table 3A | Hs.342008 | AI498316 | 4390298 | UI-H-BI1-aeq-b-02-UI.s1 cDNA, 3' end/clone = IMAGE:2720186 /clone_end = 3' | −1 | GCCAGAATGGTACAGAGTGGAGGGT GTTCTGCTAATGACTTCAGAGAAGT |
| 5263 | Table 3A | Hs.169541 | AI523598 | 4437733 | th08g11.x1 cDNA, 3' end /clone = IMAGE:2117732/clone_end = 3' | −1 | GCACAACTTCTGGGAATCTAGTGGCT GTATGTTAAGCATCGGTAAAAGA |
| 5264 | db mining | Hs.171098 | AI523617 | 4437752 | tg95b03.x1 cDNA, 3' end /clone = IMAGE:2116493/clone_end = 3' | −1 | AAAAAGGCCCCTTGTTTGTTGGTTTT TGGCCCGTTGGGGAAAATGCCTGT |
| 5265 | db mining | Hs.264120 | AI523641 | 4437776 | 601436078F1 cDNA, 5' end /clone = IMAGE:3921187/clone_end = 5' | −1 | TTTAGGAGCTGACCATACATGATGAG TGATACAGCCTGTACTTTGCTCAT |
| 5266 | Table 3A | Hs.309484 | AI523766 | 4437901 | tg94f07.x1 cDNA, 3' end /clone = IMAGE:2116453/clone_end = 3' | −1 | GGTTTCCCACGAACGGGAGGCTGCT GAAGAGTCAAAGCCTGGGCAGACTC |
| 5267 | db mining | NA | AI523780 | 4437915 | tg94h09.x1 NCI_CGAP_CLL1 cDNA clone IMAGE:2116481 3' similar to gb:M15059 LOW AFFINITY IMMUNOGLOBUL | −1 | CAGGTCATGAGTATTCCAAGCTCAGG TGGTGAGTCCTCCTCACCGGGATG |
| 5268 | db mining | Hs.171108 | AI523790 | 4437925 | tg96b01.x1 cDNA, 3' end /clone = IMAGE:2116585/clone_end = 3' | −1 | AAAGGGAAACTGGCTCTGGCACCAC CTACTGGAGACCAAACTTCACCAAA |
| 5269 | Table 3A | Hs.194054 | AI523854 | 4437989 | HA0669 cDNA | −1 | GACAAAATAGTTACCTATGCTTTCCTT CTGGCACCCCGAATGTACGCAGG |
| 5270 | Table 3A | Hs.228926 | AI523873 | 4438008 | tg97c12.x1 cDNA, 3' end /clone = IMAGE:2116726/clone_end = 3' | −1 | ATCTGACCTGAGGGAGATCACAATG CCTTCTGTATTGGGTGGTAATGAT |
| 5271 | db mining | Hs.207993 | AI523884 | 4438019 | tg97e12.x1 cDNA, 3' end | −1 | TCCGTTGTAACACATCTAATGTGAAC |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2116750/clone_end = 3' | | GCATTATAAACATGGACCTGTACT |
| 5272 | db mining | NA | AI523904 | 4438039 | tg97h03.x1 NCI_CGAP_CLL1 cDNA clone IMAGE:2116757 3' similar to SW:MKK2_HUMAN P49137 MAP KINASE-ACT | −1 | ACATAACTATTCCGTTGATGAATAGC ATCAGGACTTAAATGGTGACCTTGT |
| 5273 | db mining | Hs.337129 | AI523973 | 4438108 | tg98h03.x1 cDNA, 3' end /clone = IMAGE:2116853/clone_end = 3' | −1 | AACGGGTTTGGGTTTGGGGGGGTTT GTTCTTTTTATTGAATCCATTTAAGT |
| 5274 | db mining | Hs.340482 | AI523988 | 4438123 | tg99b05.x1 cDNA, 3' end /clone = IMAGE:2116881/clone_end = 3' | −1 | TATAGGAGATGGGATACTCATTCCCG CTGCTATTGATAAGGTCGGAGGCG |
| 5275 | db mining | Hs.283457 | AI523989 | 4438124 | 7f27b07.x1 cDNA, 3' end /clone = IMAGE:3295861/clone_end = 3' | −1 | CAGAACGTCCTCAAGGACACACTCCT CCCTCGGGCCTCACTCTGGAGCAC |
| 5276 | db mining | Hs.229405 | AI524004 | 4438139 | tg99d01.x1 cDNA, 3' end /clone = IMAGE:2116897/clone_end = 3' | −1 | CTGGACATGTTGTTTCCATGTTCAGT CCCTTCCCGGTTTTTGGGTGTTTT |
| 5277 | db mining | Hs.283458 | AI524006 | 4438141 | tg99d05.x1 cDNA, 3' end /clone = IMAGE:2116905/clone_end = 3' | −1 | AAAGTAGCCATCCTGAGTCTCCAGGG TGATGAGCGGACTTGGGTGTGGAT |
| 5278 | db mining | Hs.327719 | AI524013 | 4438148 | tg99e03.x1 cDNA, 3' end /clone = IMAGE:2116924/clone_end = 3' | −1 | CCTTCCATCTCATCGGTGGCCTCTCA CTGTGGCTCACTGTTTAACACATG |
| 5279 | Table 3A | Hs.252359 | AI524022 | 4438157 | tg99f02.x1 cDNA, 3' end /clone = IMAGE:2116923/clone_end = 3' | −1 | TGTTCAAGGTCACATAGTTTAGGTAA GAAGCTCAAACCTGAGTTTTAGGT |
| 5280 | Table 3A | Hs.192524 | AI524039 | 4438174 | tg99h02.x1 cDNA, 3' end /clone = IMAGE:2116947/clone_end = 3' | −1 | CACCTGATTCCCCCTCTTGCCCACAG GACTCTGCTGTTGTTTTCATTCTG |
| 5281 | db mining | Hs.283459 | AI524048 | 4438181 | th01a01.x1 cDNA, 3' end /clone = IMAGE:2116968/clone_end = 3' | −1 | TCTCGTGAGGTGATGTGGTGCTGCA GACTTAAGCTATCTGCCTTGAAGAT |
| 5282 | db mining | Hs.171119 | AI524139 | 4438274 | th09f04.x1 cDNA, 3' end /clone = IMAGE:2117791/clone_end = 3' | −1 | AACAAGCCTGGAATAATGCCCCCAAA GATTGAGTGGAAATCGCCCCTTTTT |
| 5283 | db mining | NA | AI524156 | 4438291 | th09h01.x1 NCI_CGAP_CLL1 cDNA clone IMAGE:2117809 3' similar to contains Alu repetitive element; con | −1 | GAGGACCAGATGGCCCAGGAGGAAG TGGATGCTTTCTTGGTAGGGAATGG |
| 5284 | Table 3A | Hs.171122 | AI524202 | 4438337 | th10d11.x1 cDNA, 3' end /clone = IMAGE:2117877/clone_end = 3' | −1 | CCTCCTGCTAGAAGACAGATTTCTTC CTTGGCTGACAGGCTGAATTAAGC |
| 5285 | db mining | Hs.171123 | AI524214 | 4438349 | th11b04.x1 cDNA, 3' end /clone = IMAGE:2117935/clone_end = 3' | −1 | AATTTCCAAAAACAAAACAAAA CAAGCAGGTTTCATGGAGCCCGAG TCCA |
| 5286 | db mining | Hs.171124 | AI524233 | 4438368 | th11d04.x1 cDNA, 3' end /clone = IMAGE:2117959/clone_end = 3' | −1 | CCTTTATGCAAGTTGTAAGGGGTTGA CCAGTAAAGAGGAAGTTTTGCCCC |
| 5287 | Table 3A | Hs.174193 | AI524263 | 4438398 | th11g07.x1 cDNA, 3' end /clone = IMAGE:2118012/clone_end = 3' | −1 | AGTATTAGCTACAAACAAGCCTTGTT TCCTCTTGGCTGTCAGGCACTGCT |
| 5288 | db mining | Hs.230874 | AI524266 | 4438401 | th11g12.x1 cDNA, 3' end /clone = IMAGE:2118022/clone_end = 3' | −1 | AAGCCCCAGTAAGGTGTTCAGGACT GGTAAACGACTGTCCTCAAGTAAGG |
| 5289 | Table 3A | Hs.12315 | AI524824 | 4438759 | hypothetical protein FJ11608 (FLJ11608), mRNA/cds = (561, 1184) | −1 | TGGTTCAGGTAGTAAATGCTTTTGGT CACATCAGAACTCTAGATCTGGGG |
| 5290 | db mining | Hs.327722 | AI524626 | 4438761 | td11c03.x1 cDNA, 3' end /clone = IMAGE:2075332/clone_end = 3' | −1 | GCCTGGGCTGTTTTTGCTATATGTAA ATAAAGCCCTTGGGTCTTTATTTT |
| 5291 | db mining | Hs.231512 | AI524700 | 4438835 | th12c05.x1 cDNA, 3' end /clone = IMAGE:2118058/clone_end = 3' | −1 | GGAGGTTAGGAAGCCCTTTTAAAGTA CAAACCCCCGGCATGGGGAATTTT |
| 5292 | db mining | Hs.171140 | AI524720 | 4438855 | th12e10.x1 cDNA, 3' end /clone = IMAGE:2118090/clone_end = 3' | −1 | AACGGGAGTGATCGGGAAGTGAACA GTTTCATCATCTGCTGCTGCTATTC |
| 5293 | db mining | Hs.292520 | AI524724 | 4438859 | th12f03.x1 cDNA, 3' end /clone = IMAGE:21118077/clone_end = 3' | −1 | CTGGTATGTTGCTTTGTAGGGGAAAA ACTAATTTGTTGGGTCAGGGACA |
| 5294 | db mining | Hs.283462 | AI538419 | 4452554 | td06a02.x1 cDNA, 3' end /clone = IMAGE:2074826/clone_end = 3' | −1 | CCGGACAAGCCATTTGATGTTCTAGT TTGCAATTACTCCACGCAAAGTGG |
| 5295 | db mining | Hs.231292 | AI538420 | 4452555 | td06a03.x1 cDNA, 3' end /clone = IMAGE:2074828/clone_end = 3' | −1 | TTTGGGCATCAACTTCAACAACTACT ACCAGGACGCCTGAGGGTGCTTTT |
| 5296 | db mining | Hs.171216 | AI538445 | 4452580 | td06d02.x1 cDNA, 3' end /clone = IMAGE:2074851/clone_end = 3' | −1 | TCGAAGAAAGTACCTGTAAATGTAGA GTAATTGCGAAGCTGTCAGGAATA |
| 5297 | Table 3A | Hs.203784 | AI538474 | 4452609 | td06h08.x1 cDNA, 3' end | −1 | TCCTAGACCCTGCATTGTGAAATGGG |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2074911/clone_end = 3' | | GCTTGAATTTTAGTTCTGAATTTT |
| 5298 | Table 3A | Hs.306024 | AI538546 | 4452681 | FK506-binding protein 3 (25 kD) (FKBP3), mRNA/cds = (23, 697) | −1 | CTAAAGCAGTGTCTGACCTGGATTTG CTGCCAATTTGTAAGCTTTCATGA |
| 5299 | Table 3A | Hs.192534 | AI538554 | 4452689 | EST384032 cDNA | −1 | GGAGCTGAGCAGGGATGCAAAACCA TCCAGTCTGTAAGATTCACAGAGAC |
| 5300 | db mining | Hs.171260 | AI540044 | 4457417 | td08e06.x1 cDNA, 3' end /clone = IMAGE:2075074/clone_end = 3' | −1 | AAACGGTGTTTGAGCTGCTTTGGGAA AACCCATGTTGCAGATTTTCAGGT |
| 5301 | db mining | Hs.283463 | AI540109 | 4457482 | 7f10e03.x1 cDNA, 3' end /clone = IMAGE:3294268/clone_end = 3' | −1 | CAGAGCTGTGTTTCCTCAACAAGTGT GCGAGCGGTCGTGTGCGCCATGAG |
| 5302 | Table 3A | Hs.171261 | AI540125 | 4457498 | MR1-BN0212-280600-001 cDNA | −1 | AAATCGCTTCTGTATTGTTAATAGCAA TATATGACCTCTGCTGTCCTCCT |
| 5303 | db mining | NA | AI540130 | 4457503 | td09g11.x1 NCI_CGAP_CLL1 cDNA clone IMAGE:2075204 3' similar to gb:X64707 BREAST BASIC CONSERVED PR | −1 | GAAGGATAATTTCGAACCCTTGCAT AGTTTCGGTATGGGCCGTGCCAAC |
| 5304 | Table 3A | Hs.171264 | AI540161 | 4457534 | td10c10.x1 cDNA, 3' end /clone = IMAGE:2075250/clone_end = 3' | −1 | CCCTCTTGAACTGCACTGCCTAAGAA ATGTTGGTTGCATGGAGACATATT |
| 5305 | Table 3A | Hs.222188 | AI540165 | 4457538 | td10d05.x1 cDNA, 3' end /clone = IMAGE:2075241/clone_end = 3' | −1 | TCTGCCTTATTTGGCTTGGAAGAGAA ACCGATAAACACTCCCGTGCTAGT |
| 5306 | Table 3A | Hs.170935 | AI540204 | 4457577 | MYE6493a cDNA | −1 | AAACAGCAGAAAAGTAATTTCTGGTG AACTGATGAGAATTCCCTATTGCA |
| 5307 | db mining | Hs327797 | AI540784 | 4458157 | tc87e06.x1 cDNA, 3' end /clone = IMAGE:2073158/clone_end = 3' | −1 | AGGTTGTTTTGGAAAAATTATTTGTTT TGTCCTAAGGGGTCCTGCCCACC |
| 5308 | db mining | Hs327798 | AI540789 | 4458162 | tc87f03.x1 cDNA, 3' end /clone = IMAGE:2073149/clone_end = 3' | −1 | CCTCCGGAACGTTTTTAAAAAGGAAA AAGCCCGGGTTTTCCCTTGGGAAAAA |
| 5309 | Table 3A | Hs.170577 | AI540813 | 4458186 | 602574255F1 cDNA, 5' end /clone = IMAGE:4702644/clone_end = 5' | −1 | CAGACCTGTGGGCTGATTCCAGACT GAGAGTTGAAGTTTTGTGTGCATCA |
| 5310 | Table 3A | Hs.173182 | AI554733 | 4487096 | tn27f08.x1 cDNA, 3' end /clone = IMAGE:2168871/clone_end = 3' | −1 | ACCAAGTTTGAATTTGTCAAATCCCA AGTCAATCCAGGATGTTCATTTCT |
| 5311 | Table 3A | Hs.282963 | AI557431 | 4489794 | 602583968F1 cDNA, 5' end /clone = IMAGE:4711721/clone_end = 5' | −1 | AGTGATCTGCCTTTCAGCAACTGTCT TATTTTGGTTCTTTGAAACTGTGA |
| 5312 | db mining | Hs.104679 | AI559444 | 4509649 | *Homo sapiens*, clone MGC:18216 IMAGE:4156235, mRNA, complete cds /cds = (2206, 2373) | −1 | TTTGAATGGCTGAAGCTAAGGCAACG TTAGTTTCTCCTTACTCTGCTTTT |
| 5313 | db mining | Hs.118392 | AI560581 | 4510902 | RST42486 cDNA | −1 | ACCTTTGTGATTCTGTCTAGTGAAAAT GGGACATTTTAATAGTGCCAGA |
| 5314 | Table 3A | NA | AI560651 | 4510992 | tq60f01.x1 NCI_CGAP_Ut1 cDNA clone IMAGE:2213209 3' similar to gb:M36072 60 S RIBOSOMAL PROTEIN L7A | −1 | GAACTTGCCCCTAAACTGGGTTAAT GGACCCTGTTGAGTTTTCTGGACA |
| 5315 | db mining | Hs.327874 | AI568374 | 4531748 | th13e03.x1 cDNA, 3' end /clone = IMAGE:211118172/clone_ end =3' | −1 | TAAAATTGGGCAAAGTTTTTTATGGAAT TTCCGGGGCAAGGTTTTGGGGGC |
| 5316 | Table 3A | Hs.340517 | AI568459 | 4531833 | tn39e07.x1 cDNA, 3' end /clone = IMAGE:2170020/clone_end = 3' | −1 | AAATCTCATTTGCAAGTTCTCCCATTA AGCAAGGGAGTAGTTTACTAGGA |
| 5317 | Table 3A | Hs.143951 | AI568622 | 4531996 | tn41e10.x1 cDNA, 3' end /clone = IMAGE:2170218/clone_end = 3' | −1 | AAGAAAGGCCCATAACAGATGGCAAA ATAGAGGATTGGTGAGGGATATGC |
| 5318 | db mining | Hs.75969 | AI568695 | 4532069 | proline-rich protein with nuclear targeting signal (B4-2), mRNA /cds = (113, 1096) | −1 | AAAACCATTCCAGCTTAATGCCTTTAA TTTTAATGCCAACAAAATTGGGG |
| 5319 | Table 3A | NA | AI568725 | 4532009 | th15a01.x1 NCI_CGAP_CLL1 cDNA clone IMAGE:2118312 3', mRNA sequence | −1 | TGCAACCTTCTTAAAATGTGGGCTAC TGGAGATCATGCCACTGCACTCCA |
| 5320 | Table 3A | Hs.159014 | AI568751 | 4532125 | th15d09.x1 cDNA, 3' end /clone = IMAGE:2118353/clone_end = 3' | −1 | AGCTCAGATGGGTCCCCAAAAGAGG CATAGGAAAGCGCGACCTCACTGCC |
| 5321 | db mining | Hs.174242 | AI568753 | 4532127 | th15e04.x1 cDNA, 3' end /clone = IMAGE:2118366/clone_end = 3' | −1 | CAAATAAAAAGGCTGGGGCCAAAGG TGGGCACCAAAAGTCCTCCTATGTG |
| 5322 | Table 3A | NA | AI568755 | 4532129 | th15f03.x1 NCI_CGAP_CLL1 cDNA clone IMAGE:2118365 3', mRNA sequence | −1 | TGCAGCTCCCATTTCCTGAGCGTCTA CCAGGTACTAGGAGAACTCTTACA |
| 5323 | db mining | Hs.327876 | AI568771 | 4532145 | th15h04.x1 cDNA, 3' end /clone = IMAGE:2118391/clone_end = 3' | −1 | ATTATCCTTTTCCCCAGGAAGCCCTC GGCCCCCAAAAAGGGAAACAGTTT |
| 5324 | db mining | Hs.179070 | AI568773 | 4532147 | th15h09.x1 cDNA, 3' end | −1 | CATGAGCCCAGGGGTTTCATGACAAA |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2118401/clone_end = 3' | | CATTACTAGCATGTTCAACTGCCC |
| 5325 | Table 3A | NA | AI569898 | 4533272 | tr57c12.x1 NCI_CGAP_Pan1 cDNA clone IMAGE:2222422 3' similar to gbD16234 PROBABLE PROTEIN DISULFID | −1 | GCCCGGTTTATGGAAAAACCAGGAC CAGTTTATGTTTGGGGTTTTGGGAA |
| 5326 | Table 3A | Hs.92448 | AI570295 | 4533669 | EST390664 cDNA | −1 | GCTTGGTACTGTCATAGTGATTACAA ATTTCATGGAATGCGAAGAGCAAC |
| 5327 | Table 3A | Hs.5637 | AI570531 | 4533905 | 602998983F1 cDNA, 5' end /clone = IMAGE:5141013/clone_end = 5' | −1 | TTTTCTCCCCTCTCTTCCCCTTCCAC GAACTGCAATACCAGTAACCTTGG |
| 5328 | Table 3A | Hs.14623 | AI571519 | 4534893 | interferon, gamma-inducible protein 30 (IFI30), mRNA/cds = (40, 951) | −1 | AGCCCAGATACACAAAATTCCACCC CATGATCAAGAATCCTGCTCCACT |
| 5329 | db mining | Hs.8882 | AI572757 | 4536131 | tu43c07.x1 cDNA, 3' end /clone = IMAGE:2253804/clone_end = 3' | −1 | CATGTGTTGACTCTGTAATGGATTTAT GTAGCCCACTTCAGTCTGCAAAT |
| 5330 | Table 3A | Hs.230430 | AI579979 | 4564355 | tq45a01.x1 cDNA, 3' end /clone = IMAGE:2211720/clone_end = 3' | −1 | AGGGGTGTCCCTTTTCCCCTTCATGT AAAAATTCTAACTGGGGCTACCAGT |
| 5331 | Table 3A | NA | AI581199 | 4565575 | ti94h10.x1 NCI_CGAP_Co14 cDNA clone IMAGE:2154787 3' similar to SW:ATP6_HUMAN P00846 ATP SYNTHASE A | −1 | TCTACTGACTATCCTAGAAATCGCTG TCGCCTTAATCCCAAGCCTACGTTT |
| 5332 | Table 3A | Hs.327922 | AI581383 | 4565759 | to71c02.x1 cDNA, 3' end /clone = IMAGE:2183714/clone_end = 3' | −1 | TGAAGAAACTGCCCTTTCTGTGATGT TTTTGAATACTACCCAACAGCCAA |
| 5333 | Table 3A | Hs.229918 | AI581732 | 4567629 | ar74f03.x1 cDNA, 3' end /clone = IMAGE:2128349/clone_end = 3' | −1 | CTTCCTAGCCCTAAGTTTGGCCTTTG GGTGGCTCCAAAAAGGATTAGGTT |
| 5334 | Table 3A | Hs.292553 | AI582954 | 4566851 | tr98e07.x1 cDNA, 3' end /clone = IMAGE:2227140/clone_end = 3' | −1 | TCCCCCTCGTTTTGTAGGGTTTGTAC ATAATAAAACAATGGGGTGGGGCC |
| 5335 | Table 3A | Hs.340925 | AI590337 | 4599385 | wh96a06.x1 cDNA, 3' end /clone = IMAGE:2388562/clone_end = 3' | −1 | TGTTAAGTGTGAGGTTTTCTGAACCC TTAGCAGAAGGACTTTTAATGTTT |
| 5336 | Table 3A | Hs.101617 | AI597917 | 4606976 | 601513709F1 cDNA, 5' end /clone = IMAGE:3914786/clone_end = 5' | −1 | AGTTCCACTGCTGTTCCTCTTACCTT GATTAATGCCTATGCATGTACTT |
| 5337 | db mining | Hs.13646 | AI611245 | 4620412 | 601287348F1 cDNA, 5' end /clone = IMAGE:3621754/clone_end = 5' | −1 | AGTTCTGTTGTGTAATCTGGTGCTGG TTCCCTGGGCATATGTATTCTGTG |
| 5338 | Table 3A | NA | AI619574 | 4628700 | ty50c09.x1 NCI_CGAP_Ut2 cDNA clone IMAGE:2282512 3' similar to gb:M23613 NUCLEOLAR PHOSPHOPROTEIN B | −1 | CCCCCTTGCTTGGTTTTAAGTAGGTA TGGAATGTTATTATAGGCCATAGT |
| 5339 | db mining | Hs.340564 | AI625119 | 4650050 | is47b12.x1 cDNA, 3' end /clone = IMAGE:2231711/clone_end = 3' | −1 | TCAGTGTAAACCATAATTAGGCCGTGA GTTTTTGCTCTTACTCCCAGGTTT |
| 5340 | Table 3A | Hs.188385 | AI625368 | 4650299 | ts37c10.x1 cDNA, 3' end /clone = IMAGE:2230770/clone_end = 3' | −1 | TGTAAACTTGTTTTAACAACTCTTTTC AACATTTTGGCCGGGGTATTCCC |
| 5341 | Table 3A | Hs.278554 | AI627495 | 4664295 | chromobox homolog 3 (Drosophila HP1 gamma) (CBX3), mRNA /cds = (111, 662) | −1 | TGCTGAAAGTGGTCCCAAAGGGGTA CTAGTTTTTAAGCTCCCAACTCCCC |
| 5342 | Table 3A | Hs.171262 | AI628993 | 4665693 | ty95h02.x1 cDNA, 3' end /clone = IMAGE:2286867/clone_end = 3' | −1 | TTCCCAGTTGCCACAGACCGTTTATA TGAAGAAATGCTAAAGAAGTTCCC |
| 5343 | Table 3A | NA | AI628930 | 4665730 | ty40d03.x1 NCI_CGAP_Ut2 cDNA clone IMAGE:2281541 3' similar to SW:ATP6_HUMAN P00846 ATP SYNTHASE A | −1 | TCTACTGACTATCCTAGAAATCGCTG TCGCCTTAATCCCAAGCCTACGTTT |
| 5344 | db mining | Hs.264154 | AI630176 | 4681506 | ad06a03.r1 cDNA/clone = ad06a03- (random) | −1 | AGTTCTAAAGCCGGGAATTCCTAAGG ATATACTAAATGAGATTATGTGGG |
| 5345 | Table 3A | Hs.340604 | AI631850 | 4683180 | wa36h07.x1 cDNA, 3' end /clone = IMAGE:2300221/clone_end = 3' | −1 | GCCTGGGGAGGAGAAGTCCCTTCC CATTCCAGCTCGATCAATCTTGCTG |
| 5346 | Table 3A | Hs.256729 | AI634652 | 4685982 | wx27c05.x1 cDNA, 3' end /clone = IMAGE:2544872/clone_end = 3' | −1 | GGAGTAGAGAGAGTCTTGCTACATGC GGGAACTAGAATTACATCACTGCG |
| 5347 | Table 3A | Hs.319825 | AI634972 | 4686302 | 602021477F1 cDNA, 5' end /clone = IMAGE:4156915/clone_end = 5' | −1 | AAGAAGTTTCATTGATATCCACTGGT CACATCATACCTGTCTATAGGGCA |
| 5348 | Table 3A | Hs.176920 | AI638800 | 4691034 | tt32e01.x1 cDNA, 3' end /clone = IMAGE:2242488/clone_end = 3' | −1 | TGCTTCAAGCACAGGATTTATGGAAT AGTTGGCAAATTAAACAACATGCT |
| 5349 | Table 3A | Hs.197028 | AI650871 | 4734850 | 602643870F1 cDNA, 5' end /clone = IMAGE:4774817/clone_end = 5' | −1 | CGGCAGCCTTATGGAATGAGTTTCTT GTCATGAATGTTGTCCCCAAAGCT |

TABLE 8-continued

| SEQ ID | Origin | Unigene | Locus | GI | Nominal Description | Strand | Probe Sequence |
|---|---|---|---|---|---|---|---|
| 5350 | Table 3A | Hs.4283 | AI651212 | 4735191 | 602621616F1 cDNA, 5' end /clone = IMAGE:4755315/clone_end = 5' | -1 | ACAGTTACTTTGGAGCTGCTAGACTG GTTTTCTGTGTTGGTAAATTGCCT |
| 5351 | db mining | Hs.203064 | AI651922 | 4735901 | hy16b12.x1 cDNA, 3' end /clone = IMAGE:3191471/clone_end = 3' | -1 | TGTGAAGAATCCCTACCATTAATACC CTGGGTGGGATAAATAAAAATGGG |
| 5352 | Table 3A | Hs.195378 | AI653766 | 4737745 | ty01b06.x1 cDNA, 3' end /clone = IMAGE:2277779/clone_end = 3' | -1 | CCCAAAATTTGTTTAAAGTTCCGACTT CCAAAAGGGGCCAATAAAAAGGG |
| 5353 | db mining | Hs.111941 | AI660405 | 4763975 | qd92a04.x1 cDNA, 3' end /clone = IMAGE:1736910/clone_end = 3' | -1 | CACCGCCTCTGCCTCCGCCTCTTCCA CTGGAGAGCCCGAGGTCAAAAGGTC |
| 5354 | Table 3A | Hs.200442 | AI669591 | 4834365 | tw34b09.x1 cDNA, 3' end /clone = IMAGE:2261561/clone_end = 3' | -1 | CCCTCACCTAGCAGTACTACCACAAT AATGCTATCATGGTGCCAGGGAAT |
| 5355 | Table 3A | Hs.101150 | AI672433 | 4852164 | Homo sapiens, clone IMAGE:4054156, mRNA, partial cds/cds = (0, 526) | -1 | TCTCCTTCCCCATTGGGCCGCCTTTA TCAATTGCCTGTTTTGTTTTGTTT |
| 5356 | Table 3A | Hs.341178 | AI676004 | 4888186 | xa30a04.x1 cDNA, 3' end /clone = IMAGE:2568270/clone_end = 3' | -1 | TTTTTATCTTTCTTGGTGGGGGTGTG GTGGTGGTGAAGAGGACCTAAAAA |
| 5357 | Table 3A | Hs.324507 | AI676099 | 4888261 | hypothetical protein FLJ20986 (FLJ20986), mRNA/cds = (182, 2056) | -1 | CGCCAGAGGTCAGAACATGTCTATTT TGAATTGGATCGTTACAAATGAGC |
| 5358 | Table 3A | Hs.178784 | AI681868 | 4892050 | 602587746F1 cDNA, 5' end /clone = IMAGE:4716442/clone_end = 5' | -1 | GCAGGCACTGACATTTTTGAGCAAAG ACGTGATGTTATGAGATAAATATC |
| 5359 | Table 3A | Hs.90744 | AI684022 | 4895316 | proteasome (prosome, macropain) 26S subunit, non-ATPase, 11 (PSMD11), mRNA/cds = (0, 1268) | -1 | TTCTGACACGATTACACAACGAGGCT TTAATGCCATTTGGGTAGGTGAGC |
| 5360 | db mining | Hs.328323 | AI684369 | 4695663 | tc96e09.x1 cDNA, 3' end /clone = IMAGE:2074024/clone_end = 3' | -1 | TTTTAAGGGGAGGGGCCGGGGTTT GGTCCCCGGTCCCAAAGGTAAAAGTT |
| 5361 | Table 3A | Hs.58774 | AI684437 | 4895731 | Homo sapiens, Similar to zinc finger protein 175, clone MGC:12651 IMAGE:4301632, mRNA, complete cds /cds = (367, 522) | -1 | GAGTGAGAAGAGGCTTTTAAGGACCA TGTGAAGAGGCTTTTAAACACTTT |
| 5362 | db mining | Hs.182817 | AI684847 | 4896141 | 602290551F1 cDNA, 5' end /clone = IMAGE:4385293/clone_end = 5' | -1 | GGGTTGGGATAAACTGCTTAGATGTT TGCCTACTTGTCCAGTGAAATTAC |
| 5363 | Table 3A | NA | AI688560 | 4899854 | wd39f08.x1 Soarses_NFL_T_GBC_S1 cDNA clone IMAGE:2330535 3', mRNA sequence | -1 | ACTGAAAAGTTGAAAGACTTTTGCAG TGAACATTTATATAACTCCCCGCT |
| 5364 | Table 3A | Hs.201789 | AI693179 | 4970519 | MR1-CI0181-081100-001-a01 cDNA | -1 | ATTCATAGGTAGTGCCCAGAGAGAGT ACAAGCTCTGACTCATATGGCAGT |
| 5365 | literature | Hs.202407 | AI697497 | 49805397 | we14b06.x1 cDNA, 3' end /clone = IMAGE:2341043/clone_end = 3' | -1 | ACATGTTACCTGGAGTAGCTGTGTCA ACAGATTAATATGGAATGCTACTA |
| 5366 | Table 3A | Hs.177708 | AI697756 | 4985658 | 602369210F1 cDNA, 5' end /clone = IMAGE:4477370/clone_end = 5' | -1 | TGGTTCCTGTGCTCACCATAGGGCTG GTGTACATTGGGCCATTAATAAAC |
| 5367 | Table 3A | Hs.206854 | AI700738 | 4988836 | EST388531 cDNA | -1 | ACAGATCCCTATTGCCAGACACATCA TTCTCTCCATCCAGAAAGCAAACA |
| 5368 | Table 3A | Hs.80887 | AI701165 | 4989065 | v-yes-1 Yamaguchi sarcoma viral related oncogene homolog (LYN), mRNA/cds = (297, 1835) | -1 | TCTGGGAAAGACATTTTAAGCTGCT GACTTCACCTGCAAAATCTAACAG |
| 5369 | Table 3A | Hs.102793 | AI707589 | 4997365 | RST17769 cDNA | -1 | AGTCACGATAAACCTGGTCACCTGAA AATTGAATTGAGCCACTTCCTTG |
| 5370 | Table 3A | Hs.30933 | AI707809 | 4997585 | as28g09.x1 cDNA, 3' end /clone = IMAGE:2318560/clone_end = 3' | -1 | AAACTGGCGGCCCAACAAAACAGTG GGTTAAATGGGTCCCTGGGTGACAT |
| 5371 | Table 3A | Hs.107369 | AI707896 | 4997672 | as34a10.x1 cDNA, 3' end /clone = IMAGE:2319066/clone_end = 3' | -1 | AGTGTTTCCTCCACATCTAAAGAAAG CCCATTTTGAAACTGGATACTGCA |
| 5372 | Table 3A | Hs.176430 | AI708327 | 4998103 | at04c02.x1 cDNA, 3' end /clone = IMAGE:2354114/clone_end = 3' | -1 | CCCAGGTGGCCCCTCTCCATCAGAT GTTATTGCTCTTCCCCATTTATTTA |
| 5373 | Table 3A | Hs.300710 | AI709236 | 4999012 | RC-MT0059-200600-021-g05 cDNA | -1 | AAGATGCCTAAGCGTTAACCAGGTGA AACAGGGGTGGGAGAGAGAAAGAA |
| 5374 | Table 3A | Hs.297184 | AI720536 | 5037792 | 601502712F1 cDNA, 5' end /clone = IMAGE:3904539/clone_end = 5' | -1 | GTCATACACCTATCCCCCATTTTCCT CCTATCCCTCAACCCGGACATCAT |
| 5375 | Table 3A | Hs.313929 | AI733018 | 5054131 | oh60h01.x5 cDNA, 3' end /clone = IMAGE:1471441/clone_end = 3' | -1 | GCAGGTGGCAGAATGGGTGCATGA AGGTTTCTGAAAATTAACACTGCTT |
| 5376 | Table 3A | Hs.310333 | AI735206 | 5056730 | at07f03.x1 cDNA, 3' end /clone = IMAGE:2354429/clone_end = 3' | -1 | ACAGAGAGGCAGCATTTGTTTTCCAG TTAAAATTTGACCTCACTGTGATT |
| 5377 | Table 3A | Hs.277201 | AI740667 | 5108955 | wg07b07.x1 cDNA, 3' end | -1 | CCCCCTTTTGTTGTGGTTTTATATTGG |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2364373/clone_end = 3' | | AACCCCCTTTTTCTTTGGAACTA |
| 5378 | Table 3A | Hs.204656 | AI741246 | 5109534 | wg26g09.x1 = 1 cDNA, 3' end /clone = IMAGE:2366272/clone_end = 3' | −1 | CTGACCCCTTCCTCACCCCTGCCAAC AGTGGTGGCATATATCACAAATGG |
| 5379 | Table 3A | Hs.299883 | AI742850 | 5111138 | hypothetical protein FLJ23399 (FLJ23399), mRNA/cds = (282, 1789) | −1 | TGTTTTACCTCACTGTTGGACATACAT TCCAAGCTTTTCAACTCTAGGAG |
| 5380 | Table 3A | Hs.6187 | AI745230 | 5113518 | wg10e05.x1 cDNA, 3' end /clone = IMAGE:2364704/clone_end = 3' | −1 | CAGAACATGCCCAAAGAAGCCTATAT CTTGCTGCTGGGAAATGTAAAGCA |
| 5381 | Table 3A | Hs.293842 | AI748827 | 5127091 | 601571679F1 cDNA, 5' end /clone = IMAGE:3838675/clone_end = 5' | −1 | CAAACACCGGCAGTTGAAAGGAAAA GGACGGGGAATGTGATGGAAAAGAG |
| 5382 | Table 3A | NA | AI749435 | 5127699 | at24b03.x1 Barstead aorta HPLRB6 cDNA clone IMAGE:2356015 3' similar to gb:X55715 40S RIBOSOMAL PRO | −1 | CCCCCTCCCTGCCCCGGTGAGCTTT GGGGAACCCAAAAATTAGATTTTGC |
| 5383 | Table 3A | Hs.204929 | AI749444 | 5127708 | at24c03.x1 cDNA, 3' end /clone = IMAGE:2356036/clone_end = 3' | −1 | CCCAAATCCAAGGACCAATGCTGTTG TAAACAAGGGGTAAAGGGCCTAAA |
| 5384 | Table 3A | Hs.205071 | AI760018 | 5175685 | wh83b02.x1 cDNA, 3' end /clone = IMAGE:2387307/clone_end = 3' | −1 | ACTCCACCAAGACTGTGAACTCCACC GGGGTAGGAAGCATATTTTACTCA |
| 5385 | Table 3A | Hs.160951 | AI760020 | 5175687 | wh83b05.x1 cDNA, 3' end /clone = IMAGE:2367313/clone_end = 3' | −1 | GAGAACTCGTTTCAAGGAACTCGATG TTTCCGGGGACCAAGCCCGCCCAG |
| 5386 | Table 3A | Hs.340921 | AI760026 | 5175693 | wh83c05.x1 cDNA, 3' end /clone = IMAGE:2367336/clone_end = 3' | −1 | CCAGCGAATTTCCAGCTTTTGAAACT CAGATTTCCTTTTGCGACCCAGGT |
| 5387 | Table 3A | Hs.26873 | AI760224 | 5175891 | wh62g06.x1 cDNA, 3' end /clone = IMAGE:2385370/clone_end = 3' | −1 | GATGCGCGGCAAGAATGTACCTGTA GATGTGTACATACCACAGTGCTGTA |
| 5388 | Table 3A | Hs.14373 | AI760353 | 5176020 | yx26h11.r1 cDNA, 5' end /clone = IMAGE:282917/clone_end = 5' | −1 | TTTATCTCAGAATCTTGATGAACTCTG AAATGACCCCTGATGGGGGCATG |
| 5389 | db mining | Hs.204598 | AI760374 | 5176041 | wh87d12.x1 cDNA, 3' end /clone = IMAGE:2387735/clone_end =3' | −1 | GGCCCCCTGTCCTTACCTGTTTTCGG CCCCCTTAATTTTTTAACCCCGGG |
| 5390 | db mining | Hs.283496 | AI760389 | 5176056 | wh87f08.x1 cDNA, 3' end /clone = IMAGE:2387751/clone_end = 3' | −1 | GTCACAGTGTAGACACATGGTGCTTC CATAGTGAGTAGAATATCCATTGT |
| 5391 | db mining | Hs.340927 | AI760556 | 5176223 | wi10d09.x1 cDNA, 3' end /clone = IMAGE:2389841/clone_end = 3' | −1 | GTGGCCTGGCCTGGCTCTCACAGAC CCAAGGCTTCCGTGTAGAATATGTC |
| 5392 | db mining | Hs.205803 | AI760674 | 5176341 | wh96b04.x1 cDNA, 3' end /clone = IMAGE:2388559/clone_end = 3' | −1 | GGATTGTGGCAGGAACTGTTTCCCCT CCCAGCCTTAAATTTTTCTGTGTT |
| 5393 | db mining | Hs.283497 | AI760699 | 5176366 | 7f34c12.x1 cDNA, 3' end /clone = IMAGE:3296566/clone_end = 3' | −1 | AAACCCACACCTCAGTGAATTTAAAA GAGTAGATGTTTTAAAAGACCGGA |
| 5394 | db mining | Hs.264654 | AI760835 | 5176502 | wh96f11.x1 cDNA, 3' end /clone = IMAGE:2388621/clone_end = 3' | −1 | TGCCATTTGGTATTTTTCCTGAAACA TTACATAATAAGAATGCAGCATGC |
| 5395 | Table 3A | NA | AI760901 | 5176568 | wi09h06.x1 NCI_CGAP_CLL1 cDNA clone IMAGE:2389787 3', mRNA sequence | −1 | GCCTGAAACCATCCTGCCTTCTAGGA AGACAGCAATTCTGGAAGAGCAAG |
| 5396 | db mining | Hs.230931 | AI760991 | 5176658 | wh97b11.x1 cDNA, 3' end /clone = IMAGE:2388669/clone_end = 3' | −1 | GGTGGTTCCCCAGCCCTTTTCCCTGG CCCTGGGTTGGAAAATTTGTTTTC |
| 5397 | db mining | Hs.328494 | AI761029 | 5178898 | wi10d06.x1 cDNA, 3' end /clone = IMAGE:2389835/clone_end = 3' | −1 | AAAACCTTTCGCCCGGCTTAAATTT ACCGGGGTTTGGTTTTATTTGGTTT |
| 5398 | Table 3A | Hs.98531 | AI761058 | 5176725 | wi69b03.x1 cDNA, 3' end /clone = IMAGE:2398541/clone_end = 3' | −1 | CTCCTTGGTGTCATGCAACTGAGGAA CCTAATTGGCTGGGTGGGTTGTTC |
| 5399 | Table 3A | Hs.205452 | AI761141 | 5178808 | wh97g08.x1 cDNA, 3' end /clone = IMAGE:2388734/clone_end = 3' | −1 | GTTTGTAAAAGAACCTGCCACATTTG TTGAAAAGTTAGAGCCATCACAGC |
| 5400 | Table 3A | NA | AI761144 | 5176811 | wh97h01.x1 NCI_CGAP_CLL1 cDNA clone IMAGE:2388721 3', mRNA sequence | −1 | CTCTTGGCTGCTGGCCTTTTGTTCTT GTCATGGCTCATTAGCTCCCTAAA |
| 5401 | db mining | Hs.328495 | AI761468 | 5177135 | wh98e07.x1 cDNA, 3' end /clone = IMAGE:2388804/clone_end = 3' | −1 | CCAGGGGTTTTAAATTTTCTGAAGTT TTTGGGGCCATTTTGGTTGTTGG |
| 5402 | Table 3A | Hs.80887 | AI761622 | 5177289 | v-yes-1 Yamaguchi sarcoma viral related oncogene homolog (LYN), mRNA/cds = (297, 1835) | −1 | CCCCGCTTGCCTTTTATTTCAGAACC CCAAGTATTACCCAATATGTTACA |
| 5403 | Table 3A | Hs.289834 | AI761924 | 5177591 | wg68h03.x1 cDNA, 3' end /clone = IMAGE:2370293/clone_end = 3' | −1 | GCCGAAGCTCACAGAGGCTAAGTTA CACGCTTAGGTGTTCTTATTCCTAC |
| 5404 | Table 3A | Hs.204610 | AI762023 | 5177690 | wh89f04.x1 cDNA, 3' end | −1 | AACCAGGTTTATGATGCTGTAATAAA |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2387935/clone_end = 3' | | CCATGGCATTAAAGAGGGCAAGAG |
| 5405 | db mining | NA | AI762158 | 5177823 | wh90e05.x1 NCI_CGAP_CLLI cDNA /clone = IMAGE:2388032 3' similar to gb:X64707 BREAST BASIC CONSERVED PR | −1 | GGGTTAAGGAGGGCCGCTCCAAAAT TTTCCTTTTTCCCAGGAAGCCCTTG |
| 5406 | db mining | Hs.204771 | AI762177 | 5177844 | wh90g09.x1 cDNA, 3' end /clone = IMAGE:2388064/clone_end = 3' | −1 | ATGCTGTGAGTGGTACACATGGCTGA GGTTATGATCTGTTAAAATATGTA |
| 5407 | Table 3A | Hs.205327 | AI782557 | 5178224 | wh92f07.x1 cDNA, 3' end /clone = IMAGE:2388229/clone_end = 3' | −1 | TTCATTAATTCCTCAACCCAATACTGT CTGGCTTCCACCAACAGGAGCGG |
| 5408 | db mining | Hs.328503 | AI762707 | 5178374 | wh93d08.x1 cDNA 3' end /clone = IMAGE:2388299/clone_end = 3' | −1 | TGGTTTCTATTTTAAAAACCTGGGTTA GGCCAAGGTTTGGGGTTCGCCCT |
| 5409 | db mining | Hs.204477 | AI762719 | 5178386 | wh93e10.x1 cDNA, 3' end /clone = IMAGE:2388330/clone_end = 3' | −1 | CAACATTGCCTACCAGTTGCAGTTCA TTAGCCCCGTCCGCCCCAGCATTG |
| 5410 | db mining | Hs205815 | AI762739 | 5178406 | wh93g11.x1 cDNA, 3' end /clone = IMAGE:2388356/clone_end = 3' | −1 | CCTTTGGGGTGGGGCTTTTTCCTTT TTGGCCGGTTCAATTAAGGTTTTT |
| 5411 | Table 3A | NA | AI762741 | 5178408 | wh93h02.x1 NCI_CGAP_CLL1 cDNA clone IMAGE:2388339 3', mRNA sequence | −1 | CCCACTCCGGCTGTTTTAGAAGTTTT CCCGAATCCGTGATCCCTTTACAA |
| 5412 | db mining | NA | AI762797 | 5178464 | wi04c12.x1 NCI_CGAP_CLL1 cDNA clone IMAGE:2389270 3' similar to TR:Q61655 Q61655 EUKARYOTIC TRANSLA | −1 | AATGGGCAAATTTTACCCAAAACTTA AGCTTGCCTATTCCGTTTGAGGCA |
| 5413 | Table 3A | Hs.333513 | AI762870 | 5178537 | wi63c07.x1 cDNA, 3' end /clone = IMAGE:2397996/ | −1 | GAAGGAGAGGCACACACAAATACAC ACACTCACACAAAACTCAACAACCA |
| 5414 | db mining | Hs.204480 | AI762931 | 5178598 | wh94e08.x1 cDNA, 3' end /clone = IMAGE:2388422/clone_end = 3' | −1 | GGATACCCCCTTTATCCGAGGGAAT TTTTACCCTTTGGATGCCTTTAAA |
| 5415 | db mining | Hs.289836 | AI762955 | 5178622 | wh94g12.x1 cDNA, 3' end /clone = IMAGE:2388454/clone_end = 3' | −1 | CAAATTACAAACCTAAAAATACAGAA CATCAGCGGAGAAGACAGGAGAGC |
| 5416 | db mining | Hs.277238 | AI763079 | 5178748 | wh95a12.x1 cDNA, 3' end /clone = IMAGE:2388476/clone_end = 3' | −1 | CTCCTCCCTTGGGTGGGACCTGGGT TGGGGGTTTGATAGAAAAATTAACC |
| 5417 | Table 3A | Hs.173904 | AI763121 | 5178788 | wi06d12.x1 cDNA, 3' end /clone = IMAGE:2389463/clone_end = 3' | −1 | GGTTAAACTAGATCCCTGCAAGGCCA TCACCTCCATTCCAAGTTGTTACT |
| 5418 | Table 3A | Hs.190453 | AI763208 | 5178873 | wh95e09.x1 cDNA, 3' end /clone = IMAGE:2388520/clone_end = 3' | −1 | AGTGGGTTATTTAGATCTTTTCCTG GGGTTCAGGTCACATAGCTTAACT |
| 5419 | db mining | Hs.283500 | AI763225 | 5178892 | UI-H-BW1-anj-a-06-0-UI.s1 cDNA, 3' end/clone = IMAGE:3082282 /clone_end = 3' | −1 | TGTTTGGGTATATTGTTTGGGTTTTG GGCACTAGGATGGGTGACTCAGGG |
| 5420 | Table 3A | Hs.130059 | AI763262 | 5178929 | wi66c04.x1 cDNA, 3' end /clone = IMAGE:2398278/clone_end = 3' | −1 | GCCAGTGAATCTAGTTTTGGCTATTC TGTATTTTGTCCAGTTTTTCCCAT |
| 5421 | db mining | Hs.328504 | AI763414 | 5179081 | wh92a11.x1 cDNA, 3' end /clone = IMAGE:2388168/clone_end = 3' | −1 | AACCATTTTCCCCCGGGAACCCGTTT TGCCTGGTTTCGGATTTTTTACCC |
| 5422 | Table 3A | Hs.36137 | AI765153 | 5231662 | hepalocyte nuclear factor 3, gamma (HNF3G), mRNA/cds = (0, 1043) | −1 | CCGGGAAGCGGGGTACTGGCTGTGT TTAATCATTAAAGGTACCGTGTCCG |
| 5423 | db mining | Hs.340947 | AI766625 | 5233134 | wi01f06.x1 cDNA, 3' end /clone = IMAGE:2388995/clone_end = 3' | −1 | TTTTTCCCCCTCCCAAATTCACTGCAT TACAGTTTTTGAAACAGAACGGG |
| 5424 | Table 3A | NA | AI766638 | 5233147 | wi02a10.x1 NCI_CGAP_CLL1 cDNA clone IMAGE:2389050 3', mRNA sequence | −1 | TACGAGAAGTCAGGAAGTTTTGAAAT GGCAGTGACAGGAGACGGGGGAAG |
| 5425 | db mining | Hs.210276 | AI766658 | 5233165 | wi02d04.x1 cDNA, 3' end /clone = IMAGE:2389063/clone_end = 3' | −1 | AAGGGCAGGCAAATCAATTAAAATTA GCCGTAACAACAACCTCGGGGGTG |
| 5426 | Table 3A | Hs.223935 | AI766706 | 5233215 | wl0g211.x1 cDNA, 3' end /clone = IMAGE:2389124/clone_end = 3' | −1 | AGTACACGGCCCTCAAAAGTTATATG TGCTGAATGTAACCTACTTAGCGA |
| 5427 | Table 3A | Hs.89104 | AI766963 | 5233472 | 602590917F1 cDNA, 5' end /clone = IMAGE:4717348/clone_end = 5' | −1 | TTGTTTTAACAACTCTTCTCAACATTT TGTCCAGGTTATTCACTGTAACCA |
| 5428 | Table 3A | Hs.209511 | AI768880 | 5235389 | wh71e04.x1 cDNA, 3' end /clone = IMAGE:2386206/clone_end = 3' | −1 | CTTCTCCACCTCGGCCAGGTATAGG GCCAGCTTCTCGTCTCTGGGATCCG |
| 5429 | Table 3A | Hs.203594 | AI796317 | 5381780 | uncharacterized gastric protein ZA43P mRNA, partial cds/cds = (0, 134) | −1 | GCCAGGTCATTGTATAGGGAGTAAGA TGAAGGTGAATTTGCAGCTAGTTG |
| 5430 | Table 3A | Hs.230939 | AI796419 | 5361882 | wj17f02.x1 cDNA, 3' end | −1 | TGTGTTTTGTTTTTCTGGTCCCAGGG |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2403099/clone_end = 3' | | CACCGTTTGTTTTGTGAACTCCTC |
| 5431 | db mining | Hs.291079 | AI797561 | 5363033 | 602437732F1 cDNA, 5' end /clone = IMAGE:4555638/clone_end = 5' | −1 | CATGGCTCTAAAATTTGGAATTAACTT CTCTTGCCTTAAGAGCTGCTTGT |
| 5432 | Table 3A | Hs.159577 | AI797788 | 5383260 | wh78b11.x1 cDNA, 3' end /clone = IMAGE:2386845/clone_end = 3' | −1 | GCTGGTGGGAAGTTGAGCCATGTTTA TCTCTAGTGGAATCCTTACCTTGT |
| 5433 | db mining | Hs.207473 | AI797813 | 5363370 | wh79c04.x1 cDNA, 3' end /clone = IMAGE:2386950/clone end = 3' | −1 | CATGTTTACACAAATTCCTTCAAAGC CCCTTAAACATGGGGCCGGGCCCC |
| 5434 | db mining | Hs.171110 | AI797652 | 5363409 | 7e88g03.x1 cDNA, 3' end /clone = IMAGE:3292276/clone_end = 3 | −1 | ACCCTAATAGCTAGGCTGGGTATATT TTCAAAGTGTAGCGAAACCCCACG |
| 5435 | db mining | NA | AI797901 | 5363296 | wh78f12.x1 NCI_CGAP_CLL1 cDNA clone IMAGE:2386895 3' similar to contains Alu repetitive element;. m | −1 | CAGTTGGCCTCCTACAATTGGGAATT CTACCAAGCTCCAAGTTGACCTGG |
| 5436 | db mining | Hs.226571 | AI797916 | 5363311 | DKFZp434G048_s1 cDNA, 3' end /clone = DKFZp434G048/clone_end = 3' | −1 | GGATTCCCGACAAAGGCTTGATGTGT ACTTGAAGTGAGCAAAGGGTTTTG |
| 5437 | db mining | Hs.223520 | AI797988 | 5363460 | wh80a02.x1 cDNA, 3' end /clone = IMAGE:2387018/clone_end = 3' | −1 | GGGTGGGAGACAGGCTAATCCTTTC CCCTTGTTTTCCACGTCTTTATGAC |
| 5438 | db mining | Hs.207062 | AI798027 | 5363499 | wh80e09.x1 cDNA, 3' end /clone = IMAGE:2387080/clone_end = 3' | −1 | ACAACCTTCTTAATATATTAGAGACCC GCAGGAAACATTTAGTGGTGAAAC |
| 5439 | db mining | Hs.341012 | AI798028 | 5363500 | wh80f11.x1 cDNA, 3' end /clone = IMAGE:2387085/clone_end = 3' | −1 | GTACATGTTTGTGTGCTAAAATTGCTC ATTTGGCAGTGATAGATTGAAAAAC |
| 5440 | db mining | Hs.229494 | AI798100 | 5363583 | wh81d01.x1 cDNA, 3' end /clone = IMAGE:2387137/clone_end = 3' | −1 | GGGGGTCAAAGAGGGTACAAATGTA TGGGGGTATATTGAATGCTAAACAT |
| 5441 | db mining | Hs.328535 | AI798101 | 536384 | wh81d02.x1 cDNA, 3' end /clone = IMAGE:2387139/clone_end = 3' | −1 | GGGAGCCCGTTTTAGAAGGAAGGGC AAAAGTAGGGTTTTTAACCCAAACG |
| 5442 | db mining | Hs.210307 | AI798114 | 5363576 | wh81c01.x1 cDNA, 3' end /clone = IMAGE:2387138/clone_end = 3' | −1 | TCCGTCCCATTCCCCCGGAAAACAAG GTTTTGAATTGGCCCGTAAAAGGG |
| 5443 | Table 3A | Hs.209609 | AI798144 | 5363816 | wh81g12.x1 cDNA, 3' end /clone = IMAGE:2387208/clone_end = 3' | −1 | ACGTCCTTATACAATGCACTGTTTGA TTTTTAACAATACCTGAAGGGCT |
| 5444 | Table 3A | Hs.158989 | AI799909 | 5365381 | 602666595F1 cDNA, 5' end /clone = IMAGE:4806358/clone_end = 5' | −1 | AC TCAATACTCGGGAAAGGCTTCACA TTTCTGGGACTCAGCATTATCCAA |
| 5445 | Table 3A | Hs.135167 | AI802181 | 5367664 | AV712376 cDNA, 5' end /clone = DCAAND12/clone_end = 5' | −1 | TTGAGAGGCAACACTTAAACACTAGG GCTACTGTGGCATCTATGTAGACA |
| 5446 | Table 3A | Hs.195175 | AI802547 | 5368019 | mRNA for CASH alpha protein /cds = (481, 1923) | −1 | AGCCCTTTCTTGTTGCTGTATGTTTA GATGCTTTCCAATCTTTTGTTACT |
| 5447 | Table 3A | Hs.25648 | AI803065 | 5368537 | tumor necrosis factor receptor superfamily, member 5 (TNFRSF5), mRNA/cds = (47, 880) | −1 | GGGGTATGGTTTAGTAATATCCACCA GACCTTCCGATCCAGCAGTTTGGT |
| 5446 | Table 3A | Hs.301209 | AI804629 | 5370101 | myeloid/lymphoid or mixed-lineage leukemia (trithorax (Drosophila) homolog); translocated to, 10 (MLLT10), mRNA/cds = (183, 3266) | −1 | AACAACAACAGCAAAATCCCCTTAGT GCGTAACTTGAAATTCCCTTCGGC |
| 5449 | db mining | Hs.209261 | AI805106 | 5391760 | tc90g10.x1 cDNA, 3' end /clone = IMAGE:2073474/clone_end = 3' | −1 | TTGTAAGTGGGTGCATAAGAAGATCT CTTCAATTAAATGCCCCCGCTGGT |
| 5450 | Table 3A | Hs.187698 | AI805111 | 5391765 | cytomegatovirus partial fusion receptor mRNA, partial cds/cds = (0, 1037) | −1 | ATAATTAAGAAATCAGCCGTGTGCTT CTCACGTTTGGGCTCCGAGACGTG |
| 5451 | Table 3A | Hs.167206 | AI805131 | 5391785 | 602727149F1 cDNA, 5' end /clone = IMAGE:4868348/clone_end = 5' | −1 | GTCAGTCTCCTCACCTGCCTCTGCTC CTCGCTTAGCCCATTGATTGCATC |
| 5452 | db mining | NA | AI805144 | 5391798 | td11g08.x1 NCI_CGAP_CLL1 cDNA clone IMAGE:2075390 3' similar to gb:L24038_ma1 A-RAF PROTO-ONCOGENE | −1 | GGGAAGAAGCCCGTGCCCCACCCA ATAAATGTTGGTTTTGGCCCTGATG |
| 5453 | db mining | NA | AI805257 | 5391750 | tc90f09.x1 NCI_CGAP_CLL1 cDNA clone IMAGE:2073449 3', mRNA sequence | −1 | CAGAACTTCTGGCGAAGGCCATGTAA GAACTACTCCAAGGAGGAAGAGGC |
| 5454 | Table 3A | NA | AI807278 | 5393844 | wf38h03.x1 Soares_NFL_T_GBC_S1 cDNA clone IMAGE:2357909 3' ,mRNA sequence | −1 | CTCTACCATAAGGCACTATCAGAGAC TGCTACTGGAGTGTATATTTGGTT |
| 5455 | db mining | NA | AI808039 | 5394527 | wf52h02.x1 Soares_NFL_T_GBC_S1 cDNA clone IMAGE:2359251 3' similar to TR:Q62845 Q62845 NEURAL CELL | −1 | ACTGCTACAGCTTAACCATTGTTCCA AGCTAATTAAATTACCTTTGGGGA |
| 5456 | Table 3A | Hs.87912 | AI808931 | 5395497 | EST379776 cDNA | −1 | CAATTGTGATTTGGAAGGTTTAACTG GGTCTGCCCAGATGTTTACGAATA |
| 5457 | db mining | Hs.209989 | AI809181 | 5395747 | wh75d05.x1 cDNA, 3' end | −1 | TCCAAGCAAAAGTTATGCAATAAGAC |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2386569/clone_end = 3' | | AGAATATAAAGTCTCCGAGAGCCT |
| 5458 | db mining | Hs.230485 | AI809184 | 5395750 | wh75d08.x1 cDNA, 3' end /clone = IMAGE:2386575/clone_end = 3' | −1 | GGGTGGGGTGGGGTGAGAGTGTGTG GAGTAAGGACCTTCAGAATTAATAT |
| 5459 | db mining | Hs.292761 | AI809305 | 5395871 | wh75g11.x1 cDNA, 3' end /clone = IMAGE:2386628/clone_end = 3' | −1 | TGCAGTTCTTATTTTCTTTTGCCTGTG ATAATTGCAAATCCGTCAATAGAA |
| 5460 | Table 3A | Hs.210385 | AI809310 | 5395876 | wh75h08.x1 cDNA, 3' end /clone = IMAGE:2386623/clone_end = 3' | −1 | TGCAAGTTTCTGAGACTGTGAAAAGT GTTTTGCTTCTTTTGTTACCCAAT |
| 5461 | db mining | Hs.90463 | AI809378 | 5395944 | wa27e12.x1 cDNA, 3' end /clone = IMAGE:2299342/clone_end = 3' | −1 | TCCCAGCGAATGTGAATCATTTAGTG TGCTACTCAAAATTAGGTGTCCAC |
| 5462 | Table 3A | Hs.257466 | AI809475 | 5398041 | UI-H-BI3-aid-e-08-0-UI.s1 cDNA, 3' end/clone = IMAGE:2736471 /clone_end = 3' | −1 | TAAGATGTAGGGGCCACCGGCCAGC AGTACCCAGGAATGACCACTATCAG |
| 5463 | db mining | Hs.208153 | AI809564 | 5396130 | wh76e01.x1 cDNA, 3' end /clone = IMAGE:2386680/clone_end = 3' | −1 | ATAAATGAAAGCATACCAAGTGCTGT CCATTCCATAGGTACAACTATGGA |
| 5464 | db mining | Hs.310486 | AI809746 | 5396312 | 7e96g11.x1 cDNA, 3' end /clone = IMAGE:3293060/clone_end = 3' | −1 | CTGGTATTCTGAGGTCAGATGTAGGC TGTTGCTCGCTCCGGCTGGGTCTC |
| 5465 | Table 3A | Hs.277293 | AI811065 | 5397631 | tr03f05.x1 cDNA, 3' end /clone = IMAGE:2217249/clone_end = 3' | −1 | CCATCGGGGGTATTGGGGTTTTGGG CTGAATTTACTTGATTATTGGAAAA |
| 5466 | Table 3A | Hs.86693 | AI817153 | 5436320 | EST380760 cDNA | −1 | GCCAGATTGTGGCAGGTAAAGAGAC AATGTAATTTGCACTCCCTATGATA |
| 5467 | Table 3A | Hs.230492 | AI818596 | 5437675 | wk74d04.x1 cDNA, 3' end /clone = IMAGE:2421127/clone_end = 3' | −1 | TTTAAAAAGGAGGGAGGATTTCTGGG TTAAAACTTTTATTTGGCCCCCAT |
| 5468 | Table 3A | Hs.229990 | AI818777 | 5437856 | wl11f10.x1 cDNA, 3' end /clone = IMAGE:2424819/clone_end = 3' | −1 | TAAAACCCAAGACTTCAGATTCAGCC GAATTGTGGTGTTTCACAAGGCCG |
| 5469 | Table 3A | NA | AI818951 | 5438030 | wj89e12.x1 NCI_CGAP_Lym12 cDNA clone IMAGE:2410030 3' similar to WP:C11H1.7 CE18492; contains Alu r | −1 | CTAAGCATGGGGAAGGGGGCAGAGT GAGGACTGTGCCATTGATTAAAGTG |
| 5470 | Table 3A | Hs.51039 | AI823541 | 5444212 | KIAA0078 gene product (KIAA0076), mRNA/cds = (86, 5182) | −1 | GTACAGAAACATATTCCATGCTTTGA AATAAAGGGAAGTGCTCTCCTGTT |
| 5471 | Table 3A | Hs.211535 | AI823649 | 5444320 | wi85g03.x1 cDNA, 3' end /clone = IMAGE:2400148/clone_end = 3' | −1 | GAAGCCTTTTCTTTTCTGTTCACCCTC ACCAAGAGCACAACTTAAATAGG |
| 5472 | Table 3A | Hs.304477 | AI824522 | 5445193 | tx71d03.x1 cDNA, 3' end /clone = IMAGE:2275013/clone_end = 3' | −1 | ACCGATCGTTTTTAGGATAATATGCA TGTTTCAAGTGGTATTGAAACCCCC |
| 5473 | db mining | Hs.270624 | AI825098 | 5445859 | 7b65e05.x1 cDNA, 3' end /clone = IMAGE:3233120/clone_end = 3' | −1 | TGAGGGACAGGCTGCCTAAAGTCTAA TTGGAGAGTTAACCTAATGTCTGT |
| 5474 | Table 3A | Hs.117906 | AI825845 | 5446316 | wb75b09.x1 cDNA, 3' end /clone = IMAGE:2311481/clone_end = 3' | −1 | CACCATCGTGGCTCTGAGAACTGAC GCCGTGAATGTTGACCTGAGTGCCG |
| 5475 | Table 3A | Hs.229993 | AI827451 | 5448122 | wt17d11.x1 cDNA, 3' end /clone = IMAGE:2425173/clone_end = 3' | −1 | GGGGAGAGACCACCCTAGACATTTG CATTTTTGTAAGTTAGCCAGCCAAT |
| 5476 | Table 3A | Hs.181400 | AI827911 | 5448669 | 602650370T1 cDNA, 3' end /clone = IMAGE:4761353/clone_end = 3' | −1 | TGGATAAATCTGAGCAACTTTCTTCTT TGTGCTCCAGGAACCTACGCACT |
| 5477 | Table 3A | Hs.342617 | AI827950 | 5448708 | ha15h10.x1 cDNA, 3' end /clone = IMAGE:2873827/clone_end = 3' | −1 | TGTGGGTTTTGATTGACATACTGTTG TTCATGCTGAAGTTTGAGTGTCGT |
| 5478 | Table 3A | Hs.132238 | AI829569 | 5450240 | wf28e02.x1 cDNA, 3' end /clone = IMAGE:2356922/clone_end = 3' | −1 | GGTGTGCAGTCCGCCTGAAAGCCTT CCCTTTAGCTATTAGGAATTGAGTC |
| 5479 | db mining | Hs.289878 | AI831819 | 5452490 | wh84f12.x1 cDNA, 3' end /clone = IMAGE:2387471/clone_end = 3 ' | −1 | ACATTGGAAAGAAACCCTACAACTGT AATGAATATGAAAAGAATTGTCTAAAA |
| 5480 | Table 3A | Hs.341177 | AI832038 | 5452709 | wj99e02.x1 cDNA, 3' end /clone = IMAGE:2410970/clone_end = 3' | −1 | AAAACCGTTTTCCCCATACATAAAGA ACAGGGGTACTCCCGCCCTGATGG |
| 5481 | Table 3A | Hs.210995 | AI832182 | 5452853 | td13h11.x1 cDNA, 3' end /clone = IMAGE:2075589/clone_end = 3' | −1 | TTTGGTGAAGTGAAAGAGAGAAGTTG CTCTAAAAGGTTGGAAACCAGCCC |
| 5482 | Table 3A | Hs.249031 | AI832183 | 5452854 | wh80g09.x1 cDNA 3' end /clone = IMAGE:2387104/clone_end = 3' | −1 | TGGACTGTTGTAATGTTTTGCGTTAT CAAATGAAAACTGCCAAATGAGA |
| 5483 | Table 3A | Hs.63908 | AI85871 | 5512387 | hypothetical protein MGC14726 (MGC14726), mRNA/cds = (21, 653) | −1 | GCTTTGAGTTTTGGGATGGTCACATG ACACAATCCAGCACTTGAACCTGA |
| 5484 | Table 3A | Hs.252259 | AI859076 | 5512692 | ribosomal protein S3 (RPS3), mRNA /cds = (22, 753) | −1 | AGAGCCATTCCCACAAAGTAAATGTG CAGTGCCCATGTTTCTTGTGTTTA |

TABLE 8-continued

| SEQ ID | Origin | Unigene | Locus | GI | Nominal Description | Strand | Probe Sequence |
|---|---|---|---|---|---|---|---|
| 5485 | Table 3A | NA | AI860120 | 5513736 | wh39e01.x1 NCI_CGAP_Kid11 cDNA clone IMAGE:2383128 3', mRNA sequence | −1 | GACTCTGAGAGAGAGCGACGGCCAT CATAGAACAGCGAAGGCAGTCGATC |
| 5486 | db mining | Hs.156811 | AI862332 | 5526439 | hz33g10.x1 cDNA, 3' end /clone = IMAGE:3209826/clone_end = 3' | −1 | ATCGATGAGAAGAGTCTGCAAAACAC TTCATCCTCAGGACGTGCTGTCCT |
| 5487 | db mining | Hs.304508 | AI882595 | 5526702 | wh99g01.x1 cDNA, 3' end /clone = IMAGE2388912/clone_end = 3' | −1 | ATATATTAAACCACAGGTATTAGAGA CATGAATTGCACCCAACACAAGCT |
| 5488 | Table 3A | NA | AI862623 | 5526730 | wh99h10.x1 NCI_CGAP_CLL1 cDNA clone IMAGE:2388931 3', mRNA sequence | −1 | ATTCATTCGGGTCTTCCTTTCTTCCG CCCCCTTCCTTCCATTGGCACCTC |
| 5489 | Table 3A | Hs.181426 | AI86542 | 5529523 | EST367815 cDNA | −1 | TCAGTTTTGTGGAATCTGGTGTTTGC ACTATAGGTTAAGAGTTGCCATTT |
| 5490 | Table 3A | Hs.341208 | AI855603 | 5529710 | wk47g03.x1 cDNA, 3' end /clone = IMAGE:2418580/clone_end = 3' | −1 | TGTGTGGTGGGGGTGCTTTTGAGGTT GGAGGAAAGTAGAGACAGCGAAAC |
| 5491 | Table 3A | Hs.9788 | AI866194 | 5530301 | hypothetical protein MGC10924 similar to Nedd4 WW-binding protein 5 (MGC10924), mRNA/cds = (104, 769) | −1 | TGTGCTTTTTGCCCAAGTGGTAATTC ATCTTGGTTTGCTATGTTAAAACT |
| 5492 | Table 3A | Hs.224760 | AI224760 | 5548156 | wm49b01.x1 cDNA, 3' end /clone = IMAGE:2439241/clone_end = 3' | −1 | CTTTGGGGACCTAAACCCCAGGTGG TCTCTTGGTGTTAATAATGCTGGAA |
| 5493 | Table 3A | NA | AI880542 | 5554591 | at80h05.x1 Barstead colon HPLRB7 cDNA clone IMAGE:2378381 3' similar to SW:ATP6_HUMAN P00846 ATP SY | −1 | AAATCGCGGTCGCCTTAATCCAAGCC TAGGTTTTCACACTTTTAGTAAGC |
| 5494 | Table 3A | Hs.220850 | AI880607 | 5554856 | ym91d11.r1 cDNA, 5' end /clone = IMAGE:166293/clone_end = 5' | −1 | TGGGGCACTTTGAAAACTTCACAGGC CCACTGCTGCTTGCTGAAATAAAA |
| 5495 | Table 3A | Hs.89414 | AI884548 | 5589712 | chemokine (C-X-C motif), receptor 4 (fusin) (CXCR4), mRNA /cds = (88, 1146) | −1 | GACATTCATCTGTTTCCACTGAGTCT GAGTCTTCAAGTTTTCACTCCAGC |
| 5496 | Table 3A | Hs.23096 | AI884871 | 5589335 | 602254146F1 cDNA, 5' end /clone = IMAGE:4345626/clone_end = 5' | −1 | TGGCGAGGATAAATAGAGGCATTGTT TTTGCTACTTTGCATATCATTGGC |
| 5497 | db mining | Hs.34650 | AI885574 | 5590738 | 602286784T1 cDNA, 3' end /clone = IMAGE:4375724 clone_end = 3' | −1 | TGGCTCTCCTCTTTGTAATATACAGG GTGAACTCTTTACTGATACACACA |
| 5498 | Table 3A | Hs.121572 | AL886313 | 5591477 | EST387650 cDNA | −1 | CCAGTGTCCTGCATGGGTGCTAGGC TGAATTATTTGTAATTGTGCTTAGG |
| 5499 | Table 3A | Hs.213385 | AI912585 | 5632440 | we11d07.x1 cDNA, 3' end /clone = IMAGE:2340781/clone_end = 3' | −1 | ACCGTCTTTTGTGATTCCCTGGAAAC CCTTAATTCAATAGTCCTGACTGA |
| 5500 | Table 3A | Hs.228486 | AI917348 | 5637203 | ts83d10.x1 cDNA, 3' end /clone = IMAGE:2237875/clone_end = 3' | −1 | AGCCCTGGGTAGCCAAGTGATTTTCC CATTCCCAAAGTTAGTAAACCTTT |
| 5501 | Table 3A | Hs.179391 | AI917642 | 5637497 | wi52d11.x1 cDNA, 3' end /clone = IMAGE:2393877/clone_end = 3' | −1 | GCAGGAAAGATGGGGTGGTGGACTG TTTTTGCCTACTTTTTGTTTTTGAA |
| 5502 | Table 3A | Hs.337286 | AI922889 | 5858853 | wn64g11.x1 cDNA, 3' end /clone = IMAGE:2450276/clone_end = 3' | −1 | CCCCCTGAAACTGGCATTTTGTAAAT GTGGTTTGACTATTTTTGTATGTT |
| 5503 | Table 3A | Hs.212553 | AI922921 | 5658885 | wn81c05.x1 cDNA, 3' end /clone = IMAGE:2452232/clone_end = 3' | −1 | ACCTGGAGAATTCCCTAAGGCCAAAG CAAGGTAACAGGGACTTCAGTTTT |
| 5504 | Table 3A | Hs.58643 | AI926251 | 5662139 | 602438603F1 cDNA, 5' end /clone = IMAGE:4564968/clone_end = 5' | −1 | GCCTCAGTACAAAGGGGGCTTTGGA AGTGTTTGTTGGCTGAATAAAGGAA |
| 5505 | Table 3A | Hs.40328 | AI927454 | 5663418 | nab63b04.x1 CDNA, 3' end /clone = IMAGE:3272383/clone_end = 3' | −1 | ACCCATGCCAATTGAAGAACGTGTTA AAGATGAGGAGGAGAGATGTACCA |
| 5506 | db mining | Hs.154368 | AI934956 | 5673826 | ng40b06.s1 cDNA, 3' end /clone = IMAGE:937235/clone_end = 3' | 1 | GCACATTCCTTCCTTATATCCTGGAA GCACCCAGATATTCTTCATGTCCC |
| 5507 | Table 3A | Hs.101370 | AI936516 | 5675386 | AL583391 cDNA /clone = CS0DL012YA12-(3-prime) | 1 | TTAAGTCATCTGCTGAGCAGTGTGCT GTGTCAACCTCCTCCTAGGTAACC |
| 5508 | Table 3A | Hs.180446 | A1948513 | 5740623 | importin beta subunit mRNA, complete cds/cds = (337, 2967) | −1 | CAGGGTATCAGATATTGTGCCTTTTG GTGCCAGGTTCAAAGTCAAGTGCC |
| 5509 | Table 3A | Hs.71245 | AI954490 | 5746809 | zl17f11.r1 cDNA, 5' end /clone = IMAGE:502221/clone_end = 5' | −1 | TGGTAATAGTGTTTGACTCCAGGGAA GAACAGATGGGTGCCAGAGTGAAA |
| 5510 | Table 3A | Hs.118820 | AI955314 | 5747624 | *Homo sapiens*, clone IMAGE:3357862, mRNA, partial cds/cds = (0, 325) | −1 | TCAAGTATACCATTTAAAATATTTCAT CAGGCAGGCCCTGACCAGGAAA |
| 5511 | db mining | NA | AI961962 | 5754664 | wt40g09.x1 NCI_CGAP_Pan1 cDNA clone IMAGE:2509984 3' similar to gb:M87789 IG GAMMA-1 CHAIN C REGION | −1 | CTTTTCCGGTTGCCCGAGGATGCTTG GGAAGGAACCCGTCTCCCTTCTTC |
| 5512 | Table 3A | Hs341528 | AI962127 | 5754840 | wx77f07.x1 cDNA, 3' end /clone = IMAGE:2549701/clone_end = 3' | −1 | TCCCCAAACCCCCTTAAAGGTTTTTA AATTGTTTCAAATCTGGGCAAGTT |
| 5513 | Table 3A | Hs.37121 | AI968387 | 5765205 | phospholipase C, beta 3 | −1 | GACTCGGAGAGCCAGGAGGAGAACA |

TABLE 8-continued

| SEQ ID | Origin | Unigene | Locus | GI | Nominal Description | Strand | Probe Sequence |
|---|---|---|---|---|---|---|---|
| | | | | | (phosphatidylinositol-specific) (PLCB3), mRNA/cds = (0, 3704) | | CGCAGCTCTGAACTGGCTGAGCGAG |
| 5514 | db mining | Hs.13034 | AI969716 | 5766534 | hv63f09.s1 CDNA, 3' end /clone = IMAGE:3178121/clone_end = 3' | −1 | CTGTTGTGAATCATTTGTGTCCTTTTC AACTGTCTTTCAGAGGAAAGGTA |
| 5515 | Table 3A | Hs.193247 | AI978581 | 5803611 | hypothetical protein DKFZp434A171 (DKFZp434A171), mRNA /cds = (113, 2584) | −1 | AAGAAGCAACCACAGCTAATTTTAGA ACATGCACTCTGACAGAAAAGACA |
| 5516 | Table 3A | Hs.153 | AI984074 | 5811293 | ribosomal protein L7 (RPL7), mRNA /cds = (10, 756) | −1 | GCTTTTGAGGACCTTTCTGGAGGAAA GGAAAAGCCTGTTTTGGGGAGTCT |
| 5517 | Table 3A | Hs.7557 | AL042081 | 5421426 | FK506-binding protein 5 (FKBP5), mRNA/cds = (153, 1526) | −1 | AGGCTGCATATGGATTGCCAAGTCAG CATATGAGGAATTAAAGACATTGT |
| 5518 | Table 3A | Hs.133262 | AL044498 | 5432716 | DKFZp434I082_s1 cDNA, 3' end /clone = DKFZp434I082/clone_end = 3' | −1 | AAGACTAGAGCTACACTAGGCCACTA TCTTATTACACGACAGCACAACAT |
| 5519 | Table 3A | Hs.39911 | AL138429 | 6855110 | mRNA for FLJ00089 protein, partial cds/cds = (82, 1111) | −1 | TTAAGAACCCCAAAGATTAAAGGAAA CAATGTTAAGGGCTTTTGTGAGGA |
| 5520 | Table 3A | Hs.89986 | AL515381 | 12778874 | cDNA/clone = CL0BB0172H06-(3-prime) | −1 | CGGAAGTCGAAATCAAATCTATGCTT TTAATTGAAACCGTGCCTGAAACG |
| 5521 | Table 3A | Hs.9096 | AL520535 | 12784028 | hypothetical protein FLJ20473 (FLJ20473), mRNA/cds = (57, 1472) | −1 | TCTTCACCAGGTTCAAGCTCCGTGGG CCACACTGCTGCTGTGCCAAGAAG |
| 5522 | Table 3A | Hs.13144 | AL521097 | 12784590 | HSPC160 protein (HSPC160), mRNA /cds = (53, 514) | −1 | GATACACTGTCCAGCCCAGGTCCAG GCCCTAGGTTCTTTACTCTAGCTAC |
| 5523 | Table 3A | Hs.118142 | AL522477 | 12785970 | AL522477 cDNA /clone = CS0DB008YK14-(3-prime) | −1 | TGGAATTTACTAAATTGTGAAATTAAC GTAACCGAAGCAACAACCGGCAA |
| 5524 | Table 3A | Hs.295112 | AL528020 | 12791513 | KIAA0616 gene product (KIAA0618), mRNA/cds = (1041, 4040) | −1 | GCGGGAGGCTGGGACTTTCCATTAC AATAGAGACTTCATTCCTGTTGAG |
| 5525 | Table 3A | Hs.26670 | AL540260 | 12870241 | AL540260 cDNA /clone = CS0DF032YF03-(3-prime) | −1 | ACTCAGGTGGTGCTGGTGTTAGTGAT GCTGGAGAAGAGAATATTACTGGT |
| 5526 | Table 3A | Hs.285013 | AL543900 | 12876379 | putative HLA class II associated protein I (PHAP1), mRNA /cds = (148, 897) | −1 | CAGGTTGCTTTCGTGTCCCTCTTCTG GTTGCTTTAGAAGTGACGTGTAAT |
| 5527 | Table 3A | Hs.183232 | AL581892 | 12909772 | hypothetical protein FLJ22638 (FLJ22638), mRNA/cds = (12, 476) | −1 | AAACACAGCCCACCCCATTTCAGACC GCCTTCCTGAGGAGAAAATGACAG |
| 5528 | Table 3A | Hs.21812 | AL582895 | 12911771 | AL562895 cDNA /clone = CS0DC021YO20-(3-prime) | −1 | GCTAACTGGATAAAGTTTGTGCAGAC ATTCCTGAGTGTACGATATTGACC |
| 5529 | Table 3A | Hs.21812 | AL582895 | 12911771 | AL562895 cDNA /clone = CS0DC021YO20-(3-prime) | −1 | GCTAACTGGATAAAGTTTGTGCAGAC ATTCCTGAGTGTACGATATTGACC |
| 5530 | Table 3A | Hs.181165 | AL565738 | 12917408 | eukaryotic translation elongation factor 1 alpha 1 (EEF1A1), mRNA /cds = (53, 1441) | −1 | AGCTGGCTTCACTGCTCAGGTGATTA TCCTGAACCACCAGGCCAAATAAG |
| 5531 | Table 3A | Hs.77393 | AL567986 | 12921892 | farnesyl diphosphate synthase (farnesyl pyrophosphate synthetase, dimethylallyltransferase, geranyltranstransferase) (FDPS), mRNA/cds = (114, 1373) | | AGTCAGGACTGTCTAGGTCAGGGAA GCCAAGATGTCTGAAGAGAGGAA |
| 5532 | Table 3A | Hs.13256 | AL570416 | 12928702 | AL570416 cDNA /clone = CS0DI020Y05-(3-prime) | −1 | ATTCAACCAGTAATGGTACCTGAGGA ATTGAAATGGGTATTTGTTTCTGT |
| 5533 | Table 3A | Hs.180546 | AL571386 | 12928631 | AL571388 cDNA /clone = CS0DI009YL09-(3-prime) | −1 | AGTGGAGAGGCCCTGTTAGTTTACTT TTCATATTGAGTGATGCATGAGGT |
| 5534 | Table 3A | Hs.21732 | AL573787 | 12933363 | AL573787 cDNA /clone = CS0DI055YM17-(3-prime) | −1 | GCATTCTATTTAAAAAGGGAGTGGGG AGCAAATGAAAATTAAATGTGGGG |
| 5535 | Table 3A | Hs.23294 | AL574514 | 12934790 | hypothetical protein FLJ14393 (FLJ14393), mRNA/cds = (60, 1454) | −1 | TCACCAGGAAAACATGCTTGTGAATT GTGCAGTAAAAGGTGGTAATGACT |
| 5536 | Table 3A | Hs.181392 | AL575666 | 12937052 | major histocompatibility complex, class I, E (HLA-E), mRNA/cds = (7, 1083) | −1 | CCTTTTCTCTCCCATGACCCTTTAACA GCATCTGCTTCATTCCCCTCACC |
| 5537 | Table 3A | Hs.85258 | AL575755 | 12937231 | CD8 antigen, alpha polypeptide (p32) (CD8A), mRNA/cds = (65, 772) | −1 | CTGAGAGCCCAAACTGCTGTCCCAAA CATGCACTTCCTTGCTTAAGGTAT |
| 5538 | Table 3A | Hs.169610 | AL576149 | 12938006 | mRNA for transmembrane glycoprotein (CD44 gene) /cds = (178, 2406) | −1 | TGAGTGAACAAAGCTGTGAAACATTC TGCGTTTATGCAACTTCCTTGCCT |
| 5539 | Table 3A | Hs.174905 | AL577970 | 12941605 | mRNA for KIAA0033 gene, partial cds /cds = (0, 1008) | −1 | CAAGAAGACAAGCATCTGTGGTGCG GAGGCAAGCAGGCTAACTAGGAGTT |
| 5540 | Table 3A | Hs.5057 | AL578975 | 12943566 | AL578975 cDNA /clone = CS0DK012YN01-(3-prime) | −1 | TTGGCCCAGTGTGATTGATTGCTTTA TCTTTGGTACTTTTACTTGAATGG |
| 5541 | Table 3A | Hs.279555 | AL582047 | 12949649 | AL582047 cDNA /clone = CS0DL003YD01-(3-prime) | −1 | CATCCAGCACTAATTTTCATGCATTTA TGAAAGGATGCCTGAGGACCCTT |
| 5542 | Table 3A | Hs.198296 | AL582354 | 12950255 | SWI/SNF related, matrix associated, actin dependent regulator of chromatin, subfamily a, member 2 (SMARCA2), mRNA/cds = (297, 5015) | −1 | AGCCTGAGGCAAATAAAATTCCAGTA ATTTCGAAGAATGGGTGTTGGCAA |
| 5543 | Table 3A | Hs.101370 | AL583391 | 12952309 | AL583391 cDNA /clone = CS0DL012YA12-(3-prime) | −1 | AGGACCTTGACAAGCCGTTTGAGATG GAATGTAGGCCCTGATGTTATGCT |
| 5544 | Table 3A | Hs.101370 | AL583391 | 12952309 | AL583391 cDNA /clone = CS0DL012YA12-(3-prime) | −1 | AGGACCTTGACAAGCCGTTTGAGATG GAATGTAGGCCCTGATGTTATGCT |
| 5545 | Table 3A | Hs.7187 | AU158636 | 11020157 | mRNA for KIAA1757 protein, partial cds/cds = (347, 4576) | −1 | AGTGGAGTGTTTACACCTTGCTGTAA CATTTGAACTTTCACAAGAGATGT |

TABLE 8-continued

| SEQ ID | Origin | Unigene | Locus | GI | Nominal Description | Strand | Probe Sequence |
|---|---|---|---|---|---|---|---|
| 5546 | Table 3A | Hs.86671 | AV648638 | 9869652 | 602079785F2 cDNA, 5' end /clone = IMAGE:4254068/clone_end = 5' | −1 | ATATCATATTATTTGATGCCATTAGGC GGCCTGGATCACCAATTCTAAGT |
| 5547 | Table 3A | Hs.343475 | AV648670 | 9869684 | 601556208T1 cDNA, 3' end /clone = IMAGE:3826392/clone_end = 3' | −1 | GCCACCAGACAGAAGGACCAGAGTT TCTGATTATAAACAATGATGCTGGG |
| 5548 | Table 3A | Hs.2730 | AV650434 | 9871446 | heterogeneous nuclear ribonucleoprotein L (HNRPL), mRNA /cds = (28, 1704) | −1 | TGTTGGTGAGCAATGTGCAGAGGCA GAGCCGCTGAAGTATGGTTCCTGAG |
| 5549 | Table 3A | Hs.312582 | AV651615 | 9872629 | 601439711F1 cDNA, 5' end /clone = IMAGE:3924482/clone_end = 5' | −1 | GGCTGCTGTTGACTGAAATTCCTATC CTCAAATTACTCTAGACTGAAGCT |
| 5550 | Table 3A | Hs.5897 | AV653169 | 9874183 | cDNA FLJ13388 fis, clone PLACE10011681/cds = UNKNOWN | −1 | CTTTTTAGTAGGCAAAGGTTCTTCTTC CTCCTCTTTTGGTGCAGGGACGC |
| 5551 | Table 3A | NA | AV664188 | 9875202 | AV654188 GLC cDNA clone GLCDTC01 3', mRNA sequence | −1 | GCGTGTATGTGGGATGCCATAGGTG TGACTGTAGAGTCATTCTTCCTTCC |
| 5552 | Table 3A | Hs.38218 | AV659358 | 9880372 | 602569369F1 cDNA, 5' end /clone = IMAGE:4693744/clone_end = 5' | −1 | TGTAAGTTGACTTTCAAAAGTCTCTG GAAACACTGGACTTTAGCTGGTCC |
| 5553 | Table 3A | Hs.133333 | AV661783 | 9882797 | AV661783 cDNA, 3' end /clone = GLCGXE12/clone_end = 3' | −1 | GAAGCGTGGCAGAGAACTATGGATC AGGCAGCCCCTCTCATCTTTACCAT |
| 5554 | Table 3A | Hs.85844 | AV700210 | 10302181 | neurotropic tyrosine kinase, receptor, type 1 (NTRK1), mRNA/cds = (0, 2390) | −1 | TTGGTCCAAACTCTGGAGCCTTGTGG GAGAACATAGGGCATAACGTGTTT |
| 5555 | Table 3A | Hs.285173 | AV700298 | 10302269 | 602632207F1 cDNA, 5' end /clone = IMAGE:4777537/clone_end = 5' | −1 | CCCTTCTTAGTAAAGAGACATCTTCT ACAGTAACCACAGAAGAAGTGG |
| 5556 | Table 3A | Hs.238730 | AV700542 | 10302513 | hypothetical protein MGC10823 (MGC10823), mRNA/cds = (63, 1235) | −1 | TGGACATAACCTGGGTCAGAAGAGAA ACTTTTGAAGCTACACGAACAAGC |
| 5557 | Table 3A | Hs.284674 | AV700636 | 10302607 | AV700636 cDNA, 3' end /clone = GKBAGH12/clone_end = 3' | −1 | CGGCTCAAATAAACCTTTACCGGATT TTTGGGGTTATGCCCACACCCTTG |
| 5558 | Table 3A | Hs.240077 | AW002624 | 5849540 | wu60d10.x1 cDNA, 3' end /clone = IMAGE:2524435/clone_end = 3' | −1 | GGACCACTAGTACTCCAGAACCATAA TATAACTAGACATGCCTGGAATGC |
| 5559 | Table 3A | Hs.301704 | AW002985 | 5849991 | eomesodermin (Xenopus laevis) homolog (EOMES), mRNA /cds = (0, 206O) | −1 | AACAAGCCATGTTTGCCCTAGTCCAG GATTGCCTCACTTGAGACTTGCTA |
| 5660 | Table 3A | NA | AW004905 | 5853768 | wz82d03.x1 NCI_CGAP_Gas4 cDNA clone IMAGE:2565317 3' similar to SW:ATP6_HUMAN P00848 ATP SYNTHASE A | −1 | TCTACTGACTATCCTAGAAATCGCTG TCGCCTTAATCCAAGCCTACGTTT |
| 5561 | Table 3A | Hs.173280 | AW005378 | 5854154 | ws94a12.x1 cDNA, 3' end /clone = IMAGE:2505598/clone_end = 3' | −1 | GAGAAACTTCCGTGCATGAAGGTTTC CTCCTTGACTCGGCAGCAGCGGCC |
| 5562 | Table 3A | Hs.233560 | AW006045 | 5854823 | wz81b09.x1 cDNA, 3' end /clone = IMAGE:2565209/clone_end = 3' | −1 | CCAAGTAGGTTTTAACTCTGGTATGG TCTCGTGTTTTCATTTGTTGTGCA |
| 5563 | Table 3A | Hs.159643 | AW006352 | 5855130 | wt04d12.x1 cDNA, 3' end /clone = IMAGE:2506487/clone_end = 3' | −1 | GTTCCCACGGAGCTGACTTCTCCGG GGTGCCTGTGCCCTACATTAAACCC |
| 5564 | Table 3A | Hs.231987 | AW006867 | 5855845 | 602320903F1 cDNA, 5' end /clone = IMAGE:4424065/clone_end = 5' | −1 | CCGTAACTCCGACAACGCAGAACTT CTTGAGGCTTTCTTCTTCTAAGGA |
| 5565 | db mining | Hs.157118 | AW009081 | 5857859 | ws76g10.x1 cDNA, 3' end /clone = IMAGE:2503938/clone_end = 3' | −1 | TCTGGACCCTGCTTGGGTTCACAGCA TTGGTGGAGGTAAGTAGTATTCTC |
| 5566 | Table 3A | Hs.134272 | AW009671 | 5858449 | ws85g09.x1 CDNA, 3' end /clone = IMAGE:2504800/clone_end = 3' | −1 | GAAGAGGAAGCTCATCCGAAGTCTTC CGACAGAGTGAGCCGTCATGCCCG |
| 5567 | db mining | Hs.131887 | AW009730 | 5858508 | 602415255F1 cDNA, 5' end /clone = IMAGE:4523725/clone_end = 5' | −1 | AGTGTGTATTCTTGATGTTTATTGGCT CATGTGGACAGAAATGTACAGGG |
| 5568 | Table 3A | Hs.232000 | AW016002 | 5864759 | UI-H-B10p-abh-h-06-0-UI.s1 cDNA, 3' end/clone = IMAGE:2712035 /clone_end = 3' | −1 | AGATGAGGCTGCTCTGAAGATTCAGT AATTAGGATGGACAGTCAGCTACT |
| 5569 | Table 3A | Hs.233261 | AW026667 | 5880120 | wv15d09.x1 cDNA, 3' end /clone = IMAGE:2529617/clone_end = 3' | −1 | TGGGCTTTGGGGTTCAGTTTGTTACC TTTGGAGACTTATTTAATGAAACC |
| 5570 | Table 3A | Hs.101340 | AW026713 | 5880166 | EST380762 dnNA | −1 | CAGTGGTTCCTGAGAGAATCTTAGTT CAAAGGACTGCCCCCGCCAACCCC |
| 5571 | Table 3A | NA | AW027160 | 5885916 | wt72b08.x1 Soares_thymus_NHFTh cDNA clone IMAGE:2512983 3' similar to contains Alu repetitive eleme | −1 | ACCGCCAAAGCCAATCATCCACTTTC AGTACTTACCTAACCAATACTCCCA |
| 5572 | Table 3A | Hs.233564 | AW027530 | 5888286 | wv74c06.x1 cDNA, 3' end /clone = IMAGE:2535274/clone_end = 3' | −1 | CAGGATGTTATTGACAGGGTGGCCTT TGTGATTCCTCCGGTGGTGGCAGC |
| 5573 | Table 3A | Hs.311783 | AW043857 | 5904386 | wy61g04.x1 cDNA, 3' end /clone = IMAGE:2554998/clone_end = 3' | −1 | GCCATTTCATTTGCTGTGTGGTTAGA CTTCCAGGAGGCTGTTTAGCTCTA |

TABLE 8-continued

| SEQ ID | Origin | Unigene | Locus | GI | Nominal Description | Strand | Probe Sequence |
|---|---|---|---|---|---|---|---|
| 5574 | Table 3A | Hs.277672 | AW050975 | 5913245 | wz25f04.x1 cDNA, 3' end /clone = IMAGE:2559103/clone_end = 3' | −1 | CCTTTGTGAAAAGTCACCTGTGACTG TCAGGGGTATGCTATGGGCCTTTT |
| 5575 | db mining | Hs.279068 | AW063114 | 8887051 | TN0103 cDNA, 3' end/clone_end = 3' | −1 | GATCCACTTTGGGGTTCGGCGGCAG ATTATTCCGCTGGTAGAGCCGGATG |
| 5576 | db mining | Hs.279082 | AW063120 | 8887169 | TN0257 cDNA, 3' end/clone_end = 3' | −1 | AATAAGGGACTCATTCATTATGCAGC AAATGTTCTTTGTTATTGGCTTGC |
| 5577 | db mining | Hs.279083 | AW063153 | 8887202 | TN0788 cDNA, 3' end/clone_end = 3' | −1 | CTTCATGGTCTCCAGCCAGGACTCCA TCAGCGCCACGGCTTCATCCGAAC |
| 5578 | db mining | Hs.279127 | AW063155 | 8887204 | DP1003 cDNA, 3' end/clone_end = 3' | −1 | TTGATGCTCATCATCTGCTCGAGGTG ATTGATGCCAGGTTGACGCACCAT |
| 5579 | db mining | Hs.279104 | AW063156 | 8887205 | TN0974 cDNA, 3' end/clone_end = 3' | −1 | TCCTTTGGATAAGGTCCAAAACCTGT AACACATGACCCTCAGAGCCCTTT |
| 5580 | db mining | Hs.279085 | AW063158 | 8887207 | TN0311 cDNA, 3' end/clone_end = 3' | −1 | CCCGGCGACTTCACCACCCGCTATCT GGGCACCAAAGACTATATCTAGAT |
| 5581 | db mining | Hs.279086 | AW063159 | 8887208 | TN0312 cDNA, 3' end/clone_end = 3' | −1 | CGCAATAGTCCTCGACAAGTCGCCAA CCCTCCCACTTCGGTGGATCAGCT |
| 5582 | db mining | Hs.279092 | AW063191 | 8887240 | TN0359 cDNA, 3' end/clone_end = 3' | −1 | CGTCGGGTACCTCGCCGATAAAATC GCTGATGGCCTGGTCGATCCTGAAG |
| 5583 | db mining | Hs.279093 | AW063196 | 8887245 | TN0380 cDNA, 3' end/clone_end = 3' | −1 | ATCTTATCCCTCTGTTACTCAATGTGA GTGCATACTTTACATTGCCTACT |
| 5584 | db mining | Hs.279102 | AW063210 | 8887259 | TN0377 cDNA, 3' end/clone_end = 3' | −1 | GGTCCTTGAAGATGACGCGGATGAT CGAGGTCTCTGCGCCGTAGGCGATG |
| 5585 | db mining | Hs279067 | AW063230 | 8887055 | TN0107 cDNA, 3' end/clone_end = 3' | −1 | ATGATGAAGCTGCTGTCCAACGCCTT CGTCTGCCAGTTTCTGCTGGTGTG |
| 5586 | db mining | Hs.279069 | AW063239 | 8887064 | TN0018 cDNA, 3' end/clone_end = 3' | −1 | TCCTTGCCAGAGCCTTCGGGTTCTAC GATTTGATCGACGACGCTGGTGTC |
| 5587 | db mining | Hs.279070 | AW063242 | 8887067 | TN0138 cDNA, 3' end/clone_end = 3' | −1 | TCGAACATGGGCAGCTCCGTTTCAAG ATGGCTCAAGACTAGCGGATTGGG |
| 5588 | db mining | Hs.279071 | AW663246 | 8887071 | TN0358 cDNA, 3' end/clone_end = 3' | −1 | AGTGATAGAGACCAAAGACTGCTTTT TAATTTTGTGGGGAGGGGGTGGA |
| 5589 | db mining | Hs.279072 | AW063252 | 8887077 | TN0149 cDNA, 3' end/clone_end = 3' | −1 | CGGGTCACTCATGTTGGCTACTAACC CTTTTCGTGCGCCGGGCATTCTAG |
| 5590 | db mining | Hs.279087 | AW063267 | 8887092 | TN0331 cDNA, 3' end/clone_end = 3' | −1 | CTTGTCCTTGATCGCTTCCTTCTCTG CAAGGGAGAGCTTCTGGACCTTCA |
| 5591 | db mining | Hs.279073 | AW063271 | 8887096 | TN0158 cDNA, 3' end/clone_end = 3' | −1 | CTTGTTTGACATCAGCGCCATCTCGA CAGCGTATTCCGCTATGACTGTTT |
| 5592 | db mining | Hs.279074 | AW063274 | 8887099 | TN0792 cDNA, 3' end/clone_end = 3' | −1 | CACGAAGCCTTCGATCAGTTGCAGCA CGCGGCCAGAGCGGTCGATAGAAC |
| 5593 | db mining | Hs.279122 | AW063299 | 8887124 | TN0185 cDNA, 3' end/clone_end = 3' | −1 | CATTTTGCCATCTGCGAGCATCTGGG TATTGACATGATCCCCAGTGGAGC |
| 5594 | db mining | Hs.279076 | AW063319 | 8887144 | TN0230 cDNA, 3' end/clone_end = 3' | −1 | CACCAAGCTGGTCAACATCCAGGCG AATGGCTATTACGTGGATGAGATCA |
| 5595 | db mining | Hs.279078 | AW063325 | 8887150 | TN0238 cDNA, 3' end/clone_end = 3' | −1 | TTGCTGATACGGCCTTTGATCATGTT TTCAACGATGTTTTCCGGCTTGCC |
| 5596 | db mining | Hs.279079 | AW063327 | 8887152 | TN0238 cDNA, 3' end/clone_end = 3' | −1 | CCTCGACAAACTAAATGTTGATTTGA ATTGGCCTGTTATCATCTTGATCAC |
| 5597 | db mining | Hs.302423 | AW063352 | 8887269 | TN0725 cDNA, 3' end/clone_end = 3' | −1 | GTTTCAGATCGGGCCGCTCCCGCCG GGTACCTATAGCGGAATCGAATTTC |
| 5598 | db mining | Hs.279095 | AW063358 | 8887295 | TN0979 cDNA, 3' end/clone_end = 3' | −1 | GAAAACAGAAATGATGCTCGGCACAT TCTCGTCCAGCACCTCGGCAACGG |
| 5599 | db mining | Hs.279096 | AW063371 | 8887308 | TN0746 cDNA, 3' end/clone_end = 3' | −1 | AACTGTATTCGATCACCGTGGCGCTG ATGGTGTCAGCAGTCGCCTTGTTC |
| 5600 | db mining | Hs.279097 | AW063372 | 8887309 | TN1085 cDNA, 3' end/clone_end = 3' | −1 | AGTTGACATATAACCCACTTTACATAC ATTCCAAAATTGCGAGTAGTGAGT |
| 5601 | db mining | Hs.279075 | AW063428 | 8887365 | TN0121 cDNA, 3' end/clone_end = 3' | −1 | ATATCGTACCGAGAAACTAGTGCGGA TATCTGACCAGGTATGGCGGTTGG |
| 5602 | db mining | Hs.279099 | AW063436 | 8887373 | TN0922 cDNA, 3' end/clone_end = 3' | −1 | GTGGATGACCTGATCCAGGTCGGCC TGATCGGCCTGACTGATGAGCTGTC |
| 5603 | db mining | Hs.279100 | AW063458 | 8887395 | TN0949 cDNA, 3' end/clone_end = 3' | −1 | ATGATGACCAGATGCTCTGGCACCGT GTCGAGTTCGAGGATGCCGACATT |
| 5604 | db mining | Hs.279103 | AW063469 | 8887406 | TN0961 cDNA, 3' end/clone_end = 3' | −1 | GATCTGGGACGCATGGCCGAAGCTG AAAAGCTGGCTGTAGAAGACCTCGA |
| 5605 | db mining | Hs.279101 | AW063474 | 8887411 | TN0354 cDNA, 3' end/clone_end = 3' | −1 | AACATGGCAATATTTATTGGTCCTAAT ACTGTCACTGGCAAGGTTGGTGT |
| 5606 | db mining | Hs.279821 | AW063497 | 8887434 | TN0113 cDNA, 3' end/clone_end = 3' | −1 | GAGGCAGAGGTGTAGCGAGTCCAGG CTCTCTTCGAACGTTGCACCCGACG |
| 5607 | db mining | Hs.279105 | AW063509 | 8887446 | TN1012 cDNA, 3' end/clone_end = 3' | −1 | GTCCCACACGTTCGGCCCTGACTCT GCTGTGTTCGACGAGGACAATCTCG |
| 5608 | db mining | Hs.279089 | AW063534 | 8887471 | TN1054 cDNA, 3' end/clone_end = 3' | −1 | CATGACGTTGTGCTCGACACCCCAAC AGATCACGTAATCAGCCTGGTGGA |
| 5609 | db mining | Hs.279080 | AW083546 | 8887483 | TN0243 cDNA, 3' end/clone_end = 3' | −1 | TAGGCTATAGAGATGTGAGGGATTAT TATTAGTCACACCTCTAGTCATGCC |
| 5610 | db mining | Hs.279108 | AW063552 | 8887489 | TN1055 cDNA, 3' end/clone_end = 3' | −1 | GGCTGCCGGATGTGTAGGTCTTCCC ATGTTGTGAAGTAACGGTGCTCCAC |
| 5611 | db mining | Hs.279109 | AW063556 | 8887493 | TN1059 cDNA, 3' end/clone_end = 3' | −1 | TGCCCTGTATAGTGTTGTAAAAATTA |

TABLE 8-continued

| SEQ ID | Origin | Unigene | Locus | GI | Nominal Description | Strand | Probe Sequence |
|---|---|---|---|---|---|---|---|
| 5612 | db mining | Hs.279110 | AW063561 | 8887498 | TN1066 cDNA, 3' end/clone_end = 3' | −1 | GAATGTTTCACCCAAACCATCTGG GTCTTTCGAATCGCTCTTTAGCTCGT |
| 5613 | db mining | Hs.279090 | AW063572 | 8887509 | TN1079 cDNA, 3' end/clone_end = 3' | −1 | GCGGGCTGTTGTCCCACTTGTTGG CTATGCGCTGCGCTACAAGCTGGAC |
| 5614 | db mining | Hs.279111 | AW063598 | 8887535 | DP0133 cDNA, 3' end/clone_end = 3' | −1 | CTGTATTCGGACTTCAGCTACTACC TTCGAAGCGACGCTGCGTGCGCTGC |
| 5615 | db mining | Hs.302424 | AW063600 | 8887537 | DP0925 cDNA, 3' end/clone_end = 3' | −1 | TCGTCCAATTGCAGCATGGATAAGG CCTTCCGCTGTCCCTTCAGTAGCTGT |
| 5616 | db mining | Hs.279124 | AW063609 | 8887546 | DP0922 cDNA, 3' end/clone_end = 3' | −1 | TTCTGTTCCCTGACGCCCACTTCT CAATGCAGCGGCTGATGCAGATCAC |
| 5617 | db mining | Hs.279113 | AW063830 | 8887567 | DP0154 cDNA, 3' end/clone_end = 3' | −1 | CCACGAGATGCAGGACGAAGGCGAG TCATTCAGTCTGAGTAGGAGGAAAGA |
| 5618 | db mining | Hs.279114 | AW063635 | 8887572 | DP0774 cDNA, 3' end/clone_end = 3' | −1 | GGACAGGTTGTTGGAGAGTTGGTT TAATTGCCGCTGAAGCAGAATCCTC |
| 5619 | db mining | Hs.279125 | AW063652 | 8887589 | DP0189 cDNA, 3' end/clone_end = 3' | −1 | GAAATGCGTCACCTTCGGATTGAC AAATGTGGTGACAAAGTACCAGCAAG |
| 5620 | db mining | Hs.279116 | AW063878 | 8887615 | DP0229 cDNA, 3' end/clone_end = 3' | −1 | AACTGGACTGTGTTTCTGGAGCCT GTTCATCGTCTCGCGTCGCAAGAAGT |
| 5621 | db mining | Hs.279117 | AW063709 | 8887648 | DP0338 cDNA, 3' end/clone_end = 3' | −1 | AAGGGCTAGGCCATGACTCGTTCG CTCTTGGCAGCCCTGCTCTCGTGGG |
| 5622 | db mining | Hs.279118 | AW063718 | 8887655 | DP0314 cDNA, 3' end/clone_end = 3' | −1 | TCAGCATCGTCGCGTGCTCCGGTGG GTGCTCGCTGAGCTGGTCCAGAAAT |
| 5623 | db mining | Hs.279119 | AW063746 | 8887683 | DP0347 cDNA, 3' end/clone_end = 3' | −1 | CCGTCGACTGAGGCGATGGCGGCTG CATGAACAAGGGCCGGATCATCCTG |
| 5624 | db mining | Hs.279123 | AW063778 | 8887715 | DP0954 cDNA, 3' end/clone_end = 3' | −1 | ATGCCCAACACACTGGACTTCGGTG CACCCGTTGTAGGCGACGAGCGTGA |
| 5625 | db mining | Hs.279121 | AW063780 | 8887717 | DP0388 cDNA, 3' end/clone_end = 3' | −1 | ACGAAAACGTGTCGGACGGCTTGTA CATATGCGGCTGTGCCATAGCCGGA |
| 5626 | db mining | Hs.279123 | AW063833 | 8887770 | DP0758 cDNA, 3' end/clone_end = 3' | −1 | TGTTCTTCGTGCGTGCCTACCCCCG TTCTTTCCGTCGCGCATCGGAATGCG |
| 5627 | db mining | Hs.279138 | AW063909 | 8887846 | SP0953 cDNA, 3' end/clone_end = 3' | −1 | AAACTCGTACTTCGTGTAGAACTC GCCAGGGGCTTTATCACTTCCATGGC |
| 5628 | db mining | Hs.279126 | AW063951 | 8887888 | DP0988 cDNA, 3' end/clone_end = 3' | −1 | CGCAGCGATGACCAGGTCAAGCTG CGCCGACCAAGCTTACCGACTTCTCG |
| 5629 | db mining | Hs.279174 | AW063977 | 8887914 | DP1019 cDNA, 3' end/clone_end = 3' | −1 | CCGATCTACTGCGACGAAGAAGGC GGTAGTGACGTGCTGAATGACGGTG |
| 5630 | db mining | Hs.279128 | AW064020 | 8887957 | DP1073 cDNA, 3' end/clone_end = 3' | −1 | CCGTCCATCATGGGTCGGAGTAAG TTCAGGACTCGTTTCACGTAGGCAAC |
| 5631 | db mining | Hs.279130 | AW064046 | 8887983 | SP0153 cDNA, 3' end/clone_end = 3' | −1 | GCTGTCTAAGTTCCCAAGGGATT CTCTTTACCCGGAAACAGGTTGGGGA |
| 5632 | db mining | Hs.279084 | AW064052 | 8887989 | SP0159 cDNA, 3' end/clone_end = 3' | −1 | GATGACACGCAGAAAATCATACGC CTTTGGATATATCGAGAAAGGCCAGG |
| 5633 | db mining | Hs.279825 | AW064053 | 8887990 | SP0992 cDNA, 3' end/clone_end = 3' | −1 | GCCTGAACAAGGAAAGCTTCCAGG AAGGCTGGTCAAGAATCTTGAGACG |
| 5634 | db mining | Hs.279131 | AW064060 | 8887997 | SP0636 cDNA, 3' end/clone_end = 3' | −1 | GAATTGCACAGTCTCGGCGTGATCC GATCGATTCGGGGGTGACATCGGCG |
| 5635 | db mining | Hs.279135 | AW064084 | 8888021 | SP0612 cDNA, 3' end/clone_end = 3' | −1 | CTGAGCACCATCACCGGAACATAAG CTGAGATCACCCTGAACACCGACAAG |
| 5636 | db mining | Hs.279136 | AW064098 | 8888035 | SP0575 cDNA, 3' end/clone_end = 3' | −1 | GACGAGATCGCAGTCTGCAACCTG CTGAAGGCTTTGGCGACAACCAGGT |
| 5637 | db mining | Hs.302426 | AW064100 | 8888037 | SP0684 cDNA, 3' end/clone_end = 3' | −1 | CTATCCGTTTGAATTGGCGAGAAC TCTTGTGCCAGCACGTCTTGCTGATA |
| 5638 | db mining | Hs.279175 | AW064121 | 8888058 | SP0554 cDNA, 3' end/clone_end = 3' | −1 | GCCGATGAATCGCGTCCCTTTGTC GAACTCCTCAAGGAAATAGTCCACCG |
| 5639 | db mining | Hs.279139 | AW064129 | 8888068 | SP0696 cDNA, 3' end/clone_end = 3' | −1 | CCTGCTGCTTGGACGCTGCCAGTT GTGACCTCGGGGTCCCCCTTGGTGA |
| 5640 | db mining | Hs.279140 | AW064138 | 8888073 | SP0570 cDNA, 3' end/clone_end = 3' | −1 | GGGTGCCGGTCTTGTCGAAGACGAC GTGTTCGGGCTTCATGTCGCCAACAC |
| 5641 | db mining | Hs.279106 | AW064157 | 8888094 | TN1014 cDNA, 3' end/clone_end = 3' | −1 | CATCGGCACTGGCATCATCGATCC AGGTTGATTTCCACTTCCTCGGGAGG |
| 5642 | db mining | Hs.279141 | AW064160 | 8888097 | SP0594 cDNA, 3' end/clone_end = 3' | −1 | TTTCGCCACCTCTTCGCCTTTGAG GTTAGCTTCCACGCTTTATCTCCTGC |
| 5643 | db mining | Hs.279142 | AW064161 | 8888098 | SP0595 cDNA, 3' end/clone_end = 3' | −1 | TCTGAGTGTGTACCCGCGCTGCTC TTAAAGTGGTAAGGGAGGTTTCTACT |
| 5644 | db mining | Hs.279143 | AW064166 | 8888103 | SP0605 cDNA, 3' end/clone_end = 3' | −1 | CCTGGGAAACATTAAGTACCTT CTTTCTCCGACTTCGAGATCTGCCCG |
| 5645 | db mining | Hs.279144 | AW064175 | 8888112 | SP0615 cDNA, 3' end/clone_end = 3' | −1 | TGGTCGAGATCGTGGTAGATGATG AACTGGATAGAGCACGAGCCTTCTAA |
| 5646 | db mining | Hs.279824 | AW064185 | 8888122 | SP0630 cDNA, 3' end/clone_end = 3' | −1 | GCTTGGAGTTGCAGGTTCGAATCC GAAGATCGGCGCAACGAAGACCGCT |
| 5647 | Table 3A | NA | AW064187 | 8888124 | (One single EST, artifact ?) SP0632 KRIBB Human CD4 intrathymic T-cell cDNA library cDNA 3', mRNA sequence | −1 | TCCACTTCATCAACTGGACCAAGAA TGCTTCTGTGACAGATTAGCTTACAT CTTACCACCTCACCGAGAAGAGCT |
| 5648 | db mining | Hs.279146 | AW064189 | 8888128 | SP0634 cDNA, 3' end/clone_end = 3' | −1 | AGCTCAAGAGCTTCCGCGACGTACC |

TABLE 8-continued

| SEQ ID | Origin | Unigene | Locus | GI | Nominal Description | Strand | Probe Sequence |
|---|---|---|---|---|---|---|---|
| 5649 | db mining | Hs.279145 | AW064194 | 8888131 | SP0633 cDNA, 3' end/clone_end = 3' | −1 | CAGCAAAGTAACGCTCGACGAATGC ATCGAAGACGTGATGCTGAACCTTTG |
| 5650 | db mining | Hs.279147 | AW064201 | 8888138 | SP0650 cDNA, 3' end/clone_end = 3' | −1 | GGCGAAGGCCGAGAAGGAAGGCAA CGATACCCTCACTAGACCTCGGATCG AATAAATCAGAGCGATCACATCG |
| 5651 | db mining | Hs.279132 | AW064208 | 8888145 | SP0658 cDNA, 3' end/clone_end = 3' | −1 | GGGGATACACACCCCACAAGCCTTC CTGCGGCTTCATCACGGTTACCACC |
| 5652 | db mining | Hs.279148 | AW064218 | 8888155 | SP0732 cDNA, 3' end/clone_end = 3' | −1 | GATCTTGGTGAGAAGCTCGGTCATGT AGAAGACCTCGCCCTGGGACACTA |
| 5653 | db mining | Hs.279826 | AW064223 | 8888160 | SP0676 cDNA, 3' end/clone_end = 3' | −1 | ATTTTATCGCCAGCTACGTCGGCATT GGTCAGGACGACCTGAAGGGGAAT |
| 5654 | db mining | Hs.279149 | AW064250 | 8888187 | SP1013 cDNA, 3' end/clone_end = 3' | −1 | TGATGCGGAGAGCGAGGTAGATCCC GGCGGAGTTTTCGTCGATGGGAAAG |
| 5655 | db mining | Hs.279150 | AW064255 | 8888192 | SP0105 cDNA, 3' end/clone_end = 3' | −1 | GTACACTTCCTGGATCTGATCCACGA GGTAACGAGCGAGAGTGGTGATAC |
| 5656 | db mining | Hs.279134 | AW064258 | 8888195 | SP0717 cDNA, 3' end/clone_end = 3' | −1 | GTGACTTCATGCTCGGGGTTGAGCTT GGCGTCCACCACCTTTTCCCACTC |
| 5657 | db mining | Hs.279151 | AW064272 | 8888209 | SP0130 cDNA, 3' end/clone_end = 3' | −1 | CCGGTGTCCTTGATCAGCTTCAGCAG TGGCTTGACGTAGATGCGGGTCGG |
| 5658 | db mining | Hs.302427 | AW064275 | 8888212 | SP1065 cDNA, 3' end/clone_end = 3' | −1 | CATCAGTGTTTCTCCTGCTGGGACTG TTGCATGTGGTGCATCACGGTTTG |
| 5659 | db mining | Hs.279153 | AW064284 | 8888221 | SP0755 cDNA, 3' end/clone_end = 3' | −1 | GCGAGGCGAAACATAGCTTCCATTGT GTCTTTTCTCCTTATGCGTCTTGC |
| 5660 | db mining | Hs.279156 | AW064319 | 8888256 | SP1055 cDNA, 3' end/clone_end = 3' | −1 | AATGAGACCCGCCGTCCCTGGAGAT GAAGATGTCGTCCGACTCCGTCCAC |
| 5661 | db mining | Hs.279157 | AW064320 | 8888257 | SP0145 cDNA, 3' end/clone_end = 3' | −1 | CGGATGTTGTCGTTCCAGAACGAAG GATCGGCCTCTTGGGCCTGGATTTC |
| 5662 | db mining | Hs.279164 | AW064343 | 8888280 | SP0916 cDNA, 3' end/clone_end = 3' | −1 | GGCACCGACTTGGGCCTGAGAGAGG CGCAGGTCATCAATATAGAATCGGG |
| 5663 | db mining | Hs.279159 | AW064348 | 8888285 | SP1044 cDNA, 3' end/clone_end = 3' | −1 | CCATGCTGAACTTGGCCAGGTCCTTG ACGGCGGTGTTTTCCGACAGCACC |
| 5664 | db mining | Hs.279161 | AW064375 | 8888312 | SP0115 cDNA, 3' end/clone_end = 3' | −1 | CGCGATGATCTCGTCCTTCGGCATG GCGATGCGCTATTCCTTCGACATGG |
| 5665 | db nining | Hs.279182 | AW064377 | 8888314 | SP1066 cDNA, 3' end/clone_end = 3' | −1 | GCCCATTGACCGTATCGCGTCATCTT GCTGGCATTTCTAAGAAAATACCG |
| 5666 | db mining | Hs.279163 | AW064378 | 8888315 | SP0966 cDNA, 3' end/clone_end = 3' | −1 | TGAACAGGGAAAAGCCAGGAAGAT CTCCGGTTCCACGTCCAATTTGTAC |
| 5667 | db mining | Hs.279168 | AW064424 | 8888361 | SP1056 cDNA, 3' end/clone_end = 3' | −1 | CAAGAATGACGGAAAAATCCGTGAGC ACAAGGCAAAGGCTTGCCGTGTGG |
| 5668 | db mining | Hs.279165 | AW064433 | 8888370 | SP1030 cDNA, 3' end/clone_end = 3' | −1 | GACTTGATCACAACCCGATCCGTAAC GACGTATTGGAGCCACTCGAACAA |
| 5669 | db mining | Hs.279166 | AW064445 | 8888382 | SP1042 cDNA, 3' end/clone_end = 3' | −1 | CTTCTCGCCGTAACTTTTCCGCCGAG CACGCTACGCACGTAGGTGTTGTG |
| 5670 | db mining | Hs.279823 | AW064450 | 8888387 | SP1048 cDNA, 3' end/clone_end = 3' | −1 | TCGACTACGACTTCAACTTCCCCAAA CGGTGGGAGAAGCGAGCTTGAGGC |
| 5671 | db mining | Hs.279167 | AW064452 | 8888389 | SP1069 cDNA, 3' end/clone_end = 3' | −1 | AAGTTGATCAGATCACGGGCCACGC CTGCAACCAGAGGCTTGTCATCGTC |
| 5672 | db mining | Hs.279169 | AW064468 | 8888405 | SP1067 cDNA, 3' end/clone_end = 3' | −1 | TGATCTGATTGTGAGGAGAGTGGAGA AGGTGGTATAGAAGCTGAAAGGGT |
| 5673 | db mining | Hs.279155 | AW064473 | 8888410 | SP1072 cDNA, 3' end/clone_end = 3' | −1 | CTTCATGCTCGAGAAGAAAATGCTCC GTGCCTCCGACGACGCCACCATCG |
| 5674 | db mining | Hs.279170 | AW064478 | 8888415 | SP1080 cDNA, 3' end/clone_end = 3' | −1 | CAGATGGTCACGAGACGCTTGTCCG TGATGTCTTCCGTCAGCGTGCAGAG |
| 5675 | db mining | Hs.279171 | AW064479 | 8888416 | SP0147 cDNA, 3' end/clone_end = 3' | −1 | TGATGGATTTGGAAAGTGTTATTCTG TTTGACTTCTCCCTGCTCTGCTCA |
| 5676 | db mining | Hs.279158 | AW064487 | 8888424 | SP1087 cDNA, 3' end/clone_end = 3' | −1 | TTGAACGGGTATAGCCACCAAGGCAT TGGCTGCAAAGTCGGGCAAAACTT |
| 5677 | db mining | Hs.330544 | AW064490 | 8888427 | SP1090 cDNA, 3' end/clone_end = 3' | −1 | ACTGTGTATTGATGAGTATCTGATGC CTATAACATCTGTAGGAGGCTACA |
| 5678 | db mining | Hs.279160 | AW067725 | 8888472 | SP0110 cDNA, 3' end/clone_end = 3' | −1 | GTACGAAGGTGGCGATGATGCGTTC GATCACCTCGGGGATTTCCTCGGCG |
| 5679 | db mining | Hs.279129 | AW067742 | 8888489 | SP0150 cDNA, 3' end/clone_end = 3' | −1 | CGACCTTCGGCGTTTCCGCTTCGGAA CCCGTGAAGGCGTTCTTCACTTTG |
| 5680 | db mining | Hs.279133 | AW067752 | 8888499 | SP0141 cDNA, 3' end/clone_end = 3' | −1 | ATTCGCTGGCAACATAATTACCAGAC TCACATCGAACGAAGCTCGGTTCC |
| 5681 | db mining | Hs.279154 | AW067760 | 8888507 | SP0122 cDNA, 3' end/clone_end = 3' | −1 | TGTTCGTTGCCATCCTTGTCGAGGAA CATCTCGCTTTCCAGTTCCCCCTG |
| 5682 | Table 3A | Hs.89433 | AW071894 | 8026892 | ATP-binding cassette, sub-family C (CFTR/MRP), member 1 (ABCC1), transcript variant 1, mRNA /cds = (196, 4791) | −1 | TTTGGGGGATCCTTTTGTAATGACTT ACACTGGAAATGCGAACATTTGCA |
| 5683 | Table 3A | Hs.299581 | AW073707 | 6028705 | xb01h03.x1 cDNA, 3' end /clone = IMAGE:2575061/clone_end = 3' | −1 | GGACAAGGGGCACCCGGATTATATTT CCCACCAATCCTAATCCTAAACCC |
| 5684 | db mining | Hs.243286 | AW075809 | 6030807 | xa85g05.x1 cDNA, 3' end | −1 | TGGAGCTTATTTTGGAGAACTGTCAC |

TABLE 8-continued

| SEQ ID | Origin | Unigene | Locus | GI | Nominal Description | Strand | Probe Sequence |
|---|---|---|---|---|---|---|---|
| | | | | | /clone = IMAGE:2573624/clone_end = 3' | | CATTTTATCCCAGTTGGCAATTTT |
| 5685 | db mining | Hs.277714 | AW075814 | 6030812 | xa85h03.x1 cDNA, 3' end /clone = IMAGE:2573821/clone_end = 3' | −1 | ATTATGGGTAAGGCTTGGGCTTGTTC CCACATGTTAACCAAATGGCCTCA |
| 5686 | db mining | Hs.244048 | AW075894 | 6030892 | xa81c04.x1 cDNA, 3' end /clone = IMAGE:2573190/clone_end = 3' | −1 | GGGAGGGCCAAAGAAATCTTTTTCCC GTTTCAATTATGTTCCCCAAAAA |
| 5687 | db mining | Hs.329433 | AW075905 | 6030903 | xa81d05.x1 cDNA, 3' end /clone = IMAGE:2573193/clone_end = 3' | −1 | TTACCCCAAATGCTTTTGCCCCGGTGG CCCAGTTTGTAAATTGGTTTGATT |
| 5688 | db mining | Hs.329434 | AW075921 | 6030919 | xa81f04.x1 cDNA, 3' end /clone = IMAGE:2573215/clone_end = 3' | −1 | CCCCCCTTGGCAGGTTAATTGGTGTT TAAGGAACCCTCCAGGGTGGGGGG |
| 5689 | db mining | NA | AW075929 | 6030927 | xa81g05.x1 NCI_CGAP_CML1 cDNA clone IMAGE:2673240 3', mRNA sequence | −1 | CCCCCCAGTTTTAATGTTAGGGGGAA GGGATTTAACCCCTTATTTAAAAAA |
| 5690 | db mining | Hs.265834 | AW075948 | 6030946 | xa82b03.x1 cDNA, 3' end /clone = IMAGE:2573281/clone_end = 3' | −1 | CTATCACCCTTGATATGAAATTCCAG AATTTTCTGTGATACCACATGGCC |
| 5691 | db mining | Hs.277716 | AW075986 | 6030984 | xa82f05.x1 cDNA, 3' end /clone = IMAGE:2573313/clone_end = 3' | −1 | ACTCCGGGCCTTAATGGATTTGGCCT GTCCTCAAGAATGGTAATTATGAA |
| 5692 | db mining | Hs.241982 | AW076004 | 6031002 | xa82h04.x1 cDNA, 3' end /clone = IMAGE:2573335/clone_end = 3' | −1 | ACGTGGTTTCAGTCCTTAGCACCGTG GTATTGACATGACATCAGTTGCAA |
| 5893 | db mining | Hs.257711 | AW076027 | 6031025 | he31c12.x1 cDNA, 3' end /clone = IMAGE:2920630/clone_end = 3' | −1 | CACAACTTGCTGTTCACGTCTTTGGG GTGTTTTCCATTCCTAATAGATGG |
| 5694 | db mining | Hs.277717 | AW076038 | 6031036 | xa83d08.x1 cDNA, 3' end /clone = IMAGE:2573391/clone_end = 3' | −1 | AACCCGTCCTCCATTATAATTACCTT TCAAAGGGCAAGTCAAAGTTGT |
| 5695 | db mining | Hs.241983 | AW076068 | 6031068 | xa84e02.x1 cDNA, 3' end /clone = IMAGE:2573450/clone_end = 3' | −1 | AAACAGCACAACATGAGTGTTTCCTA CCACATCAATTTTAATGAAGACAC |
| 5696 | db mining | Hs.277718 | AW076075 | 6031073 | xa84a10.x1 cDNA, 3' end /clone = IMAGE:2573466/clone_end = 3' | −1 | CGGAATCGGGTTTCCATTGGACCCCA AAAATTTCCCTTTGGGCTTCATGA |
| 5697 | db mining | Hs.242605 | AW076083 | 6031081 | xa84b10.x1 cDNA, 3' end /clone = IMAGE:2573467/clone_end = 3' | −1 | TGAGGATAGAAGCAGCCTTTTATATT TTTGTGTGGTAAAGCAAATTGGCA |
| 5698 | db mining | Hs.329436 | AW076127 | 6031125 | xa84g01.x1 cDNA, 3' end /clone = IMAGE:2573520/clone_end = 3' | −1 | GGGGCAAATTTCAAGGGACCTCCCC AAAGGGGGTGTTTTCCCTGGATGGG |
| 5699 | Table 3A | Hs.244816 | AW078847 | 6033999 | xb18g07.x1 cDNA, 3' end /clone = IMAGE:2576700/clone_end = 3' | −1 | AAACAGGAAGGGGGTTTGGGCCCTT TGATCAACTGGAACCTTTGGATCAAG |
| 5700 | Table 3A | Hs.245616 | AW080951 | 6036103 | xc28c10.x1 cDNA, 3' end /clone = IMAGE:2585588/clone_end = 3' | −1 | ACTCTTTGTCTTTTAAGACCCCTAAT AGCCCTTTGTAACTTGATGGCTT |
| 5701 | Table 3A | Hs.176498 | AW081098 | 6036250 | xc29a12.x1 cDNA, 3' end /clone = IMAGE:2585662/clone_end = 3' | −1 | CCGGCTGCCTCCATCCCAGAAGAGT GCGCAGAGAATTAAATCTAGATATT |
| 5702 | Table 3A | NA | AW081232 | 6036384 | xc22e08.x1 NCI_CGAP_Co19 cDNA clone IMAGE:2585030 3' similar to SW:RSIA_HUMAN P39027 40S RIBOSOMAL | −1 | GGGATGTAATACATATTTTTCCAAATA AAATGCCTCATGGGCTTTGGGGC |
| 5703 | Table 3A | Hs.295945 | AW081320 | 6036472 | xc30f12.x1 cDNA, 3' end /clone = IMAGE:2585807/clone_end = 3' | −1 | AGAACCCGTATTCATAAAATTTAGAC CAAAAAGGAAGGAATCGAACCCCC |
| 5704 | Table 3A | Hs.120219 | AW081455 | 6036607 | xc31c07.x1 cDNA, 3' end /clone = IMAGE:2585868/clone_end = 3' | −1 | AGTTAGTATACAGCCAGAACAGCCAA GCCTCAATTCTTGTACCTTGTGTC |
| 5705 | Table 3A | Hs.277738 | AW082714 | 6037888 | xb61f07.x1 cDNA, 3' end /clone = IMAGE:2580805/clone_end = 3' | −1 | CCCTGATCCTCTGTAGGGAACTTCCT TTTCTCTAATCCTAGATCTTTTCA |
| 5706 | db mining | NA | AW088500 | 6044305 | xd10a04.x1 NCI_CGAP_Or23 cDNA clone IMAGE:2593326 3' similar to SW:BAT3_HUMAN P48379 LARGE PROLINE- | −1 | GAGGCATCAGAGGTTCAGGAGAGTT ACAGGCAGCAGGTGCGGTATAATAT |
| 5707 | Table 3A | Hs.243457 | AW102836 | 6073449 | xd38h12.x1 cDNA, 3' end /clone = IMAGE:2596103/clone_end = 3' | −1 | TTTGTTTCTTTGGGCCTGATTTGTATC TCTGGAAGGCATTAATTCTTGAA |
| 5708 | Table 3A | Hs.341908 | AW117189 | 6085773 | xd83f08.x1 cDNA, 3' end /clone = IMAGE:2604231/clone_end = 3' | −1 | GCTTTGCCTCTCGGAGGAGTCAAAG GGGCAGTAACTGTATGGGGTGAGAG |
| 5709 | Table 3A | Hs.3642 | AW130007 | 6131612 | RAB1, member RAS oncogene family (RAB1), mRNA/cds = (50, 667) | −1 | GCTCCCGAATATTGTAATTTGTTGCC CCCTATGTACCCAACCCCCTGAAA |
| 5710 | Table 3A | Hs.248367 | AW131768 | 6133375 | MEGF11 protein (MEGF11), mRNA | −1 | AGGAAGTATGAGAGTTCTGAAACCCT |

TABLE 8-continued

| SEQ ID | Origin | Unigene | Locus | GI | Nominal Description | Strand | Probe Sequence |
|---|---|---|---|---|---|---|---|
| 5711 | Table 3A | Hs.203606 | AW131782 | 6133389 | /cds = (159, 3068) PM0-UT0103-300101-002-f12 cDNA | −1 | TGATAGAAACTGGAAGCCTGCCAT GACATAGGGTTGCAGTAGTGAGTGG GCATCTGTTCTCAGAAGGCAGTGCC |
| 5712 | Table 3A | Hs.335449 | AW136717 | 6140850 | UI-H-BI1-adm-a-03-0-UI.s1 cDNA, 3' end/clone = IMAGE:2717092 /clone_end = 3' | −1 | TTCTGGCCTTGTTCACCTAGAAACGC TATTTCCTGTGTTATGGTTCTGGC |
| 5713 | Table 3A | Hs.8121 | AW137104 | 6141237 | Notch (Drosophila) homolog 2 (NOTCH2), mRNA/cds = (12, 7427) | −1 | GCTCTGGGAAAGAGACAGGGAAGTC TGGAATGGAAAAGAACACGATGAGA |
| 5714 | Table 3A | Hs.12035 | AW137149 | 6141282 | 602122419F1 cDNA, 5' end /clone = IMAGE:4279300/clone_end = 5' | −1 | GGGTTACATTTGAGTCTCTGTACCTG CTTGGAAGAAATAAAAATACGTGT |
| 5715 | Table 3A | Hs.342003 | AW138461 | 6142779 | UI-H-BI1-edg-e-06-0-UI.s1 cDNA, 3' end/clone = IMAGE:2716882 /clone_end = 3' | −1 | CTGGGAATATGAAGCGAACGCCACA CACTAGAACGCGCCCTGGGAGCTGG |
| 5716 | Table 3A | Hs.245138 | AW139918 | 6144636 | UI-H-BI1-aee-d-05-0-UI.s1 cDNA, 3' end/clone = IMAGE:2719138 /clone_end = 3' | −1 | GCTGCTTTTGCCCATCCAGGTTTCCA CATCCTAATCTTTGCTTTTCTTGT |
| 5717 | Table 3A | Hs.276718 | AW148618 | 6196514 | 601473284T1 cDNA, 3' end /clone = IMAGE:3876165/clone_end = 3' | −1 | TGTAAATGTGGTTTGACTATTTCTGTA TGTCCCCATCTATTGATGAGGGT |
| 5718 | Table 3A | Hs.89104 | AW148765 | 6196661 | 602590917F1 cDNA, 5' end /clone = IMAGE:4717348/clone_end = 5' | −1 | TTGTTTTAACAACTCTTCTCAACATTT TGTCCAGGTTATTCACTGTAACCA |
| 5719 | Table 3A | Hs.248857 | AW150084 | 6198076 | xg36f03.x1 cDNA, 3' end /clone = IMAGE:2629661/clone_end = 3' | −1 | ACATAAACTGTCCCTTTAGGAAGAAG CCCAATGCCCGATTTTGCCCTTTA |
| 5720 | Table 3A | NA | AW150085 | 6196077 | xg36f04.x1 NCI_CGAP_UI1 cDNA clone IMAGE:2829663 3' similar to gb:X65018 PULMONARY SURFACTANT-ASSOC | −1 | GGACAAGTGGCATCGGTACTATATTT CCCACCAATCCTAATCCTAATCCC |
| 5721 | Table 3A | Hs.265838 | AW150944 | 6198842 | xg42e09.x1 cDNA, 3' end/clone = IMAGE: 2630248/clone_end = 3' | −1 | TATGTCCCTTTTTCTCCTCCCTTCCCC ATTCCCTGGCATCATATTGGGAC |
| 5722 | Table 3A | Hs.301104 | AW151854 | 6199839 | 602313002F1 cDNA, 5' end/ clone = IMAGE: 4422480/ clone_end = 5' | −1 | CGCTGTCGCCTTAATCCAAGCCTACG TTTTCACACTTCTAGTAAGCCTCT |
| 5723 | Table 3A | Hs.337727 | AW161820 | 6300853 | au70h03.x1 cDNA, 3' end/clone = IMAGE: 2781653/clone_end = 3' | −1 | TGTGGGCTTGGTATAAACCCTACTTT GTGATTTGCTAAAGCACAGGATGT |
| 5724 | Table 3A | Hs.299967 | AW166001 | 6397526 | xf43e11.x1 cDNA, 3' end/clone = IMAGE: 2620844/clone_end = 3' | −1 | CCGCCTGAAACGGGCATTTTGTAAAT GGGGTTTGACTATTTTTGTATGTC |
| 5725 | Table 3A | Hs.81248 | AW166442 | 6397967 | CUG triplet repeat, RNA-binding protein 1 (CUGBP1), mRNA/cds = (137, 1585) | −1 | ACTGGCAAATGAAGCATACTGGCTTG CAGGGACCTTCTGATTCAAGTACA |
| 5726 | Table 3A | Hs.169738 | AW172306 | 6438254 | xj37a08x1 cDNA, 3' end/clone = IMAGE: 2659382/clone_end = 3' | −1 | GAATTCGATTTGAGATCTGAGGGCAG ACCCGAACCAGGAAAGCAACTCAG |
| 5727 | Table 3A | Hs.8991 | AW172850 | 6438798 | adaptor-related protein complex 1, gamma 2 subunit (AP1G2), mRNA/cds = (45, 2402) | −1 | AATGCACCAGGCTGCCACCTGCACC AGTGGTTGCTACATGGGATAAGAAA |
| 5728 | Table 3A | Hs.143525 | AW173163 | 6439111 | xj84b08x1 cDNA, 3' end/clone = IMAGE = 2663895/clone_end = 3' | −1 | TATGATAGGATTCTCCACAGTGGCTT CCGACTCAGGCTCCAATGGACCAA |
| 5729 | Table 3A | Hs.38664 | AW188135 | 6462571 | IL0-MT0152-061100-501-e04 cDNA | −1 | TGCTGTATGGGCAGGTTGTCTTATTA TGTGATCAACAGATGTCCAGGAAC |
| 5730 | Table 3A | NA | AW188398 | 6462834 | xj98c03.x1 NCI_CGAP_Co18 cDNA clone IMAGE: 2665252 3', mRNA sequence | −1 | ACCTCCAAGAACATCTGCCTTTGTTG AACGTGTTTATTACCTGTCCACTC |
| 5731 | Table 3A | Hs.252989 | AW191929 | 6470628 | xl77c10.x1 cDNA, 3' end/clone = IMAGE: 2680722/clone_end = 3' | −1 | CCTTTTGCCCCTTAGCCCTTGGATAA TCCGGCTGGGAATGGGGGTGGGGG |
| 5732 | Table 3A | Hs.203755 | AW194379 | 6473179 | xm08h07.x1 cDNA, 3' end/clone = IMAGE: 2683645/clone_end = 3' | −1 | CCCAAATAAGCTCTGTACTTCGGTTA CCTATGTACCTGTTACCACTTTCA |
| 5733 | Table 3A | Hs.253151 | AW195119 | 6474139 | xn66b07.x1 cDNA, 3' end/clone = IMAGE: 2699413/clone_end = 3' | −1 | GCCACATGTCCTATTCTCACACAGGT GCTTTAATTTCAGCCCAGTCTCTA |
| 5734 | db mining | Hs.253154 | AW195169 | 6474211 | xn66h03.x1 cDNA, 3' end/clone = IMAGE: 2699477/clone_end = 3' | −1 | CTTGAAGGGGCTTTGTTGGGTTTTTG GGGTTTTGGGTGGGACTCCCAAAG |
| 5735 | db mining | Hs.330019 | AW195270 | 6474330 | xn67c04.x1 cDNA, 3' end/clone = IMAGE: 2699528/clone_end = 3' | −1 | GGGGTTTTAAAAATTTTCCCGATTTGA AAATTAATTTTCCGTTGCCCCCCGG |
| 5736 | db mining | Hs.253167 | AW195284 | 6474352 | xn67d09.x1 cDNA, 3' end/clone = IMAGE: 2699537/clone_end = 3' | −1 | CCCCCTGGGGTTTTTGGGAATGAGG TAAGGCTTTGAATTTGGTTTGATAT |
| 5737 | db mining | Hs.253168 | AW195300 | 6474388 | xn67l12.x1 cDNA, 3' end/clone = IMAGE: 2699567/clone_end = 3' | −1 | ACATGCTTAGAGCTGGAGGCTTGAAA CCATAATCCCAATTAAGTGCTGTC |
| 5738 | db mining | Hs.253169 | AW195313 | 6474381 | xn67h05.x1 cDNA, 3' end/clone = IMAGE: 2699577/clone_end = 3' | −1 | TGTTTGTCCAGGAAAAGGAAGAGGG GGAAATTAAAACCTTTCCGGTTAGT |
| 5739 | Table 3A | Hs.253384 | AW204029 | 6503501 | UI-H-BI1-aen-d-02-0-UI.s1 cDNA, 3' end/clone = IMAGE: 2719899/ clone_end = 3' | −1 | GCACTGCTCCGTCTAGCTGTATGACC TTTGTTATGTTTCTTTTCTTCCGT |
| 5740 | Table 3A | Hs.253502 | AW205824 | 6505098 | UI-H-BI1-afr-e-01-0-UI.s1 cDNA, 3' end/clone = IMAGE: 2722657/ | −1 | CTTCAATCTGGGCTGGGCACTCCAC GCACATAATCGTCACTCTCGGAGGA |

TABLE 8-continued

| SEQ ID | Origin | Unigene | Locus | GI | Nominal Description | Strand | Probe Sequence |
|---|---|---|---|---|---|---|---|
| 5741 | Table 3A | Hs.330058 | AW206977 | 6506473 | UI-H-BI1-afs-h-11-0-UI.s1 cDNA, 3' end/clone = IMAGE: 2723180/ clone_end = 3' | -1 | GCGGGAAGTGAAAGCGGAGGCTGGG ACAAGGGGAACTTACTGCTCAAAAA |
| 5742 | Table 3A | Hs.157315 | AW207701 | 6507197 | UI-H-BI2-age-e-03-0-UI.s1 cDNA, 3' end/clone = IMAGE: 2724172 clone_end = 3' | -1 | AGTGGTGTGGTGGCAATAGGAAAAG AAAAGATCAGGATGAGAAATTGCTT |
| 5743 | db mining | NA | AW236188 | 6568575 | xn70e07.x1 NCI_CGAP_CML 1 cDNA clone IMAGE: 2699844 3', mRNA sequence | -1 | CCAAGGGCCTTTTGGGGTTGTTTCCT ATAACTTCAGTATTGTAAATTAGT |
| 5744 | db mining | NA | AW238203 | 6568592 | xn70h07.x1 NCI_CGAP_CML 1 cDNA clone IMAGE: 2699869 3', mRNA sequence | -1 | CATAAAGGGGCATTCCCCTAGCCGG TCCGGCCTTTTTCCAGTCCATCCTG |
| 5745 | db mining | Hs.330063 | AW236208 | 6568597 | xn71a06.x1 cDNA, 3' end/clone = IMAGE: 2699890/clone_end = 3' | -1 | AGGTTTAAGAAATTTCCCCTAAATCTT GTTTGGTTGGTTGGGATGAAAAGT |
| 5746 | db mining | Hs.253747 | AW238262 | 6568641 | xn71g08.x1 cDNA, 3' end/clone = IMAGE: 2699966/clone_end = 3' | -1 | AATTGATCCCATTCTTGCTGAAGTAG ACAGTGCCCTCAAGTGGAATTAAA |
| 5747 | db mining | Hs.253748 | AW236271 | 6568880 | xn72b03.x1 cDNA, 3' end/clone = IMAGE: 2699981/clone_end = 3' | -1 | CTCCAATGCTGTTATCCCGGCTGGGT CCTCACACTCCCCCAACAATCCCA |
| 5748 | db mining | NA | AW236345 | 6568734 | xn73c12.x1 NCI_CGAP_CML 1 cDNA clone IMAGE: 2700118 3' similar to contains element MER21 repetitive e | -1 | AGAATGCGCTATTTCCCTCAAAGCCC TGGCTGTAATAAAGAAGCCGATTT |
| 5749 | Table 3A | Hs.253820 | AW237483 | 6569872 | xm72e01.x1 cDNA, 3' end/clone = IMAGE: 2689752/clone_end = 3' | -1 | CTGAGGTCAGTGTGGTTTGGTGGAA GGATTATGATATTTACAAGCTGAGT |
| 5750 | Table 3A | Hs.342342 | AW243795 | 6577635 | xo56f02.x1 cDNA, 3' end/clone = IMAGE: 2707995/clone_end = 3' | -1 | GGTCAATGTTTTGAAATTTGTGGAGC AAACCCCAGTTTTATGCCCTTGGT |
| 5751 | Table 3A | Hs.250591 | AW262077 | 6638893 | xp19e09.x1 cDNA, 3' end/clone = IMAGE: 2740840/clone_end = 3' | -1 | AGTTGGAAATTTAGAAATGTCCACT GTAGGACGTGGAATATGGCGTCGA |
| 5752 | db mining | Hs.250591 | AW262272 | 6639088 | xp19e09.x1 cDNA, 3' end/clone = IMAGE: 2740840/clone_end = 3' | -1 | TTCACGTCCTAAAGTGTGGTAGACGC GCCCGCGAATTTAGTAGTAGTAGG |
| 5753 | Table 3A | Hs.277994 | AW262728 | 6639544 | xq94a12.x1 cDNA, 3' end/clone = IMAGE: 2758270/clone_end = 3' | -1 | GGACAAGTGGCATCCGTATTATATTT CCCACCATTCCTATTCTTAATCCC |
| 5754 | db mining | Hs.61345 | AW262891 | 6639707 | mRNA for KIAA1154 protein, partial cds/cds = (0, 676) | -1 | GGTCTGCCTCAGTCTTCTACTCATCA GCACCACACTGTCAAAATGTTGGA |
| 5755 | Table 3A | Hs.5662 | AW264291 | 6641033 | guanine nucleotide binding protein (G protein), beta polypeptide 2-like 1 (GNB2L1), mRNA/cds = (95, 1048) | -1 | AGATGAATTGAAGCAAAAGTTTTCA GTACCAGCAGCAAGGCAGACCCCC |
| 5756 | Table 3A | Hs.122656 | AW274156 | 6681186 | hypothetical protein MGC14425 (MGC14425), mRNA/cds = (318, 686) | -1 | TCACCTCCACCTCTGAGGGAGCAAC GAATACAAAGGTAGACCCCCAAAAG |
| 5757 | Table 3A | Hs.250600 | AW291304 | 6697940 | UI-H-BI2-agk-a-02-0-UI.s1 cDNA, 3' end/clone = IMAGE: 2724386/ clone_end = 3' | -1 | CCCCAGCCAGCACTTCCCTTTTCTGC GAGGGTTTTCTGTTTCTTTGATTA |
| 5758 | Table 3A | Hs.47325 | AW291458 | 6698021 | UI-H-BI2-agh-c-02-0-UI.s1 cDNA, 3' end/clone = IMAGE: 2724099/ clone_end = 3' | -1 | AGAAAATTTGAACCCTACCCTTCTCC CATCCCACTTCTTACTCCATCCCG |
| 5759 | Table 3A | Hs.170381 | AW291507 | 6698143 | UI-H-BI2-aga-g-11-0-UI.s1 cDNA, 3' end/clone = IMAGE: 2723900/ clone_end = 3' | -1 | CTGTGGCATCATTCACACCACCAGCA GAGTCCCTTCCAAGAGGGGTCTGG |
| 5760 | db mining | Hs.255118 | AW292757 | 6699393 | UI-H-BW0-aij-b-12-0-UI.s1 cDNA, 3' end/clone = IMAGE: 2729423/clone_end = 3' | -1 | CCGTGTTAAAACCAAAGTTTGGGATT TTTCGGGTATTCATTGGAAGTCAC |
| 5761 | Table 3A | Hs.255119 | AW292772 | 6699408 | UI-H-BW0-aij-d-03-0-UI.s1 cDNA, 3' end/clone = IMAGE: 2729501/clone_end = 3' | -1 | CGAGAGCCTGGAAGCTTTGCACACTA CTGCCTGGAAGATCTGATTCTTTG |
| 5762 | db mining | Hs.255123 | AW292814 | 6699450 | UI-H-BW0-aij-h-02-0-UI.s1 cDNA, 3' end/clone = IMAGE: 2729691/clone_end = 3' | -1 | TGTTTTAAAAGTGGGTTTATTTCAACC GCTTCACTCCCGGTTGGTGACCG |
| 5763 | db mining | Hs.255129 | AW292855 | 6699491 | UI-H-BW0-aif-d-03-0-UI.s1 cDNA, 3' end/clone = IMAGE: 2729117/clone_end = 3' | -1 | TCTTCTCTCAGTCTTCAGCAAGTAGC TTCTTTCAGAACTGCCTCCTCCCG |
| 5764 | db mining | Hs.255544 | AW292873 | 6899509 | UI-H-BW1-ame-e-09-0-UI.s1 cDNA, 3' end/clone = IMAGE: 3069784/clone_end = 3' | -1 | GTTTCTGCATCCCAAATGTCCTGGG GCATGTGTCCCTTCCTTGCTGACC |
| 5765 | db mining | Hs.265134 | AW292900 | 6699536 | UI-H-BW0-aig-a-05-0-UI.s1 cDNA, 3' end/clone = IMAGE: 2729000/clone_end = 3' | -1 | TGTTATGATTCTCTCAATTTCATAAAG CTCTTCTGGCAGAGGAGACAGAT |
| 5766 | db mining | Hs.255135 | AW292902 | 6699538 | UI-H-BW0-aig-a-07-0-UI.s1 cDNA, 3' end/clone = IMAGE: 2729004/clone_end = 3' | -1 | AAATGGATTACAATTTCCCTGACATTT GGGCATAAAACATCTGCCATCCT |
| 5767 | db mining | Hs.256139 | AW292928 | 6699584 | UI-H-BW0-aig-d-11-0-UI.s1 cDNA, 3' end/clone = IMAGE: 2729156/clone_end = 3' | -1 | TCCTCCTTCCAGAGACCTTTGCTTTA CTGCCATTTTTTCTGTGGGCTTTT |
| 5768 | db mining | Hs.255140 | AW292941 | 6699577 | UI-H-BW0-aig-f-10-0-UI.s1 | -1 | AGGCATAGCAGTAGAATCTGTCAAAA |

TABLE 8-continued

| SEQ ID | Origin | Unigene | Locus | GI | Nominal Description | Strand | Probe Sequence |
|---|---|---|---|---|---|---|---|
| | | | | | cDNA, 3' end/clone = IMAGE: 2729250/clone_end = 3' | | AGGAGGCATGGAATGAAATGAACC |
| 5769 | db mining | Hs.255142 | AW292960 | 6699598 | UI-H-BW0-aih-a-02-0-UI.s1 cDNA, 3' end/clone = IMAGE: 2728995/clone_end = 3' | −1 | CTGACCCTCTCGCCCCTCCACCTGTG CTTCTGCCCTAGGATAACGCTGGG |
| 5770 | db mining | Hs.147728 | AW292969 | 6699625 | RST12623 cDNA | −1 | GACCCAAAGAAAAGATCAAGAC CGCATGTAGCAAATGTAGCAAGGA GGCA |
| 5771 | db mining | Hs.255152 | AW293001 | 6699637 | UI-H-BW0-aih-d-12-0-UI.s1 cDNA, 3' end/clone = IMAGE: 2729159/clone_end = 3' | −1 | CTAATTTCCCACTAAAAGGTCCAGAA AAATTGATGCCACCTGTAGTTTGG |
| 5772 | db mining | NA | AW293017 | 6699653 | UI-H-BW0-aih-f-06-0-UI.s1 NCI_CGAP_Sub6 cDNA clone IMAGE: 2729243 3', mRNA sequence | −1 | GTAAAGTTCCAAGCGAGTGGAAGGTA AATCACGACTGTGGCACCGGAGCC |
| 5773 | db mining | NA | AW293143 | 6699779 | UI-H-BW0-aii-a-03-0-UI.s1 NCI_CGAP_Sub6 cDNA clone IMAGE: 2729356 3', mRNA sequence | −1 | GAAACTGAATGACCATGGAATGCTGA AATTCCAAAAGAAAAACGTCGCGC |
| 5774 | db mining | Hs.255172 | AW293158 | 6699794 | UI-H-BW0-aii-b-07-0-UI.s1 cDNA, 3' end/clone = IMAGE: 2729412/clone_end = 3' | −1 | TCTCTCAGGTCGTCTTCAGAGTCCAT TCCCTTTGTCTTGATCTTTTCTCT |
| 5775 | Table 3A | Hs.166975 | AW293159 | 6699795 | splicing factor, arginine/serine-rich 5 (SFRS5), mRNA/cds = (218, 541) | −1 | CTCCCATCATTCCCTCCCGAAAGCCA TTTTGTTCAGTTGCTCATCCACGC |
| 5776 | db mining | Hs.255174 | AW293172 | 6699808 | UI-H-BW0-aii-c-10-0-UI.s1 cDNA, 3' end/clone = IMAGE: 2729466/clone_end = 3' | −1 | GCCCTGCCCCCTACCCTTGCCCTTTA AATTTTTGGGACTGAATAAAGAAT |
| 5777 | Table 3A | Hs.255178 | AW293267 | 6899829 | UI-H-BW0-aii-e-10-0-UI.s1 cDNA, 3' end/clone = IMAGE: 2729582/clone_end = 3' | −1 | TGCAGGATAACTTGCTCATGAAAGGA AATGCCAGATTAAACCCCTTGCCA |
| 5778 | Table 3A | Hs.75354 | AW293424 | 6700060 | mRNA for KIAA0219 gene, partial cds/cds = (0, 7239) | −1 | GCCTTCCCTTCGTTCCTTTCCAGGCA ATAATGACATCATTAGTGATGCAA |
| 5779 | Table 3A | Hs.255200 | AW293428 | 6700062 | UI-H-BW0-BI2-ahm-b-02-0-UI.s1 cDNA, 3' end/clone = IMAGE: 2727122/clone_end = 3' | −1 | CGCCACGGCTCCAATCCCTATATGAG TGAGCAGTAGAATCACATAGGAAT |
| 5780 | Table 3A | Hs.10041 | AW293461 | 6700097 | 602713308F1 cDNA, 5' end/clone = IMAGE: 4853618/clone_end = 5' | −1 | CCTAGAATCAGACTTAAGCACAAGC AGGGAGGGAAAGCACTTGAGCAGT |
| 5781 | db mining | Hs.291317 | AW293859 | 6700495 | nx40e10.s1 cDNA, 3' end/clone = IMAGE: 1258602/clone_end = 3' | −1 | GCACATGCAAAAACTCAGATGTGCAA ATAACTGTTCCCTATTAACTACAA |
| 5782 | Table 3A | Hs.255249 | AW293895 | 6700531 | UI-H-BW0-ain-f-10-0-UI.s1 cDNA, 3' end/clone = IMAGE: 2729995/clone_end = 3' | −1 | GGTGCTCAAACTGTATTTTCTCCCTC CCTCCCTCCTTCTTTCTTTCCAGA |
| 5783 | db mining | Hs.255251 | AW293922 | 6700558 | UI-H-BW0-aik-a-04-0-UI.s1 cDNA, 3' end/clone = IMAGE: 2729382/clone_end = 3' | −1 | TTCTTCCACGGGATTTCTAATTCATTA AATAGGACCTCCACACCAGACCT |
| 5784 | db mining | Hs.255253 | AW293949 | 6700585 | UI-H-BW0-aik-c-10-0-UI.s1 cDNA, 3' end/clone = IMAGE: 2729490/clone_end = 3' | −1 | TATCCAGCCTGACTTCTTCATGCTGT ACTAGCCTTCCAATCCTTAACTAA |
| 5785 | do mining | Hs.255254 | AW293950 | 6700588 | UI-H-BW0-aik-c-11-0-UI.s1 cDNA, 3' end/clone = IMAGE: 2729492/clone_end = 3' | −1 | TGGACATTGGGGGTCAAACCCTTTTG TTTAAATTTTCCCTTTCCCAGGGC |
| 5786 | Table 3A | Hs.255255 | AW293955 | 670000591 | UI-H-BW0-alk-d-05-0-UI.s1 cDNA, 3' end/clone = IMAGE: 2729526/clone_end = 3' | −1 | GCTGTGCCACGGTCAGGTGGCTTCC AATCTGTACTCAATTGTTACTGTAC |
| 5787 | Table 3A | Hs.190904 | AW294363 | 670000729 | UI-H-BI2-ahg-b-05-0-UI.s1 cDNA, 3' end/clone = IMAGE: 2726720/clone_end = 3' | −1 | TCAGAGATGCTGATGTCATATAAGTA GTTTCCCTGTCTGGCCTTGGATGT |
| 5788 | db mining | Hs.255330 | AW294818 | 6701254 | UI-H-BW0-ail-a-05-0-UI.s1 cDNA, 3' end/clone = IMAGE: 2729385/clone_end = 3' | −1 | GTATGACTGATGATAGCTGCGAATGA GGAGGAGGGAAGGGAAGGCTGGAG |
| 5789 | db mining | Hs.255333 | AW294644 | 6701280 | UI-H-BW0-ail-c-11-0-UI.s1 cDNA, 3' end/clone = IMAGE: 2729493/clone_end = 3' | −1 | CCATTGCCCCGGTGTTTTGGTTTAAT TTTCCCAGGCTTATTTTAAAGGCC |
| 5790 | Table 3A | Hs.255687 | AW294654 | 6701290 | UI-H-BW0-ail-d-10-0-UI.s1 cDNA, 3' end/clone = IMAGE: 2729539/clone_end = 3' | −1 | AGGAAATTAAACATGAGCATGACATG ACCCCAACTCTCAAGAAATCCCCA |
| 5791 | Table 3A | Hs.255336 | AW294081 | 6701317 | UI-H-BW0-ail-g-10-0-UI.s1 cDNA, 3' end/clone = IMAGE: 2729683/clone_end = 3' | −1 | ATCAGGTCCCCTACAAAATTAGCTAC TTTGGCCTTTCCTACAAAATTAGC |
| 5792 | db mining | Hs.255337 | AW294692 | 6701328 | UI-H-BW0-ail-h-11-0-UI.s1 cDNA, 3' end/clone = IMAGE: 2729733/clone_end = 3' | −1 | TCATTCGTTTGCTTTCTCTGACTGACA GGCAGTAATGACTTCAATAAGCT |
| 5793 | Table 3A | Hs.255339 | AW294695 | 6701331 | UI-H-BW0-aim-e-02-0-UI.s1 cDNA, 3' end/clone = IMAGE: | −1 | AGGGCCTGCTTCAGAGTTTGTTTCCT AAATAAAACAATGGCTCTCCCCGT |

TABLE 8-continued

| SEQ ID | Origin | Unigene | Locus | GI | Nominal Description | Strand | Probe Sequence |
|---|---|---|---|---|---|---|---|
| 5794 | db mining | Hs.255341 | AW294697 | 67001333 | UI-H-BW0-aim-a-04-0-UI.s1 cDNA, 3' end/clone = IMAGE: 2729738/clone_end = 3' | −1 | CCCCCAACTTACATGGAAAAGGGATG GTTGCATTTCTGTGTCATATGCAT |
| 5795 | db mining | Hs.342539 | AW294717 | 67001353 | UI-H-BW0-ajl-g-03-0-UI.s1 cDNA, 3' end/clone = IMAGE: 2729742/clone_end = 3' | −1 | GCAGAGGGAAGAGGAAATGCTTTGA AGCCTTGCTAGTTATTTAATTAGTT |
| 5796 | db mining | Hs.255347 | AW294739 | 67001375 | UI-H-BW0-aim-f-07-0-UI.s1 cDNA, 3' end/clone = IMAGE: 2732333/clone_end = 3' | −1 | GACATAGTTGCAAAACACAATACTTA ATACTTTTTCTGGAGGAGGGGGCC |
| 5797 | db mining | Hs.255354 | AW294769 | 67001405 | UI-H-BW0-ail-g-02-0-UI.s1 cDNA, 3' end/clone = IMAGE: 2729667/clone_end = 3' | −1 | ACCCCTTTTCTTAATTTCTCAGGAGAA TGGCAGCTCCTTCTTTTGTCGTC |
| 5798 | db mining | NA | AW294812 | 6701448 | UI-H-BI2-ahi-d-06-0-UI.s1 NCI_CGAP_Sub4 cDNA clone IMAGE: 2726842 3', mRNA sequence | −1 | CCTCCGGTGTCTTCGGAAGCACTGAA GGGACATCTGGGGACCCTCACCTG |
| 5799 | db mining | Hs.255388 | AW295071 | 6701707 | UI-H-BW0-ait-c-03-0-UI.s1 cDNA, 3' end/clone = IMAGE: 2730245/clone_end = 3' | −1 | ACTCTTTGACCAATAAATCACTGGAA TAGAGGTTCCAGCATATTCTGAGA |
| 5800 | Table 3A | Hs.255389 | AW295088 | 6701724 | UI-H-BW0-ait-d-09-0-UI.s1 cDNA, 3' end/clone = IMAGE: 2730305/clone_end = 3' | −1 | ATGCTTACACCCTGGATGAATAAAGT CTTTATTTACACCTCCACCTCCCC |
| 5801 | db mining | Hs.255157 | AW295376 | 6702012 | UI-H-BI2-ahv-f-03-0-UI.s1 cDNA, 3' end/clone = IMAGE: 2728085/clone_end = 3' | −1 | CTCTTCACAGGTCATAAGCCCCTCTG AGCGGCGACAGTCCTCGCATCCAG |
| 5802 | db mining | Hs.330175 | AW295597 | 6702233 | UI-H-BW0-aip-a-10-0-UI.s1 cDNA, 3' end/clone = IMAGE: 2729779/clone_end = 3' | −1 | CAGCTCGACCTCAGTCCCCTTCAGAA ATAAGATGGCGGCTGCGCTGACAG |
| 5803 | Table 3A | Hs.255446 | AW295610 | 6702246 | UI-H-BW0-alp-c-03-0-UI.s1 cDNA, 3' end/clone = IMAGE: 2729861/clone_end = 3' | −1 | TTTCAACGTGTACCTTTCCTGGGAAA CCATCTCAATAAACACATTTTGGT |
| 5804 | db mining | Hs.255448 | AW295616 | 6702252 | UI-H-BW0-alp-c-09-0-UI.s1 cDNA, 3' end/clone = IMAGE: 2729873/clone_end = 3' | −1 | GCTGGACACATGGGTTAAGAGGAGG AAAAGTAGGAAAGGAGGAGGGGAGA |
| 5805 | db mining | Hs.255449 | AW295629 | 6702288 | UI-H-BW1-amu-a-09-0-UI.s1 cDNA, 3' end/clone = IMAGE: 3071128/clone_end = 3' | −1 | GGCTGGGACCAGGGTTTTTCAAGCC ACCTTTTCCTGTCTCAGTTCAGAGA |
| 5806 | Table 3A | Hs.255454 | AW295664 | 6702300 | UI-H-BW0-aip-g-12-0-UI.s1 cDNA, 3' end/clone = IMAGE: 2730071/clone_end = 3' | −1 | CCCACTTTCACACATGACTCACACGA CTGAAGGAAAGAAAGGGCATCCTT |
| 5807 | db mining | Hs.255465 | AW295689 | 6702305 | UI-H-BW0-aip-h-06-0-UI.s1 cDNA, 3' end/clone = IMAGE: 2730107/clone_end = 3' | −1 | AAGAAATTAAGGAAGGCAAGAG GGTAGGTGTTGGCCCATGGAAGTT TCCC |
| 5808 | db mining | Hs.255457 | AW295888 | 6702324 | UI-H-BW0-aiw-b-02-0-UI.s1 cDNA, 3' end/clone = IMAGE: 2730578/clone_end = 3' | −1 | CTGGCAAATATTGCGGAAGATGTACT GAAATGTAATTGAAATGTAGCTGC |
| 5809 | db mining | Hs.255459 | AW295711 | 6702347 | UI-H-BW0-aiw-d-03-0-UI.s1 cDNA, 3' end/clone = IMAGE: 2730676/clone_end = 3' | −1 | AGCATAAGAGATACGAAGCTGATGGT AATTAACTTGTACCCCTTGAAGTG |
| 5810 | db mining | Hs.255462 | AW295724 | 6702360 | UI-H-BW0-aiw-e-08-0-UI.s1 cDNA, 3' end/clone = IMAGE: 2730734/clone_end = 3' | −1 | AGTGTCAGACAATTAGATACTCTTTC CTGTCTTCAGGAGCCCATCTGAA |
| 5811 | db mining | Hs.255484 | AW295731 | 6702367 | UI-H-BW0-aiw-f-05-0-UI.s1 cDNA, 3' end/clone = IMAGE: 2730776/clone_end = 3' | −1 | GAAGTGTAAACATGCCAACAGGGTTT ATATTTAGGTTCCAAGAGTTGCCA |
| 5812 | Table 3A | Hs.158814 | AW295985 | 6702531 | KIAA0377 gene product (KIAA0377), mRNA/cds = (126, 4346) | −1 | CTTCCCAAACTCCATTGTCTCATTCTC ACTGCTTATGTTATTGCTCTTAT |
| 5813 | Table 3A | Hs.255492 | AW295005 | 6702641 | UI-H-BW0-aiu-b-01-0-UI.s1 cDNA, 3' end/clone = IMAGE: 2730552/clone_end = 3' | −1 | CCCACACAGCAGAGAAGTATCAGAAA ACATAGAAACATGTGAAAATGCGC |
| 5814 | db mining | Hs.255495 | AW296020 | 6702656 | UI-H-BW0-aiu-c-07-0-UI.s1 cDNA, 3' end/clone = IMAGE: 2730612/clone_end = 3' | −1 | AGGTTCAATTCATTTTCCTGAGATGTT TGGTTTATAAGATTTGAGGATGGT |
| 5815 | db mining | Hs.255497 | AW296044 | 6702680 | UI-H-BW0-aiu-e-10-0-UI.s1 cDNA, 3' end/clone = IMAGE: 2730714/clone_end = 3' | −1 | ATACTTACATGTGCTTGGATCCTGGG TGGGAGGCTTGGTTAGAAGTCACG |
| 5816 | db mining | Hs.255498 | AW296054 | 6702690 | UI-H-BW0-aiu-f-10-0-UI.s1 cDNA, 3' end/clone = IMAGE: 2730762/clone_end = 3' | −1 | TGGGTCAGCGTGTTCAATTTTAAATA GGAATACACTAGCCTTACAACGGA |
| 5817 | db mining | Hs.255499 | AW296058 | 6702694 | UI-H-BW0-aiu-g-02-0-UI.s1 cDNA, 3' end/clone = IMAGE: 2730794/clone_end = 3' | −1 | TGTTCATCTTGATGTAATAGAGAAGG AAAGAGAGAGCATCCCTTTTCAGT |
| 5818 | Table 3A | Hs.255501 | AW296063 | 6702699 | UI-H-BW0-aiu-g-08-0-UI.s1 cDNA, 3' end/clone = IMAGE: | −1 | ACCAGTAACACAATGACGGCAAGCAC AGAGAAGGAAAAAGTCAGATCCCC |

TABLE 8-continued

| SEQ ID | Origin | Unigene | Locus | GI | Nominal Description | Strand | Probe Sequence |
|---|---|---|---|---|---|---|---|
| 5819 | db mining | Hs.255502 | AW296066 | 6702702 | UI-H-BW0-aiu-g-11-0-UI.s1 cDNA, 3' end/clone = IMAGE: 2730806/clone_end = 3' | −1 | ACTTGGAGCTAGAGAGCCACCCATCA TATGGAGGAGAAGTGGTCACTCTA |
| 5820 | db mining | Hs.34871 | AW298352 | 6702988 | zinc finger homeobox 1B (ZFHX1B), mRNA/cds = (444, 4088) | −1 | TGCATGTGTGTTGTGTACTTGTCTGT TCTGTAAGATTGTCGGTGTTACAC |
| 5821 | db mining | Hs.255543 | AW298373 | 6703009 | UI-H-BW0-aio-c-10-0-UI.s1 cDNA, 3' end/clone = IMAGE: 2729874/clone_end = 3' | −1 | TTCCTGGCAGTAAAGAAAAGAA AGAAGATGTGAGTTATGAAGCATT GACT |
| 5822 | db mining | Hs.255548 | AW298398 | 6703034 | UI-H-BW0-aio-f-01-0-UI.s1 cDNA, 3' end/clone = IMAGE: 2730000/clone_end = 3' | −1 | AAATAGGAATATAATCTGTCCACATC AAAGAATGGGAAGTCGAAGTGTACA |
| 5823 | db mining | Hs.255549 | AW296404 | 6703040 | UI-H-BW0-aio-f-08-0-UI.s1 cDNA, 3' end/clone = IMAGE: 2730014/clone_end = 3' | −1 | GTTCCAAATGTTTTCCGCTAATAGTTT GTCCTAAAGCCTTTGCCATTCCT |
| 5824 | db mining | Hs.255552 | AW298446 | 6703082 | UI-H-BW0-aiq-b-07-0-UI.s1 cDNA, 3' end/clone = IMAGE: 2730160/clone_end = 3' | −1 | ACAGAGAAGGCTTATTTACGTTGGGA ATTACATTAAGGAAAAGTGGTGAC |
| 5825 | Table 3A | Hs.255554 | AW296490 | 6703126 | UI-H-BW0-aiq-f-08-0-UI.s1 cDNA, 3' end/clone = IMAGE: 2730374/clone_end = 3' | −1 | CCTTCCTCCTATATCCTGCCTTGAAT AGGGATGTGATACCTTGAGCCATG |
| 5826 | db mining | Hs.255558 | AW298504 | 6703140 | UI-H-BW0-aiq-g-12-0-UI.s1 cDNA, 3' end/clone = IMAGE: 2730430/clone_end = 3' | −1 | ATATTTGGGTCTCTGTTTAAGATTTCA TTGCCGTGGTAGGGAGAGTTCCA |
| 5827 | db mining | Hs.255556 | AW298511 | 6703147 | UI-H-BW0-aiq-h-08-0-UI.s1 cDNA, 3' end/clone = IMAGE: 2730470/clone_end = 3' | −1 | TGGATGCCATGATGACACCAATAAGC AACCCACAGATTAGGGGAAATACT |
| 5828 | Table 3A | Hs.255559 | AW296532 | 6703168 | UI-H-BW0-aiv-b-07-0-UI.s1 cDNA, 3' end/clone = IMAGE: 2730565/clone_end = 3' | −1 | GGGGCTGGGAGCCACCAAAAGGGCC TGCTCTTCGGAGAAATGCTGAATTC |
| 5829 | Table 3A | Hs.255560 | AW296545 | 6703181 | UI-H-BW0-aiv-c-11-0-UI.s1 cDNA, 3' end/clone = IMAGE: 2730621/clone_end = 3' | −1 | AGGCATCTTGAAAGTTCCATAAAGAC AGAAGTAAGGGTCATTCAGTCATT |
| 5830 | db mining | Hs.255561 | AW296567 | 6703203 | UI-H-BW0-aiv-f-04-0-UI.s1 cDNA, 3' end/clone = IMAGE: 2730751/clone_end = 3' | −1 | AGCTAAAGCCACGGAACTCAATGAGA TTTATGCATGGAAGGAAACAGGTT |
| 5831 | db mining | Hs.255569 | AW296695 | 6703331 | UI-H-BW0-aix-c-06-0-UI.s1 cDNA, 3' end/clone = IMAGE: 2730635/clone_end = 3' | −1 | TGTTCTCTCTCGAACTCTGGAGCACA TCAGCTCTCTCTGCATAAACTGTT |
| 5832 | db mining | Hs.255572 | AW296727 | 6703363 | UI-H-BW0-aix-f-09-0-UI.s1 cDNA, 3' end/clone = IMAGE: 2730785/clone_end = 3' | −1 | ATCTGGAGGATGGCAGTTTGAGAATT AGGACTAAGCCCGTCTCCCTTTG |
| 5833 | Table 3A | Hs.255573 | AW296730 | 6703386 | UI-H-BW0-aix-f-12-0-UI.s1 cDNA, 3' end/clone = IMAGE: 2730791/clone_end = 3' | −1 | CATTAGCTCTCTAAACATTTGGCCTA AGGGATTCATAGGTGAAGCCTTTA |
| 5834 | db mining | Hs.255575 | AW296758 | 6703394 | UI-H-BW0-ajb-a-10-0-UI.s1 cDNA, 3' end/clone = IMAGE: 2730931/clone_end = 3' | −1 | GGTAGGATTTATCCTTTTTCTTCATGTG CAACTGTATAAACTGGCAAAGCA |
| 5835 | db mining | Hs.255577 | AW296773 | 6703409 | UI-H-BW0-ajb-c-04-0-UI.s1 cDNA, 3' end/clone = IMAGE: 2731015/clone_end = 3' | −1 | AGTCTTATGGGACAGAGCAGCTCTCC AGTCTAGGATGGTAGAAGATTCTT |
| 5836 | Table 3A | Hs.255579 | AW296797 | 6703433 | UI-H-BW0-ajb-e-07-0-UI.s1 cDNA, 3' end/clone = IMAGE: 2731117/clone_end = 3' | −1 | GAGTCTGTACCCCTTTCTAATAAACT GCTCTGGACACAATGAACCCTGAA |
| 5837 | db mining | Hs.255550 | AW296802 | 6733438 | UI-H-BW0-ajb-f-02-0-UI.s1 cDNA, 3' end/clone = IMAGE: 2731155/clone_end = 3' | −1 | CCATCGGCAAGCCTTGGTGGGTTCAT ATTCAGTGGCATTAGGGATTAAGG |
| 5838 | db mining | Hs.255590 | AW296914 | 6703550 | UI-H-BW0-ajc-e-12-0-UI.s1 cDNA, 3' end/clone = IMAGE: 2731294/clone_end = 3' | −1 | CCATTTCTTCTGGATCCTCTCCTAGTT GTCTTTGTGTGGACGCACAAGCG |
| 5839 | db mining | Hs.255591 | AW296947 | 6703583 | UI-H-BW0-ajc-c-05-0-UI.s1 cDNA, 3' end/clone = IMAGE: 2731472/clone_end = 3' | −1 | GATCCTTTGCTGACACTGGTTTCTCT CTTATTTTGCCCCGCCAATAAAAA |
| 5840 | db mining | Hs.255598 | AW297024 | 6703660 | UI-H-BW0-ajf-e-04-0-UI.s1 cDNA, 3' end/clone = IMAGE: 2731495/clone_end = 3' | −1 | TCTGTCTGAAACTTCTTTTCTCTCTGA GAATTAAATTTTCCAATGGACCGT |
| 5841 | db mining | Hs.255600 | AW297026 | 6703662 | UI-H-BW0-ajf-e-06-0-UI.s1 cDNA, 3' end/clone = IMAGE: 2731499/clone_end = 3' | −1 | GATCTGTGTTTTCCTCCCAAAAGAAG ATCATCTTTCCAGAAAAAGAGGAT |
| 5842 | db mining | Hs.255601 | AW297030 | 6703666 | UI-H-BW0-ajf-e-10-0-UI.s1 cDNA, 3' end/clone = IMAGE: 2731507/clone_end = 3' | −1 | TTCCATATGTCACTGTATCTGCCTGG CATTACCCCTTCTTAAAACACACA |
| 5843 | db mining | Hs.288403 | AW297038 | 6703672 | AV757131 cDNA, 5' end/clone = BMFAKG04/clone_end = 5' | −1 | GCTCACTACCACTTCTTCAAATCCAG CTAAAAGCATCACGGCCTCAATGA |
| 5844 | db mining | Hs.255614 | AW291182 | 6703808 | HNC68-1F10.R cDNA | −1 | GTCTGGTTGTTAGCTTTCCCGATCCT |

TABLE 8-continued

| SEQ ID | Origin | Unigene | Locus | GI | Nominal Description | Strand | Probe Sequence |
|---|---|---|---|---|---|---|---|
| 5845 | db mining | Hs.255615 | AW297175 | 6703811 | UI-H-BW0-ajd-c-04-0-UI.s1 cDNA, 3' end/clone = IMAGE: 2731375/clone_end = 3' | −1 | CCACACATTGGAAACCTAAGCATA GGGCAATGGAGCCACAGACTCTCTA ACTTCAAGAGGTGTTTCATAGGTGT |
| 5846 | db mining | Hs.255618 | AW297199 | 6703835 | UI-H-BW0-ajd-e-07-0-UI.s1 cDNA, 3' end/clone = IMAGE: 2731477/clone_end = 3' | −1 | AGCTGAGGTCAGACAAACCACAACAT ATATGCAGATTTATCAGCAATAAA |
| 5847 | db mining | Hs.255617 | AW297201 | 6703637 | 7k38c02.x1 cDNA, 3' end/clone = IMAGE: 3477507/clone_end = 3' | −1 | CCTGCCAGGGTTGTTCGGAAGTCGC AGGTCCGAAAATCTCCTCCGCATAC |
| 5848 | db mining | Hs.255621 | AW297220 | 6703656 | UI-H-BW0-ajd-g-09-0-UI.s1 cDNA, 3' end/clone = IMAGE: 2731577/clone_end = 3' | −1 | CTTCTCTGAAATGGTACGCCTATACT TGCATTTCTGAGAAGCCAAACAAA |
| 5849 | db mining | Hs.255622 | AW297233 | 6703869 | UI-H-BW0-aji-a-03-0-UI.s1 cDNA, 3' end/clone = IMAGE: 2731684/clone_end = 3' | −1 | AGTTTTCTGGCTAAGTCACCTCTTAA GGAGATCCCTGTAAAATTCACCCT |
| 5850 | db mining | NA | AW297255 | 6703891 | UI-H-BI2-ahi-d-06-0-UI.s1 NCI_CGAP_Sub6 cDNA clone IMAGE: 2731782 3', mRNA sequence | −1 | CAGATTAAAAACCCCATCCCGGCCCT CACCGAGGTGTTACAACTCTGTCC |
| 5851 | db mining | Hs.48820 | AW297262 | 6703998 | TAFII105 mRNA, partial/cds = (0, 2405) | −1 | AGCAAATTACTCTGCCTGGAAATAAA ATTCTGTCACTTCAAGCATCTCCT |
| 5852 | db mining | Hs.255628 | AW297265 | 6703901 | UI-H-BW0-aji-d-02-0-UI.s1 cDNA, 3' end/clone = IMAGE: 2731826/clone_end = 3' | −1 | TCCAGGCACTGTATAGGTGGCGAGG ACACAATGATAGGCAAAGTAGTACA |
| 5853 | db mining | Hs.255630 | AW297294 | 6703930 | UI-H-BW0-aji-f-09-0-UI.s1 cDNA, 3' end/clone = IMAGE: 2731936/clone_end = 3' | −1 | ACACACCCAAACCTCACACAGTGAAA GGCCACTTTCCTCACACAGTGAAA |
| 5854 | db mining | Hs.255632 | AW297313 | 6703949 | 7k46h07.x1 cDNA, 3' end/clone = IMAGE: 3478525/clone_end = 3' | −1 | TTGCTTCAGACTTTTAACAACAATCCT AGAAGCCAGAAAACAATGAAGAAA |
| 5855 | db mining | Hs.255633 | AW297317 | 6703953 | UI-H-BW0-aji-h-12-0-UI.s1 cDNA, 3' end/clone = IMAGE: 2732038/clone_end = 3' | −1 | TTCTGTCAGGGCTTCAAAAGAGACTT CCATAGTTTTGGGAACTGGAGTCA |
| 5856 | db mining | Hs.255634 | AW297318 | 6703954 | UI-H-BW0-air-a-01-0-UI.s1 cDNA, 3' end/clone = IMAGE: 2730121/clone_end = 3' | −1 | GATATATTGAAGGTCAGAGGCAGAGC TAAACAGGTGATGCCACTGGGTCT |
| 5857 | db mining | Hs.215635 | AW297328 | 6703964 | UI-H-BW0-air-a-11-0-UI.s1 cDNA, 3' end/clone = IMAGE: 2730141/clone_end = 3' | −1 | AGGCTCTTGTTGAGTATTCCTTTGATT CCTGCTTCTGTCTTTTTAAATCA |
| 5858 | Table 3A | Hs.255637 | AW297339 | 6703975 | UI-H-BW0-air-c-03-0-UI.s1 cDNA, 3' end/clone = IMAGE: 2730221/clone_end = 3' | −1 | ACACACCAAAAGAAATACAAGAGTCT TTTTCTGCCCTTGGGGAATCTGCA |
| 5859 | db mining | NA | AW297356 | 6703992 | UI-H-BW0-air-d-08-0-UI.s1 NCI_CGAP_Sub6 cDNA clone IMAGE: 2730279 3', mRNA sequence | −1 | ACACCCAGCACCCACAGGGAAGAAA TAATTCCACAGAGCTAAGTATTCCA |
| 5860 | db mining | Hs.330185 | AW297367 | 6104003 | UI-H-BW0-air-f-01-0-UI.s1 cDNA, 3' end/clone = IMAGE: 2730361/clone_end = 3' | −1 | TGTGCCTGTGTGCTCCAGCCTCTTCC TATGTGTGTAACTTCAATAAAACC |
| 5861 | db mining | Hs.255644 | AW297374 | 6704010 | UI-H-BW0-air-f-08-0-UI.s1 cDNA, 3' end/clone = IMAGE: 2730375/clone_end = 3' | −1 | ACCGAGTGTTACCGCAAGAGGTGTAA AAATCGAGGTTCATCTTTGCACAC |
| 5862 | db mining | Hs.255645 | AW297384 | 6704020 | UI-H-BW0-air-g-08-0-UI.s1 cDNA, 3' end/clone = IMAGE: 2730423/clone_end = 3' | −1 | TCCTGATTCTCAAAGTACCCCCTTCC CTACAACTCTAACATGCTTTGTCT |
| 5863 | db mining | Hs.255646 | AW297390 | 6704026 | UI-H-BW0-air-h-05-0-UI.s1 cDNA, 3' end/clone = IMAGE: 2730485/clone_end = 3' | −1 | CCATGATTTTTCCAATGGACAAGCAC TATTAACATGGGACTGTATTTCCT |
| 5864 | Table 3A | Hs.255647 | AW297400 | 6704038 | UI-H-BW0-ais-a-05-0-UI.s1 cDNA, 3' end/clone = IMAGE: 2730152/clone_end = 3' | −1 | AATAGAACTGATAGCCCATGATGATT GGCTGGCAGGGTTAAGGAAGTGGG |
| 5865 | db mining | Hs.255648 | AW297401 | 6704037 | UI-H-BW0-ais-a-08-0-UI.s1 cDNA, 3' end/clone = IMAGE: 2730154/clone_end = 3' | −1 | TCCCAGGAGAGTCACATTTCTTTTC ACTAAATAAGGAGGGGAAGAAAAA |
| 5866 | db mining | Hs.255649 | AW297407 | 6704043 | UI-H-BW0-ais-b-02-0-UI.s1 cDNA, 3' end/clone = IMAGE: 2730194/clone_end = 3' | −1 | GGGTTACCTCACTTTCTAGGTTCCCA AGATTCCCAAGTTAAGGAAGCTTT |
| 5867 | db mining | Hs.255650 | AW297411 | 6704047 | UI-H-BW0-ais-b-07-0-UI.s1 cDNA, 3' end/clone = IMAGE: 2730204/clone_end = 3' | −1 | AAAGCGTCCAGTCCCCTAACTCAAA CACAGAAACATAACAATTTTACAA |
| 5868 | db mining | Hs.255653 | AW297426 | 6704062 | UI-H-BW0-ais-c-12-0-UI.s1 cDNA, 3' end/clone = IMAGE: 2730262/clone_end = 3' | −1 | CCCAGGGCTCCTCCACCTGAAAGAAT TGTCAGGGTTTCAGATCAGCTAAA |
| 5869 | db mining | Hs.256657 | AW297443 | 6704079 | UI-H-BW0-ais-e-09-0-UI.s1 cDNA, 3' end/clone = IMAGE: 2730352/clone_end = 3' | −1 | TGGCCTCCACCCATTAAACTGTCTTT GCCTAAGACAAATAATTCCCAGGA |
| 5870 | Table 3A | Hs.255661 | AW297522 | 6704158 | UI-H-BW0-aja-e-02-0-UI.s1 | −1 | TGTACTCCTGATGCCTGAAAATCGTT |

TABLE 8-continued

| SEQ ID | Origin | Unigene | Locus | GI | Nominal Description | Strand | Probe Sequence |
|---|---|---|---|---|---|---|---|
| | | | | | cDNA, 3' end/clone = IMAGE: 2731108/clone_end = 3' | | AAGTGAAGACTTATCACATTACCG |
| 5871 | db mining | Hs.255665 | AW297581 | 6704217 | UI-H-BW0-ajg-b-08-0-UI.s1 cDNA, 3' end/clone = IMAGE: 2731718/clone_end = 3' | −1 | ATCCTTCAGATTGAGCTGGGTGTCAG CATTCAATTCCACAAGCCTACCTG |
| 5872 | db mining | Hs.255686 | AW297590 | 6704226 | RST6539 cDNA | −1 | TGGATAAGCAATATGTTGGACTAGTA TGAAAATGGCATTCCCAGCAGTGA |
| 5873 | db mining | Hs.256672 | AW297628 | 6704262 | UI-H-BW0-ajg-f-12-0-UI.s1 cDNA, 3' end/clone = IMAGE: 2731918/clone_end = 3' | −1 | TCACTAGCAGAATATAGTGGGCATGA CCAGTATCCTAGTAGAGCTGACCC |
| 5874 | db mining | Hs.255673 | AW297030 | 6704272 | UI-H-BW0-ajg-h-03-0-UI.s1 cDNA, 3' end/clone = IMAGE: 2731996/clone_end = 3' | −1 | AGTTTCTTTCTTACAATGCGGGTCTG AAATCCAGGGTTTCCACACCAGGG |
| 5875 | db mining | Hs.255674 | AW297849 | 6704285 | UI-H-BW0-ajh-a-05-0-UI.s1 cDNA, 3' end/clone = IMAGE: 2731665/clone_end = 3' | −1 | CCAAATACTTAGTGTAGTTGACTTGT CTTGGGTTGCACTGTAAGGCAGAG |
| 5876 | db mining | Hs.255675 | AW297651 | 6704267 | UI-H-BW0-ajh-a-07-0-UI.s1 cDNA, 3' end/clone = IMAGE: 2731669/clone_end = 3' | −1 | CAAGAGTTTCCATGCGTCCAGTGATG ACCGGAATTAATCATGTATGGTGT |
| 5877 | db mining | Hs.255677 | AW297664 | 6704300 | UI-H-BW0-ajh-b-11-0-UI.s1 cDNA, 3' end/clone = IMAGE: 2731725/clone_end = 3' | −1 | GTTTCTAACCCATAAGTGCCTCATAC ATACATTGCTAGTCTAAAGAGCTTT |
| 5878 | db mining | Hs.255679 | AW297692 | 6704328 | UI-H-BW0-ajh-e-05-0-UI.s1 cDNA, 3' end/clone = IMAGE: 2731857/clone_end = 3' | −1 | ACCGGCTAATTTTGTAACTGGCTTGT TTGTAAAATAAATCCTTCCTGTGT |
| 5879 | db mining | Hs.255881 | AW297694 | 6704330 | UI-H-BW0-ajh-e-07-0-UI.s1 cDNA, 3' end/clone = IMAGE: 2731881/clone_end = 3' | −1 | TGGTGGGACTATGTGTTATTCTTGTA TACTTGCAGTGGGTAGATGTCACT |
| 5880 | db mining | Hs.255682 | AW297698 | 6704334 | UI-H-BW0-ajh-e-11-0-UI.s1 cDNA, 3' end/clone = IMAGE: 2731869/clone_end = 3' | −1 | ACTTCCCTACCTCACAGGTTAGGATT CAAAGTGTGTATTCCCCCATTGTG |
| 5881 | db mining | Hs.255688 | AW297728 | 6704364 | UI-H-BW0-aiy-a-01-0-UI.s1 cDNA, 3' end/clone = IMAGE: 2730888/clone_end = 3' | −1 | GGGTGCTTTACAGGATTCTTGGAAAT GTGTAGTGGATGCTGGCTCTAGGG |
| 5882 | db mining | Hs.255688 | AW297749 | 6704385 | UI-H-BW0-aiy-c-03-0-UI.s1 cDNA, 3' end/clone = IMAGE: 2730988/clone_end = 3' | −1 | ACAGAAGCAGGGGGTCAGAAAGTTT CATAAAGGAGGTGTCTTGGAACAAA |
| 5883 | db mining | Hs.342530 | AW297758 | 6704392 | UI-H-BW0-aiy-d-01-0-UI.s1 cDNA, 3' end/clone = IMAGE: 2731032/clone_end = 3' | −1 | CTATTGTGTGGGTTGCCTTGTCCTAC TCAACTTCAAATATTCACCACCCC |
| 5884 | db mining | Hs.255691 | AW297780 | 6704416 | UI-H-BW0-aiy-e-11-0-UI.s1 cDNA, 3' end/clone = IMAGE: 2731100/clone_end = 3' | −1 | CAGGTGTGCTTACTGGCAGGAACCG AGGGGATAAATAAAGATCACTGGAA |
| 5885 | db mining | Hs.255692 | AW297761 | 6704417 | UI-H-BW0-aiy-e-12-0-UI.s1 cDNA, 3' end/clone = IMAGE: 2731102/clone_end = 3' | −1 | ACCAGCCTTATGTGTGTGGGTATTCA ATACTCTGCACATTATATACTGTA |
| 5886 | db mining | Hs.255693 | AW297785 | 6794421 | UI-H-BW0-aiy-f-04-0-UI.s1 cDNA, 3' end/clone = IMAGE: 2731134/clone_end = 3' | −1 | GGGCATTTGTTACCCCTCCTCACCA CCATCCCCATTAAAGGCTTCGGGG |
| 5887 | Table 3A | Hs.255695 | AW297613 | 6704438 | UI-H-BW0-aiy-g-09-0-UI.s1 cDNA, 3' end/clone = IMAGE: 2731192/clone_end = 3' | −1 | CTGTATCTACAACTCCTGACTTCAGA TTTTTGCTTTCTTCAAAACAGCCT |
| 5888 | Table 3A | Hs.255697 | AW297627 | 6704452 | UI-H-BW0-aiy-h-11-0-UI.s1 cDNA, 3' end/clone = IMAGE: 2731244/clone_end = 3' | −1 | AGCAAGACTTAACCACTAATTACTATT ATCTGACCCAGGACTCCGCC |
| 5889 | db mining | Hs.255698 | AW297843 | 6704488 | UI-H-BW0-aoa-c-05-0-UI.s1 cDNA, 3' end/clone = IMAGE: 3083913/clone_end = 3' | −1 | TGGATAGTTGCTCAATGTAGCAGTGA TGTTCTTGGGATTGCCAGCAGAGC |
| 5890 | db mining | Hs.326317 | AW297929 | 6704565 | yg18e06.s1 cDNA, 3' end/clone = IMAGE: 32551/clone_end = 3' | −1 | CCAACAGATTCGTGCTTACCCTGAGG TGAAGCCTCGTTTGAGAACCAAAT |
| 5891 | db mining | Hs.255705 | AW297949 | 6704565 | UI-H-BW0-ajn-d-11-0-UI.s1 cDNA, 3' end/clone = IMAGE: 2732229/clone_end = 3' | −1 | CAACCTTCTTGTTGAATTGATTTACTA CTCATCAGGGTCATGCACAAGCA |
| 5892 | db mining | Hs.255706 | AW297951 | 6704587 | UI-H-BW0-ejn-e-01-0-UI.s1 cDNA, 3' end/clone = IMAGE: 2732257/clone_end = 3' | −1 | ACATTCAAACTGCCAGAATATGACTG TAAAACAGCGAAGTGTTCTCTTGC |
| 5893 | db mining | Hs.255708 | AW297970 | 6704600 | UI-H-BW0-ajn-f-10-0-UI.s1 cDNA, 3' end/clone = IMAGE: 2732323/clone_end = 3' | −1 | TCTTCCTGGGAATGTGATGTGTTTTT CACTGGTTCTAATTCTGTCTTCCT |
| 5894 | db mining | Hs.255710 | AW297974 | 6704610 | UI-H-BW0-ajn-g-02-0-UI.s1 cDNA, 3' end/clone = IMAGE: 2732355/clone_end = 3' | −1 | ACTTATTAATTCTCACCTCAGCCTCA GGGATGTATGTAGGGAAGGAGCAT |
| 5895 | db mining | Hs.255713 | AW297994 | 6704830 | UI-H-BW0-ajn-h-11-0-UI.s1 cDNA, 3' end/clone = IMAGE: 2732421/clone_end = 3' | −1 | ACATTCCTGTCATTAGTGAATAAGAA GCTGAGGTGTGACTAAGAAGACAA |
| 5896 | db mining | Hs.255717 | AW298042 | 6704678 | UI-H-BW0-ajp-e-07-0-UI.s1 | −1 | CCTCCTTGATAAAATCAAGAACAGGT |

TABLE 8-continued

| SEQ ID | Origin | Unigene | Locus | GI | Nominal Description | Strand | Probe Sequence |
|---|---|---|---|---|---|---|---|
| | | | | | cDNA, 3' end/clone = IMAGE: 2732629/clone_end = 3' | | TAGATTAAAGCAGTAAATCCTAGACT |
| 5697 | db mining | Hs.330189 | AW298048 | 6704684 | UI-H-BW0-ejp-f-01-0-UI.s1 cDNA, 3' end/clone = IMAGE: 2732665/clone_end = 3' | −1 | TCCTGGCCTTTGTGGGTTTTTAATTC CCTTTACCTTTTCCCTTTTTGGAT |
| 5898 | db mining | Hs.255721 | AW298073 | 6704709 | UI-H-BW0-ajp-h-05-0-UI.s1 cDNA, 3' end/clone = IMAGE: 2732769/clone_end = 3' | −1 | ACTGCTGCAACTACAATTCTCAGATA GTCCCATTTGTTTAAATCACGCAT |
| 5899 | db mining | Hs.342533 | AW296095 | 6704731 | UI-H-BW0-ajs-b-12-0-UI.s1 cDNA, 3' end/clone = IMAGE: 2732878/clone_end = 3' | −1 | CCTTCCCTCTTGCCTGTAGGTTCTGT GGCTATAAACAAATCATAACTTTT |
| 5900 | db mining | Hs.255725 | AW298100 | 6704742 | UI-H-BW0-ajs-c-07-0-UI.s1 cDNA, 3' end/clone = IMAGE: 2732916/clone_end = 3' | −1 | TTAAATGCTTCCCTGGCTCTCCCTGG GTTTCAGTTTCTATCCATGCCCTG |
| 5901 | db mining | Hs.255726 | AW298110 | 6704746 | UI-H-BW0-ajs-c-11-0-UI.s1 cDNA, 3' end/clone = IMAGE: 2732924/clone_end = 3' | −1 | TTGTTCTCCTCCCAAGTCTCTGGTTC TATTTGGCTTTTTCAGCTCTGTGC |
| 5902 | db mining | Hs.255727 | AW298123 | 6704759 | UI-H-BW0-ajs-e-01-0-UI.s1 cDNA, 3' end/clone = IMAGE: 2733000/clone_end = 3' | −1 | GCATTTCAGGGACACAAATGGGT CCATGGCAGAGACCAGTAATGCCA GATA |
| 5903 | db mining | Hs.255736 | AW298201 | 6704837 | UI-H-BW0-ajt-d-08-0-UI.s1 cDNA, 3' end/clone = IMAGE: 2732967/clone_end = 3' | −1 | TTTTATCCCCGCTTTAACTTTGTTTGC TTGGTACTTTTCTTGTGGTTACA |
| 5904 | db mining | NA | AW298208 | 6704844 | UI-H-BW0-ajl-e-05-0-UI.s1 NCI_CGAP_Sub6 cDNA clone IMAGE: 2733009 3', mRNA sequence | −1 | CACGCACCCAACTCCCCACTGCTCCT CTCCATCCAGATGTTCGTCCAGAG |
| 5905 | db mining | Hs.255740 | AW298234 | 6704870 | UI-H-BW0-ajt-g-09-0-UI.s1 cDNA, 3' end/clone = IMAGE: 2733113/clone_end = 3' | −1 | TTTGAGGGCAATTTAATGGTTAAGTG TAGGAAAATCCACTCTTACAGTGT |
| 5906 | db mining | Hs.330191 | AW298238 | 6704874 | UI-H-BW0-ajt-h-04-0-UI.s1 cDNA, 3' end/clone = IMAGE: 2733151/clone_end = 3' | −1 | GGCCTTTTGATTTTCCATTGGGGTCC CCCGCTTTCCCATTTTTGGTTTTT |
| 5907 | db mining | Hs.255743 | AW298239 | 6704875 | UI-H-BW0-ajt-h-05-0-UI.s1 cDNA, 3' end/clone = IMAGE: 2733153/clone_end = 3' | −1 | GACAGTTTGGGGAAGGGATTGAAGG TCTGCGTCAAAGAGAACAGAAAACC |
| 5908 | db mining | NA | AW298271 | 6704994 | UI-H-BW0-ajk-d-01-0-UI.s1 cDNA, 3' end/clone = IMAGE: 2732184/clone_end = 3' | −1 | AGGGGCCTTTTACCGGTTTGTTTTCC CTTAAATTTTTAAAGGAATTGAAT |
| 5909 | db mining | Hs.183669 | AW298312 | 6705035 | mRNA for KIAA1271 protein, partial cds/cds = (72, 1700) | −1 | TCCTCTTTCTTGTCACTGTGAAGCGA TGAATAAACCTGGGTGTAGATCCA |
| 5910 | db mining | Hs.302681 | AW298348 | 6704908 | 7j80e10.x1 cDNA, 3' end/clone = IMAGE: 3392778/clone_end = 3' | −1 | CCTAGAAATTATTATACAGGGATAAAT GAGGCACTGAAGGTGGGAGAACC |
| 5911 | db mining | Hs.255746 | AW298349 | 6704909 | UI-H-BW0-ajj-c-10-0-UI.s1 cDNA, 3' end/clone = IMAGE: 2731795/clone_end = 3' | −1 | ACGACAAACTGCACAGTAAATATCAC AAACACGGAAATACCACAGTGTCT |
| 5912 | db mining | Hs.255747 | AW298355 | 6704915 | UI-H-BW0-ajj-d-06-0-UI.s1 cDNA, 3' end/clone = IMAGE: 2731835/clone_end = 3' | −1 | ACCATGACTTGGCAAAGAGTTTCAAG AGAGGGCATAATCAAAAGTAACCA |
| 5913 | db mining | Hs.255749 | AW298388 | 6704948 | UI-H-BW0-ajj-g-08-0-UI.s1 cDNA, 3' end/clone = IMAGE: 2731983/clone_end = 3' | −1 | GATTAATCAAGGGAAGAGCTTCAAGC AGAGCTCCTTAGGTTTTTCAAAAA |
| 5914 | Table 3A | Hs.313413 | AW298430 | 6705068 | 802721745F1 cDNA, 5' end/ clone = IMAGE: 4848506/ clone_end = 5' | −1 | GCTCAGGGGACAGCTATTCTTTTTCA AGAGCTCCTTAGGTTTTTCAAAA |
| 5915 | db mining | Hs.255762 | AW298437 | 6705073 | UI-H-BW0-ajl-d-08-0-UI.s1 cDNA, 3' end/clone = IMAGE: 2732199/clone_end = 3' | −1 | TGAGAGCTTTCCTTCCTCCTACGATC CAACCTGTCAAACATTTCCTACA |
| 5916 | db mining | Hs.255763 | AW298445 | 6705081 | UI-H-BW0-ajl-e-07-0-UI.s1 cDNA, 3' end/clone = IMAGE: 2732245/clone_end = 3' | −1 | TGTGCCAACGCATGATTTCTTTGAGT AAATTTCTAAACGTCACAGAAGTT |
| 5917 | db mining | Hs.255764 | AW298447 | 6705083 | UI-H-BW0-ajl-e-09-0-UI.s1 cDNA, 3' end/clone = IMAGE: 2732249/clone_end = 3' | −1 | AGTCAACATGGAGCAAGTGAGCTAAG GAAGTAATGGAAACTGTTTGGAGA |
| 5918 | db mining | Hs.255766 | AW298482 | 6705118 | UI-H-BW0-ajl-h-11-0-UI.s1 cDNA, 3' end/clone = IMAGE: 2732397/clone_end = 3' | −1 | AGCTCAGGTCTTCCCTCATCTGTTAG TTTCCTGGAGTCTGTTCTCATACT |
| 5919 | db mining | Hs.255767 | AW298489 | 6705125 | UI-H-BW0-ajm-a-08-0-UI.s1 cDNA, 3' end/clone = IMAGE: 2732078/clone_end = 3' | −1 | AAACATACTCCTCTTCACCAGCACTC AGACATTTGTATCCAGAGAAAGCT |
| 5920 | db mining | Hs.255768 | AW298490 | 6705128 | UI-H-BW0-ajm-a-09-0-UI.s1 cDNA, 3' end/clone = IMAGE: 2732080/clone_end = 3' | −1 | AGTCTGCAATTGTTTAAGCCTGTGA TCTTTCTTTTCCCAGTTAAGAGTT |
| 5921 | db mining | Hs.255769 | AW298494 | 6705130 | UI-H-BW0-ajm-b-01-0-UI.s1 cDNA, 3' end/clone = IMAGE: 2732112/clone_end = 3' | −1 | TGTCCTCTCAACCCTACTTGTGGTTT TACACTGTTAATTACACTATTTGC |

TABLE 8-continued

| SEQ ID | Origin | Unigene | Locus | GI | Nominal Description | Strand | Probe Sequence |
|---|---|---|---|---|---|---|---|
| 5922 | db mining | Hs.132781 | AW298502 | 6705138 | class I cytokine receptor (WSX-1), mRNA/cds = (138, 2048) | −1 | GTGTGTGTATGGTTGTTGGGCGTAG GACAGGTTTCGGGGATGCGCGGTAC |
| 5923 | db mining | Hs.255770 | AW298503 | 6705139 | UI-H-BW0-ajm-b-12-0-UI.s1 cDNA, 3' end/clone = IMAGE: 2732134/clone_end = 3' | −1 | CTGTGCTTGACTATTGAAAACTTAGA ATTGGGATGCCAAAGTTACTTCCT |
| 5924 | db mining | Hs.255772 | AW298510 | 6705146 | UI-H-BW0-ajm-c-11-0-UI.s1 cDNA, 3' end/clone = IMAGE: 2732180/clone_end = 3' | −1 | GGTTGTATCAAAAGAACTCCACATCC ATATTGAATAAACTCCCACTAGCC |
| 5925 | db mining | Hs.255777 | AW298559 | 6705195 | UI-H-BW0-ajm-n-04-0-UI.s1 cDNA, 3' end/clone = IMAGE: 2732406/clone_end = 3' | −1 | GGCTGCCCAGATCTCGTGGGAAGAA GACCACAGGAGGACTCGGCTCAATG |
| 5926 | db mining | Hs.255779 | AW298607 | 6705243 | UI-H-BW0-ajr-d-12-0-UI.s1 cDNA, 3' end/clone = IMAGE: 2732615/clone_end = 3' | −1 | TGGAAAAATGATAGCAGCCAACTTGA CAGAAGAACCCAGCATACACATTC |
| 5927 | db mining | Hs.255762 | AW298616 | 6705252 | UI-H-BW0-ajr-e-10-0-UI.s1 cDNA, 3' end/clone = IMAGE: 2732659/clone_end = 3' | −1 | TTGGTTTTGGGGATTGGGAAGTCTTA AGCCAAATTGTCCCCGGTCTCCCC |
| 5928 | db mining | Hs.255783 | AW298627 | 6705263 | UI-H-BW0-ajr-f-10-0-UI.s1 cDNA, 3' end/clone = IMAGE: 2732707/clone_end = 3' | −1 | GCCCTATATCTAGTGAGCAGGTTGTG GCAATCAGGAAGGGATTGATATTT |
| 5929 | db mining | Hs.255784 | AW298832 | 6705268 | UI-H-BW0-ajr-g-04-0-UI.s1 cDNA, 3' end/clone = IMAGE: 2732743/clone_end = 3' | −1 | TGCACGCAATGCTTGAAGTGTTCCCA GGTATTTAGTTTCAGGTAAATTTT |
| 5930 | db mining | Hs.255785 | AW298647 | 6705283 | UI-H-BW0-ajr-h-09-0-UI.s1 cDNA, 3' end/clone = IMAGE: 2732801/clone_end = 3' | −1 | CTGTAGGTATGAGCTGCCAGGATCCA GGTGTGACTCGGGTATTTCTAGGG |
| 5931 | db mining | Hs.255788 | AW298875 | 6705311 | UI-H-BW0-ajo-c-03-0-UI.s1 cDNA, 3' end/clone = IMAGE: 2732524/clone_end = 3' | −1 | TCCCATTTGGGGGGTGGGCTGTTAA ATTTTGACTCCCTGTTTTAAACCC |
| 5932 | db mining | Hs.255794 | AW298720 | 6705358 | UI-H-BW0-ajo-g-07-0-UI.s1 cDNA, 3' end/clone = IMAGE: 2732724/clone_end = 3' | −1 | CCACTTGCATCTCTTCTGGGGGTTCT TTCCTTTCTTTCCTGTTCTAAGGC |
| 5933 | db mining | Hs.255797 | AW298752 | 6705388 | UI-H-BW0-ajq-b-08-0-UI.s1 cDNA, 3' end/clone = IMAGE: 2732506/clone_end = 3' | −1 | TGGGTAATCAACACTCAACCATCAAC AAACACTCTCTATTCCAGGCACTG |
| 5934 | db mining | Hs.255799 | AW298806 | 6705442 | RC4-MT0235-061200-011-a11 | −1 | AGGAGAAATAATTAGAGTGGCACACT AGCATGATGGTAAACATTCTGTCA |
| 5935 | Table 3A | Hs.157396 | AW300500 | 6710177 | xs66c06.x1 cDNA, 3' end/clone = IMAGE: 2774602/clone_end = 3' | −1 | AGGAGTTCAAGAAGCAGAGATTTCCA GGTCCATGCACCAAAGCTCATGTG |
| 5936 | Table 3A | Hs.262789 | AW300888 | 6710545 | xk07d09.x1 cDNA, 3' end/clone = IMAGE: 2666033/clone_end = 3' | −1 | CTTGTCCTCTCCTGATCCAGGGCTCC AGTGCCCATGTCCAGTGCCTTGGT |
| 5937 | db mining | Hs.255880 | AW337887 | 6834513 | he12d07.x1 cDNA, 3' end/clone = IMAGE: 2918797/clone_end = 3' | −1 | GCATCTCCCCGCTGTCAGCCTCAGC CCTCTCCTACCAAAATCTCTTTCGA |
| 5938 | Table 3A | Hs.328348 | AW338115 | 6834741 | tp39g05.x1 cDNA, 3' end/clone = IMAGE: 2190200/clone_end = 3' | −1 | GGCGTTTCCCATTGACCAGTTTGACC CTGGTTTGAATAAAGAGAAGTGCG |
| 5939 | db mining | Hs.255920 | AW339530 | 6836156 | he13d09.x1 cDNA, 3' end/clone = IMAGE: 2918897/clone_end = 3' | −1 | AGCCCATTGAAAACCTTGGCAAAATG TCAGACCTTAAGACTTTCCACTAT |
| 5940 | Table 3A | Hs.255927 | AW339851 | 6836277 | he15g04.x1 cDNA, 3' end/clone = IMAGE: 2919126/clone_end = 3' | −1 | TCAGAGACAACGGAAGCTGAAAAATA AGAGCTGAGAAAGGAAGAACTTTT |
| 5941 | Table 3A | Hs.207995 | AW340421 | 6837047 | hc96h02.x1 cDNA, 3' end/clone = IMAGE: 2907891/clone_end = 3' | −1 | ATATACATACAAATCTAAGCTCCAAG AAGCCTAAGAAAACCCCTTAGGGG |
| 5942 | Table 3A | Hs.256031 | AW341086 | 6837631 | xz92h04.x1 cDNA, 3' end/clone = IMAGE: 2871703/clone_end = 3' | −1 | GGGCAATTTACATCGGGACTCGTTTC ATCTCTAGACCTTCACTTACCTGA |
| 5943 | Table 3A | Hs.283867 | AW341449 | 6838075 | arginyl aminopeptidase (amino-peptidase B) (RNPEP), mRNA/cds = (9, 1982) | −1 | AGCTCTGGAGTGCCCTCCCTCCAAA TAAAGTATTTAAGCGAACACTGA |
| 5944 | Table 3A | Hs.337986 | AW440517 | 6975823 | Homo sapiens, clone MGC: 17431 IMAGE: 2984883, mRNA, complete cds/cds = (1338, 1494) | −1 | GCCAGTCTCTATGTGTCTTAATCCCT TGTCCTTCATTAAAAGCAAAACTA |
| 5945 | db mining | Hs.256958 | AW440813 | 6976044 | he03b05.x1 cDNA, 3' end/clone = IMAGE: 2917905/clone_end = 3' | −1 | CCCTCAGGCATAGAAATTGAATCTGA AATGGCTGATGAATAAGCAAAGGC |
| 5946 | db mining | Hs.313573 | AW440817 | 6976048 | he03c02.x1 cDNA, 3' end/clone = IMAGE: 2917922/clone_end = 3' | −1 | CAGCCCTGCCTGAGTTTTTGACACCT GCATCCCTCCCTGCCTCACCTCAC |
| 5947 | Table 3A | Hs.256981 | AW440866 | 6976172 | he05f02.x1 cDNA, 3' end/clone = IMAGE: 2918139/clone_end = 3' | −1 | AGAGCAGGAGAAATCCTACTGCATTA TTAATCTGAAAGCACAAGGACAGC |
| 5948 | Table 3A | Hs.173730 | AW440869 | 6976175 | Mediterranean favor (MEFV), mRNA/cds = (41, 2386) | −1 | CTGTCTTGGTTTGTATGGGAAAATCT GCGGGTTGTGGAATATTAGGTTCT |
| 5949 | Table 3A | Hs.118448 | AW440985 | 6976271 | HNC35-1-D12.R cDNA | −1 | TGGGATTATAGGGGGAGACAGGAGT TGTGGAATTACAGGAGAGGTTCACT |
| 5950 | db mining | Hs.118446 | AW440985 | 6976271 | HNC35-1-D12.R cDNA | −1 | TGGGATTATAGGGGGAGACAGGAGT TGTGGAATTACAGGAGAGGTTCACT |
| 5951 | Table 3A | Hs.256971 | AW440974 | 6976280 | he08e12.x1 cDNA, 3' end/clone = IMAGE: 2918254/clone_end = 3' | −1 | CTGAGAAAAGGAGTGTCTCTCTTCTG CTCCCAAACTTCCAGTAGCTTCCA |
| 5952 | Table 3A | Hs.342632 | AW444482 | 6988244 | UI-H-BI3-akb-e-05-0-UI.s1 cDNA, 3' end/clone = IMAGE: 2733777/clone_end = 3' | −1 | TCGAGGTTCTTCCCAAGAAAAGCCCA ATCTTATAAACTGTTACTTCCCCT |

TABLE 8-continued

| SEQ ID | Origin | Unigene | Locus | GI | Nominal Description | Strand | Probe Sequence |
|---|---|---|---|---|---|---|---|
| 5953 | Table 3A | Hs.250 | AW444632 | 6988394 | xanthene dehydrogenase (XDH), mRNA/cds = (81, 4082) | −1 | TGCAATGAGGCAGTGGGGTAAGGTT AAATCCTCTAACCGTCTTTGAATCA |
| 5954 | Table 3A | Hs.335815 | AW444812 | 6986574 | UI-H-BI3-ajy-d-11-0-UI.s1 cDNA, 3' end/clone = IMAGE: 2733380/clone_end = 3' | −1 | TGGCAACTTCAACTCCTTGATGGCGA TAATCTCTGGTATGAATATGAGCC |
| 5955 | Table 3A | Hs.99665 | AW444899 | 6986661 | UI-H-BI3-ajz-d-07-0-UI.s1 cDNA, 3' end/clone = IMAGE: 2733373/clone_end = 3' | −1 | TTGTGCTCCTGATACGACGTTGCCAC AGTTAATCCGTTCTGATCTCTGCT |
| 5956 | Table 3A | Hs.257283 | AW450350 | 6991126 | UI-H-BI3-akn-c-01-0-UI.s1 cDNA, 3' end/clone = IMAGE: 2734825/clone_end = 3' | −1 | CAAGCCTAACTTTCCAACACTCCCGC GACGCAACCCCTTCCCCTTTCCTC |
| 5957 | Table 3A | Hs.313715 | AW450835 | 6991611 | UI-H-BI3-alf-f-06-0-UI.s1 cDNA, 3' end/clone = IMAGE: 2736539/clone_end = 3' | −1 | CACGGTTAGAGTCACCAAACCTGTAT TTCAGGGGACATCTTTCCAGCTCC |
| 5958 | Table 3A | Hs.199014 | AW250874 | 6991850 | 601499703F cDNA, 5' end/clone = IMAGE: 3901440/clone_end = 5' | − | CCAAAGGCTCACTACCCCTGTGCGTT GTCCAGCACACAGACACTATGTGC |
| 5959 | Table 3A | Hs.342873 | AW451293 | 6992069 | RC3-HT0230-130100-014-g06 cDNA | −1 | TGCTTGGGAAATTTGGTTTGTAAACC TAAAATAGCCCTTATTTCTGGGGA |
| 5960 | Table 3A | Hs.101370 | AW452023 | 6992799 | AL583391 cDNA/clone = CS0DL012YA12-(3-prime) | −1 | CATCTGCTGAGCAGTGTGCTGTGTCA ACCTCCTCCTAGGTCTCCTCTATG |
| 5961 | Table 3A | Hs.342735 | AW452096 | 6992953 | UI-H-BI3-alo-d-02-0-UI.s1 cDNA, 3' end/clone = IMAGE: 3069196/clone_end = 3' | −1 | CTTTCTGCCTGAAGCTGCCCCCATGA CTCCCTTCTTTGTGCAAAAGCATG |
| 5962 | Table 3A | NA | AW452487 | 6993243 | UI-H-BI3-als-e-09-0-UI.s1 NCI_CGAP_Sub5 cDNA clone IMAGE: 3068632 3', mRNA sequence | −1 | GAAATGAGTTGGTGTCTTCACAGAAT GAGGATCCCCAGAGCCATCTTGCC |
| 5963 | Table 3A | Hs.257579 | AW452513 | 6993289 | UI-H-BW1-ame-b-03-0-UI.s1 cDNA, 3' end/clone = IMAGE: 3069628/clone_end = 3' | −1 | GTCTCCCTCCCACTCTCTGCCTTACC TGGTATCTATGACTCGACTGAAAT |
| 5964 | db mining | Hs.257581 | AW452528 | 6993304 | UI-H-BW1-ame-c-07-0-UI.s1 cDNA, 3' end/clone = IMAGE: 3069684/clone_end = 3' | −1 | TGCGAGAGGAAGCAGAGACCACCT GAAACTCGGGTGCATTAAGTCCTTG |
| 5965 | db mining | Hs.257582 | AW452545 | 6993321 | UI-H-BW1-ame-d-12-0-UI.s1 cDNA, 3' end/clone = IMAGE: 3069742/clone_end = 3' | −1 | TTAGCCACTGCTATTCTAGGTTCCTT GATGGAGCCCCACTCCCACGCCTA |
| 5966 | db mining | Hs.257630 | AW452932 | 6993708 | UI-H-BW1-amd-c-07-0-UI.s1 cDNA, 3' end/clone = IMAGE: 3069325/clone_end = 3' | −1 | ACCACCCAGAGGTTGCTGGCTTCCTT AATAAAGCTAACTTTCCTTTCACC |
| 5967 | db mining | Hs.257632 | AW452953 | 6993729 | UI-H-BW1-amd-e-04-0-UI.s1 cDNA, 3' end/clone = IMAGE: 3069415/clone_end = 3' | −1 | AGGGGAGCCAGTGGTTTTTGGTCAT GGGAAGTGTTCTCATAAAATTCATT |
| 5968 | db mining | Hs.257633 | AW452960 | 6993736 | UI-H-BW1-amd-e-11-0-UI.s1 cDNA, 3' end/clone = IMAGE: 3069429/clone_end = 3' | −1 | GCACCAGACTTCTGAACAGGCTGGG AGAGTGAGGCATAAACACATGAAAT |
| 5969 | db mining | Hs.257638 | AW452985 | 6993761 | UI-H-BW1-amd-g-12-0-UI.s1 cDNA, 3' end/clone = IMAGE: 3069527/clone_end = 3' | −1 | ACACAGTACTTTGTTGAGATGTTGGC TTCTTGGTTTATGGCATGAATTCT |
| 5970 | Table 3A | Hs.257640 | AW453021 | 6993797 | UI-H-BW1-ama-c-02-0-UI.s1 cDNA, 3' end/clone = IMAGE: 3069290/clone_end = 3' | −1 | ACTTATCTTTTGCCACCCATGTTCCT GGATGCCTTGCCTTCCTCTTTCAT |
| 5971 | db mining | Hs.257644 | AW453034 | 6993810 | UI-H-BW1-ama-d-03-0-UI.s1 cDNA, 3' end/clone = IMAGE: 3069340/clone_end = 3' | −1 | AAACAGGAAGCCTCTCATGAATTTGA CCAAGGAGCTACATTCGTTCTCTA |
| 5972 | db mining | Hs.257645 | AW453039 | 6993815 | UI-H-BW1-ama-d-08-0-UI.s1 cDNA, 3' end/clone = IMAGE: 3069350/clone_end = 3' | −1 | TGAGGAAGAGGAGATTATTAAGCCC CTTCTTTTAGGCTAGGAGGTTTCC |
| 5973 | Table 3A | Hs.257648 | AW453044 | 6993820 | UI-H-BW1-ama-e-01-0-UI.s1 cDNA, 3' end/clone = IMAGE: 3069384/clone_end = 3' | −1 | GGACACTGGCTTTTGTGCAGCTCTTC ATCACAGAGTCTGTTGAGCTACAA |
| 5974 | db mining | Hs.257647 | AW453055 | 6993831 | UI-H-BW1-ama-e-12-0-UI.s1 cDNA, 3' end/clone = IMAGE: 3069408/clone_end = 3' | −1 | ACAGTGATTTTCAACCAAGGGGCTTT TTCAAACTACATTCCTTAGCTCCC |
| 5975 | Table 3A | Hs.257667 | AW467193 | 7037299 | he07a04.x1 cDNA, 3' end/clone = 2918288/clone_end = 3' | −1 | GGTGGTGGCTACAAGGGTGATTGCC TTATGATAATTGACCGTGTCATAAT |
| 5976 | db mining | Hs.257688 | AW487208 | 703314 | he07c09.x1 cDNA, 3' end/clone = 2918320/clone_end = 3' | −1 | AGCTGGGAGGCCATTACTTTTTGTCT GAGTCTTCTGGAGTTCTAGCAAAA |
| 5977 | db mining | Hs.255877 | AW467312 | 703418 | he09b01.x1 cDNA, 3' end/clone = 2918473/clone_end = 3' | −1 | AGTTGCATTAAACTGAGCTTAGATGT GTAAGTTTGCTAACGGATGGGTTT |
| 5978 | db mining | Hs.257677 | AW467338 | 7037444 | he09e07.x1 cDNA, 3' end/clone = 2918532/clone_end = 3' | −1 | CCTCTAAGGCATTTATTTACTGACAA CATAAAATCTTGAACCCCAGGTCA |
| 5979 | db mining | Hs.257679 | AW467385 | 7037491 | he10d12.x1 cDNA, 3' end/clone = 2918815/clone_end = 3' | −1 | TCACCTCCATCAACTTACTAGCACAT AAAGGGTGGGATTTCATGTGTTGA |
| 5980 | Table 3A | Hs.257880 | AW487400 | 7037506 | he10f11.x1 cDNA, 3' end/clone = IMAGE: 2918637/clone_end = 3' | −1 | CTGGCAAAGGCATGGGTACAACCTG CTCTGTGATCTACCTTCTGAACCAC |
| 5981 | db mining | NA | AW487421 | 7037527 | he17b02.x1 NCI_CGAP_CML 1 | −1 | ACACCTGTGGTATATTTGTATCATTCA |

TABLE 8-continued

| SEQ ID | Origin | Unigene | Locus | GI | Nominal Description | Strand | Probe Sequence |
|---|---|---|---|---|---|---|---|
| | | | | | cDNA clone IMAGE: 2919243 3' similar to contians Alu repetitive element; con | | GTCTGGTTTCTCACCCTTCCTAA |
| 5982 | Table 3A | NA | AW487437 | 7037543 | he17d05.x1 NCI_CGAP_CML 1 cDNA clone IMAGE: 2919273 3' mRNA sequence | −1 | AACCCTCGTAAGGTTTCATCTTCCTT GATTGCAAAATGAGTTTGTGTGAA |
| 5983 | db mining | NA | AW467445 | 7037551 | he17e08.x1 NCI_CGAP_CML 1 cDNA clone IMAGE: 2919302 3' similar to contains element MSR1 repetitive el | −1 | CCCGCTTCACCTTCCCTAAATAACTC GTTTGCAGGCTAATTCCATCAAAT |
| 5984 | db mining | NA | AW487448 | 7037554 | he17l02.x1 NCI_CGAP_CML 1 cDNA clone IMAGE: 2919291 3' similar to contians Alu repetitive element; con | −1 | ATTTTGCTCATTACCTGTCAGGAGAA AACCCTCCTTCCCCAGTCTCCACT |
| 5985 | Table 3A | Hs.257687 | AW467501 | 7037607 | he19e06.x1 cDNA, 3' end/clone = IMAGE: 2919490/clone_end = 3' | −1 | ACCTACTGAATCTCCAGATTGCCAAG TGAAACACAATGGTTGCCTCTTCA |
| 5986 | db mining | Hs.257688 | AW467571 | 7037677 | he21l02.x1 cDNA, 3' end/clone = IMAGE: 2919675/clone_end = 3' | −1 | TGCGAAAGCTAATTCCCTAGTATGAA TAAACTTCAGACCTTGCTCTCCTT |
| 5987 | db mining | Hs.257690 | AW467582 | 7037688 | 602497524F1 cDNA, 5' end/ clone = IMAGE: 4611316/ clone_end = 5' | −1 | AGCCTGAGGTGGGTGAAGAAAATAC CTGCTTTATACTGTTCTGGAAACTC |
| 5988 | db mining | Hs.266387 | AW467607 | 7037713 | he22c05.x1 cDNA, 3' end/clone = IMAGE: 2919752/clone_end = 3' | −1 | CTTTTCCCCTTCATGGTAGTTGCTGC TTAAGTTTCTCTAACATGCCTGCA |
| 5989 | Table 3A | Hs.257695 | AW467746 | 7037776 | he23d05.x1 cDNA, 3' end/clone = IMAGE: 2919849/clone_end = 3' | −1 | TGAATGTGCAGATGCAGAACCCATTG ATATGGAGGGCTGAGTGTCTGAAA |
| 5990 | Table 3A | Hs.257705 | AW467863 | 7037969 | he27c04.x1 cDNA, 3' end/clone = IMAGE: 2920230/clone_end = 3' | −1 | TGTACTACTTATTTATGTGTAAACCAT ACACAGGGCTAGAAAGGAAGGGAT |
| 5991 | Table 3A | Hs.257706 | AW467884 | 7037970 | he27c05.x1 cDNA, 3' end/clone = IMAGE: 2920232/clone_end = 3' | −1 | TGTAGAATTGCGGAGTAGAAAGACCC TTGAAAGATCATTTGTCCTGTGGT |
| 5992 | Table 3A | Hs.257709 | AW467992 | 7038098 | he30b01.x1 cDNA, 3' end/clone = IMAGE: 2920489/clone_end = 3' | −1 | GCTCAAGTTCCCAGCACCTGGGGAA TTCTAAGCCTGAGGAAGACAAGGTG |
| 5993 | db mining | Hs.257713 | AW468139 | 7038245 | he32g11.x1 cDNA, 3' end/clone = IMAGE: 2920772/clone_end = 3' | −1 | TGTTTTTATGTCCTGAGCAAGCAAATT GCTGCAATTAAAATCACCAATTT |
| 5994 | Table 3A | Hs.257716 | AW468207 | 7038313 | he34e12.x1 cDNA, 3' end/clone = IMAGE: 2920894/clone_end = 3' | −1 | AGGCCTGATATTGAAAGCTTTTGATA CTGAGATCCTATTAATCTCAGATGA |
| 5995 | db mining | Hs.257719 | AW468316 | 7038422 | he38a05.x1 cDNA, 3' end/clone = IMAGE: 2921072/clone_end = 3' | −1 | TGTTAGTTTGCTTTTGAAATTCTTTGG AGGGTACTCTTCAGGGCTTCACA |
| 5996 | db mining | Hs.278060 | AW488430 | 7038538 | he37h10.x1 cDNA, 3' end/clone = IMAGE: 2921251/clone_end = 3' | −1 | TAGTGATTATCTCCAGGAATCAAGTA CAAACTTTGAAAAAAGACTGGAGGT |
| 5997 | Table 3A | Hs.257727 | AW488431 | 7038537 | he37h11.x1 cDNA, 3' end/clone = IMAGE: 2921253/clone_end = 3' | −1 | TTGTCCCAAGGGCTCAGACTGAAAG AATGCAATGTGAGAGGTATGCCAC |
| 5998 | db mining | Hs.330268 | AW468459 | 7038565 | he38d05.x1 cDNA, 3' end/clone = IMAGE: 2921289/clone_end = 3' | −1 | TCTGTGAAAATCTTTCTGCAAATGTCT TTGCTTGCTTGTACTCACGTTTT |
| 5999 | db mining | Hs.257738 | AW468559 | 7038665 | he41a07.x1 cDNA, 3' end/clone = IMAGE: 2921556/clone_end = 3' | −1 | TGTCTTTAACGCACAGATGTTACTTC AGCACCACAAGGACTGTTGATGGA |
| 6000 | Table 3A | Hs.257743 | AW488621 | 7038727 | he42e03.x1 cDNA, 3' end/clone = IMAGE: 2921692/clone_end = 3' | −1 | CAGTCAGATGTTGGAATTGGGGGTA GAGGGATTATAGAGTTGTGTGTGCT |
| 6001 | Table 3A | Hs.122116 | AW469546 | 7039652 | hd19e09.x1 cDNA, 3' end/clone = IMAGE: 2909992/clone_end = 3' | −1 | AAAGGAGGGACTATGGCATCAAACA GCCTCTTCAGCACAGTGACACCATG |
| 6002 | Table 3A | Hs.80618 | AW510795 | 7148873 | hypothetical protein (FLJ20015), mRNA/cds = (31, 522) | −1 | ACCCAGTTTGTGCATAGTTCATGATC CTCTATAAAACCAGCTTTTGTGGA |
| 6003 | Table 3A | Hs.193869 | AW512498 | 7150576 | hypothelical protein DKFZp588J1119 (DKFZp588J1119), mRNA/cds = (27, 2153) | −1 | CTGTCGGGCTCTGAAGCGAGCTGGT TTAGTTGTAGAAGATGCTCTGTTTG |
| 6004 | Table 3A | Hs.42915 | AW572538 | 7237271 | ARP2 (actin-related protein 2, yeast) homolog (ACTR2), mRNA/ cds = (74, 1258) | −1 | TGGAATGGACTCTTAAAACAATGAAA GAGCATTTATCGTTTGTCCCTTGA |
| 6005 | Table 3A | Hs.342858 | AW572930 | 7237663 | hf17f07.x1 cDNA, 3' end/clone = IMAGE: 2932165/clone_end = 3' | −1 | TCACTACCTTCAATTGTTTACAAGGT GGATATGGGCAGGCAACAGATACT |
| 6006 | Table 3A | Hs.325991 | AW573211 | 7237944 | 602679187F1 cDNA, 5' end/ clone = IMAGE: 4812093/ clone_end = 5' | −1 | CTAGGCCGGATGGGCCAGAGAAGGA GAACCATGGCAGGAGCCGGAAGCAG |
| 6007 | db mining | Hs.258933 | AW589231 | 7276337 | he27g09.x1 cDNA, 3' end/clone = IMAGE: 2920288/clone_end = 3' | −1 | AAATGTTGAGCAACTGTTCAAAT AACAGCACTAATTGTGTGTTCATT GGCT |
| 6008 | Table 3A | Hs.304925 | AW592876 | 7280068 | hg04d05.x1 cDNA, 3' end/clone = IMAGE: 2944617/clone_end = 3' | −1 | CTGGCACATCCAGGTTTTAGAGCAGG CAGCCTGAGATTTCAAAAATGAGG |
| 6009 | Table 3A | Hs.298654 | AW614181 | 7319367 | hg77d03.x1 cDNA, 3' end/clone = IMAGE: 2951621/clone_end = 3' | −1 | GGAGCGGAATACAGTAAAAGCACTG GACTGACCTAAGAGTTTGTTTCTGC |
| 6010 | Table 3A | Hs.259842 | AW614193 | 7319379 | cDNA FLJ11025 fis, clone PLACE 1003968, moderately similar to 5'-AMP-ACTIVATED PROTEIN KINASE, GAMMA-1 SUBUNIT/cds = (159, 1145) | −1 | ACACCATTTCAGCGTTGGATCACAGA CAGCTCTTCCTTTATATCCCAGCA |
| 6011 | Table 3A | Hs.342967 | AW629176 | 7375966 | 802819939F1 cDNA, 5' end/ | −1 | CCACCTTGCTGCCTTTTGAAACACTC |

TABLE 8-continued

| SEQ ID | Origin | Unigene | Locus | GI | Nominal Description | Strand | Probe Sequence |
|---|---|---|---|---|---|---|---|
| | | | | | clone = IMAGE: 4745649/ clone_end = 5' | | AGGAAATATAGTTGGCTAAAACTG |
| 6012 | Table 3A | Hs.140720 | AW629485 | 7376275 | FRAT2 mRNA, complete cds/ cds = (129, 830) | −1 | CACTTCGCAACGGAGTGTTTGAAATT GTGGTGGTCCTGATTTATAGGATT |
| 6013 | db mining | Hs.175437 | AW771958 | 7704007 | hn88h09.x1 cDNA, 3' end/clone = IMAGE: 3032897/clone_end = 3' | −1 | GCTTTGGCAGATGGATTAACCTTGTT CTTTTGGAGCCAGATCAATATCTA |
| 6014 | Table 3A | Hs.151393 | AW778854 | 7793457 | glutamate-cysteine ligase catalytic subunit (GCLC), mRNA/cds = (92, 2005) | −1 | AGAATGCCTGGTTTTCGTTTGCAATT TGCTTGTGTAAATCAGGTTGTAAA |
| 6015 | Table 3A | Hs.109441 | AW780057 | 7794660 | cDNA FLJ14235 fis, clone NT2RP4000167/cds = (62, 2172) | −1 | TTCTGAACATTTTAGTCAAGCTACAAC AGGTTTGGAAAACCTCTGTGGGG |
| 6016 | Table 3A | Hs.343475 | AW873028 | 8007081 | 601556208T1 cDNA, 3' end/ clone = IMAGE: 3826392/ clone_end = 3' | −1 | TGCAAGTGGATGGTTTGGTATCACTG TAAATAAAAAGAGGGCCTGGGAAA |
| 6017 | Table 3A | Hs.166338 | AW873324 | 8007377 | hl92e07.x1 cDNA, 3' end/clone = IMAGE: 3009396/clone_end = 3' | −1 | GTGGCTTTTCTGTTGACGCCAAAGGT TACTCCCTCTGCCTCACCATAAAA |
| 6018 | Table 3A | Hs.90960 | AW873326 | 8007379 | 602563938F1 cDNA, 5' end/ clone = IMAGE: 4688769/ clone_end = 5' | −1 | ACCTCCTACGTCTGTTTTCTGGCTGT GGTGACTTGGGATTTTTAACCTTA |
| 6019 | Table 3A | Hs.120243 | BE044364 | 8361417 | gamma-parvin (PARVG), mRNA/ cds = (0, 995) | −1 | ATCGTTGGATTATCTTTGAACCCCCT TGTGTGGATCATTTTGAGCCGCCT |
| 6020 | db mining | Hs.157489 | BE047166 | 8364219 | 602462536F1 cDNA, 5' end/ clone = IMAGE: 4575393/ clone_end = 5' | −1 | AGCTCCAAAGTGGTTTGATGACCACA GGCTAAAATTCATAGTCTTAAAAT |
| 6021 | Table 3A | Hs.82316 | BE049439 | 8366494 | interferon-induced, hepatitis C-associated microtubular aggregate protein (44kD) (MTAP44), mRNA/cds = (0, 1334) | −1 | TCAGAAAGGAGAAAACACAGAC CAAAGAGAAGTATCTAAGACCAAA GGGA |
| 6022 | Table 3A | Hs.121587 | BE217848 | 8905166 | 602637362F1 cDNA, 5' end/ clone = IMAGE: 4765191/ clone_end = 5' | −1 | GCATCACGATTTGTCTACATAAGTCC AGTTCATCTCGCGTTTGTTTTGGC |
| 6023 | Table 3A | Hs.5734 | BE218938 | 8906256 | meningloma expressed antigen 5 (hyaluronidase) (MGEA5), mRNA/ cds = (395, 3145) | −1 | ATACAGGGTTCCATCCAGAAAGCATT CAGTCAGAGCAAGTTAAAGTCAGT |
| 6024 | Table 3A | Hs.203772 | BE220869 | 8908187 | FSHD region gene 1 (RFG1), mRNA/cds = (191, 967) | −1 | AAGTGCCAGATTTTGATAATCACCAG CCTCTCATTCAACTCCTATGTTGC |
| 6025 | Table 3A | Hs.73931 | BE220959 | 8908277 | major histocompatibility complex, class II, DQ beta 1 (HLA-DQB1), mRNA/cds = (57, 842) | −1 | ACCCTTGGTCACTGGTGTTTCAAACA TTCTGGCAAGTCACATCAATCAAG |
| 6026 | Table 3A | Hs.128675 | BE222032 | 8909271 | hr61g11.x1 cDNA, 3' end/clone = IMAGE: 3133028/clone_end = 3' | −1 | AGCTCTGGAGCCTTTGCTTCCTCAAA TACGAGCGGGAACTGCGTTGAGCG |
| 6027 | Table 3A | Hs.167988 | BE222301 | 8909619 | neural cell adhesion molecule 1 (NCAM1), mRNA/cds = (201, 2747) | −1 | AAGTTGTCCTGTGCTAAAGCAAGCGT GGGATGATCCTACCTACCTCTAGG |
| 6028 | Table 3A | Hs.79914 | BE222392 | 8909710 | lumican (LUM), mRNA/cds = (84, 1100) | −1 | ATTTGGACAGATGCAGAAGGAACTGT TAGTGAGTCAAGACAAACACATCT |
| 6029 | Table 3A | Hs.99237 | BE326857 | 9200633 | hr65h06.x1 cDNA, 3' end/clone = IMAGE: 3133403/clone_end = 3' | −1 | CCCCTACCCCTGGAAAGTAATATACT GAAGTCTCATCATACTGTTTTGGG |
| 6030 | Table 3A | Hs.83623 | BE328818 | 9202594 | nuclear receptor subfamily 1, group I, member 3 (NR1I3), mRNA/cds = (272, 1318) | −1 | TGTTTCGTAAATTAAATAGGTCTGGC CCAGAAGACCCACTCAATTGCCTT |
| 6031 | Table 3A | Hs.27774 | BE348809 | 9260662 | 602386841F1 cDNA, 5' end/ clone = IMAGE: 4515730/ clone_end = 5' | −1 | AGCTAGTGATGTTTTGTCCAAAGGAA GATTCTGACAACAGCTTCAGCAGA |
| 6032 | Table 3A | NA | BE348955 | 9260808 | hs91h01.x1 NCI_CGAP_Kid13 cDNA clone IMAGE: 3144625 3', mRNA sequence | −1 | ACACAGACATATTGACCGCACACAAC ACTGAAATGGACTGACTTGAGAAA |
| 6033 | Table 3A | Hs.56156 | BE349148 | 9261067 | 601463367F1 cDNA, 5' end/ clone = IMAGE: 3866512/ clone_end = 5' | −1 | TGGTTCTCTGATTTGTAATGAGCACC TGGATATGTCAATTAAAATGCCCA |
| 6034 | Table 3A | Hs.315050 | BE351010 | 9262791 | hl22g04.x1 cDNA, 3' end/clone = IMAGE: 3147510/clone_end = 3' | −1 | GGTCCATGTCACCGTGAGTACACCC CTATGATTGGTTTGTTGTCAAGAAG |
| 6035 | Table 3A | Hs.5027 | BE379724 | 9325089 | 601159415T1 cDNA, 3' end/ clone = IMAGE: 3511107/ clone_end = 3' | −1 | TGCTAGTTCAGGTCCTCCAGGCATTG ATTTGTACAGTTAAACTCCGAGTG |
| 6036 | Table 3A | Hs.86437 | BE464239 | 9510014 | 602411368F1 cDNA, 5' end/ clone = IMAGE: 4540096/ clone_end = 5' | −1 | ACAAGCATTTAGATCATAACATGGTA AAGCCTATTACCAGCCAATGTTGT |
| 6037 | Table 3A | Hs.127426 | BE466500 | 9512198 | *Homo sapiens*, Similar to homeo box A9 clone MGC: 19648 IMAGE: 2987818, mRNA, complete cds/cds = (62, 880) | −1 | GGCCTACTGACCAAATTGTTGTGTTG AGATGATATTTAACTTTTTGCCAA |
| 6038 | Table 3A | Hs.21812 | BE467470 | 9513245 | AL562895 cDNA/clone = CS0DC021YO20-(3-prime) | −1 | AAGTTTGTGCAGCACATTCCTGAGTG TACGATATTGACCTGTAGCCCAGC |
| 6039 | Table 3A | Hs.122575 | BE502248 | 9704854 | endotheilial differentiation, lysophosphatidic acid G-protein- | −1 | CGATAGAATTGAAGCAGTCCACGGG GAGGGGATGATACAAGGAGTAAACC |

TABLE 8-continued

| SEQ ID | Origin | Unigene | Locus | GI | Nominal Description | Strand | Probe Sequence |
|---|---|---|---|---|---|---|---|
| | | | | | coupled receptor, 4 (EDG4), mRNA/cds = (6, 1061) | | |
| 6040 | Table 3A | Hs.279522 | BE502919 | 9705327 | hz81b08.x1 cDNA, 3' end/clone = IMAGE: 3214359/clone_end = 3' | −1 | ATAGACTCCAAAGAGGCGTTAAGCACCTGGTTTTCCTTTGGCTCAGAAAA |
| 6041 | Table 3A | Hs.197766 | BE502992 | 9705400 | clone 23932 mRNA sequence/cds = UNKNOWN | −1 | CTCAAACGAAATTGGGCAGGCCATTTGCGTGGTTTCTCTGGATAAGTTCC |
| 6042 | Table 3A | Hs.61426 | BE550944 | 9792636 | 602329933F1 cDNA, 5' end/clone = IMAGE: 4431248/clone_end = 5' | −1 | GCACATGACAGTAAGCGAGGTTTTGGGTAAATATAGATGAGGATGCCTAT |
| 6043 | Table 3A | Hs.201792 | BE551203 | 9792895 | 7b55h12.x1 cDNA, 3' end/clone = IMAGE: 3232199/clone_end = 3' | −1 | TCCCAGAGTAACTGACAGTATCAAATAGCAAGAGAGTTAGGATGAGGACT |
| 6044 | Table 3A | Hs.122655 | BE551867 | 9793559 | hypothetical protein MGC14425 (MGC14425), mRNA/cds = (318, 686) | −1 | ACACAGGAACCGCTTACCCACCAGCTCTGCCCGCGTCTCTACCGCCATAG |
| 6045 | Table 3A | Hs.282091 | BE552131 | 9793823 | hw29b05.x1 cDNA, 3' end/clone = IMAGE: 3184305/clone_end = 3' | −1 | TTCTTCCAAGAGAATAACCCTATTAAAGGCTAAAAATGGAAGCTCCCAGT |
| 6046 | Table 3A | Hs.146381 | BE613237 | 9894834 | RNA binding motif protein, X chromosome (RBMX), mRNA/cds = (11, 1186) | −1 | ACTGACCTAGCAGATGTGTGGAAAAGGAATCAGATCTTGATTCTTCTGGG |
| 6047 | Table 3A | Hs.4310 | BE614297 | 9895894 | eukaryotic translation initiation factor 1A (EIF1A), mRNA/cds = (207, 641) | −1 | ACAACTCAAGTGAAAAGATGTCTCCAGTTTCTGAAGATAACGCACGCTGA |
| 6048 | Table 3A | Hs.198802 | BE621611 | 9892551 | 601493754T1 cDNA, 3' end/clone = IMAGE: 3895836/clone_end = 3' | −1 | CGCCGACTCGTTGAAAGTTTTGTTGTGTAGTTGGTTTTCGTTGAGTTCTT |
| 6049 | Table 3A | Hs.324481 | BE646433 | 9970744 | EEST 380617 cDNA | −1 | CACCCACCTGGTAGGAAGGTCAATCTTATGCTCAGAAGTCCCACCCACCA |
| 6050 | db mining | Hs.283165 | BE646441 | 9970752 | 7e86h06.x1 cDNA, 3' end/clone = IMAGE: 3292091/clone_end = 3' | −1 | CAACTCCTTAAAGGGTTGAAGGTTGTGACAATAACTGAGGGAACTGATGT |
| 6051 | Table 3A | Hs.341573 | BE6466470 | 9970781 | tc38c11.x1 cDNA, 3' end/clone = IMAGE: 2066900/clone_end = 3' | −1 | AAAACACTCCACCTAAAAGCAGGAAAGATGGCAATTCTAAATAGCAGCTA |
| 6052 | db mining | Hs.283166 | BE646492 | 9970803 | 7e87g01.x1 cDNA, 3' end/clone = IMAGE: 3292178/clone_end = 3' | −1 | GGAGGTTTTGATCGTGACTTTATTTTGAGATATTGTATCTTTGTTAGTATTGC |
| 6053 | Table 3A | Hs.187872 | BE646499 | 9970810 | 7e87h02.x1 cDNA, 3' end/clone = IMAGE: 3292179/clone_end = 3' | −1 | TTGTAAGGTTCCGGGGAACTGACTCAACATGGTTCTCCAACTCGAGGTTG |
| 6054 | db mining | Hs.283167 | BE646510 | 9970821 | 7e88b08.x1 cDNA, 3' end/clone = IMAGE: 3292215/clone_end = 3' | −1 | TGTGAGTGTTATAGGTTACAGTGGATTCCAAACTAGCCACAAGTGAAGCA |
| 6055 | db mining | Hs.283168 | BE646569 | 9970880 | 7e89c01.x1 cDNA, 3' end/clone = IMAGE: 3292320/clone_end = 3' | −1 | TCAGCCAGGAGGAAAAGCACTCTGATTATGAATTGAGCAGAAGGAAACAA |
| 6056 | db mining | Hs.283169 | BE646617 | 9970928 | 7e91b07.x1 cDNA, 3' end/clone = IMAGE: 3292501/clone_end = 3' | −1 | GTTCCCACTCGTTCTTGCCGGAGAAACCTGCCTTTTCAAGCATAATTCAA |
| 6057 | db mining | Hs.225200 | BE46840 | 9970951 | 7e91f08.x1 cDNA, 3' end/clone = IMAGE: 3292551/clone_end = 3' | −1 | GGGTCCAAGATTATTGATTAATTTGGGCACCGCGAGAGCTCGAGTCCCCC |
| 6058 | Table 3A | Hs.129192 | BE670584 | 10031125 | 7e36h08.x1 cDNA, 3' end/clone = IMAGE: 3284607/clone_end = 3' | −1 | GACCACCTGTAAAGCAAGTCCTTTCAAGTTTCACTGCACATCCCAAACCA |
| 6059 | Table 3A | Hs.75703 | BE670804 | 10031345 | small inducible cytokine A4 (homologous to mouse Mip-1b) (SCYA4), mRNA/cds = (108, 386) | −1 | TGGTCCACTGTCACTGTTTCTCTGCTGTTGCAAATACATGGATAACACAT |
| 6060 | Table 3A | Hs.195374 | BE671815 | 10032445 | 7a47c12.x1 cDNA, 3' end/clone = IMAGE: 3221878/clone_end = 3' | −1 | AGACTCTGGAAAAGGAGGGTCGGAGTATTAAACTGGCTGGGAATGAGAGG |
| 6061 | Table 3A | NA | BE672733 | 10033274 | 7b75g07.x1 NCI_CGAP_Lu24 cDNA clone IMAGE: 3234108 3' similar to TR: O99231 O99231 CYTOCHROME OXIDASE | −1 | TGAGAGCACACCATAAATTCACAGCAGGAATAAACGAAGACACACGAGCA |
| 6062 | Table 3A | Hs.77542 | BE673364 | 10033905 | 602629438F1 cDNA, 5' end/clone = IMAGE: 4754432/clone_end = 5' | −1 | ACATTCTCTCATTTTGCTGAAGCTGATTTGATTGGGTGTCTGTTTCTCGC |
| 6063 | Table 3A | Hs.66357 | BE673759 | 10034300 | 7d69d02.x1 cDNA, 3' end/clone = IMAGE: 3278211/clone_end = 3' | −1 | TGAGAAGGTAAAGTAGAAAGGGAAGATGATGAGTGAACAATAAGCCTTGT |
| 6064 | db mining | Hs.283248 | BE674662 | 10035284 | 7e93g03.x1 cDNA, 3' end/clone = IMAGE: 3292758/clone_end = 3' | −1 | ACATTATTCCATGGGAATAAGTCATCAGTGCAAAGGACTGTAAGGAGTGC |
| 6065 | Table 3A | Hs.88845 | BE674685 | 10035307 | AV733781 cDNA, 5' end/clone = cdAASF08/clone_end = 5' | −1 | CGCCGCTCCTGGAGACCTGATAACTTAGGCTTGAAATAATTGACTTGTCT |
| 6066 | Table 3A | Hs.171120 | BE674709 | 10035331 | 7e94l05.x1 cDNA, 3' end/clone = IMAGE: 3292833/clone_end = 3' | −1 | TGTATGTGCAATATGCTTATGGGTAATTATGGGCAAGAGAAATGGAAACA |
| 6067 | db mining | Hs.283249 | BE674713 | 10035335 | 7e94g02.x1 cDNA, 3' end/clone = IMAGE: 3292850/clone_end = 3' | −1 | ACCCCTTGGTAAAGCAGTTGTAAGAATTAAACAAGAGGAATTGCTCTTTC |
| 6068 | Table 3A | Hs.167208 | BE674762 | 10035230 | 7e98d05.x1 cDNA, 3' end/clone = IMAGE: 3293193/clone_end = 3' | −1 | AAATCAGGCCCCTTGCGCCATTCACAAAAATCCTTGTGAGATGACTCAAG |
| 6069 | db mining | Hs.283247 | BE674807 | 10035275 | 7e93d11.x1 cDNA, 3' end/clone = IMAGE: 3292725/clone_end = 3' | −1 | AGGGCAGGGTCCTTTGGGAGGGTAAGCTCACAAAAACTCAGGGAGGCAG |
| 6070 | Table 3A | Hs.174010 | BE674902 | 10035443 | 7e97a04.x1 cDNA, 3' end/clone = IMAGE: 3293070/clone_end = 3' | −1 | TCATCTCCGCCAAGGTTCCCACTAGGCAGGAAAGGATTTTATCTAAAGT |
| 6071 | Table 3A | Hs.174144 | BE674951 | 10035492 | 7e97g10.x1 cDNA, 3' end/clone = IMAGE: 3293154/clone_end = 3' | −1 | CCACCCAAGTCGGAATCCGAGTGAAATAAATAGCATCGCCCGCCAACTAC |

TABLE 8-continued

| SEQ ID | Origin | Unigene | Locus | GI | Nominal Description | Strand | Probe Sequence |
|---|---|---|---|---|---|---|---|
| 6072 | Table 3A | Hs.190065 | BE874984 | 10035505 | 7f11b09.x1 cDNA, 3' end/clone = IMAGE: 3294329/clone_end = 3' | −1 | AGGCACACGATTGTCACCATTTCTCC CTTTACAAGCTGTATAATCAGTAA |
| 6073 | Table 3A | Hs.211826 | BE875092 | 10035633 | 7f02d07.x1 cDNA, 3' end/clone = IMAGE: 3293485/clone_end = 3' | −1 | GCAACGTCTGAATGTAGTAATGTGAC TCAGAGCTTCAAAGTAAGCATTCG |
| 6074 | db mining | Hs.330706 | BE675125 | 10035668 | IL3-UT0114-301100-357-H02 cDNA | −1 | GCCACCCCATCTGGGAGGCCCAGCA TCCAATTCAGTCGCCTTCAATGATT |
| 6075 | db mining | Hs.283251 | BE875180 | 10035721 | 7f03h06.x1 cDNA, 3' end/clone = IMAGE: 3293827/clone_end = 3' | −1 | TGATAGACTGGATGCTGCTATGGTAA TCTGCCTCAGGAAAATGCCGGACT |
| 6076 | db mining | Hs.339281 | BE675338 | 10035879 | HNC29-1-D4.R cDNA | −1 | TGGAGCCAAGAAGCCACTGACTCAA GAGGATTTCAAGCGAGAGCTGCTTG |
| 6077 | db mining | Hs.283253 | BE675379 | 10035920 | 7f08b02.x1 cDNA, 3' end/clone = IMAGE: 3294027/clone_end = 3' | −1 | CAACTTTTGTAACAGGGGACTTAGCC GGGGGCAGGAGGGGTTCTTGAGAC |
| 6078 | db mining | Hs.283254 | BE675403 | 10035944 | 7f08d10.x1 cDNA, 3' end/clone = IMAGE: 3294067/clone_end = 3' | −1 | ACTTGAAGGCACATCTTCCTTTTGGT TGTTTTCCATCTTCAAATTAAACT |
| 6079 | db mining | Hs.283255 | BE675434 | 10035975 | 7f09a10.x1 cDNA, 3' end/clone = IMAGE: 3294138/clone_end = 3' | −1 | TAAAAACTGACATGACATGAGATGGT TTAAGTGTCAAACATAAGGGTCTTT |
| 6080 | db mining | Hs.283256 | BE675531 | 10036072 | 7f10h08.x1 cDNA, 3' end/clone = IMAGE: 3294303/clone_end = 3' | −1 | ACTGACATAAGCCCACTTCAGGTGTT TGGAAGACACTAAAGAGAATCAGA |
| 6081 | db mining | Hs.315345 | BE675610 | 10038151 | 7f12g09.x1 cDNA, 3' end/clone = IMAGE: 3294496/clone_end = 3' | −1 | GCAGCTTTTTGCTGGCGGGGTCTA AATAAAGTAGCTTCCCCAAAAGAAA |
| 6082 | db mining | Hs.180637 | BE875718 | 10036259 | 7f14h04.x1 cDNA, 3' end/clone = IMAGE: 3294679/clone_end = 3' | −1 | ACCTGGTTATCTCGCAATGACCTAGC TAACACAAATGCAACATCAGCCGG |
| 6083 | db mining | Hs.283258 | BE675792 | 10036333 | 7f18b02.x1 cDNA, 3' end/clone = IMAGE: 3294795/clone_end = 3' | −1 | TGATCAAAATGAAGATGCTCCAACCG TATAAATGGCAGATGAAATAGACT |
| 6084 | db mining | Hs.283259 | BE675819 | 10036360 | 7f17d10.x1 cDNA, 3' end/clone = IMAGE: 3294931/clone_end = 3' | −1 | GCAGGAGAGAAATACCTTCTAATGGG TGTGGACACTGGAGGAACTGTTAC |
| 6085 | db mining | Hs.283261 | BE675957 | 10036498 | 7f19b06.x1 cDNA, 3' end/clone = IMAGE: 3295091/clone_end = 3' | −1 | AGGGCACTGTTTGTTCCTTTAATATG GAGAAATATCGCAAATAACTGGGA |
| 6086 | db mining | NA | BE676019 | 10036560 | 7f20c12.x1 NCI_CGAP_CLL1 cDNA clone IMAGE: 3295222 3' similar to contains Alu repetitive element; m | −1 | TTGGCCTATGTTAATTTCTATTCTCAG TTCTTCTGTGCCCTTCCTCCTCT |
| 6087 | Table 3A | Hs.170584 | BE676049 | 10036590 | 7f21a03.x1 cDNA, 3' end/clone = IMAGE: 3295276/clone_end = 3' | −1 | GAACGTAAGCCCGACGCTAGGCAGT GCTGTTAGAAAGTGATTTGGAAGAG |
| 6088 | Table 3A | Hs.181015 | BE676054 | 1003695 | signal transducer and activator of transcription 6, interleukin-4 induced (STAT6), mRNA/cds = (165, 2708) | −1 | ATCCCATTCTCCCTCTCAAGGCAGGG GTCATAGATCCTAAGCCATAAAAT |
| 6089 | db mining | Hs.283263 | BE676154 | 10036695 | 7f24a12.x1 cDNA, 3' end/clone = IMAGE: 3295582/clone_end = 3' | −1 | TGCTGTAAAATGGCAGCTCCATAGGA ACCTATTTTCCATAGGAACCTGCA |
| 6090 | db mining | Hs.283264 | BE676173 | 10036714 | 7f24c12.x1 cDNA, 3' end/clone = IMAGE: 3295606/clone_end = 3' | −1 | ACTGGAGAAAGGTGTCTTCCTGTCCT TTCAGGGGCTCCTGCGGGGAATTC |
| 6091 | Table 3A | Hs.134648 | BE676210 | 10036751 | 7f25c05.x1 cDNA, 3' end/clone = IMAGE: 3295688/clone_end = 3' | −1 | ATTATATTTGTCCCTATCAGAATCCTC GAATCCCTAGCAGCCAGTCCCTG |
| 6092 | db mining | Hs.283266 | BE676275 | 10036816 | 7f26d04.x1 cDNA, 3' end/clone = IMAGE: 3295783/clone_end = 3' | −1 | TGCTCACTGTCTTCTGGAAGAGACAA GCACTTTCTTGAAATTCCTAAGCA |
| 6093 | Table 3A | Hs.158714 | BE676408 | 10036949 | 7f29b11.x1 cDNA, 3' end/clone = IMAGE: 3296061/clone_end = 3' | −1 | CAATCGGATCATTCTTCTCAACTTGG GCGGCTCTTTCCTCCCTTCCTTCC |
| 6094 | Table 3A | Hs.220929 | BE676472 | 10037003 | cDNA FLJ14369 firs, clone HEMBA 1001174, highly similar to ADP-RIBOSYLATION FACTOR-LIKE PROTEIN 5/cds = (207, 746) | −1 | TGCTTTGGGCAGTAGCTGAAGCCGA AGTATGAACAGTCCATTTTGTTTCT |
| 6095 | db mining | Hs.283268 | BE676474 | 10037005 | 7f30c08.x1 cDNA, 3' end/clone = IMAGE: 3296174/clone_end = 3' | −1 | CACAGTTGAGTAGGAGGTCATGAAGA AGAAGAGATGATACCTGCCTTACC |
| 6096 | db mining | Hs.283269 | BE676528 | 10037069 | 7f31d12.x1 cDNA, 3' end/clone = IMAGE: 3296279/clone_end = 3' | −1 | TTTGTGTAGCAAATGTTCATTAATTGC CTACTTTGTGCCAAATTCAGGCC |
| 6097 | Table 3A | Hs.123254 | BE676541 | 10037082 | AL572805 cDNA/clone = CS0DI034YHI06-(3-prime) | −1 | TCCAGCATTGTATTGTCTATTGACAC ACAAAGTTTGAAAATAAAGGGGCA |
| 6098 | db mining | Hs.283505 | BE676548 | 10037089 | wh79f01.x1 cDNA, 3' end/clone = IMAGE: 2386969/clone_end = 3' | −1 | CACCCACCAGACCGAGGATTCCAAAA GGGGGCGAAGGCGGAGAGCAAAGG |
| 6099 | db mining | Hs.283270 | BE676813 | 10037154 | 7f33a08.x1 cDNA, 3' end/clone = IMAGE: 3296438/clone_end = 3' | −1 | TGGACTCTGTTTTCAAGAGGAAGAAA CAACTGACAAATAAGTTGATGTCA |
| 6100 | db mining | Hs.283271 | BE676614 | 10037155 | 7f33a10.x1 cDNA, 3' end/clone = IMAGE: 3298442/clone_end = 3' | −1 | ATGTTGAAACTGGTTTTAACTTGTAAT GGTGTGGCTGATGTTACCCGACC |
| 6101 | db mining | Hs.283272 | BE676667 | 10037208 | 7f34a07.x1 cDNA, 3' end/clone = IMAGE: 3296532/clone_end = 3' | −1 | ACACAGATTTGAAGTCTACTGTTCTA AATGGCCTCTACTTCCTGCTGTCA |
| 6102 | db mining | Hs.102165 | BE676737 | 10037278 | 7f37g03.x1 cDNA, 3' end/clone = IMAGE: 3296884/clone_end = 3' | −1 | GGAACTTCTGCTTCCACTTACGATGA AGGAACTTGTACTCAATCCATCCA |
| 6103 | db mining | Hs.283276 | BE676772 | 10037313 | 7f35d05.x1 cDNA, 3' end/clone = IMAGE: 3298849/clone_end = 3' | −1 | GAAGCCTTCCTGTGGTCATAACAAGT CTCACACACCCCAAGGACTGATCT |
| 6104 | db mining | Hs.86761 | BE738569 | 10152561 | 601572850F1 cDNA, 5' end/ clone = IMAGE: 3839581/ clone_end = 5' | −1 | GAGTCCAGCCTTTGAACCTGGCGCT GAATCCTGACTTTACTGCTTATTCA |
| 6105 | Table 3A | Hs.293842 | BE748883 | 10162655 | 601571679F1 cDNA, 5' end/ clone = IMAGE: 3838675/ | −1 | AAACTCATACATGCAGAAAATTTG TCTTTGCTCGAAATGGTAATGCC |

TABLE 8-continued

| SEQ ID | Origin | Unigene | Locus | GI | Nominal Description | Strand | Probe Sequence |
|---|---|---|---|---|---|---|---|
| 6106 | Table 3A | Hs.293842 | BE748663 | 10162655 | 601571879F1 cDNA, 5' end/ clone = IMAGE: 3838875/ clone_end = 3' | −1 | AAAA AAACTCATACATGCAGAAAATTGTCTT TGCTCGAAATGGTAATGCCAAAA |
| 6107 | Table 3A | Hs.270293 | BE857296 | 10371182 | 7g27b01.x1 cDNA, 3' end/clone = IMAGE: 3307657/clone_end = 3' | −1 | ACAAAAGTCATGGCTGTGAGGCTATC ATTACCCTTTTACCAAAGTTGGAA |
| 6108 | Table 3A | Hs.155935 | BE858152 | 10373065 | complement component 3a receptor 1 (C3AR1), mRNA/cds = (0, 1448) | −1 | AGTTCTATTTCTATCCCAAACTAAGCT ATGTGAAATAAGAGAAGCTACTTTGT |
| 6109 | Table 3A | Hs.294348 | BE961923 | 11764299 | 601655335R1 cDNA, 3' end/ clone = IMAGE: 3845768/ clone_end = 3' | −1 | ATCCCGATGGTGCCCACCGCTATTAA AGGTTCGTTGTTCCACGATTAAA |
| 6110 | Table 3A | Hs.5181 | BE962588 | 11765836 | proliferation-associated 2G4, 38kD (PA2G4), mRNA/cds = (97, 1281) | −1 | ATGTCTCCATACCCATTACAATCTCC AGCATTCCCCCTCAAACCTAAAAA |
| 6111 | Table 3A | Hs.314941 | BE962883 | 11766238 | 602381893F1 cDNA, 5' end/ clone = IMAGE: 4499447/ clone_end = 5' | −1 | GCCCGTATTTACCCTATAGCACCCCC TCTACCCCCTTTAGAGCCCAAAA |
| 6112 | Table 3A | Hs.301110 | BE963194 | 11766612 | 601656811R1 cDNA, 3' end/ clone = IMAGE: 3865731/ clone_end = 3' | −1 | ACATTTTCCTCCGCATAAGCCTGCGT CAGATTAAAACACTGAACTGACAA |
| 6113 | Table 3A | Hs.330887 | BE963374 | 11788792 | 601857137R1 cDNA, 3' end/ clone = IMAGE: 3866193/ clone_end = 3' | −1 | CCAAGCTGGTTTCAAGCCAACCCCAT GGCCTCCATGACTTTTTCCAAAAC |
| 6114 | Table 3A | Hs.334926 | BE963551 | 11755970 | Homo sapiens, clone MCG: 8857 IMAGE: 3868266, mRNA, complete cds/cds = (62, 133) | −1 | TGATCAGGTGAACCGGAAGTCTCCAA TTTCTGAATGGATTATGTTTCTAA |
| 6115 | Table 3A | Hs.316047 | BE963666 | 11767085 | 601656685R1 cDNA, 3' end/ clone = IMAGE: 3865820/ clone_end = 3' | −1 | TGAGTACGTGACACTTGTTGTAGAAT AGTGGTGTTGAGCTATATTCTTGT |
| 6116 | Table 3A | Hs.294578 | BE963811 | 11767228 | 601657482R1 cDNA, 3' end/ clone = IMAGE: 3875846/ clone_end = 3' | −1 | GTGACCCTTGGCACCCGCTAGAAGTT TATGGCCGAGCTTTACCAATTAAA |
| 6117 | Table 3A | Hs.302585 | BE964028 | 11767358 | 601657601R1 cDNA, 3' end/ clone = IMAGE: 3875617/ clone_end = 3' | −1 | TGAACTCCAACTTTGACCAACCCATG AGACCCTGTTATCCAAACTTTCT |
| 6118 | db mining | Hs.210628 | BE964051 | 11767519 | 601472729T1 cDNA, 3' end/ clone = IMAGE: 3875791/ clone_end = 3' | −1 | CCCTCTACTATTTGGCTCCATAACTTA GGACCTGCCTTTCCCGGTTCCAG |
| 6119 | Table 3A | Hs.330588 | BE964134 | 11767602 | 601151626F1 cDNA, 5' end/ clone = IMAGE: 3507774/ clone_end = 5' | −1 | CCCGTATTTACCCTATAGCACCCCCT CTACCCCCTTTAGAGCCCCAAAA |
| 6120 | Table 3A | Hs.252259 | BE964149 | 11767617 | ribosomal protein S3 (RPS3), mRNA/cds = (22, 753) | −1 | CCAACTTTCAGAACAGAAGGGTGGG AAACCAGAACCGCCTGCCATGCCCC |
| 6121 | Table 3A | Hs.184052 | BE964596 | 11768078 | PP1201 protein (PP1201), mRNA/ cds = (75, 1010) | −1 | GCGCCAGAAATCCAATCCAGCCCAA GGATATAGTTAGGATTAATTACTTA |
| 6122 | Table 3A | Hs.288754 | BE965319 | 11769559 | 601859229R1 cDNA, 3' end/ clone = IMAGE: 3895783/ clone_end = 3' | −1 | CTGAGTTTTGGGTTTTCCACACGGG CCAAGATACCCGGCCTCTGCTGAG |
| 6123 | Table 3A | Hs.297190 | BE965554 | 11770044 | 601659486R1 cDNA, 3' end/ clone = IMAGE: 3896204/ clone_end = 3' | −1 | ATATCATTTCCACTTAGTATTATACCC ACACCCACCCAAGAACAGGGTTT |
| 6124 | Table 3A | Hs.108327 | BF001438 | 10701713 | damage-specific DNA binding protein 1 (127kD) (DDB1), mRNA/cds = (109, 3531) | −1 | ACAGCATGAGAAACTGTTAGTACGCA TACCTCAGTTCAAACCTTTAGGGA |
| 6125 | Table 3A | Hs.161075 | BF001821 | 10702098 | 7g93g02.x1 cDNA, 3' end/clone = IMAGE: 3314068/clone_end = 3' | −1 | GCTTGCCCTAGCAGAGTCATACGAA TAATGGAAAACTCAACTTGTGTTC |
| 6126 | Table 3A | NA | BF056055 | 10809951 | 7k07h12.x1 NCI_CGAP_GC6 cDNA clone IMAGE: 3443950 3' similar to contains element L1 repetitive eleme | −1 | CACAATGCTGCCTCCTCTGTGGATGA CTGATGGCAAGAGTCTGAATTGAA |
| 6127 | Table 3A | Hs.221695 | BF058398 | 10812294 | 7k30d01.x1 cDNA, 3' end/clone = IMAGE: 3476785/clone_end = 3' | −1 | CCTCTCACTCTCAGACTCCAAGGGCC AAGAAAAACTACGGACAGGAAGCC |
| 6128 | db mining | Hs.255664 | BF058429 | 10812325 | 7k30g11.x1 cDNA, 3' end/clone = IMAGE: 3476949/clone_end = 3' | −1 | GAGAGGAGGGGTCTCAGACGTTGGG GGACACACTGCTGGGTGGGTGATTT |
| 6129 | Table 3A | Hs.43857 | BF058599 | 10812495 | mRNA for KIAA1247 protein, partial cds/cds = (285, 2942) | −1 | TAAGAAATCCCAATTTTCAGGAGTGG TGGTGTCAATAAACGCTCTGTGCC |
| 6130 | Table 3A | Hs.144583 | BF059133 | 108113029 | Homo sapiens, clone IMAGE: 3462401, mRNA, partial cds/cds = (0, 153) | −1 | CGGCAGGGTGGCCTGTAACAATTTCA GTTTTCGCAGAACATTCAGGTATT |
| 6131 | db mining | Hs.257697 | BF060727 | 10819637 | AL533532 cDNA/clone = CS0DN004YJ14-(5-prime) | −1 | GGGGCTCCCTTCCCGGCTTTGTTTTC TCTGGGAGATTTTATTTTACCTAA |
| 6132 | Table 3A | Hs.193237 | BF062295 | 10821193 | 7k76b11.x1 cDNA, 3' end/clone = IMAGE: 3481293/clone_end = 3' | −1 | GAAAGTGGAGGGAGTGGACGGGGAG GAGACTAGCCAGAGAGGCTCATTAG |
| 6133 | Table 3A | Hs.174215 | BF062628 | 10821538 | 7h62h05.x1 cDNA, 3' end/clone = IMAGE: 3320601/clone_end = 3' | −1 | CTTCTCCCCTCTTGCCCTCTGTGGTC TGTTTAAAACGAAAAGGTCGGAT |

TABLE 8-continued

| SEQ ID | Origin | Unigene | Locus | GI | Nominal Description | Strand | Probe Sequence |
|---|---|---|---|---|---|---|---|
| 6134 | db mining | Hs.159013 | BF063875 | 10822585 | hh82b10.x1 cDNA, 3' end/clone = IMAGE: 2969275/clone_end = 3' | −1 | GGACTTCTGAAATAGAGCTGGCTCCC TGGGGGTGACAATGTATATATGCAA |
| 6135 | Table 3A | Hs.125887 | BF109873 | 10939563 | hypothetical protein FLJ14464 (FLJ14484), mRNA/cds = (69, 3146) | −1 | CTGGGTGTCGTGGAAGATGACGAAG ATGCTGGGCTGGCAGATGCAGTCCA |
| 6136 | Table 3A | Hs.288443 | BF110312 | 10940002 | 7n38d08.x1 cDNA, 3' end/clone = IMAGE: 3566854/clone_end = 3' | −1 | ACCAGGGCTTAAAACCTCAATTTATG TTCATGACAGTGGGGATTTTCTT |
| 6137 | Table 3A | Hs.250905 | BF116224 | 10985700 | hypothetical protein (LOC51234), mRNA/cds = (0, 551) | −1 | ATTCTCCAACCACAAACAGCACTTCT AAACTAACTTTACTTTCTGCCCA |
| 6138 | Table 3A | Hs.318215 | BF183507 | 11061818 | 60180999R1 cDNA, 3' end/clone = IMAGE: 4040470/clone_end = 3' | −1 | GATATAGTCTCCATACCCCATTACCA TCTCCCAGCCATTCCCCCTCCAAC |
| 6139 | Table 3A | Hs.96568 | BF194880 | 11081165 | 602137338F1 cDNA, 5' end/ clone = IMAGE: 4274048/ clone_end = 5' | −1 | TGATACTTTGGTTCTCTTCCTGCTCA GGTCCCTTCATTTGTACTTTGGA |
| 6140 | Table 3A | Hs.232257 | BF195579 | 11082611 | RST2302 cDNA | −1 | TAATACTGGAGGGGCTTGAAGAAGG CTGTCGTGTTTTGTCACCTGCTTTG |
| 6141 | Table 3A | Hs.3353 | BF197153 | 11085769 | beta-1,3-glucuronyltransferase 1 (glucuronosyltransferase P) (B3GAT1), mRNA/cds = (175, 1179) | −1 | GTCTTTCCCGTCTTTCTTCCTCACCTA TGTAATTTCAGTAGTCTCTCAGC |
| 6142 | Table 3A | NA | BF197762 | 11087169 | 7p91f02.x1 NCI_CGAP_Skn1 cDNA clone IMAGE: 3653139 3', mRNA sequence | −1 | AGGAAGAGCCTGCACCTGTGGTGGA ACAATCAGGGAAAAGGAAGTCAAAA |
| 6143 | Table 3A | Hs.50785 | BF221780 | 11128957 | SEC22, vesicle trafficking protein (S. cerevisiae)-like 1 (SEC22L1), mRNA/cds = (119, 766) | −1 | TTGGAGCTTCTATAGGAGTGGAGAG GGGCAGCTCATTGTTGAGAGTTGC |
| 6144 | Table 3A | Hs.250811 | BF432643 | 11444806 | v-ral simian leukemia viral oncogene homolog B (ras related; GTP binding protein) (RALB), mRNA/cds = (170, 790) | −1 | TGATCTGACTGGAAAACAATCCTGTA TCCCCTCCCAAAGAATCATGGGCT |
| 6145 | Table 3A | Hs.296356 | BF433058 | 11445221 | mRNA; cDNA DKFZp434M162 (from clone DKFZp434M162)/ cds = UNKNOWN | −1 | TCATCCCTTAAACACTCTGTGATGGG ATCTTCAGGATCATCTTTTGAAGT |
| 6146 | Table 3A | Hs.76611 | BF433353 | 11445518 | 601435773F1 cDNA, 5' end/ clone = IMAGE: 3920582/ clone_end = 5' | −1 | TGCGTTTGGTTTAGGAATGTGCTTTT GTACTTCCACTTGAATAAAGGTGT |
| 6147 | Table 3A | Hs.178703 | BF433657 | 11445848 | AV716627 cDNA, 5' end/clone = DCBBCH05/clone_end = 5' | −1 | TGCTCAGGGCACATGCACACAGACAT TTATCTCTGCACTCACATTTTGTG |
| 6148 | Table 3A | Hs.222833 | BF435098 | 11447388 | 7p05g01.x1 cDNA, 3' end/clone = IMAGE: 3645097/clone_end = 3' | −1 | GGTTATTGCTGACACGCTGTCCTCTG GCGACCTGTCGCTGGAGAGGTTGG |
| 6149 | Table 3A | Hs.293478 | BF435821 | 11447923 | hypothetical protein FKSG44 (FKSG44), mRNA/cds = (126, 1520) | −1 | CGTTTTCTGAGCATCCGTTGTGCCTT AACATTTTCTGCTTGTCCTTTGGG |
| 6150 | db mining | Hs.257641 | BF436704 | 11448943 | 7p07d12.x1 cDNA, 3' end/clone = IMAGE: 3644999/clone_end = 3' | −1 | CTTCTGAATGCCCGAGTCTTCTCTTT TGTGCTCACAAATGCCACCCAATC |
| 6151 | Table 3A | Hs.160980 | BF437585 | 11449991 | 7p74d12.x1 cDNA, 3' end/clone = IMAGE: 3651526/clone_end = 3' | −1 | TGCTTACAAGGGTGATTGACCTTGCC TTACTCTTTATGTAAATTATGGCA |
| 6152 | db mining | Hs.258513 | BF437915 | 11450432 | AF150421 cDNA/clone = CBNBCG12 | −1 | CTGGCGTATTACCATTTTGATAGCCT CTCTTCAGGCTAGATAAGCTGGGG |
| 6153 | Table 3A | Hs.128594 | BF445163 | 11510224 | nad21d12.x1 cDNA, 3' end/clone = IMAGE: 3368191/clone_end = 3' | −1 | CCCTGTATTATTGAAATGTCAGCATA ATGACTGGAAGGTGAAATTGGTCC |
| 6154 | Table 3A | Hs.174104 | BF445405 | 11510543 | 601438710F1 cDNA, 5' end/ clone = IMAGE: 3923643/ clone_end = 5' | −1 | ACTGCTGTTGCATGAATAGATGATAC AAAGCAAGTGATGAGGTTGGTATG |
| 6155 | Table 3A | Hs.143389 | BF446017 | 11511155 | 7p18a11.x1 cDNA, 3' end/clone = IMAGE: 3646004/clone_end = 3' | −1 | TGGAAGAACAAATTCAGACATCATCA GTAAGTCTTTAGGGACACAGGGAA |
| 6156 | Table 3A | Hs.295726 | BF447885 | 11513023 | integrin, alpha V (vitronactin receptor, alpha polypeptide, antigen CD51) (ITGAV), mRNA/ cds = (41, 3187) | −1 | AGTGAAAACTGGTACAGTGTTCTGCT TGATTTACAACATGTAACTTGTGA |
| 6157 | Table 3A | Hs.179528 | BF475501 | 11548328 | upregulated by 1,25-dihydroxy-vitamin D-3 (VDUP1), mRNA/ cds = (221, 1396) | −1 | GCCAGAAAGTGTGGGCTGAAGATGG TTGGTTTCATGTTTTTGTATTATGT |
| 6158 | Table 3A | Hs.181311 | BF478236 | 11549065 | asparaginyl-tRNA synthetase (NARS), mRNA/cds = (73, 1719) | −1 | TGTCCTCTGAACCTGAGTGAAGAAAT ATACTCTGTCCTTTGTACCTGCGT |
| 6159 | Table 3A | Hs.179703 | BF5077849 | 11591147 | tripartite motif protein 14 (TRIM14), mRNA/cds = (10, 1230) | −1 | CCATTTCCACTACATGCCTTTCCTAC CTTCCCTTCACAACCAATCAAGTG |
| 6160 | Table 3A | Hs.159873 | BF508053 | 11591351 | UI-H-BI4-apx-b-11-0-UI.s1 cDNA, 3' end/clone = IMAGE: 3088845/clone_end = 3' | −1 | ACACTTCCCTGAATGTTGAAGAAGAT ATGCTATCCATGCAATCCTTGTCG |
| 6161 | Table 3A | Hs.158999 | BF508694 | 11591992 | UI-H-BI4-aop-f-09-0-UI.s1 cDNA, 3' end/clone = IMAGE: 3085601/clone_end = 3' | −1 | ACTTGTGTTTGAACCACTTCTGCTTC CTCTTTAACCTGAGATGCACACGT |
| 6162 | Table 3A | Hs.77542 | BF508702 | 11592000 | 602629438F1 cDNA, 5' end/ clone = IMAGE: 4754432/ | −1 | ACATTCTCTCATTTTGCTGAAGCTGAT TTGATTGGGTGTCTGTTTCTCGC |

TABLE 8-continued

| SEQ ID | Origin | Unigene | Locus | GI | Nominal Description | Strand | Probe Sequence |
|---|---|---|---|---|---|---|---|
| 6163 | Table 3A | Hs.127311 | BF508731 | 11592029 | AU185774 cDNA/clone = B02302-013 clone_end = 5' | −1 | TGACAGAATGAACTGGAAATGAAATC CCACAGTTATGATCGTAGTAGAGT |
| 6164 | Table 3A | Hs.144265 | BF509758 | 11593056 | UI-H-BI4-apg-d-04-0-UI.s1 cDNA, 3' end/clone = IMAGE: 3087390/clone_end = 3' | −1 | AAGTACAGATGCCATCCCGGTGCTGT GATCTTCCAGCCATTCTCCATTTC |
| 6165 | Table 3A | Hs.256931 | BF510393 | 11593891 | zb02d05.s1 cDNA, 3' end/ clone = IMAGE: 300873/ clone_end = 3' | −1 | ACTGCCAATCTGATTTAAAATTCTCCA AGCTTAATTCTGTGCAACAAACA |
| 6166 | Table 3A | Hs.276341 | BF510670 | 11593968 | UI-H-BI4-aof-b-08-0-UI.s1 cDNA, 3' end/clone = IMAGE: 3084615/clone_end = 3' | −1 | GCCTGTTGTTCTGTTTATCGCCCTAT TTTACAAAACTGATTCTGACCTGG |
| 6167 | Table 3A | Hs.248689 | BF512500 | 11597602 | UI-H-BI3-alw-h-10-0-UI.s1 cDNA, 3' end/clone = IMAGE: 3069162/clone_end = 3' | −1 | AACTGGCATTGCTAAGCCCCAGAAAA ATGTATTTAGTGGAACAGATGAAA |
| 6168 | Table 3A | Hs.136375 | BF513274 | 11598453 | 602544150F1 cDNA, 5' end/ clone = IMAGE: 4668332/ clone_end = 5' | −1 | ACACTAGGTCCTTTTATACCTGTGCC TTTACGTTCGTTTTCCTGATTGCA |
| 6169 | Table 3A | Hs.300870 | BF513602 | 11598781 | mRNA; cDNA DKFZp547M072 (from clone DKFZp547M072)/ cds = UNKNOWN | −1 | AATACAGATTCATTTTATTTAAGCGTC CGTGGCACCGACAGGGACCCCAG |
| 6170 | Table 3A | Hs.255340 | BF514247 | 11599426 | UI-H-BW1-ani-h-09-0-UI.s1 cDNA, 3' end/clone = IMAGE: 3082601/clone_end = 3' | −1 | AGTTCATCCCCTTTCAGAAGCTGTTT GCTCTTGGCTCATTAAACCTGTGA |
| 6171 | Table 3A | Hs.283022 | BF514341 | 11599520 | triggering receptor expressed on myeloid cells 1 (TREM1), mRNA/ cds = (47, 751) | −1 | GCCTCTTTTCCTGTATCACACAAGGG TCAGGGATGGTGGAGTAAAAGCTC |
| 6172 | Table 3A | Hs.83734 | BF515538 | 11600717 | syntaxin 4A (placental) (STX4A), mRNA/cds = (66, 959) | −1 | TGTTAGGTGGCCTCTGCATACCTATG GGAACTCAGTGATGTAATGCAAAG |
| 6173 | Table 3A | Hs.146065 | BF591040 | 11683364 | AL580165 cDNA/clone = CS0DJ005YB18-(3-prime) | −1 | CTGGGGCCGTAGCAAAAATCATGAAA AACACTTCAACGTGTCCTTTCAAT |
| 6174 | Table 3A | Hs.30941 | BF592138 | 11684462 | calcium channel, voltage-dependent, beta 2 subunit (CACNB2), mRNA/cds = (501, 2318) | −1 | TGCCAAGTCAGCAGATTTGCTTTATG AATTACAGGGACTAGAAATGCCCA |
| 6175 | Table 3A | Hs.695 | BF890338 | 11975746 | cystalin B (stefin B) (CSTB), mRNA/cds = (96, 392) | −1 | TTGCATGTCTCTTCCTAAATTTCATTG TGTTGATTTCTAATCCTTCCCGT |
| 6176 | Table 3A | Hs.142838 | BF732404 | 12057407 | nuclear protein interacting with the FHA domain of pIG-87 (NIFK), mRNA/cds = (54, 935) | −1 | AGAGTGAGAAGGCAGTTCCAGTTTTA GCACAGATTTGTTTATGTGTTCAG |
| 6177 | Table 3A | Hs.296317 | BF938959 | 12356279 | mRNA for KIAA1789 protein, partial cds/cds = (3466, 4899) | −1 | GAAGTGACACTGACTGTATCTACCCTC TCCTTTTTCTTCATCAGGTGTTCCT |
| 6178 | Table 3A | Hs.182937 | BF939014 | 12356334 | peptidylpropyl isomerase A (cyclophilin A) (PPIA), mRNA/ cds = (44, 541) | −1 | TCCCTGGGTGATACCATTCAATGTCT TAATGTACTTGTGGCTCAGACCTG |
| 6179 | Table 3A | Hs.28138 | BF940103 | 12357423 | hypothetical protein MGC14158 (MGC14156), mRNA/cds = (82, 426) | −1 | AATTCCAAAGGAGTGATGTTGGAATA GTCCCTCTAAGGGAGAGAAATGCA |
| 6180 | Table 3A | Hs.133372 | BF940291 | 12357611 | AF150127 cDNA/cds = CBCBGA01 | −1 | AGCCCCTCCACCCCACCCAGTACTTT TACAATGTGTTATTAAAGACCCCT |
| 6181 | Table 3A | Hs.304900 | BF980139 | 12347354 | 602288147F1 cDNA, 5' end/ clone = IMAGE: 4373983/ clone_end = 5' | −1 | CCATCCTTGAGAAAATGTGGGCACCAA GTCCATAATCTCCATAAATCCAAT |
| 6182 | Table 3A | Hs.303214 | BG0546649 | 12511436 | 7045b01.x1 cDNA, 3' end/ clone = IMAGE: 3576912/ clone_end = 5' | −1 | CGTTGCATTTTCACATTTGTGTGGCA GGACAAGCATGGGGCAAGAGGGAC |
| 6183 | Table 3A | Hs.8258 | BG054966 | 12512220 | cDNA FLJ14737 fis, clone NT2RP3002273, weakly similar to SCD8 PROTEIN/cds = (77, 1468) | −1 | TATGAGTTTATGCGTTTTCCCAGCCC TCCGAATCACTGACTGGGGCGTTT |
| 6184 | Table 3A | Hs.179661 | BG056668 | 12521375 | *Homo sapiens*, tubulin, beta 5, clone MGC: 4029 IMAGE: 3817988, mRNA, complete cds/ cds = (1705, 3039) | −1 | TTGAAAAGATGACATCGCCCCAAGAG CCAAAAATAAATGGGAATTGAAAA |
| 6185 | Table 3A | Hs.56205 | BG057282 | 12522612 | insulin induced gene 1 (INSIG1), mRNA/cds = (414, 1247) | −1 | TGCACTCTACCAGATTTGAACATCTA GTGAGGTTCACATTCATACTAAGT |
| 6186 | Table 3A | Hs.3709 | BG057892 | 12523835 | low molecular mass ubiquinone-binding protein (9.5kD) (QP-C), mRNA/cds = (77, 358) | −1 | TGGTGATATCTGCTTAGATTTCCCTG TATCTTTGCTGCCCTCCTTCAAGT |
| 6187 | Table 3A | Hs.5122 | BG058599 | 12525258 | 602293015F1 cDNA, 5' end/ clone = IMAGE: 4387778/ clone_end = 5' | −1 | AGTTGGAGCTATCTGTCAGCAGTTT CTCTACAGTTGTGCATAAATGTTT |
| 6188 | Table 3A | Hs.89104 | BG058739 | 12525527 | 602590917F1 cDNA, 5' end/ clone = IMAGE: 4717348/ clone_end = 5' | −1 | CGTGGGAGGATGACAAAGAAGCATG AGTCACCCTGCTGGATAAACTTAGA |
| 6189 | Table 3A | Hs.166962 | BG149747 | 12661777 | phosphatidylinositol glycan, class F (PIGF), mRNA/cds = (67, | −1 | GTGGTTTGGTCAGCATACACACTTCT CATTTCATTTGATGTACACAGCCA |

TABLE 8-continued

| SEQ ID | Origin | Unigene | Locus | GI | Nominal Description | Strand | Probe Sequence |
|---|---|---|---|---|---|---|---|
| 6190 | Table 3A | Hs.100293 | BG149988 | 12662016 | O-linked N-acetylglucosamine (GlcNAc) transferase (UDP-N-acetylglucosamine: polypeptide-N-acetylglucosaminyl transferase) (OGT), mRNA/cds = (2039, 4801) | −1 | ACCTGGGATTTCATTTCTGCTGAAAG AAATAGGAAGAACAGGACTCACTT |
| 6191 | Table 3A | Hs.198427 | BG150273 | 12662303 | hexokinase 2 (HK2), mRNA/cds = (1490, 4243) | −1 | GGGTGTGATGAATAGCGAATCATCTC AAATCCTTGAGCACTCAGTCTAGT |
| 6192 | Table 3A | Hs.313810 | BG150461 | 12662491 | 7k01d08.x1 cDNA, 3' end/clone = IMAGE: 3443006/clone_end = 3' | −1 | AGCTTTCACCACCTCGCAGTTGTAGA GATAGTCCCCGAAATATTATTCCA |
| 6193 | Table 3A | Hs.184456 | BG230563 | 12725596 | hypothetical protein (LOC51249), mRNA/cds = (0, 611) | −1 | GTGTGAAGTGACAGCCTTGTGTGTGA TGTTTTCTGCCTTCCCCAAGTTTG |
| 6194 | Table 3A | Hs.89104 | GB231557 | 12726664 | 602590917F1 cDNA, 5' end/clone = IMAGE: 4717348/clone_end = 5' | −1 | TTGTTTTAACAACTCTTCTCAACATTT TGTCCAGGTTATTCACTGTAACCA |
| 6195 | Table 3A | Hs.152925 | BG231805 | 12726934 | mRNA for KIAA1268 protein, partial cds/cds = (0, 3071) | −1 | TAAGTGGATTGGCAGACTCCTTGTTG CTTAAGAGTGGCTTTCTAGGCAGG |
| 6196 | Table 3A | Hs.89104 | BG231961 | 12727100 | 602590917F1 cDNA, 5' end/clone = IMAGE: 4717348/clone_end = 5' | −1 | TTGTTTTAACAACTCTTCTCAACATTT TGTCCAGGTTATTCACTGTAACCA |
| 6197 | Table 3A | Hs.337986 | BG235942 | 12749789 | Homo sapiens, clone MGC: 17431 IMAGE: 2984883, mRNA, complete cds/cds = (1336, 1494) | −1 | GCCAGTCTCTATGTGTCTTAATCCCT TGTCCTTCATTAAAAGCAAAACTA |
| 6198 | Table 3A | Hs.3353 | BG236015 | 12749882 | beta-1,3-glucuronyltransferase 1 (glucuronosyltransferase P) (B3GAT1), mRNA/cds = (175, 1179) | −1 | GTCTTTCCCGTCTTTCTTCCTCACCTA TGTAATTTCAGTAGTCTCTCAGC |
| 6199 | Table 3A | Hs.75703 | BG238084 | 12749931 | small inducible cytokine A4 (homologous to mouse Mip-1b) (SCYA4), mRNA/cds = (108, 386) | −1 | GGTCCACTCTCACTCTTTCTCTGCTG TTGCAAATACATGGATAACACCGT |
| 6200 | db mining | Hs.5146 | D19756 | 500072 | HUMGS00712 cDNA, 3' end/clone = mm0970/clone_end = 3' | −1 | CATTCAGTATTTATTGGGAAGACTTG TCAAGCACCATGATAAGTGGTGGA |
| 6201 | db mining | Hs.237971 | D19770 | 500086 | hypothetical protein MGC5627 (MGC5627), mRNA/cds = (72, 584) | −1 | AGAGGGGGAAGGACTTACATGACAT CCTACTGGGAATTTGCTAGAAACCA |
| 6202 | db mining | Hs.30709 | D20225 | 501322 | HUMGS01199 cDNA, 3' end/clone = pm0880/clone_end = 3' | −1 | CTGGTGAAGCTGACTCCCCAGGTAAA GAGATATCAGCTCTGCTTCAGACT |
| 6203 | db mining | Hs.30731 | D20378 | 501474 | HUMGS01352 cDNA, 3' end/clone = pm2943/clone_end = 3' | −1 | TTGCTTCTTCCTGCTTTATAGAGTTCC CGTAAAATACCCTTCACCCTGCC |
| 6204 | db mining | NA | D20425 | 501521 | HUMGS01399 Human promyelocyte cDNA clone pm1261 3', mRNA sequence | −1 | TCTGACCTCCGTGACGTTTATTACCA GCTGATGTCCCGTACACTGATTTCA |
| 6205 | db mining | Hs.229071 | D20458 | 501554 | HUMGS01432 cDNA, 3' end/clone = pm1542/clone_end = 3' | −1 | GGGAAGGGTCAGCAACGATTTCTCA CCAAATCACTACACAGACACAAAGG |
| 6206 | db mining | Hs.330221 | D20465 | 501581 | HUMGS01439 cDNA, 3' end/clone = pm2194/clone_end = 3' | −1 | ACCACTAAATGGTTACACTACACCAA GACACTAAAATGGCAGGGAGCCCT |
| 6207 | db mining | Hs.92440 | D20522 | 501618 | HUMGS01497 cDNA, 3' end/clone = pm1507/clone_end = 3' | −1 | AAATTCAAATCACCCTTGATACCCAC TTCTTTCTCCCACCCAAATCTGAT |
| 6208 | db mining | Hs.90165 | D20538 | 501634 | HUMGS01513 cDNA, 3' end/clone = pm1504/clone_end = 3' | −1 | ACCATATCGTGCAAAATGTAATATGG AATTTCCAAACATCAATGAAGGGAT |
| 6209 | db mining | Hs.90171 | D20572 | 501668 | HUMGS01547 cDNA, 3' end/clone = pm1503/clone_end = 3' | −1 | AATAAGTACCGTATATAAACACTTCTC TTTCTCTCCTCCACAATGGCACG |
| 6210 | db mining | Hs.30766 | D20726 | 504546 | HUMGS01703 cDNA, 3' end/clone = mp0664/clone_end = 3' | −1 | AGCATCACTCTTAGAAGAAGCAACTC CTTCCCTTGATTCTGTGTATTTGG |
| 6211 | db mining | Hs.5816 | D20846 | 504688 | HUMGS01827 cDNA, 3' end/clone = mp0825/clone_end = 3' | −1 | TCAACCCAGAATCTATAATGTATGAA ATAAATTAATAGAGAACCCAACAGAT C |
| 6212 | db mining | Hs.30793 | D20888 | 504708 | HUMGS01869 cDNA, 3' end/clone = mp0838/clone_end = 3' | −1 | AAGGTCTCCATCTAACAGGTAGAGCA GTTGGTGCAGATGAGATGAGCCTG |
| 6213 | Table 3A | Hs.292590 | D59502 | 960608 | 602628588F1 cDNA, 5' end/clone = IMAGE: 4751396/clone_end = 5' | −1 | GGTGATGATACCACCTCCAATGAACA GGGAAGCAAGTTCATCAGTCAACA |
| 6214 | Table 3A | Hs.119274 | F13765 | 758015 | RAS p21 protein activator (GTPase activating protein) 3 (Ins(1,3,4,5)-P4-binding protein) (GAP1|P48P), mRNA/cds = (46, 2550) | −1 | AGCTGTTGGGGCTGCACTGAGCTGC AATTTTTAACATGGATTTATAACTT |
| 6215 | db mining | Hs.238797 | H07915 | 872737 | 602081681F1 cDNA, 5' end/clone = IMAGE: 4245999/clone_end = 5' | −1 | AAGGAATTTGTTTTCCCTATCCTAACT CAGTAACAGAGGGTTTACTCCGA |
| 6216 | db mining | Hs.11307 | H09541 | 874363 | RST29274 cDNA | −1 | CGCACACATTTTCTGTATGGACAAAT CCTGGATTGGCTTCGTTATTTGGT |
| 6217 | Table 3A | Hs.187908 | H69141 | 1030426 | EST375312 cDNA | −1 | GGTAATGAAACAATCATCCAGTTAAC AATCAGCAAGGTTCTTCAGAGCCT |

TABLE 8-continued

| SEQ ID | Origin | Unigene | Locus | GI | Nominal Description | Strand | Probe Sequence |
|---|---|---|---|---|---|---|---|
| 6218 | Table 3A | Hs.117005 | H71236 | 1043052 | sialic acid binding Ig-like lectin 5 (SIGLEC5), mRNA/cds = (142, 1797) | −1 | TGGAAGAGTGGACTGAAGAAAG AACTTATACTCTCCCTCCTCTAAAA TTGA |
| 6219 | Table 3A | NA | H78395 | 1056484 | yu12f03.x1 Soares fetal liver spleen 1NFLS cDNA clone IMAGE: 233597 3' similar to contains Alu repet | −1 | TCCTGGGCTATTGGCTTTATGATATC TTTTGAGAAACAGGATTTTCACTT |
| 6220 | Table 3A | Hs.38864 | H80108 | 1058197 | IL0-MT0152-061100-501-e04 cDNA | −1 | ACCTTTTAAGGATGTCTTATTTCCACC CCAACTCTCCACTCCATTTTAGT |
| 6221 | Table 3A | NA | H92914 | 1099242 | yl94g03.s1 Soares_pineal_gland_N3HPG cDNA clone IMAGE: 231988 3', mRNA sequence | −1 | GAACCTTCAAAACTGTCACTTTGAGT TCCAGAAGAGTCCTTCAGCATCTT |
| 6222 | Table 3A | Hs.2210 | L40410 | 703109 | thyroid receptor interactor (TRIP3) mRNA, 3' end of cds/cds = (0, 458) | −1 | GTATTTGGGCTTCTCCAAGCAGATCA CGCAGACGACGGTGCTACATTTGA |
| 6223 | Table 3A | Hs.2200 | L40557 | 705359 | perforin 1 (performing protein) (PRF1), mRNA/cds = (0, 1667) | −1 | CAAGCATACTGGTTCTTTCCAAGCTC ACTGTTCTCACCACACGGCCCAC |
| 6224 | Table 3A | Hs.198726 | M24069 | 181483 | vasoactive intestinal peptide receptor 1 (VIPR1), mRNA/cds = (56, 1543) | −1 | TCCATATCCATTTCTGACGTTGAACC ATTTGACAGTGCCAAGGACTTTGG |
| 6225 | Table 3A | Hs.132911 | N20190 | 1125145 | MR2-OT0079-290500-007-b03 cDNA | −1 | AAGCCTGTTTTTCACTCTAAAAATTCA AGAGGACACGCTAAGAACGATCA |
| 6226 | Table 3A | Hs.323950 | N23307 | 1137457 | zinc finger protein 6 (CMPX1) (ZNF8), mRNA/cds = (1265, 3361) | −1 | CCTCAGCTTCCAACTCTGATTCCAGG ACAGGATGGAAAACCTTTGGACAG |
| 6227 | db mining | Hs.32250 | N30152 | 1148872 | yx81l03.s1 cDNA, 3' end/clone = IMAGE: 268157/clone_end = 3' | −1 | AGTTGTGTTTGCTACTTTAGAAGC AGTTGTGTTTGCTACTTTAGAAGC |
| 6228 | Table 3A | Hs.44512 | N33584 | 1153983 | yv21f11.s1 cDNA, 3' end/clone = IMAGE: 243405/clone_end = 3' | −1 | AACTCACGACAATTGCTACAAAACAC CAGGGAGGGGGCTTTTTGTGTTTTT |
| 6229 | Table 3A | Hs.3353 | N36787 | 1157929 | beta-1,3-glucuronyltransferase 1 (glucuronosyltransferase P) (B3GAT1), mRNA/cds = (175, 1179) | −1 | GTCTTTCCCGTCTTTCTTCCTCACCTA TGTAATTTCAGTAGTCTCTCAGC |
| 6230 | Table 3A | Hs.38218 | N39230 | 1162437 | 602569369F1 cDNA, 5' end/ clone = IMAGE: 4693744/ clone_end = 5' | −1 | GCCCTGGTATGTATGCCTTTCTCTCC TACTGTCTAATAGCACCTCGTAAA |
| 6231 | Table 3A | Hs.236456 | N49836 | 1191002 | 602287746T1 cDNA, 3' end/ clone = IMAGE: 4375067/ clone_end = 3' | −1 | AAGAAACCGTGGAAGATACTGGTTTA TTTCAAATGAGCAGAGTATGTTGT |
| 6232 | Table 3A | Hs.114453 | N58052 | 1201942 | 601880526F1 cDNA, 5' end/ clone = IMAGE: 4109119/ clone_end = 5' | −1 | CCACCTCTTCTGACATGAATGTAGCA TAAGTTAGCAATCGGTTCTTCCAA |
| 6233 | Table 3A | Hs.334731 | N58136 | 1202026 | Homo sapiens, clone IMAGE: 3448308, mRNA, partial cds/cds = (0, 2353) | −1 | AGGTTCCCTTTCAAATAAAGATAAAG |
| 6234 | Table 3A | Hs.205565 | N72600 | 1229704 | za46f08.r1 cDNA, 5' end/ clone = IMAGE: 295623/ clone_end = 5' | −1 | GGCTGGCCTCATTTTGAAAAGTTAGT ACAATTTTCTTCAGTGCTAACTTG |
| 6235 | Table 3A | Hs.256931 | N80578 | 1243279 | zb02d05.s1 cDNA, 3' end/ clone = IMAGE: 300873/ clone_end = 3' | −1 | ACTCCAGAACGTCAGAAATGGTGTAG CAGAATGAATTCTGTTATAAGGAA |
| 6236 | Table 3A | Hs.303018 | N94511 | 1266820 | zb80g04.s1 cDNA, 3' end/ clone = IMAGE: 309942/ clone_end = 3' | −1 | CTGTTCGAAAGTTGGAGACTGCCTGT ACCCAGGTTGATAGTCAATTGTTT |
| 6237 | db mining | Hs.118964 | NM_017660 | 8923093 | hypothetical protein FLJ20085 (FLJ20085), mRNA/cds = (82, 655) | −1 | CCACCTTGAGCGCCTTCTTCTGGTTG GTTGTCATGCAGTTCTCACACATG |
| 6238 | Table 3A | Hs.11594 | R12665 | 765741 | yl40a04.s1 cDNA, 3' end/ clone = IMAGE: 129294/ clone_end = 3' | −1 | ACCCTTCCCCTTTTTCATATCCTTTCT TCAAAAATCTAAATGATGTGCCT |
| 6239 | db mining | Hs.108082 | R40823 | 821181 | 602068988F1 cDNA, 5' end/ clone = IMAGE: 4067972/ clone_end = 5' | −1 | AGTTCCAGGAGGTGGTTTTAAATATT GGATGAAAACTTACAGGCTGTTTT |
| 6240 | db mining | Hs.94881 | R50838 | 812740 | 602387588F1 cDNA, 5' end/ clone = IMAGE: 4516388/ clone_end = 3' | −1 | ACAATACATTTACAAAGCCATCTTTAC ATGCATTAAACGAGGGCTACAAC |
| 6241 | Table 3A | Hs.94881 | R50838 | 812740 | 602387588F1 cDNA, 5' end/ clone = IMAGE: 4518388/ clone_end = 5' | −1 | ACAATACATTTACAAAGCCATCTTTAC ATGCATTAAACGAGGGCTACAAC |
| 6242 | RG housekeeping genes | Hs.92004 | R52541 | 814443 | HSU55987 cDNA/clone = 39883 | −1 | GGCCTGAAGAAGGAGATAAGTGTTC CATTCGGCAACATAAGAGAAGTTAA |
| 6243 | RG housekeeping genes | Hs.26766 | R60313 | 831008 | 602270716F1 cDNA, 5' end/ clone = IMAGE: 4359027/ clone_end = 5' | −1 | TCCATCCCAAAGGAGAGCTACTGTAC TGACTGTACTTGTGGAATGCAGCG |

TABLE 8-continued

| SEQ ID | Origin | Unigene | Locus | GI | Nominal Description | Strand | Probe Sequence |
|---|---|---|---|---|---|---|---|
| 6244 | db mining | Hs.330530 | T25714 | 583034 | ESTDIR309 cDNA, 3' end/ clone = CDDIRX9/clone_end = 3' | −1 | ACCCACCACTCTCAGGACCACCTGAA GGCAGAATAAACCGGATCCTGTTG |
| 6245 | db mining | NA | T25727 | 583047 | ESTDIRX51 CD34 + DIRECTIONAL cDNA clone CDDIRX51 3', mRNA sequence | −1 | AAATTGTGTGAGAAGGCTGATAAACG TCTGTGGTTTCTCCCTGTGCTATT |
| 6246 | db mining | Hs.7569 | T26893 | 587784 | ESTDIR485 cDNA, 3' end/ clone = CDDIR465/clone_end = 3' | −1 | GCTGGGCTTCTGCAAAATTATAAAGT TGCTTTATTAAATTCATACATGCGG |
| 6247 | db mining | Hs.172822 | T26903 | 587794 | ESTDIR551 cDNA, 3' end/ clone = CDDIR551/clone_end = 3' | −1 | AGCTGATTCATTCATTCTATGTGTGC CACTAAATAAAGAGATTGAGCAAGT |
| 6248 | Table 3A | Hs.185675 | T98171 | 747516 | QV2-EN0098-010201-603-a05 cDNA | −1 | CTTGAAGCTGTGTTGGTGGCCTGTGA CCTTCCAATGCAATCTAGACTGTG |
| 6249 | Table 3A | Hs.58066 | W72392 | 1382348 | 602389077F1 cDNA, 5' end/ clone = IMAGE: 4517875/ clone_end = 5' | −1 | CTCATACACTTCTCAGCCTCAGCACC TAACCCTCACACAACACTCCAGTA |
| 6250 | Table 3A | NA | W86427 | 1400194 | zh81c11.s1 Soares_fetal_liver_spleen_1NFLS_S1 cDNA clone IMAGE: 416564 3', mRNA sequence | −1 | TGAGTATTGTTGTGGGGCGGGTAT GTCTGTATATAAATCTGTGCAGCCA |
| 6251 | Table 1 | NA | AA136584 | 1697794 937202 | zn95b02.s1 Stratagene fetal retinal cDNA clone IMAGE: 565899 3', mRNA sequence | −1 | AACATATCCAGGGGAGGACAAAC TCTGGGCTGGACAATGTATCCACA AGGG |
| 6252 | Table 1 | NA | AA431959 | 2115667 | zw77a03.s1 Soares_testis_NHT cDNA clone IMAGE: 782188 3', mRNA sequence | −1 | AGAGCAAGTCTCAGAAATAATGCTGT ATCTACACTGTCATGTATTTGCCA |
| 6253 | Table 1 | NA | AA482019 | 2209697 | zu98e04.s1 NCI_CGAP_GCB1 cDNA clone IMAGE: 746046 3', mRNA sequence | −1 | ACCACCAGCTATTTGTAATTCCTTCTT CTAAGGCATAGTGAAAACTTGCT |
| 6254 | Table 1 | NA | AA524720 | 2265848 | ng42e03.s1 NCI_CGAP_Co3 cDNA clone IMAGE: 937468 3', mRNA sequence | −1 | GGACGGTTGGCTGAATGGCAACAGT GATGGAATATTTATATTTAGCCACA |
| 6255 | Table 1 | Hs.57787 | AA588755 | 2402488 | 602381381F1 cDNA, 5' end/ clone = IMAGE: 4498845/ clone_end = 5' | −1 | AGGTTGTTATCAGGTGGCACAAATTA AATCCATCTTGAAGACTTCACACA |
| 6256 | Table 1 | NA | AA628833 | 2541220 | af37g04.s1 Soares_total_fetus_Nb2HF8_9w cDNA clone IMAGE: 1033878 3', mRNA sequence | −1 | GACTCGTTACGCCGTAGTTTGTCCTA TCTTGTTTATCAAATGAATTTCGT |
| 6257 | Table 2 | Hs.180669 | AA633203 | 2556817 | OS-4 protein (OS-4) mRNA, complete cds/cds = (305, 1158) | −1 | AGAGCTATGGGTGCTACAGGCTTGTC TTTCTAAGTGACATATTCTTATCT |
| 6258 | Table 1 | Hs.239489 | AA639796 | 2563575 | TIA1 cytotoxic granule-associated RNA-binding protein (TIA1), transcript variant 2, mRNA/cds = (185, 1345) | −1 | ACCCTTATAAACCAGAGCCCAGGAAA GACAGCTCGAGTGTATAATTCTCT |
| 6259 | Table 1 | Hs.29282 | AA748714 | 2788872 | mitogen-activated protein kinase kinase kinase 3 (MAP3K3), mRNA/cds = (83, 1983) | −1 | AGCTCCTCCCTCTCAACACCCAGTTT CCTTGGGAGTTGTCATTAAAGGAA |
| 6260 | Table 1 | Hs.111554 | AA806222 | 2874972 | ADP-ribosylation factor-like 7 (ARL7), mRNA/cds = (14, 592) | −1 | GCTGTAATTCTCTGTCTCATCATCCTT CTCTTTTGTTTCCATAGCCTTTT |
| 6261 | Table 1 | NA | AA806766 | 2875516 | ob91d04.s1 NCI_CGAP_GCB1 cDNA clone IMAGE: 1338727 3', mRNA sequence | −1 | TCGCTTTCTAACTGATTCCATTCCAC CATGTCAGATACTCCTGGGCTGCT |
| 6262 | Table 1 | Hs.226755 | AA909983 | 3049273 | RC1-UT0033-250800-022-h02 cDNA | −1 | ATCCAAGGTTTAATTCTGCCATCTCA GAATGGTGATAAACCATTTCTCCC |
| 6263 | Table 1 | Hs.50252 | AA984245 | 3162770 | milochondrial ribosomal protein L32 (MRPL32), mRNA/cds = (46, 612) | −1 | TCAGCCAACCTGAATCTGGTATCTTT ACTTAAACACAGCAGTTGTAGTTA |
| 6264 | Table 1 | Hs.53542 | AI084224 | 3422647 | chorea-acanthocylosis (CHAC) mRNA, complete cds/cds = (260, 9784) | −1 | TCAATAGTTGTGAAATTCTTCTCAGG CTCCTTAAACCCTCGCTTTGTTGT |
| 6265 | Table 1 | Hs.135167 | AI091533 | 3430592 | AV712376 cDNA, 5' end/ clone = DCAAND12/clone_end = 5' | −1 | AGAGGCAACACTTAAACACTAGGGCT ACTGTGGCATCTATGTAGACAGGA |
| 6266 | Table 1 | Hs.11637 | AI275205 | 3897479 | 602388093F1 cDNA, 5' end/ clone = IMAGE: 4517086/ clone_end = 5' | −1 | TGACTTTCAGGAATGTCAGCATTGAC CTCTCCTTGCCACTGTTACTCAGC |
| 6267 | Table 1 | Hs.8724 | AI298509 | 3958245 | serine threonine protein kinase (NDR), mRNA/cds = (595, 1992) | −1 | TCTCAAGAGAACGCCACAGCAGA GAGACCCAATCCGCCTAAGTTGCAG |
| 6268 | Table 1 | Hs.142838 | AI299573 | 3959158 | nucleolar protein interacting with the FHA domain of pKi-67 (NIFK), mRNA/cds = (54, 935) | −1 | AGAGTGAGAAGGCAGTTCCAGTTTTA GCACAGATTTGTTTATGTGTTCAG |
| 6269 | Table 1 | Hs.100555 | AI352690 | 4089896 | DEAD/H (Asp—Glu—Ala—Asp/ His) box polypeptide 18 (Myc- | −1 | GGGGTAGGAAGAGGATGGAATTGAG ATGTTTGAGCCTCATTTACATCAAT |

TABLE 8-continued

| SEQ ID | Origin | Unigene | Locus | GI | Nominal Description | Strand | Probe Sequence |
|---|---|---|---|---|---|---|---|
| | | | | | regulated) (DDX18), mRNA/cds = (71, 2083) | | |
| 6270 | Table 1 | Hs.108124 | AI362793 | 4114414 | cDNA: FLJ23088 fls, clone LNG07026/cds = UNKNOWN | −1 | GCTCGCTACCAGAAATCCTACCGATA AGCCCATCGTGACTCAAAACTCAC |
| 6271 | Table 1 | Hs.134342 | AI363001 | 4114622 | mRNA for LanC-like protein 2 (lancl2 gene)/cds = (186, 1538) | −1 | GACGCGCACACACCTTGAGTGACAG CGACCTCTTCTCTACAGGTTTTCCC |
| 6272 | Table 1 | Hs.192427 | AI380016 | 4189889 | 602298277F1 cDNA, 5' end/ clone = IMAGE: 4390770/ clone_end = 5' | −1 | ACTTCCCCTTTAGGTATCCCTGGAGT AATAATGACAACAAAATTCACTGC |
| 6273 | Table 2 | Hs.158978 | AI380390 | 4190243 | UI-H-BI2-ahi-a-03-0-UI.s1 cDNA, 3' end/clone = IMAGE: 2726892/clone_end = 3' | −1 | GTCCTTTGATAGCAGAACAAGAGGCT CTGTGATCCTCTGGACCTCAGATT |
| 6274 | Table 1 | NA | AI392705 | 422252 | tg23b03.x1 NCI_CGAP_CLL1 cDNA clone IMAGE: 2109581 3', mRNA sequence | −1 | TGCAGGCTCATTGTGCTCCTTCTTCT GGGTTTCAATTGGATTTCAGTCCT |
| 6275 | Table 1 | Hs.76239 | AI393970 | 4223517 | hypothetical protein FLJ20608 (FLJ20608), mRNA/cds = (81, 880) | −1 | GAGGACTGGGACCGTGATTCCACTA ACCGGAAACCGTCGCCTTTCGGGCC |
| 6276 | Table 1 | Hs.79988 | AI419082 | 4265013 | splicing factor 30, survival of motor neuron-related (SPF30), mRNA/cds = (0, 716) | −1 | GGATGTGTGATGTTTATATGGGAGAA CAAAAAGCTGATGTATAGCCCTGT |
| 6277 | Table 1 | Hs.121973 | AI458739 | 4311318 | 602428025F1 cDNA, 5' end/ clone = IMAGE: 4547239/ clone_end = 5' | −1 | CCTGCAACAGCTAAGGCCAAGCCAA ACTTACCGTGGACTCAAACACTTTG |
| 6278 | Table 1 | Hs.342008 | AI498318 | 4390298 | UI-H-BI1-aeq-b-02-0-UI.s1 cDNA, 3' end/clone = IMAGE: 2720186/clone_end = 3' | −1 | GCCAGAATGGTACAGAGTGGAGGGT GTTCTGCTAATGACTTCAGAGAAGT |
| 6279 | Table 1 | Hs.194054 | AI523854 | 4437989 | HA0669 cDNA | −1 | GACAAAATAGTTACCTATGCTTTCCTT CTGGCACCCCGAATGTACGCAGG |
| 6280 | Table 1 | Hs.14623 | AI571519 | 4534893 | interferon, gamma-inducible protein 30 (IFI30), mRNA/cds = (40, 951) | −1 | AAGCCCAGATACACAAAATTCCACCC CATGATCAAGAATCCTGCTCCACT |
| 6281 | Table 1 | Hs.278554 | AI627495 | 4664295 | chromobox homolog 3 (Drosophila HP1 gamma) (CBX3), mRNA/ cds = (111, 682) | −1 | TGCTGAAAGTGGTCCCAAAGGGGTA CTAGTTTTAAGCTCCCAACTCCCC |
| 6282 | Table 1 | Hs.17132 | AI633798 | 4885128 | 602326676F1 cDNA, 5' end/ clone = IMAGE: 4427970/ clone_end = 5' | −1 | GCAACTGTTTTCTAGGACATGTTTAC TAGAACTACTTTAAGTATGCTGTGC |
| 6283 | Table 1 | Hs.4283 | AI651212 | 4735191 | 602621616F1 cDNA, 5' end/ clone = IMAGE: 4755315/ clone_end = 5' | −1 | ACAGTTACTTTGGAGCTGCTAGACTG GTTTTCTGTGTTGGTAAATTGCCT |
| 6284 | Table 1 | Hs.324507 | AI678099 | 4888281 | hypothetical protein FLJ20986 (FLJ20988), mRNA/cds = (182, 2056) | −1 | CGCCAGAGGTCAGAACATGTCTATTT TGAATTGGATCGTTACAAATGAGC |
| 6285 | Table 1 | Hs.90744 | AI684022 | 4895316 | proteasome (prosome, macropain) 26S subunit, non-ATPase, 11 (PMSD11), mRNA/cds = (0, 1268) | −1 | TTCTGACACGATTACACAACGAGGCT TTAATGCCATTTGGGTAGGTGAGC |
| 6286 | Table 1 | NA | AI688560 | 4899854 | wd39f08.x1 Soares_NFL_T_GBC_S1 cDNA clone IMAGE: 2330535 3', mRNA sequence | −1 | ACTGAAAAGTTGAAAGACTTTTGCAG TGAACATTTATATAACTCCCCCGCT |
| 6287 | Table 1 | Hs.177708 | AI697756 | 4985658 | 602369210F1 cDNA, 5' end/ clone = IMAGE: 4477370/ clone_end = 5' | −1 | TGGTTCCTGTGCTCACCATAGGGCTG GTGTACATTGGGCCATTAATAAAC |
| 6288 | Table 1 | Hs.80887 | AI701165 | 4989065 | v-yes-1 Yamaguchi saricoma viral related oncogene homolog (LYN), mRNA/cds = (297, 1835) | −1 | TCTGGGAAAGACATTTTAAGCTGCT GACTTCACCTGCAAAATCTAACAG |
| 6289 | Table 1 | Hs.299883 | AI742850 | 5111138 | hypothetical protein FLJ23399 (FLJ23399), mRNA/cds = (282, 1769) | −1 | TGTTTTACCCTCACTGTTGGACAT ACATTCCAAGCTTTTCAACTCTA GGAG |
| 6290 | Table 1 | Hs.14373 | AI760353 | 5176020 | yx26h11.r1 cDNA, 5' end/ clone = IMAGE: 262917/ clone_end = 5' | −1 | TTATCTCAGAATCTTGATGAACTCTG AAATGACCCCTGATGGGGGCATG |
| 6291 | Table 1 | Hs.36137 | AI785153 | 6231662 | hepalocyte nuclear factor 3, gamma (HNF3G), mRNA/cds = (0, 1043) | −1 | CCGGGAAGCGGGGTACTGGCTGTGT TTAATCATTAAAGGTACCGTGTCCG |
| 6292 | Table 1 | Hs.195175 | AI802547 | 5368019 | mRNA for CASH alpha protein/ cds = (481, 1923) | −1 | AGCCCTTTCTTGTTGCTGTATGTTTA GATGCTTTCCAATCTTTTGTTACT |
| 6293 | Table 1 | Hs.24848 | AI803065 | 5288537 | tumor necrosis factor receptor superfamily, member 5 (TNFRSF5), mRNA/cds = (47, 880) | −1 | GGGGTATGGTTAGTAATATCCACCA GACCTTCCGATCCAGCAGTTTGGT |
| 6294 | Table 1 | NA | AI807278 | 5393844 | wf38h03.x1 Soares_NFL_T_GBC_S1 cDNA clone IMAGE: 2357909 3', mRNA sequence | −1 | CTCTACCATAAGGCACTATCAGAGAC TGCTACTGGAGTGTATATTTGGTT |

TABLE 8-continued

| SEQ ID | Origin | Unigene | Locus | GI | Nominal Description | Strand | Probe Sequence |
|---|---|---|---|---|---|---|---|
| 6295 | Table 1 | Hs.220850 | AI880607 | 5554656 | ym91d11.r1 cDNA, 5' end/ clone = IMAGE: 166293/ clone_end = 5' | −1 | TGGGGCACTTTGAAAACTTCACAGGC CCACTGCTGCTTGCTGAAATAAAA |
| 6296 | Table 1 | Hs.23098 | AI884671 | 5589835 | 602254138F1 cDNA, 5' end/ clone = IMAGE: 4346626/ clone_end = 5' | −1 | TGGCGAGGATAAATAGAGGCATTGTT TTTGCTACTTTGCATATCATTGGC |
| 6297 | Table 1 | Hs.179391 | AI917642 | 5637497 | wi52d11.x1 cDNA, 3' end/ clone = IMAGE: 2393877/ clone_end = 3' | −1 | GCAGGAAAGATGGGGTGGTGGACTG TTTTTGCCTACTTTTTGTTTTTGAA |
| 6298 | Table 1 | Hs.180446 | AI948513 | 5740823 | importin beta subunit mRNA, complete cds/cds = (337, 2987) | −1 | CAGGGTATCAGATATTGTGCCTTTTG GTGCCAGGTTCAAAGTCAAGTGCC |
| 6299 | Table 1 | Hs.7557 | AL042081 | 5421426 | FK508-binding protein 5 (FKBP5), mRNA/cds = (153, 1526) | −1 | AGGCTGCATATGGATTGCCAAGTCAG CATATGAGGAATTAAAGACATTGT |
| 6300 | Table 1 | Hs.39911 | AL138429 | 6855110 | mRNA for FLJ00089 protein, partial cds/cds = (62, 1111) | −1 | TTAAGAACCCCAAAGATTAAAGGAAA CAATGTTAAGGGCTTTTGTGAGGA |
| 6301 | Table 1 | Hs.13144 | AL521097 | 12784590 | HSPC160 protein (HSPC160), mRNA/cds = (53, 514) | −1 | GATACACTGTCCAGCCCAGGTCCAG GCCCTAGGTTCTTTACTCTAGCTAC |
| 6302 | Table 1 | Hs.26670 | AL540260 | 12870241 | AL540260 cDNA/clone = CS0DF032YF03-(3-prime) | −1 | ACTCAGGTGGTGCTGGTGTTAGTGAT GCTGGAGAAGAGAATATTACTGGT |
| 6303 | Table 1 | Hs.183232 | AL561892 | 12909772 | hypothetical protein FLJ22638 (FLJ22638), mRNA/cds = (12, 476) | −1 | AAACACAGCCCACCCCATTTCAGACC GCCTTCCTGAGGAGAAAATGACAG |
| 6304 | Table 1 | Hs.5057 | AL578975 | 12943566 | AL578976 cDNA/clone = CS0DK012YN01-(3-prime) | −1 | TTGGCCCAGTGTGATTGATTGCTTTA TCTTTGGTACTTTTACTTGAATGG |
| 6305 | Table 1 | Hs.198296 | AL582354 | 12950255 | SWI/SNF related, matrix associated, actin dependent regulator of chromatin, subfamily a, member 2 (SMARCA2), mRNA/cds = (297, 5015) | −1 | AGCCTGAGGCAAATAAAATTCCAGTA ATTTCGAAGAATGGGTGTTGGCAA |
| 6306 | Table 1 | Hs.101370 | AL583391 | 12952309 | AL583391 cDNA/clone = CS0DL012YA12-(3-prime) | −1 | AGGACCTTGACAAGCCGTTTGAGATG GAATGTAGGCCCTGATGTTATGCT |
| 6307 | Table 1 | Hs.38218 | AV659358 | 9880372 | 602589369F1 cDNA, 5' end/ clone = IMAGE: 4893744/ clone_end = 5' | −1 | TGTAAGTTGACTTTCAAAAGTCTCTG GAAACACTGGACTTTAGCTGGTCC |
| 6308 | Table 1 | Hs.301704 | AW002985 | 5849991 | eomesodermin (Xanopus laevis) homolog (EOMES), mRNA/cds = (0, 2060) | −1 | AACAAGCCATGTTTGCCCTAGTCCAG |
| 6309 | Table 1 | NA | AW027160 | 5885918 | wf72b08.x1 Soares_thymus_NHFTh cDNA clone IMAGE: 2512983 3' similar to contains Alu repetitive eleme | −1 | ACCGCCAAAGCCAATCATCCACTTTC AGTACTTACCTAACCAATCTCCCA |
| 6310 | Table 1 | Hs.89433 | AW071894 | 6026892 | ATP-binding cassette, sub-family C (CFTR/MRP), member 1 (ABCC1), transcript variant 1, mRNA/cds = (196, 4791) | −1 | TTTGGGGGATCCTTTTGTAATGACTT ACACTGGAAATGCGAACATTTGCA |
| 6311 | Table 1 | Hs.335449 | AW136717 | 6140850 | UI-H-BI1-adm-a-03-0-UI.s1 cDNA, 3' end/clone = IMAGE: 2717092/clone_end = 3' | −1 | TTCTGGCCTTGTTCACCTAGAAACGC TATTTCCTGTGTTATGGTTCTGGC |
| 6312 | Table 1 | Hs.12035 | AW137149 | 8141282 | 602122419F1 cDNA, 5' end/ clone = IMAGE: 4279300/ clone_end = 5' | −1 | GGGTTACATTTGAGTCTCTGTACCTG CTTGGAAGAAATAAAAATACGTGT |
| 6313 | Table 1 | Hs.337727 | AW161820 | 6300853 | au70h03.x1 cDNA, 3' end/ clone = IMAGE: 2781653/ clone_end = 3' | −1 | TGTGGGCTTGGTATAAACCCTACTTT GTGATTTGCTAAAGCACAGGATGT |
| 6314 | Table 1 | Hs.81248 | AW166442 | 6397987 | CUG triplet repeat, RNA-binding protein 1 (CUGBP1), mRNA/cds = (137, 1585) | −1 | ACTGGCAAATGAAGCATACTGGCTTG CAGGGACCTTCTGATTCAAGTACA |
| 6315 | Table 1 | Hs.166975 | AW293159 | 6699795 | splicing factor, arginine/serine-rich 5 (SFRS5), mRNA/cds = (218, 541) | −1 | CTCCCATCATTCCCTCCCGAAAGCCA TTTTGTTCAGTTGCTCATCCACGC |
| 6316 | Table 1 | Hs.328348 | AW338115 | 6834741 | lp39g05.x1 cDNA, 3' end/ clone = IMAGE: 2190200/ clone_end = 3' | −1 | GGCGTTTCCCATTGACCAGTTTGACC CTGGTTTGAATAAAGAGAAGTGCG |
| 6317 | Table 1 | Hs.337988 | AW440517 | 8975823 | Homo sapiens, clone MGC: 17431 IMAGE: 2984883, mRNA, complete cds/cds = (1336, 1494) | −1 | GCCAGTCTCTATGTGTCTTAATCCCT TGTCCTTCATTAAAAGCAAAACTA |
| 6318 | Table 1 | Hs.250 | AW444632 | 8986394 | xanthene dehydrogenase (XDH), mRNA/cds = (81, 4082) | −1 | TGCAATGAGGCAGTGGGGTAAGGTT AAATCCTCTAACCGTCTTTGAATCA |
| 6319 | Table 2 | Hs.335815 | AW444812 | 8986574 | UI-H-BI3-ajy-d-11-0-UI.s1 cDNA, 3' end/clone = IMAGE: 2733380/clone_end = 3' | −1 | TGGCAACTTCAACTCCTTGATGGCGA TAATCTCTGGTATGAATATGAGCC |
| 6320 | Table 1 | Hs.342873 | AW451293 | 6992069 | RC3-HT0230-130100-014-g06 cDNA | −1 | TGCTTGGGAAATTTGGTTTGTAAACC TAAAATAGCCCTTATTTCTGGGGA |
| 6321 | Table 1 | Hs.342735 | AW452096 | 6992953 | UI-H-BI3-alo-d-02-0-UI.s1 cDNA, 3' end/clone = IMAGE: 3068186/clone_end = 3' | −1 | CTTTCTGCCTGAAGCTGCCCCCATGA CTCCCTTCTTTGTGCAAAAGCATG |

TABLE 8-continued

| SEQ ID | Origin | Unigene | Locus | GI | Nominal Description | Strand | Probe Sequence |
|---|---|---|---|---|---|---|---|
| 6322 | Table 1 | Hs.80618 | AW510795 | 7148873 | hypothetical protein (FLJ20015), mRNA/cds = (31, 522) | −1 | ACCCAGTTTGTGCATAGTTCATGATC CTCTATAAAACCAGCTTTTGTGGA |
| 6323 | Table 1 | Hs.259842 | AW614193 | 7319379 | cDNA FLJ11025 fis, clone PLACE 1003968, moderately similar to 5'-AMP-ACTIVATED PROTEIN KINASE, GAMMA-1 SUBUNIT/cds = (159, 1145) | −1 | ACACCATTTCAGCGTTGGATCACAGA CAGCTCTTCCTTTATATCCCAGCA |
| 6324 | Table 1 | Hs.334437 | AW778778 | 7793371 | hypothetical protein MGC4248 (MGC4248), mRNA/cds = (70, 720) | −1 | TGGCATAATGTTGGATTGAATCTACA TTTTGGCAGAAGTTAAACATTCCC |
| 6325 | Table 1 | Hs.151393 | AW778854 | 7793457 | glutamate-cysteine ligase, catalytic subunit (GCLC), mRNA/cds = (92, 2005) | −1 | AGAATGCCTGGTTTTCGTTTGCAATT TGCTTGTGTAAATCAGGTTGTAAA |
| 6326 | Table 1 | Hs.120243 | BE044384 | 8361417 | gamma-parvin (PARVG), mRNA/cds = (0, 995) | −1 | ATCGTTGGATTATCTTTGAACCCCCT TGTGTGGATCATTTTGAGCCGCCT |
| 6327 | Table 1 | Hs.5734 | BE218938 | 8908256 | mengioma expressed antigen 5 (hyaluronidase) (MGEA5), mRNA/cds = (395, 3145) | −1 | ATACAGGGTTCCATCCAGAAAGCATT CAGTCAGAGCAAGTTAAAGTCAGT |
| 6328 | Table 1 | Hs.167988 | BE222301 | 8909619 | neural cell adhesion molecule 1 (NCAM1), mRNA/cds = (201, 2747) | −1 | AAGTTGTCCTGTGCTAAAGCAAGCGT GGGATGATCCTACCTACCTCTAGG |
| 6329 | Table 1 | Hs.27774 | BE348809 | 9260662 | 602386841F1 cDNA, 5' end/ clone = IMAGE: 4515730/ clone_end = 5' | −1 | AGCTAGTGATGTTTTGTCCAAAGGAA GATTCTGACAACAGCTTCAGCAGA |
| 6330 | Table 1 | NA | BE348955 | 9260808 | hs91h01.x1 NCI_CGAP_Kid13 cDNA clone IMAGE: 3144625 3', mRNA sequence | −1 | ACACAGACATATTGACCGCACACAAC ACTGAAATGGACTGACTTGAGAAA |
| 6331 | Table 1 | Hs.56156 | BE349148 | 9261087 | 601463367F1 cDNA, 5' end/ clone = IMAGE: 3868512/ clone_end = 5' | −1 | TGGTTCTCTGATTTGTAATGAGCACC TGGATATGTCAATTAAAATGCCCA |
| 6332 | Table 1 | Hs.127428 | BE466500 | 9512198 | Homo sapiens, Similar to homeo box A9 clone MGC: 19648 IMAGE: 2987818, mRNA, complete cds/cds = (62, 880) | −1 | GGCCTACTGACCAAATTGTTGTGTTG AGATGATATTTAACTTTTTGCCAA |
| 6333 | Table 1 | Hs.122575 | BE502248 | 9704854 | endotheilial differentiation, lysophosphatidic acid G-protein-coupled receptor, 4 (EDG4), mRNA/cds = (6, 1061) | −1 | CGATAGAATTGAAGCAGTCCACGGG GAGGGGATGATACAAGGAGTAAACC |
| 6334 | Table 1 | Hs.197766 | BE502992 | 9705400 | clone 23932 mRNA sequence/ cds = UNKNOWN | −1 | CTCAAACGAAATTGGGCAGGCCATTT GCGTGGTTTCTCTGGATAAGTTCC |
| 6335 | Table 1 | Hs.61426 | BE550944 | 9792636 | 602329933F1 cDNA, 5' end/ clone = IMAGE: 4431248/ clone_end = 5' | −1 | GCACATGACAGTAAGCGAGGTTTTGG GTAAATATAGATGAGGATGCCTAT |
| 6336 | Table 1 | Hs.122655 | BE551867 | 9793559 | hypothetical protein MGC14425 (MGC14425), mRNA/cds = (318, 686) | −1 | ACACAGGAACCGCTTACCCACCAGCT CTGCCCGCGTCTCTACCGCCATAG |
| 6337 | Table 1 | Hs.4310 | BE614297 | 9895894 | eukaryotic translation initiation factor 1A (EIF1A), mRNA/cds = (207, 641) | −1 | ACAACTCAAGTGAAAAGATGTCTCCA GTTTCTGAAGATAACGCACGCTGA |
| 6338 | Table 1 | Hs.341573 | BE6466470 | 9970781 | tc38c11.x1 cDNA, 3' end/clone = IMAGE: 2066900/clone_end = 3' | −1 | AAAACACTCCACCTAAAAGCAG GAAAGATGGCAATTCTAAATAGCA GCTA |
| 6339 | Table 1 | Hs.88845 | BE674685 | 10035307 | AV733781 cDNA, 5' end/ clone = cdAASF08/clone_end = 5' | −1 | CGCCGCTCCTGGAGACCTGATAACTT AGGCTTGAAATAATTGACTTGTCT |
| 6340 | Table 1 | Hs.181015 | BE676054 | 1003695 | signal transducer and activator of transcription 6, interleukin-4 induced (STAT6), mRNA/cds = (165, 2708) | −1 | ATCCCATTCTCCCTCTCAAGGCAGGG GTCATAGATCCTAAGCCATAAAAT |
| 6341 | Table 1 | Hs.108327 | BF001438 | 10701713 | damage-specific DNA binding protein 1 (127kD) (DDB1), mRNA/cds = (109, 3531) | −1 | ACAGCATGAGAAACTGTTAGTACGCA TACCTCAGTTCAAACCTTTAGGGA |
| 6342 | Table 1 | NA | BF056055 | 10809951 | 7k07h12.x1 NCI_CGAP_GC6 cDNA clone IMAGE: 3443950 3' similar to contains element L1 repetitive eleme | −1 | CACAATGCTGCCTCCTCTGTGGATGA CTGATGGCAAGAGTCTGAATTGAA |
| 6343 | Table 1 | Hs.43857 | BF058599 | 10812495 | mRNA for KIAA1247 protein, partial cds/cds = (285, 2942) | −1 | TAAGAAATCCCAATTTTCAGGAGTGG TGGTGTCAATAAACGCTCTGTGGC |
| 6344 | Table 1 | Hs.144583 | BF059133 | 108113029 | Homo sapiens, clone IMAGE: 3462401, mRNA, partial cds/cds = (0, 153) | −1 | CGGCAGGGTGGCCTGTAACAATTTCA GTTTTCGCAGAACATTCAGGTATT |
| 6345 | Table 1 | Hs.144519 | BF061421 | 10820331 | T-cell leukemia/lymphoma 6 (TCL6), transcript variant TCL6a2, mRNA/cds = (1767, 2192) | −1 | GCTGGAGGGAGAGGCACTGGGGAAT TTTTCCTGGTGAATACTGAAGTTAC |
| 6346 | Table 1 | Hs.96568 | BF194880 | 11081165 | 602137338F1 cDNA, 5' end/ clone = IMAGE: 4274048/ clone_end = 5' | −1 | TGATACTTTGGTTCTCTTTCCTGCTCA GGTCCCTTCATTTGTACTTTGGA |

TABLE 8-continued

| SEQ ID | Origin | Unigene | Locus | GI | Nominal Description | Strand | Probe Sequence |
|---|---|---|---|---|---|---|---|
| 6347 | Table 1 | Hs.111583 | BF197608 | 11088855 | 602365742F1 cDNA, 5' end/ clone = IMAGE: 4473923/ clone_end = 5' | −1 | ACTGCCAGTGAAGACTGTAAAGACAG AACACACTATTTTGGAGGGAGGAT |
| 6348 | Table 2 | NA | BF197762 | 11087169 | 7p91f02.x1 NCI_CGAP_Skn1 cDNA clone IMAGE: 3653139 3', mRNA sequence | −1 | AGGAAGAGCCTGCACCTGTGGTGGA ACAATCAGGGAAAAGGAAGTCAAAA |
| 6349 | Table 2 | Hs.50785 | BF221780 | 11128957 | SEC22, vesicle trafficking protein (S. cerevisiae)-like 1 (SEC22L1), mRNA/cds = (119, 766) | −1 | TTTGGAGCTTCTATAGGAGTGGAGAG GGGCAGCTCATTGTTGAGAGTTGC |
| 6350 | Table 1 | Hs.250811 | BF432643 | 11444806 | v-ral simian leukemia viral oncogene homolog B (ras related; GTP binding protein) (RALB), mRNA/cds = (170, 790) | −1 | TGATCTGACTGGAAAACAATCCTGTA TCCCCTCCCAAAGAATCATGGGCT |
| 6351 | Table 1 | Hs.293478 | BF435821 | 11447923 | hypothetical protein FKSG44 (FKSG44), mRNA/cds = (126, 1520) | −1 | CGTTTTCTGAGCATCCGTTGTGCCTT AACATTTTCTGCTTGTCCTTTGGG |
| 6352 | Table 1 | Hs.174104 | BF445405 | 11510543 | 601438710F1 cDNA, 5' end/ clone = IMAGE: 3923643/ clone_end = 5' | −1 | ACTGCTGTTGCATGAATAGATGATAC AAAGCAAGTGATGAGGTTGGTATG |
| 6353 | Table 1 | Hs.295726 | BF447885 | 11513023 | integrin, alpha V (vitronactin receptor, alpha polypeptide, antigen CD51) (ITGAV), mRNA/ cds = (41, 3187) | −1 | AGTGAAAACTGGTACAGTGTTCTGCT TGATTTACAACATGTAACTTGTGA |
| 6354 | Table 1 | Hs.181311 | BF478236 | 11549065 | asparaginyl-tRNA synthetase (NARS), mRNA/cds = (73, 1719) | −1 | TGTCCTCTGAACCTGAGTGAAGAAAT ATACTCTGTCCTTTGTACCTGCGT |
| 6355 | Table 1 | Hs.179703 | BF5077849 | 11591147 | tripartite motif protein 14 (TRIM14), mRNA/cds = (10, 1230) | −1 | CCATTTCCACTACATGCCTTTCCTAC CTTCCCTTCACAACCAATCAAGTG |
| 6356 | Table 1 | Hs.300870 | BF513602 | 11598781 | mRNA; cDNA DKFZp547M072 (from clone DKFZp547M072)/ cds = UNKNOWN | −1 | AATACAGATTCATTTTATTTAAGCGTC CGTGGCACCGACAGGGACCCCAG |
| 6357 | Table 1 | Hs.283022 | BF514341 | 11599520 | triggering receptor expressed on myeloid cells 1 (TREM1), mRNA/ cds = (47, 751) | −1 | GCCTCTTTTCCTGTATCACACAAGGG TCAGGGATGGTGGAGTAAAAGCTC |
| 6358 | Table 1 | Hs.146065 | BF591040 | 11683364 | AL580165 cDNA/clone = CS0DJ005YB18-(3-prime) | −1 | CTGGGGCCGTAGCAAAAATCATGAAA AACACTTCAACGTGTCCTTTCAAT |
| 6359 | Table 1 | Hs.170577 | BF725383 | 12041294 | 602574255F1 cDNA, 5' end/ clone = IMAGE: 4702644/ clone_end = 5' | −1 | CAGACCTGTGGGCTGATTCCAGACT GAGAGTTGAAGTTTTGTGTGCATCA |
| 6360 | Table 1 | Hs.104640 | BF726114 | 12042025 | HIV-1 inducer of short transcripts binding protein (FBI1), mRNA/ cds = (0, 1754) | −1 | AAGGCAACCAACCACATTAGAAGTCT TGGCACTTTGTAACGGAACGGGTA |
| 6361 | Table 1 | Hs.296317 | BF938959 | 12356279 | mRNA for KIAA1789 protein, partial cds/cds = (3466, 4899) | −1 | GAAGTGACACTGACTGTATCTACCCTC TCCTTTTTCTTCATCAGGTGTTCCT |
| 6362 | Table 1 | Hs.28138 | BF940103 | 12357423 | hypothetical protein MGC14158 (MGC14156), mRNA/cds = (82, 426) | −1 | AATTCCAAAGGAGTGATGTTGGAATA GTCCCTCTAAGGGAGAGAAATGCA |
| 6363 | Table 1 | Hs.133372 | BF940291 | 12357611 | AF150127 cDNA/cds = CBCBGA01 | −1 | AGCCCCTCCACCCCACCCAGTACTTT TACAATGTGTTATTAAAGACCCCT |
| 6364 | Table 1 | Hs.304900 | BF980139 | 12347354 | 602288147F1 cDNA, 5' end/ clone = IMAGE: 4373983/ clone_end = 5' | −1 | CCATCCTTGAGAAATGTGGGCACCAA GTCCATAATCTCCATAAATCCAAT |
| 6365 | Table 1 | Hs.8258 | BG054966 | 12512220 | cDNA FLJ14737 fis, clone NT2RP3002273, weakly similar to SCD8 PROTEIN/cds = (77, 1488) | −1 | TATGAGTTTATGCGTTTTCCCAGCCC TCCGAATCACTGACTGGGGCGTTT |
| 6366 | Table 1 | Hs.5122 | BG058599 | 12525258 | 602293015F1 cDNA, 5' end/ clone = IMAGE: 4387778/ clone_end = 5' | −1 | AGTTGGAGCTATCTGTGCAGCAGTTT CTCTACAGTTGTGCATAAATGTTT |
| 6367 | Table 2 | Hs.89104 | BG058739 | 12525527 | 602590917F1 cDNA, 5' end/ clone = IMAGE: 4717348/ clone_end = 5' | −1 | CGTGGGAGGATGACAAAGAAGCATG AGTCACCCTGCTGGATAAACTTAGA |
| 6368 | Table 1 | Hs.166962 | BG149747 | 12661777 | phosphatidylinositol glycan, class F (PIGF), mRNA/cds = (67, 726) | −1 | GTGGTTTGGTCAGCATACACACTTCT CATTTCATTTGATGTACACAGCCA |
| 6369 | Table 1 | Hs.184456 | BG230583 | 12725596 | hypothetical protein (LOC51249), mRNA/cds = (0, 611) | −1 | GTGTGAAGTGACAGCCTTGTGTGTGA TGTTTTCTGCCTTCCCCAAGTTTG |
| 6370 | Table 1 | Hs.3353 | BG236015 | 12749882 | beta-1,3-glucuronyltransferase 1 (glucuronosyltransferase P) (B3GAT1), mRNA/cds = (175, 1179) | −1 | GTCTTTCCCGTCTTTCTTCCTCACCTA TGTAATTTCAGTAGTCTCTCAGC |
| 6371 | Table 1 | Hs.83623 | BG654774 | 13792183 | nuclear receptor subfamily 1, group I, member 3 (NR1I3), mRNA/cds = (272, 1318) | −1 | TGTTTCGTAAATTAAATAGGTCTGGC CCAGAAGACCCACTCAATTGCCTT |
| 6372 | Table 1 | Hs.109007 | BG655723 | 13793132 | 602342214F1 cDNA, 5' end/ clone = IMAGE: 4452602/ clone_end = 5' | −1 | GTGGAAATCAGCACACAACCACAATG ACATTTAAGCACAGGATCATTATT |

TABLE 8-continued

| SEQ ID | Origin | Unigene | Locus | GI | Nominal Description | Strand | Probe Sequence |
|---|---|---|---|---|---|---|---|
| 6373 | Table 1 | Hs.14453 | BG744911 | 14055584 | interferon consensus sequence binding protein 1 (ICSBP1), mRNA/cds = (47, 1327) | −1 | AGAATGGCAGACCTGTTTGCTGAAGT GTTCATAAGATAACAATAGGCTTG |
| 6374 | Table 1 | Hs.2730 | BI084548 | 14502878 | heterogeneous nuclear ribonucleoprotein L (HNRPL), mRNA/cds = (28, 1704) | −1 | TGGGATTTTGTTTTTAAGTCATTTGGT TTGGGGAGGACCTTGTTTATTTT |
| 6375 | Table 1 | Hs.296356 | BI085832 | 14504182 | mRNA; cDNA DKFZp434M162 (from clone DKFZp434M162)/cds = UNKNOWN | −1 | TGGACAAACTGACAGGGACTGCTTTG AAAGACAGGTACTCAGTTGAGTAT |
| 6376 | Table 1 | Hs.132911 | N20190 | 1125145 | MR2-OT0079-290500-007-b03 cDNA | −1 | AAGCCTGTTTTTCACTCTAAAAATTCA AGAGGACACGCTAAGAACGATCA |
| 6377 | Table 1 | Hs.334731 | N58136 | 1202026 | Homo sapiens, clone IMAGE: 3448306, mRNA, partial cds/cds = (0, 2353) | −1 | AGGTTCCCTTTCAAATAAAGATAAAG AATTTGACTTGGGACACTGCCAGA |
| 6378 | Table 1 | Hs.303018 | N94511 | 1266820 | zb80g04.s1 cDNA, 3' end/clone = IMAGE: 309942/clone_end = 3' | −1 | CTGTTCGAAAGTTGGAGACTGCCTGT ACCCAGGTTGATAGTCAATTGTTT |
| 6379 | Table 1 | NA | W68708 | 1377588 | zd35h04.s1 Soares_fetal_heart_NbHH19W cDNA clone IMAGE: 342679 3', mRNA sequence | −1 | AGCAGAGTTAAGTTTAAATTTCCATTC TCACTAGTTTGTGACCTTTGCCA |
| 6380 | Table 1 | NA | W88427 | 1400194 | zh81c11.s1 Soares_fetal_liver_spleen_1NFLS_S1 cDNA clone IMAGE: 416564 3', mRNA sequence | −1 | TGAGTATTGTTGTGGGGCGGGTAT GTCTGTATATAAATCTGTGCAGCCA |
| 6381 | Table 3A | NA | | 36G5 | | 1 | CCCTTGCAGATACATGAGACAGGCA GGGGCTGGAGTCTTGTTCCATCCTG |
| 6382 | Table 3A | NA | | 38F11 | | 1 | GAGTAGTTGTCTTTCCTGGCACTAAC GTTGAGCTCGTGTACGCACTGAAG |
| 6383 | Table 1 | NA | | 37G7 | | 1 | GAGTCCAATCTACACTCTAGTAGTGA AGACAGAAGAGTTGGCATACGAGT |
| 6384 | Table 1 | NA | | 37G8 | | 1 | GGCTGAACTTACTCATTAAGCCACAT AACTTCGAGTCAAGTTCCAGTCTA |
| 6385 | Table 3A | Hs.197345 | | | thyroid autoantigen 70kD (Ku antigen) (G22P1), mRNA/cds = (17, 1846) | 1 | GCTCTCAAGCCTCCTCCAATAAAGCT CTATCGGGAAACAAATGAACCAGT |
| 6386 | Table 1 | NA | | 40E4 | | 1 | AGGAATGCACACATTGCTCCAGGATC ACTGTGAGGATTAAAGGAGATGGT |
| 6387 | Table 3A | NA | | 41E9 | | 1 | AGTAACGGAACAGTTCCCAGTACTCC TGGTTCCTAGGTGAGCAGGTGATG |
| 6388 | Table 3A | Hs.169476 | | | Homo sapiens, glyceraldehyde-3-phosphate dehydrogenase, clone MGC: 10926 IMAGE: 3628129, mRNA, complete cds/cds = (2306, 3313) | 1 | GGTGTGAACCATGAGAAGTTCGACAA CAGCCTCAAGATCATCAGCAATGA |
| 6389 | Table 3A | NA | | 47E5 | | 1 | GGAGGTGTATAGGCTGGGATTTGAAA AGGAAAATAATCAGCGTGGTGCCA |
| 6390 | Table 2 | NA | | 47D11 | | 1 | CCTAGACACCTGCATCAGTCAAGGTC ATGGATATTGGGAAGACAGACAGC |
| 6391 | Table 1 | NA | | 50A11 | | 1 | TCCAGCAGATATAGGAAGCAGTGTAT CTAAACAGACAAATAAAAAGGCCT |
| 6392 | Table 3A | Hs.132906 | | | DNA sequence from clone RP11-404F10 on chromosome 1q23.1–24.1. Contains the 5' end of the SLAM gene for signaling lymphocytic activation molecule a SET (SET translocation (myeloid leukemia-associated)) protein pseudogene, the CD48 gene for CD48 antigen (B-cell membrane protein), the gene for a novel LY9 (lymphocyte antigen 9) like protein and the 5' end of the LY9 gene. Contains ESTs, STSs and GSSs/cds = (41, 1048) | 1 | ATCTAGTGTACGAGACTTGGAGTCAG GCAGTGAGACTGGTGGGGCACGGG |
| 6393 | Table 1 | NA | | 52B9 | | 1 | TGGTTTAATGGAAAATGCTCTGGAAA ATTCTTTTGCAACAGTTCATCGCT |
| 6394 | Table 1 | NA | | 53B1 | | 1 | CACTAAAAGAGTGGGGAGGTGCAGC ACCTGGCTGGGGAACAAGAATATGG |
| 6395 | Table 1 | NA | | 53E3 | | 1 | AAACGAATCACGTGCCTCGAAAGGG ACATATATTGTTCCTTTAAGCATTT |
| 6396 | Table 1 | NA | | 53E10 | | 1 | AAGGGTTCAATTTCTTCTTTGGAAGG TGATGGTAAGGGTGTGGCTCCAGA |
| 6397 | Table 2 | NA | | 53G7 | | 1 | TGGACAATTCCAAGTCCAAGAGGACT GTCTACTTTCGACCTTGTGTGATT |

TABLE 8-continued

| SEQ ID | Origin | Unigene | Locus | GI | Nominal Description | Strand | Probe Sequence |
|---|---|---|---|---|---|---|---|
| 6398 | Table 1 | NA | | | 54F4 | 1 | TTGTGTTAACCTGTTGTCCACGCTAA GATACAAACTTCCCGGAGGAAAGT |
| 6399 | Table 1 | NA | | | 54G9 | 1 | TGTCACAGTGTTCTATTATTTGCCCG GTTCTTAAAGTGAGAGCATCCTGA |
| 6400 | Table 1 | NA | | | 59G1 | 1 | ACAATGATATTGATGAGGCACCCAGT CTTTTCATTTACTCTGAGTGAAGT |
| 6401 | Table 1 | Hs.48320 | | | mRNA for ring-IBR-ring domain containing protein Dorfin, complete cds/cds = (317, 2833) | 1 | AGATCGAGATCTTCAGTCCTCTGCTT CATCTGTGAGCTTGCCTTCAGTCA |
| 6402 | Table 1 | NA | | | 60G8 | 1 | GGCCAGAGACCCTAAGCTGCTTAATA CATTTATACCACATCCTTCTCAGC |
| 6403 | Table 2 | NA | | | 62C9 | 1 | CCCTTGGAATTACTTGTTCAACTTCTT TCTTTCCCACTAGACGGGGACTT |
| 6404 | Table 3A | NA | | | 62F11 | 1 | CTTTGTAGATGCAGAGAGAAGCTATA AGAAACCCCAGTACTTGCCGGGCG |
| 6405 | Table 1 | NA | | | 63E1 | 1 | ACTGCCACATCTGACTTTACAGAATA ACCAATGTAAGTTAAAATAGAGAAAC AG |
| 6406 | Table 2 | NA | | | 65B1 | 1 | AGTCTTGCGAGTCAACTCAGACTCAA ATGTAGAACTGGGAAGGACAGTGC |
| 6407 | Table 2 | NA | | | 65d10 | 1 | AGCACTGTGCAGATGGCTTTAGAAGA TTCAGAACAGAAGCACAATCTGTT |
| 6408 | Table 2 | NA | | | 65D11 | 1 | AGCACTGTGCAGATGGCTTTGGAAGA TTCAGAACAGAAGCACAATCTGTT |
| 6409 | Table 2 | NA | | | 65D12 | 1 | CTATGGAGTCTTGGAGGACACTGGA GTCACCATGCTAACACTGTGCAGAT |
| 6410 | Table 1 | NA | | | 68C9 | 1 | CCCTGTCACCCTTCGTGGCCAGTGC CAGACAGTAACTAGTGGATGCTAAA |
| 6411 | Table 1 | NA | | | 69F8 | 1 | GAGAGAATAGGGTAGAGAGACCGGG ACTTGGGTAGAGATGACCGGGATTC |
| 6412 | Table 1 | NA | | | 69H11 | 1 | AGTGGAAGCTAGGAGAAATATCGAAT GTGTTAGGGACTTTGAAGTTACCA |
| 6413 | Table 3A | NA | | | 70B6 | 1 | CTGCATCTCTCTTTACTACCAGTGATT ACAAAGTGGGGTTTGGTGGGAGT |
| 6414 | Table 3A | Hs.17109 | | | integral membrane protein 2A (ITM2A), mRNA/cds = (139, 930) | 1 | TCTCTGACTTCTTATTACCAAGGACA CTCTATCTGTTGCCTCTTACTCTT |
| 6415 | Table 2 | NA | | | 72D4 | 1 | CAGTTCCCAGATGTGCGTGTTGTGGT CCCCAAGTATCACCTTCCAATTTC |
| 6416 | Table 3A | Hs.234279 | | | microtubule-associated protein, RP/EB family, member 1 (MAPRE1), mRNA/cds = (64, 870) | 1 | AACGACCCTGTATTGCAGAAGATTGT AGACATTCTGTATGCCACAGATGA |
| 6417 | Table 2 | NA | | | 72D8 | 1 | GGGTCCCGAGCCCTTCAAGAGCTAG ATTTACTCAAGTTTGTTCCCTTGCC |
| 6418 | Table 1 | NA | | | 73C4 | 1 | CACTGAAGCCAAACCACAGAAGACTT TTGAGAATGAGGAGACAAATGAGT |
| 6419 | Table 1 | NA | | | 73H4 | 1 | AGGTGAAAATTACTCTTCAGAAGATA GCAGAGTGGATAATGGCCCATCGA |
| 6420 | Table 2 | NA | | | 73A7 | 1 | TGCAGTGAGACTACATTTCTGTCTAA AGAAGATGTGTGAGTTCCGTCGT |
| 6421 | Table 3A | Hs.174228 | | | small inducible cytokine subfamily C, member 2 (SCYC2), mRNA/ cds = (0, 344) | 1 | TCCAGCCAGCCAGCTCATTTCACTTT ACACCCTCATGGACTGGGATTATA |
| 6422 | Table 3A | Hs.3945 | | | CGI-107 protein (LOC51012), mRNA/cds = (84, 719) | 1 | TTTCATACATTGGAACTCCACCTGAC TTTGGACCAACCCCAGAACAGAGC |
| 6423 | Table 1 | NA | | | 75A2 | 1 | AGCACCGGAATACAAAAATGATACTA TGCTGCCCTCCTAGATCTCAGGGA |
| 6424 | Table 3A | Hs.249495 | | | heterogeneous nuclear ribonucleo-protein A1 (HNRPA1), transcript variant 2, mRNA/cds = (104, 1222) | 1 | TGCCCATACACATGAGTATTTGTCTA AAACATGTCTTCTTTGTAGCAGCT |
| 6425 | Table 2 | NA | | | 75B12 | 1 | GCAAATCTAAACTGCAGGAAAATTTT TGCACCCGAAGTATTCAGATCCCT |
| 6426 | Table 2 | Hs.205442 | | | 601439689F1 cDNA, 5' end/ clone = IMAGE: 3924407/ clone_end = 5' | −1 | GGCCCAGTGCTAATGTAACCAATGAT GCCATGTCGATATTGGAAACCATA |
| 6427 | Table 3A | NA | | | 101G7 | 1 | GGGGAAGAACAAGATAATCTAGTGAC CTCACCACAGTCTATGCCCAGGCC |
| 6428 | Table 3A | Hs.179565 | | | minichromosome maintenance deficient (S. cerevisiae) 3 (MCM3), mRNA/cds = (44, 2470) | 1 | AATTCAACTGAAGGCGAGGAATGTTG GTGATGAAGCTGAGATCAGGACTC |
| 6429 | Table 1 | Hs.119640 | | | hBKLF for basic kruppel like factor (LOC51274), mRNA/ cds = (55, 1092) | 1 | CACCTATATCGAAAGTTTGGGCTCAT CTCCCATTGGTGGCAAAGACCTCC |
| 6430 | Table 3A | Hs.215595 | | | guanine nucleotide binding protein (G protein), beta polypeptide 1 | 1 | TGGTGGAAAAGTGTGTCTGTCTGACA ATTACACTCAAGTTTACCTCTGGT |

TABLE 8-continued

| SEQ ID | Origin | Unigene | Locus | GI | Nominal Description | Strand | Probe Sequence |
|---|---|---|---|---|---|---|---|
| | | | | | (GNB1), mRNA/cds = (280, 1302) | | |
| 6431 | Table 1 | NA | | | 105A10 | 1 | ACGATAATACTGTTGGTTACTGCCAT AAATATTGGAAGCTAATGTAAAATGC A |
| 6432 | Table 1 | NA | | | 107G11 | 1 | TTCTCTTATAAAGGACAGCAAGTTTAA AATGGAGCAAGGAGCATTGGAAA |
| 6433 | Table 1 | NA | | | 107H8 | 1 | TGGCCAAAGAATAGAAGCTCTAGACC TTCCTTATTTCTATCGTGAAAACA |
| 6434 | Table 3A | Hs.64239 | | | DNA sequence from clone RP5-1174N9 on chromosome 1p34.1–35.3. Contains the gene for a novel protein with IBR domain, a (pseudo?) gene for a novel protein similar to MT1E (metallothionein 1E (functional)), ESTs, STSs, GSSs and two putative CpG islands/cds = (0, 2195) | 1 | ACATGACCTGTGCAGTGTGTGGCTGT GAATTCTGTTGGCTTTGTATGAAA |
| 6435 | Table 1 | NA | | | 109H9 | 1 | TGACATAACTACCATCCCTGCAACTA ATGAACCCACCCTCACAGCTTCCT |
| 6436 | Table 3A | Hs.80261 | | | enhancer of filamentation 1 (cas-like docking; Crk-associated substrate related) (HEF1), mRNA/cds = (163, 2667) | 1 | GAATGACATAAACCCCCTCCGGTCTG AGGTCCGGCCTTCCAGCTTGTCTC |
| 6437 | Table 3A | Hs.1422 | | | Gardner-Rasheed feline sarcoma viral (v-fgr) oncogene homolog (FGR), mRNA/cds = (147, 1736) | 1 | GCCTTTCTCACTCCATCCCCACCCAA AGTGCTCAGACCTTGTCTAGTTAT |
| 6438 | Table 3A | Hs.333114 | | | AV713318 cDNA, 5' end/clone = DCAAAC09/clone_end = 5' | 1 | TCGTTTTACAACGTCGTGACTGGGAA AACCCTGGCGTTACCCAACTTAAT |
| 6439 | Table 1 | NA | | | 129A12 | 1 | TGTTTTGTTTTCTGAAACGAAATCCTG CTCTGTTGGCCCAGCTAGAACGC |
| 6440 | Table 1 | NA | | | 129F10 | 1 | CAGAAGCTGGATGACGTTGCTCCATC TTCACTCTGTTAATGAGACATGAT |
| 6441 | Table 3A | NA | | | 137D4 | 1 | CACATCTTCCATTCAGCCCTACCATG AAAACCGTACCTCGGGCGCGACCA |
| 6442 | Table 1 | NA | | | 142F9 | 1 | AATTTGCTTTAAATTGAGTTTCCTTGC CATTGCACACTCCTATCTTTCTG |
| 6443 | Table 3A | Hs.250655 | | | prothymosin, alpha (gene sequence 28) (PTMA), mRNA/cds = (155, 487) | 1 | CAGATGACACGCGCTCTCCACCACC CAACCCAAACCATGAGAATTTGCAA |
| 6444 | Table 3A | Hs.249495 | | | heterogeneous nuclear ribonucleo-protein A1 (HNRPA1), transcript variant 2, mRNA/cds = (104, 1222) | 1 | CCCATGCTGTTGATTGCTAAATGTAA CAGTCTGATCGTGACGCTGAATAA |
| 6445 | Table 1 | NA | | | 149G2 | 1 | GACACAGACAGACCAAGCTATAGTCA GACCTGGTTACACACATACACACA |
| 6446 | Table 1 | NA | | | 149A11 | 1 | TGGCAAAGATCACTGAAATTTAGGAC ACCAAAGCTAAAACCCCAAATGCT |
| 6447 | Table 3A | NA | | | 151F11 | 1 | GCTTGTGCTCGAGACCGCTTGCTATA GAAACGCTGAGCTGCTGGTTTATG |
| 6448 | Table 1 | NA | | | 162E8 | 1 | CTGGTTAAAAGCCCCATTACTGACCT TCGCCGCCACCACGCCTATCACTA |
| 6449 | Table 3A | Hs.334330 | | | calmodulin 3 (phosphonylase kinase, delta) (CALM3), mRNA/cds = (123, 581) | 1 | GCATCCACCTCCTTCTCTGTCTCATG TGTGCTCTTCTTCTTTCTACAGTA |
| 6450 | Table 1 | NA | | | 170F7 | 1 | TTAAATCTATCAAGAATTCATCCAAAT TGGTACCCTGCCGGGCCGCCTCG |
| 6451 | Table 2 | NA | | | 170F9 | 1 | AGTGCTGTATTGACTTTGCTCGGCAG TAGATGAAGCTATTCTGAACCCAA |
| 6452 | Table 3A | NA | | | 177A3 | 1 | TGCTGGACAAAGACAATGAGATGATT ATTGGTGGTGGGATGGCTGTTACC |
| 6453 | Table 1 | NA | | | 331A3 | 1 | GTGGAAAAGTCACTACCAGGCTGGC AGGGAATGGGGCAATCTATTCATAC |
| 6454 | Table 1 | NA | | | 331A5 | 1 | AAGGGACAGGGAGCGGGCACAAAAT AAAACTTAGTTTGGTAGAAATTATA |
| 6455 | Table 3A | NA | | | 146C3 | 1 | TCAAAGCACTGGAGATGAGAGCCAG GATGGACCCGAAAAGAATTTTACAG |
| 6456 | Table 1 | NA | | | 146D8 | 1 | CAGGAACATGGCTGCAGCATATAAAA AGAATTGAATTCCATACTTTTGTTAAC CCT |
| 6457 | Table 3A | Hs.153 | | | ribosomal protein L7 (RPL7), mRNA/cds = (10, 756) | 1 | TTGCCATAACCACGCTTGTAGATTAG TTCATTTACTGACTTCAGATTGGG |
| 6458 | Table 1 | NA | | | 158G6 | 1 | TTACAGGCAACCGGAGCATCCAATCA CCTTTCTCTAAGAGAGTACCTCGG |
| 6459 | Table 1 | NA | | | 158H6 | 1 | AAAAGCATCTTCGAGAGGGACTGTCA |

TABLE 8-continued

| SEQ ID | Origin | Unigene | Locus | GI | Nominal Description | Strand | Probe Sequence |
|---|---|---|---|---|---|---|---|
| 6460 | Table 3A | Hs.119598 | | | ribosomal protein L3 (RPL3), mRNA/cds = (6, 1217) | 1 | ATTCTCGACTATTTTCCAACCCGC AAGAAGGAGCTTAATGCCAGGAACA GATTTTGCAGTTGGTGGGGTCTCAA |
| 6461 | Table 1 | NA | | | 158E9 | 1 | AGAGACACCTAAATTACAGATTTGTG AGCTGAGAGCTGGAGTTTTTCATT |
| 6462 | Table 3A | Hs.326249 | | | ribosomal protein L22 (RPL22), mRNA/cds = (51, 437) | 1 | AACAGCAAAGAGAGTTACGAATTACG TTACTTCCAGATTAACCAGGACGA |
| 6463 | Table 3A | Hs.297753 | | | vimentin (VIM), mRNA/cds = (122, 1522) | 1 | AGCGCAAGATAGATTTGGAATAGGAA TAAGCTCTAGTTCTTAACAACCGA |
| 6464 | Table 3A | NA | | | 155H10 | 1 | GCATGGACAAGATGCCAAGGCCCGG ATGCTTTAGGATGAAGTTCTTATCT |
| 6465 | Table 3A | Hs.108124 | | | cDNA: FLJ23088 fls, clone LNG07026/cds = UNKNOWN | 1 | CCTCCAGTCACCATACACAGGTTACC AGTGTCGAACTTGATGAAATCAGT |
| 6466 | Table 1 | NA | | | 159F8 | 1 | CCAAACATCTGGACTTGTGACTGTAA AAGGGGAGGAGGTAGCCAATGATT |
| 6467 | Table 3A | NA | | | 166F3 | 1 | TTATGGTGGTCGGGGTGGGTGGTAG TTCAATGGGAGGTATGGGATTTATT |
| 6468 | Table 1 | NA | | | 166F6 | 1 | AGCTGTCTGGCTCAAAGATCTACATT CTGAAGTTGGCTGGAAATGTCTTG |
| 6469 | Table 1 | Hs.8121 | | | Notch (Drosophila) homolog 2 (NOTCH2), mRNA/cds = (12, 7427) | 1 | CTGGTTCCTACCAGTGCCAGTGCCTT CAGGGCTTCACAGGCCAGTACCTC |
| 6470 | Table 2 | Hs.25130 | | | cDNA FLJ14923 fls, clone PLACE1008244, weakly similar to VEGETATIBLE INCOMPATI- BILITY PROTEIN HET-E-1/cds = UNKNOWN | 1 | TGACACAGACTGTTTCAATCTTGGAG CAGCGACTGACTTTGACAGAAGAT |
| 6471 | Table 1 | NA | | | 188A9 | 1 | TGCTATTTAAAGCACCATGATAAATAT GAGGCCACTTGGAAATCCATCCA |
| 6472 | Table 1 | NA | | | 171F11 | 1 | GCAGGCGATGCTCTATAATCTAAAAT GTATCTCTCTTTCCCTAAGCTGAA |
| 6473 | Table 3A | NA | | | 171G11 | 1 | AAGTAAGACCACCTGTGAACTTGATC ATTATCTGGCGCACATAGGAAGAT |
| 6474 | Table 1 | NA | | | 175D1 | 1 | GCTGGGGCTGGGAATTGCGTGGGCT AATGTGTCATTTGACTTAAGAAACT |
| 6475 | Table 1 | NA | | | 182H1 | 1 | TTTGGGAAGAACCGATTGCTAAATTA TGCCTAATTCATGTCAGAAGAGGG |
| 6476 | Table 3A | NA | | | 184B5 | 1 | AAGCAGTATACCATTTATATAGCAAA CAGCCAGTGGCCAGTTCACTGTAT |
| 6477 | Table 3A | NA | | | 184D2 | 1 | CTGCCCTTTGGTAGTGAGAGGACCA CGCCAATGATGCTTTTAAGTAACCT |
| 6478 | Table 1 | NA | | | 184H1 | 1 | CATTTCTTCATCTCTAAGGCACACTT GCTACCCCTCTTTGCTGACCCCAG |
| 6479 | Table 1 | NA | | | 46D1 | 1 | GCCTGCGTGTCTGTCTCAGTGTTTCC TGGTCCTCCTCTAAGTACTCTAAA |
| 6480 | Table 1 | NA | | | 98C1 | 1 | AATCCTAGACATGTGCTTGTCATTGC TCCCATGAAGGTAGTTTTCAAACA |
| 6481 | Table 1 | NA | | | 98C3 | 1 | ACCAATAGAGAAGAAGCTCTAGAAGA CAAAATCCCAAACCTTGGCACAAA |
| 6482 | Table 2 | Hs.205442 | | | 601439689F1 cDNA, 5' end/ clone = IMAGE: 3924407/ clone_end = 5' | 1 | GGCTTCAACAGAAACATCAAATGCCA AGACCAGTGAGAGAGCGTCAAAAA |
| 6483 | Table 1 | NA | | | 98H4 | 1 | GCAAGCCCACTAAAATAAACATCTAA CCAGCATCTTTCCCCCATTATAGG |
| 6484 | Table 1 | Hs.169363 | | | GLE1 (yeast homolog)-like, RNA export mediator (GLE1L), mRNA/ cds = (87, 2068) | 1 | ATGGATCTGTTCCTCTGTGCTAAATG TCTTGTGGCAGGGTGTGTTTGTGG |
| 6485 | Table 3A | NA | | | 113F12 | 1 | GCCGTAATGTCTCGGGATCTCTAATA ATAGAGGAGGTGAGTTGTGGTGTC |
| 6486 | Table 1 | Hs.30212 | | | thyroid receptor interacting protein 15 (TRIP15), mRNA/cds = (15, 1346) | 1 | AGGCACTCCTCAACCAGTGTTCACTG AATTCAACTGCTGAAATTGTAACA |
| 6487 | Table 3A | NA | | | 173A10 | 1 | AGAGAGGGTTTTAAGGGAGGGCTTG TGAATACTTGGGAGAATACGGAAGG |
| 6488 | Table 3A | Hs.334853 | | | hypothetical protein FLJ23544 (FLJ23544), mRNA/cds = (125, 517) | 1 | ATGAATTTGAAGACATGGTGGCTGAA AAGCGGCTCATCCCAGATGGCTGT |
| 6489 | Table 3A | Hs.20252 | | | DNA sequence from clone RP4- 646B12 on chromosome 1q42.11– 42.3. Contains an FTH1 (femitin, heavy polypeptide 1) (FTHL6) pseudogene, the gene for a novel Ras family protein, ESTs, STSs, GSSs and a putative CpG islands/ cds = (0, 776) | 1 | TTCCACAGATAGGTAAGCCAGGCGC GGCAAGATGAGACTGTATTCAGTTA |
| 6490 | Table 1 | NA | | | 174D1 | 1 | TCTTGTCCTAGTCATTGTGGCAACCC |

TABLE 8-continued

| SEQ ID | Origin | Unigene | Locus | GI | Nominal Description | Strand | Probe Sequence |
|---|---|---|---|---|---|---|---|
| 6491 | Table 1 | NA | | | 45B9 | 1 | CATCTGACACCTTGTGTAGTACCT TTCTGGCAAGCTCTTGTCATGGTGTT |
| 6492 | Table 1 | NA | | | 45H8 | 1 | CGACACTTCCTTCTGTCTTCTTGG TTTCAACATGGCTAGATCCATCAGAA |
| 6493 | Table 1 | NA | | | 111H6 | 1 | ACTGAAGGCGGGGGAGAAAGCTCTC GGTACTCAAAGGAAATTACTCTTTCT |
| 6494 | Table 1 | NA | | | 111E12 | 1 | CTGGAACCCTGGCAGAAAGTTTTA ATCCTTCCTACCTTTTATTATGAAAGT |
| 6495 | Table 1 | NA | | | 111H11 | 1 | TTTGGTACCTGGCCCGGCGAGCG ATTAAGGTTTTTAACATCTACTTTGGG |
| 6496 | Table 1 | NA | | | 112H3 | 1 | TGATGGAGCCTTCAATGAAGTCA GAAAGACTACGAATTTCGCTGGGAG |
| 6497 | Table 1 | NA | | | 112E9 | 1 | GTAATAGGGAAGCCTTCCACATAAA AAATGAGGTCAGCAATAACCTTGATT |
| 6498 | Table 1 | NA | | | 114G3 | 1 | CGGTCCTCCACTGGCAACATTTTA CTTCTCTCCCTGTAACCAGGCAGTGT |
| 6499 | Table 1 | NA | | | 117H6 | 1 | GTGGGCGGGGCTCAGAACATATCT GTTGCCCTGATCTGGAAATCCTGTTG |
| 6500 | Table 1 | NA | | | 165E7 | 1 | CTTCTTCTGGGATGAAGGAACCTC TAAGATAACCCACAGGCACTTCCTGT |
| 6501 | Table 1 | NA | | | 165E11 | 1 | CATAAAGCCAACGACACAGACCAG ATGGGAACAGGATGTTAAATACACAC |
| 6502 | Table 1 | NA | | | 165F7 | 1 | ATACATACGCACACAAGCGTTGGG CCTCTGCTATCACTAGAGAATGTAGA |
| 6503 | Table 1 | NA | | | 176A6 | 1 | GAATGGAAATGGCTGCCTTTATGC GATACAGATGTGATTATTCAGCCTCA |
| 6504 | Table 1 | NA | | | 176G2 | 1 | AGGGGACTTCTCCATTGCGTAACG TTATTGTTACCAATTAGAATCAGCAAT |
| 6505 | Table 1 | NA | | | 176E10 | 1 | TCAACTGTGCGGTGATTTGGCCT TCATCACTTGGGTTAACTAAAGGTTT |
| 6506 | Table 3A | NA | | | 176F11 | 1 | GCGTATCACACAATTACACTACAA TTCATAGTCAAACAAAAGGTAAGATC |
| 6507 | Table 1 | Hs.232400 | | | heterogeneous nuclear ribonucleo-protein A2/B1 (HNRPA2B1), transcript variant B1, mRNA/ cds = (169, 1230) | 1 | ATGCATATACCCACGGCAACAAGG CCCACCCCCTTCCCCTCCATGTGAAG ATTTGGGTGCTTAACATATCATTT |
| 6508 | Table 1 | NA | | | 71F2 | 1 | GGGAGACATGCTGATTCCACTCAAAG ATCTCATAATAAACAGCTTTGGCC |
| 6509 | Table 1 | Hs.172028 | | | a disintegrin and metalloproteinase domain 10 (ADAM10), mRNA/ cds = (469, 2715) | 1 | AAATAAATTTGGAATGGGACATTGTG CTGTTTCACCTTCAATGCTGTTA |
| 6510 | Table 1 | Hs.180610 | | | splicing factor proline/glutamine rich (polypyrimidine tract-binding protein-associated) (SFPQ), mRNA/cds = (85, 2208) | 1 | AGAACAGTCTTGGGTTCAGGGGTGT GATGCCAGAATGTATTTTCGTACCT |
| 6511 | Table 1 | NA | | | 124G4 | 1 | AAGGCGAAGTCAATCCCATCTCCCTG AACCCAACTGCCAGTAGGTAGTTC |
| 6512 | Table 1 | NA | | | 123C8 | 1 | AGTTAAACTGTTGGTGAGGTAGTGTG TCAGGTACTCTGTATATTAGCTCT |
| 6513 | Table 1 | NA | | | 124F9 | 1 | ACTGGATAAACAGAACGGATCAAAGA TAAAAGTATTCTTGTTGCCTGGGC |
| 6514 | Table 3A | NA | | | 127A12 | 1 | GTCCCTTAGGGGAGGGAGAGTTGTC CTCTTTGCCCACAGTCTACCCTCAG |
| 6515 | Table 1 | Hs.50180 | | | 601652275F1 cDNA, 5' end/ clone = IMAGE: 3935610/ clone_end = 5' | 1 | ACTGGACTACTGAACTTTAGAATACT GTCCTAAGGAAATAGGTCTGGGCA |
| 6516 | Table 1 | NA | | | 161E8 | 1 | CAAACAACAAAAGTGGCCTCCATCGC TGTGAGCCTCTCAAGGGACAGGGC |
| 6517 | Table 1 | NA | | | 186E8 | 1 | AAGGTGGCTGGCTTTTATGATACAGT GGTGGTAATGTAGCCCTTTTTGGT |
| 6518 | Table 2 | NA | | | 191F6 | 1 | TGCTCAATTGCCATACATGCACTATA GGCCGGGATAGAAAATCGTCAGCT |
| 6519 | Table 3A | NA | | | 193G3 | 1 | TTCAAGGATGTGACTGATATCTGGTG TGGTTTATTTTGTTTGTTTTGGGG |
| 6520 | Table 1 | NA | | | 194C2 | 1 | AGCTTTGGAAATTTGAACAAGGTGGG GACAAAATCAGGCAATAACAGACT |
| 6521 | db mining | NA | | | 458C6 | 1 | CACTTCCTGAGTGTTTCCTGAGAACA AAGGATCAGAGCTTCGGCTGTGAG |
| 6522 | Table 1 | NA | | | 458E4 | 1 | TTTTCCTTTTCGCTGACTTTCCCACTC ACTGTCTGTCTCTCATTTTCTCT |
| 6523 | Table 1 | NA | | | 458G10 | 1 | GCATGGGAATTGGCTGTCATCACTCA TAGCACGGTGTATAAACTCAAGGA |
| 6524 | Table 1 | NA | | | 459B3 | 1 | GTCCACTCAAGTTACCTGGCTGTCTA TCTTTTGGCTGACCCCTGAAGCGA |
| 6525 | Table 1 | NA | | | 459D2 | 1 | CTAAGTAAGCAAAGAGGCAGAGGGG |

TABLE 8-continued

| SEQ ID | Origin | Unigene | Locus | GI | Nominal Description | Strand | Probe Sequence |
|---|---|---|---|---|---|---|---|
| 6526 | Table 1 | NA | | | 459E6 | 1 | AGGAGGGGAGTGTTTGGTACTGTCC TGGTGCGGTGTTCATGATTATTATGC AGGGTGGAAGTTCAGTATTTGGTC |
| 6527 | Table 3A | Hs.20830 | | | DNA sequence from cosmid ICK0721Q on chromosome 6. Contains a 60S Ribosomal Protein L35A LIKE pseudogene, a gene coding for a 60S Ribosomal Protein L12 LIKE protein in an intron of the HSET gene coding for a Kinesin related protein, the PHF1 (PHF2) gene coding for alternative splice products PHD finger proteins 1 and 2, the gene coding for five different alternatively spliced mRNAs coding for a protein similar to CYTA (CYCY) and identical to a polypeptide coded for by a known patented cDNA, and the first two exons of the gene coding for the homolog of the rat synaptic ras GTPase-activating protein p135 SynGAP. Contains three predicted CpG islands, ESTs and an STS/cds = (163, 2184) | 1 | AGCACATTTGTGCAGAAAGGTTTTGC AGGTATCTGAGGCACTGCTCACCT |
| 6528 | Table 3A | NA | | | 460D5 | 1 | AGAACAACACGGGATTGAAGTGGGA AGAGATGGGACCCTCATTGGATCTG |
| 6529 | Table 1 | NA | | | 480B9 | 1 | GGAACAATAGACCTCTTCACTAGCTC CCTGCTGTTTGATGGTTTGGTTGG |
| 6530 | Table 3A | NA | | | 461A4 | 1 | AGAGGATGACTTTGAGGTAAATGTTT ACGATGCACGGTTTTAGGCGATGT |
| 6531 | Table 1 | NA | | | 461G8 | 1 | GTGTCCTGGGGAGTGAGGAGAGGTG GAGTAGACTCTGAGAGGAGTGAAAA |
| 6532 | Table 1 | NA | | | 461D9 | 1 | AGATCATGTCTGGATTGTGTTTCCTA TTACCTAGAGACGAACACAGATCT |
| 6533 | Table 3A | Hs.80788 | | | chloride channel 7 (CLCN7), mRNA/cds = (38, 2455) | 1 | GTGTCCCAGGACGAGCGGGAGTGCA CCATGGACCTCTCCGAGTTCATGAA |
| 6534 | Table 1 | NA | | | 481H7 | 1 | TGTATGGCTTATAGCCAGAGATGAAA CAGAACCCAAGTTAATATTGCCAG |
| 6535 | Table 1 | Hs.333513 | | | small inducible cytokine subfamily E, member 1 (endothelial monocyle-activating) (SCYE1), mRNA/cds = (49, 987) | 1 | AGGTTTCAGAATCTGGGCCTTACCTT TACAGGTTCAACAAAAGAATGGCA |
| 6536 | Table 1 | NA | | | 483A5 | 1 | AAGATGAGGCGTAGCTCATGTACAAA TGCAGCATTCTCATAAGTGCTTTA |
| 6537 | Table 1 | NA | | | 483B2 | 1 | AGATAGTGGTATTTGGGTGCTGGGCT TGTCTGAACTGAGGAGGTGGGTGC |
| 6538 | Table 1 | NA | | | 483C5 | 1 | CCTTGCACCAGAGACGACTGACATAT ATAGATGGGAGTCACTCATGCGCT |
| 6539 | Table 3A | Hs.40919 | | | hypothetical protein FLJ14511 (FLJ14511), mRNA/cds = (22, 1272) | 1 | GGTGTAGCGTGAAGATCTGGACAGC GCACTACGACCCGGGCCACTGTTTC |
| 6540 | Table 1 | NA | | | 463H5 | 1 | AGAAGCAAACCTGTGAAGCTACTATC GTTTATCATCAGTGTGAATGCACT |
| 6541 | Table 1 | NA | | | 463A7 | 1 | TAGTGATACAATTTGGGGTGCCAGAG GTTGGGGGTAAGGAATTTTGAAGC |
| 6542 | Table 1 | NA | | | 463B10 | 1 | GTGTGGCCTAAGGAACACCTCTTGTG GGGAGTAAGAGCCCAGCCCTTCCTC |
| 6543 | Table 1 | NA | | | 463C7 | 1 | AGATGCGGGCGCAAGCTTATGTCCT GTTATGAGGGTTTAAATTAGATTGG |
| 6544 | Table 1 | NA | | | 463F10 | 1 | TCATAACGCCCTTCAAAACATTGAAT AAAATCAGTGCAAAACATTGAGCA |
| 6545 | Table 1 | NA | | | 464C2 | 1 | TGAGAAAGGAGTTAGCAGAATATTAA CATACCGAGAAGCTGTTGTTAGCA |
| 6546 | Table 1 | NA | | | 464C5 | 1 | CTGGAGACTCAGGTCGCTTAAGTGG AGGGGACGGGCACAGCCATTCCTCC |
| 6547 | Table 1 | NA | | | 464C10 | 1 | AAAGACCTGCCACTTATTTTGGCTC TCATCTGTACTCTTAAGTGTGTGT |
| 6548 | Table 1 | NA | | | 464D8 | 1 | AGACACAGCTGCAGAAAACTTATTCT TTTCAAGCATGCACAGTCACAAAA |
| 6549 | Table 1 | Hs.221695 | | | 7k30d01.x1 cDNA, 3' end/ clone = IMAGE: 3476765/ clone_end = 3' | 1 | CATTCAACAACACAAACCGAGCACCT ACTGTGTGCCACGCCACAGACAAG |
| 6550 | Table 1 | NA | | | 464E7 | 1 | CCTAGGAAACACAGGTCAAAGA AACACAGTCCAACATGTATTCAGA |

TABLE 8-continued

| SEQ ID | Origin | Unigene | Locus | GI | Nominal Description | Strand | Probe Sequence |
|---|---|---|---|---|---|---|---|
| 6551 | Table 1 | NA | | | 464H12 | 1 | ATTC AAACGCAATCTATTTTAGGTTTGAGAT TAGAAGCTGAGGCCAAGGACTCA |
| 6552 | Table 2 | NA | | | 465B3 | 1 | TCCTCCAGATGCATGGTCCGTGAAGA AATTTAATAGCAAAGACGAGAAGA |
| 6553 | Table 1 | NA | | | 465G2 | 1 | GGCTCTCATGCTTATGCCACACATCC TTGATTCTGCTTAGGAGTCTCTGG |
| 6554 | Table 1 | NA | | | 465H5 | 1 | AAGCCTGAGCTAACAAGAGCTGAGG ACAGTAGCTTATTCCTCTTTATGGG |
| 6555 | Table 1 | NA | | | 465A12 | 1 | TGGATGATGGGATTGGATAAGCATGT GGACTGGATTGTGTTACAAACTCT |
| 6556 | Table 1 | NA | | | 465F7 | 1 | TGCTGTTTCTAGGATTAACACGAAAT CATCACTTTGCCATATTTTGAGCT |
| 6557 | Table 1 | NA | | | 465G8 | 1 | GGCTCAGCACAAAAGAGAATTCGTAG CACTTTCATGTGAAAGCAGACCCA |
| 6558 | Table 1 | NA | | | 465H10 | 1 | GATATTAAGGTACTTTCAGTACAAATC TGGTGCTGTGAGTGGGCTCATCC |
| 6559 | Table 3A | Hs.136309 | | | DNA sequence from clone RP4-612B15 on chromosome 1p22.2–31.1. Contains the (possibly pseudo) gene for a novel protein similar to 60S ribosomal protein L17 (RPL17), the gene for CGI-61, endophilin B1 and KIAA0491, ESTs, STSs, GSSs and two CpG islands/cds = (1011, 1406) | 1 | TCCAGTTTCTCATAAACAAATTCTTCT ATCCTGGCATTTGGATTTGGGTT |
| 6560 | Table 1 | NA | | | 515C12 | 1 | TCATGGTCATAGCTGTAACCTGTGTG AAATAGTAATCAGATCAAAAAGCG |
| 6561 | Table 1 | NA | | | 515H10 | 1 | ATATGTACCTGGAGGGCGGACGATC GAAATTACTAGTGAATTAGCGGCAG |
| 6562 | Table 1 | NA | | | 55G3 | 1 | TGCGAGTGTAATTTCTGTAAGGAGGG TATGGGATAATTAATAGCACGCCT |
| 6563 | Table 1 | NA | | | 55F9 | 1 | GCCCCCAGCATTCAATTCATTTTGTA CCCTTAGTTTAAAGAACTTCTCCC |
| 6564 | Table 3A | NA | | | 99E7 | 1 | AACTTTGCTTTCTGAAGGTTTTGGTG TACCTCGGGCGCGAACACGCTAAT |
| 6565 | Table 1 | Hs.319825 | | | 602021477F1 cDNA, 5' end/ clone = IMAGE: 4156915/ clone_end = 5' | 1 | ATTGACTCCACTTTGTGCCAAGCTCT GCGGGTAGGCATATTTCATATCTT |
| 6566 | Table 1 | Hs.17481 | | | mRNA; cDNA DKFZp434G2415 (from clone DKFZp434G2415)/ cds = UNKNOWN | 1 | CAGTGGAGAAGCTGCACTGTCTCCG GGCTTGTGTGATCCGATCTCTGTAC |
| 6567 | Table 1 | NA | | | 116C9 | 1 | AGCTTTGAAAGTAATGTCTAACCCTG CTGTCAGTTTATCACAAGTGCATT |
| 6568 | Table 1 | NA | | | 128F5 | 1 | AGCTTAATTGAATTGGAGGAGCACCG AACAGGCAGTTTCCTGAGCAGTGG |
| 6569 | Table 1 | NA | | | 135F10 | 1 | GCTCTCACTGATCTCTCTTCTCTATCT CTTTCTGCAGTTATACCAGCACT |
| 6570 | Table 1 | NA | | | 189F3 | 1 | TGAGAAGAGCTGTGAAGGCAGAGGC GGGGCAAGTGCAAAGGTCCTGACTT |
| 6571 | Table 1 | NA | | | 189A8 | 1 | AACTCCCTGTTCAGTTCAGTTGCTAA TGATCTCAAGCTCTTCCCTGATTA |
| 6572 | Table 1 | NA | | | 195H12 | 1 | CAGCCTAATGCCTAACCACACAGATA CCATTGGTGGGCGACGTGACCCAG |
| 6573 | Table 1 | Hs.292457 | | | *Homo sapiens*, clone MGC: 16362 IMAGE: 3927795, mRNA, complete cds/cds = (498, 835) | 1 | CACCATCTTTTGCTCGGATACTAGCC CGCAATACCCACTCACCTACCACC |
| 6574 | Table 3A | NA | | | 466C4 | 1 | AGGGTCTCCACCTTACAGAAGTACAT GAACAACCAGAGATAGCAGGGCTG |
| 6575 | Table 1 | NA | | | 466D1 | 1 | ACCAGGAAAAGTAAAAATCATAGTTG GTGTCTCTCGGGTTTCTCACCTTC |
| 6576 | Table 1 | NA | | | 466G2 | 1 | ATGTATGAGAGAGATTCGAGATGAGT TAAAGGAGGGGAAGGGAGGGGTGGT |
| 6577 | Table 1 | NA | | | 466H5 | 1 | CATGAGTATTGGCACTGGGGTTCAAG TTCCAGGGCAGAGCAGGATAAGAG |
| 6578 | Table 1 | NA | | | 466B7 | 1 | CTCCTGGGGCTGGAGTCCTGGTCTG CCTTCTGGGGACAGAGATTAGGTCG |
| 6579 | Table 2 | NA | | | 466B10 | 1 | TGGAACTTCAGTCAAAAACATCTGTA CTTTGTACAGGACAAAGATTTGGC |
| 6580 | Table 1 | NA | | | 466C9 | 1 | ATAGAACTTGTTTTACCCTATGAG CCTTGCCTTGTATTTATTCACTG TGGC |
| 6581 | Table 1 | Hs.7187 | | | mRNA for KIAA1757 protein, partial cds/cds = (347, 4576) | 1 | ACATCTCTTGTGAAAGTTCAAATGTTA CAGCAAGGTGTAAACACTTCCACT |
| 6582 | Table 1 | NA | | | 121F1 | 1 | GGGTGAATTAATCGGGAGATGGGTA GTCAGGGCAAATGATGGGTGGGTTT |

TABLE 8-continued

| SEQ ID | Origin | Unigene | Locus | GI | Nominal Description | Strand | Probe Sequence |
|---|---|---|---|---|---|---|---|
| 6583 | Table 1 | NA | | | 121A11 | 1 | TGCAATTGTGGAGACAAATTGTTAGAGTTTAAATCCTGGCTCTGTTCCCT |
| 6584 | Table 3A | NA | | | 121F8 | 1 | GGACCTATGTCCTCAAGACATGGAAACTACTAGTTCTGTCGTGCCAGGAG |
| 6585 | Table 1 | NA | | | 178B2 | 1 | AATTAAGGATGCCCTACCGACATCTATCAGCATACCTGGAACAGGTTCGA |
| 6586 | Table 3A | NA | | | 178B5 | 1 | CGGCCAACCCAGGAGGGCAGGTGTTTTGGGCATCTGGTTTATAGTACCTC |
| 6587 | Table 1 | NA | | | 178F5 | 1 | GCTGGGGTGAAAACTTGAAGACTCAGACCTCAGTGGAAACAGATGAATGT |
| 6588 | Table 1 | NA | | | 178C12 | 1 | CCCCAGGCTCTGTGACGCTTGAAATTCTAATTAGCGCAGAAAAGGGCTAA |
| 6589 | Table 1 | NA | | | 462A11 | 1 | CCTGACTACGTGTTTTCCCCACAGACATCACACTGGTTCACCTCGTTGAA |
| 6590 | Table 1 | Hs.13231 | | | od15d12.s1 cDNA/clone = IMAGE: 1368023 | 1 | AATGGAAAGACACTTCTGTATACACTGGAAATCTCAGGAAATTTCTTTTTCC |
| 6591 | Table 1 | NA | | | 462D9 | 1 | GACAGTACAGTACCCTAAGAGCACTGAGGAGGGCCAGGGGACGTGAACTC |
| 6592 | Table 1 | NA | | | 462E8 | 1 | TTTCCTTGGAGATTTCAGGCATCTTAGGCCGGAAGGGACCTCGAAGGTGG |
| 6593 | Table 1 | NA | | | 462F9 | 1 | CTCCGCTTCTTTCACTCATTCGTTTAGTGTTTCTTTAAGCTTTGCCTTGT |
| 6594 | Table 1 | NA | | | 462F11 | 1 | TCCACATTTTGATCATGCATTTATGAAAGCCCTGGGTTTGTTATTGAGAA |
| 6595 | Table 1 | NA | | | 462G12 | 1 | GCTATCTTCTGCTGAATCAGCGTAATGCTGATATACACCCTATTTTCTGT |
| 6596 | Table 1 | NA | | | 462H9 | 1 | AAAAGAAAAGTTTTTCAACCCAGGGAATTTATAGTGGGTGTCAGTCGAGA |
| 6597 | Table 1 | NA | | | 472B1 | 1 | AGGAGACGATGTAGGGGGAAGTGTGTTAGATTGTAATGGAGGGGTTTGGA |
| 6598 | Table 1 | NA | | | 472C1 | 1 | GCTCTTTCCCAGACCCAGCCGCCAGGTTCTCTGTAGAAGAAAATAAATGC |
| 6599 | Table 1 | NA | | | 472E6 | 1 | AAGGAGGAATGGGAATCTCAAGCTCAAGGGCACTCTCACTAATTGTGGGT |
| 6600 | Table 1 | NA | | | 472F4 | 1 | AAATAGCCACCTTCTCCCCATTTTCTGTCAGAACACACACTTTATATCCA |
| 6601 | Table 1 | NA | | | 472G2 | 1 | TTTGGTAAAAGAGATTGGAGGGGACACCAGGGAAACCAGGATTTTCTGGC |
| 6602 | Table 1 | NA | | | 472D7 | 1 | AAGTGCTAAGGCATTCTCTAAACTATCTTTCCAGCTCCGGGCGACAATGG |
| 6603 | Table 1 | NA | | | 472G12 | 1 | CCACTCTCTAAGTCAAGCGAGTCCTTCCTGCATACCTGTACTGGGTGCTG |
| 6604 | Table 1 | Hs.75354 | | | mRNA for KIAA0219 gene, partial cds/cds = (0, 7239) | 1 | GGACTTTGCAGGCTTCATTCCCTGTCTGTGTCTTTTCCTTCTGGTGTGTT |
| 6605 | Table 2 | NA | | | 64G9 | 1 | ATTTGCTGGCCAATCCTGCTGACTATGAATCTTTGGGGGCACTGAGTTAC |
| 6606 | Table 1 | NA | | | 467E5 | 1 | CTGGGGTACTGGGGAAAAGGAACTGGTATTGAGATTTTATATTTGGGGCG |
| 6607 | Table 1 | NA | | | 467A8 | 1 | TTGAGTAAGGCTCAGAGTTGCAGATGAGGTGCAGAGAACATCCTGTGACT |
| 6608 | Table 1 | NA | | | 467C9 | 1 | GGTCACAGAGAGAAATGGTAGCTGAAGAAGCAGGGCACGAGGGCTCTAAC |
| 6609 | Table 3A | NA | | | 467F8 | 1 | TTTCCGGTATATTCGTGTGGGTTGACTTTTTGTGTGTGTGGTTGTGGTGG |
| 6610 | Table 1 | NA | | | 468E6 | 1 | GGATCTCTTGCTCCTCTCACCTGTGTGACAGACTACTAACAGCCCAACTG |
| 6611 | Table 1 | NA | | | 468B9 | 1 | ACAGTGTGGGACAGAAGAGTGCTCAGTGATTAAATGCCTGATAATAGATT |
| 6612 | Table 1 | NA | | | 468E10 | 1 | CTCTCTCGCAATTTACAACCGCTTTCAGTACCATTCACCGTCACTCCTCT |
| 6613 | Table 1 | NA | | | 468F10 | 1 | CTTTGGGGAGTGGAGTTGTTGTAGATGGGGAGAGAATCAGAACAAGGAGA |
| 6614 | Table 1 | NA | | | 468F11 | 1 | CCTTACTGCTTACGGTCATCGGTCATCAGCCCAACCCGCTTGGTTAGGTG |
| 6615 | Table 1 | NA | | | 468G12 | 1 | AGAGTATAATTTCCCCAGTGTGGAGTGGTTAGTGTTGCTAAAGAAGAGGT |
| 6616 | Table 1 | NA | | | 468H11 | 1 | CTGTGTCGTGTCTGCACTCACCTGGTCATGTGTTCTGTTGTGCGGTAGT |
| 6617 | Table 1 | NA | | | 469B6 | 1 | AGGGGCAGAGAAGAATCCACACTCACAAGAGATGACCAGGAGTAAAACTG |
| 6618 | Table 1 | NA | | | 469D2 | 1 | CCCAGCAGAGGCCAACAAGCAGCCATACCCAAACTTCAGCCAAAATAAAA |
| 6619 | Table 1 | NA | | | 469A10 | 1 | TGTGCAAATACGGCAGAGAAGAAGTGCATGAGAAAGTGCTTTATAAGCTGT |
| 6620 | Table 1 | NA | | | 469E12 | 1 | CCAGCTTTTCCTTTGATGTTAGTTAGCAGTAAGTCACAGGTTTGAGCCCC |

TABLE 8-continued

| SEQ ID | Origin | Unigene | Locus | GI | Nominal Description | Strand | Probe Sequence |
|---|---|---|---|---|---|---|---|
| 6621 | Table 1 | NA | | | 469F8 | 1 | GGCACGCATCCTCATTCCTGCATGCT CTTAGAATATCTATCAATGATCAT |
| 6622 | Table 1 | NA | | | 469G8 | 1 | ACTTCTATACTCAGTGCGCTGTGGGT AACCAAGCAAGCAGGTTTGTTGTC |
| 6623 | Table 1 | NA | | | 470B2 | 1 | GCGGGATGGTGGGAAGACAGACACT GCCTTAGAGCATGAATAATTGAAGA |
| 6624 | Table 1 | Hs.118174 | | | tetratricopeptide repeat domain 3 (TTC3), mRNA/cds = (2082, 7460) | 1 | AGGTAGACTATTTAGCTGGAAGCATC CAAACAGGGGATTTTAAAAATACTCA |
| 6625 | Table 1 | NA | | | 470C3 | 1 | AAAATGTAGGTTAAAACTCTCACTTAA GAAGGAGAAGATCTGAGTAAACCCA |
| 6626 | Table 1 | NA | | | 470D5 | 1 | ACCTGAACAATGAATGAAGAAAGGAA GACTTGGTTCTTCTAGCTCTGGAC |
| 6627 | Table 1 | NA | | | 470E1 | 1 | CATGGCTCACAAGCTCTAACACTCCC CTCCCTCCAGATCCTAAGAAGAAG |
| 6628 | Table 1 | NA | | | 470E5 | 1 | TCTGAGCTTCACTTCAAGAACTGGTA GTCCAAAAGAACTGGTTCGTTCAG |
| 6629 | Table 1 | NA | | | 470F3 | 1 | ACTTCACTCACTTTTTAGCCTGTTCAT ATGAGCTTGTCAGTGCTTTTGTT |
| 6630 | Table 1 | NA | | | 470G6 | 1 | TGAGGAGGATGGGAGGCGCACAGGC AATTTAGCTAGATATAGAAAGAGAA |
| 6631 | Table 1 | NA | | | 470B8 | 1 | AGCTGATTTGGATTCTTGCGGTTTGC ATCGGTCTAATTTATCAAGTGTGT |
| 6632 | Table 1 | NA | | | 470G10 | 1 | TCCATCCTTGGAAGCTTGACAAGCAT TCACACTACTGGCTCACCTACTAT |
| 6633 | Table 1 | NA | | | 471D6 | 1 | TAGCACTGTAGCCAGAGTCCCTGCTT GTACCAGGAAGCTGGGTGGTGGTT |
| 6634 | Table 1 | NA | | | 471F1 | 1 | TGGATAGCAGAATTACGTGTTTTGT GGATTGGGGAGGGAGGGGAGGAAA |
| 6635 | Table 1 | NA | | | 471F4 | 1 | GCACTCCTGGAACCTTCTCACTAATT CGGGGACCAGTTTTGTGAATGTTG |
| 6636 | Table 1 | NA | | | 471F6 | 1 | TTGCTGCGGATGACCTGACTGAGCC CTGGGAGACTGTGCTATAATCTCTC |
| 6637 | Table 1 | NA | | | 471E9 | 1 | AGAAGGAGGATCTGTTCTAAACATCT GCGAGGGGAGGACAAAGCATTGAA |
| 6638 | Table 1 | NA | | | 471E11 | 1 | CTGCATCTGAGTGAAGATGAACCTT TCTTTCCCAGCCCTGAGAGAGGGA |
| 6639 | Table 1 | NA | | | 471H11 | 1 | GTCTAGCTGGCAGGTGATGGATGAAT GGATGAGCTGGCAGACCAACAGAA |
| 6640 | Table 1 | NA | | | 473E4 | 1 | TGCATGGAAATGTTTCGAGTACGGGG AAAATAAGGGAGCCAAAACTGTGT |
| 6641 | Table 1 | NA | | | 473F3 | 1 | TTTTAAGGTGTGACTCAATTTACAGG CATTCTGTATTTTTGCGATTTGGT |
| 6642 | Table 1 | NA | | | 473E11 | 1 | ACCTTTGGGAGAAAGTCTTACAACTA CATGAAATGCAGATTTATGGACTC |
| 6643 | Table 1 | NA | | | 476C1 | 1 | GAAGGGACAGAACAATCAACTGTGA GAGATGGGAAGAAAACTCAAATGGA |
| 6644 | Table 1 | NA | | | 476D3 | 1 | CTAGTTTGGGGACTTTCATTGGGCAC GTGAATCCAGGAGGGCTGAATTTT |
| 6645 | Table 1 | NA | | | 476F5 | 1 | GGCCCAGATTGTAGACAGCATAAAAA TAATTTTGGGCTTTTCCTGTTAAA |
| 6646 | Table 1 | NA | | | 476G3 | 1 | CTGGGCTTCTTGTGTGAGAAGCACC GCAGCCAAGAACAACCAGTGCAACT |
| 6647 | Table 2 | NA | | | 476G4 | 1 | GAAGGGGGATTCGGTGATGGGGGAA GCCAAGGGACAAGGGAAAAAGGAAA |
| 6648 | Table 1 | NA | | | 476A10 | 1 | AACCCAACCATGAAAAAGAAGA AGCTCTGGACTACGGCCAGGCGTG GGAG |
| 6649 | Table 1 | NA | | | 476G8 | 1 | TGGCTATTTGAGTTTTCTCTTACATGA AATGCCTGGCAACGTACACTGGC |
| 6650 | Table 1 | NA | | | 476H10 | 1 | TGAACTCTGATTTCCGCCGAAACTAG GAGGAAACACCCAAAAGAAGACGG |
| 6651 | Table 2 | NA | | | 477E1 | 1 | TTTGCTGGGACTAAAATCAAAACTGC ACTGCAGAGCAGGTGAGGGTTCAT |
| 6652 | Table 1 | NA | | | 477E6 | 1 | TGGAGAGTGTGTGTATTACCATTTTTT TACATTGCATCACATTTTACCATCTAT ATCT |
| 6653 | Table 2 | NA | | | 477A11 | 1 | TTTGAAGCCCCTCATAGAGAAGAGAC TGTACCATAAGAGAAGCCCACTCA |
| 6654 | Table 1 | NA | | | 477D9 | 1 | AACTCTCAGTCCATGAGCTTGATTAC TCCATTGTACCATTTGGAAGCCCA |
| 6655 | Table 1 | NA | | | 477D10 | 1 | GTGGGTAGCCATTAAGTGGTCTGGC ACAGAAAGGGACAAGTAGCTTCAAG |
| 6656 | Table 2 | NA | | | 480A3 | 1 | CTGGTGCTGAGTGGAGTCACAGTAA GGCTGTAGATGGAGCGCCCTGGGAA |
| 6657 | Table 1 | NA | | | 480B5 | 1 | TTTTGATGTGACCAGTCGTGCATGGC |

TABLE 8-continued

| SEQ ID | Origin | Unigene | Locus | GI | Nominal Description | Strand | Probe Sequence |
|---|---|---|---|---|---|---|---|
| 6658 | Table 1 | NA | | | 480D2 | 1 | GGGGGACAGGAGCTTAGGGGGAAT ATTATGCATGTCGAGGGGACAACTTT |
| 6659 | Table 1 | NA | | | 480E2 | 1 | TATTAAACAGGAGGGGTGTGTCTT TGGTCATGTTTCCCTCTTTACTCCAC |
| 6660 | Table 1 | NA | | | 480E3 | 1 | GACAGTTTCATTATTGTAACCAGG TTCTGTTGGTTATATGAATGGCAGTT |
| 6661 | Table 1 | NA | | | 480F3 | 1 | ATTGTCTCCCAGTGTGTGGGTTCT AGTCCTGGCAACTTTACCTGGGAATT |
| 6662 | Table 1 | NA | | | 480G4 | 1 | GTCTGTAATCTTTAAGCAGTGGCG AGGACTTATCTAGCTTTCACAGATTC |
| 6663 | Table 1 | NA | | | 480C8 | 1 | AGAGTGCGTTTCAAACATCATTGT TTTAACAGGCTTATCTAGGACATAGG |
| 6664 | Table 1 | NA | | | 480D9 | 1 | CCCAAGAGGGGAGGAGGAGGAAGGC CTCCAGGCCGAACGAGCCTCCACTC |
| 6665 | Table 1 | NA | | | 480E7 | 1 | TGGATTAAGATCTGTCATCTTGACA GCAGGACTTGTGGCAGGACTCAACG |
| 6666 | Table 1 | NA | | | 480E11 | 1 | GGAGAGAAAGAGGCTGAAACATAAA AAGAACATCCCAACTTTTCCGGTAGG |
| 6667 | Table 1 | NA | | | 480F8 | 1 | CAAGTGTCAAGTCACCTGGACAAT TCTGTGGCTTGTTGTGGGACCCCTGC |
| 6668 | Table 1 | NA | | | 487F11 | 1 | GCCCTTTAAATTAGGGCATATTTA GCGCTAAAAACCTGGTGATTAAATGA |
| 6669 | Table 3A | NA | | | 499G1 | 1 | CAAACAGAACGTGAGAAGAGATTT TCCTGCACACAACAAATAAAGACAAG |
| 6670 | Table 1 | NA | | | 518F10 | 1 | AATAAAGGGCCACCCATCAGTAGC ATGTTGTTCAAATTAAACATCATACCA |
| 6671 | Table 3A | NA | | | 524A12 | 1 | CATGGGGGCAGCTACCAATTTTT TAATATGAAAAGCTGGAAAAGAATTA |
| 6672 | Table 1 | NA | | | 526B9 | 1 | AGGGGTTGAGGAGACGTGCCGGGT GTTACCCTGACGAATGCAGTCCTCGT |
| 6673 | Table 1 | NA | | | 583B5 | 1 | GTGGAATGTCTATGCCCTCTTGAG ACACCAGCAGTCATAGGGGAAAGGG |
| 6674 | Table 1 | NA | | | 583D6 | 1 | GAATACAGTTAATTGGGTATTTGTT ACTCCCTCCCATCTCTGGTCTTTAGT |
| 6675 | Table 1 | NA | | | 583G8 | 1 | TGGAAGCAAGCTTTCGGACAACGG TCCAACAAGGGTTACGGCAGAATTTA |
| 6676 | Table 3A | NA | | | 584A1 | 1 | TGCGAAAGTCTTCTTTGGGCTAAA TTGTTCTGCTCAGGCCAAGGATTGTT |
| 6677 | Table 1 | NA | | | 584D3 | 1 | GTGTGCTCTGTATTTGCTGCTTTG GGCCCGGCATGTCTTCGTTTTGTCAG |
| 6678 | Table 3A | NA | | | DNA sequence from clone RP4-620E11 on chromosome 20q11.2–12 Contains 1 | 1 | TCCTCATCCAATCCATCTTCATAT GTGGGTTTTTAGACACCTGCAGCAAG AAGAAATACTGACTGACTAGGCAT |
| 6679 | Table 3A | NA | | | 591H9 | 1 | TTTTAAAGAAAAATCTATTATCTTGGA GCATGGATGGGGGAATGCGAAGG |
| 6680 | Table 3A | Hs.6179 | | | DNA sequence from clone RP3-434P1 on chromosome 22 Contains the KCNJ4 gene for inwardly rectifying potassium channel J4 (hippocampal inward rectifier, HIR, HRK1, HIRK2, KIR2.3), the KDELR3 gene for KDEL (Lys—Asp—Glu—Leu) endoplasmic reticulum protein retention receptor 3, the DDX17 gene for DEAD/H (Asp—Glu—Ala—Asp/His) box polypeptide 17 (72kD), ESTs, STSs, GSSs and slx putative CpG islands/cds = (307, 2259) | 1 | CAGAAGAAACATGGCAAACTGCTCTG TGCTTTCAAACCAAAGTGTTCCCC |
| 6681 | Table 1 | Hs.44577 | | | 602388170F1 cDNA, 5' end/ clone = IMAGE: 4517129/ clone_end = 5' | 1 | GTTACTTAAGATCAGTATGTGTGGTG CATATGTGATTTCGACCATTCAGT |
| 6682 | Table 3A | Hs.108124 | | | cDNA: FLJ23088 fls, clone LNG07026/cds = UNKNOWN | 1 | GAGAATTTCCGTCTGATCTATGACAC CAAGGGTCGCTTTGCTGTACCTCG |
| 6683 | Table 1 | NA | | | 119F12 | 1 | CTGGGTTAATACTCACCAACTTTGAG AAGGTTGGTCTCTGCTCTTCTGTA |
| 6684 | Table 1 | NA | | | 119G10 | 1 | GGAAAGACAGGTGAGTGTGCCACAA CTACCTAACACATCAGCAAATCTGG |
| 6685 | Table 1 | NA | | | 485A8 | 1 | GTCACTTTAGCGAGCGGGAAAACAAT GGCGGAAAGGGAAAACCTGGAAAG |
| 6686 | Table 1 | NA | | | 485D5 | 1 | CGATAAGCTGTGGTGTTGGGAGTGA GAGATGTTACTTTGCGAATGTTCAA |
| 6687 | Table 1 | NA | | | 489H9 | 1 | AAAGGCTAGGTTTGCGAAAGCCCTTC TAAAACTATGCTTTGGTGGTTACT |

TABLE 8-continued

| SEQ ID | Origin | Unigene | Locus | GI | Nominal Description | Strand | Probe Sequence |
|---|---|---|---|---|---|---|---|
| 6688 | Table 2 | NA | | | 494B11 | 1 | CTGACCCTGCGGGGCGGAAGATAAA ACAAAAACGAGAAGAACAAGCAAGA |
| 6689 | Table 1 | NA | | | 478E5 | 1 | AAGATTGTAAAAATACATTTTAGGCTC AAGAGTTCCAGGGGTTTCAGAGC |
| 6690 | Table 1 | NA | | | 478G6 | 1 | TGCAAGCTGGCACCTTCACGTTTATT TTTAAAGGGCTTCACATCAAAGAT |
| 6691 | Table 3A | NA | | | 478H3 | 1 | AAACAAAGAAGGAAAATGAAGAGGG GGAAAAGATGAACATCAGGCTGGGT |
| 6692 | Table 1 | NA | | | 478C7 | 1 | TCCAAAGGATGTTCTGGTGTTGCAGC ATGATTTCTGGTGTTAGTCTTTCT |
| 6693 | Table 1 | NA | | | 478G8 | 1 | TTTGTGGGTGCGTGAGAGGGGATTTA TACTCCTTGAGCCATATTTTGTGA |
| 6694 | Table 1 | NA | | | 478H7 | 1 | GGGTTCACAGCATGGGTGGAGGTAA GTAGTATTCTCATTGGTTGGTTAGT |
| 6695 | Table 3A | NA | | | 479B4 | 1 | GACAGTGAGAAGAATATGGAGTAGA GTCCTTTTGGTCTTTGAGGCGGTCA |
| 6696 | Table 1 | NA | | | 479D2 | 1 | AACAGCTGAAGAACAAGAAGGTGAG CTCTGAATGCGTCAGGTGGTCATTC |
| 6697 | Table 1 | NA | | | 479G2 | 1 | GGCTGACCAGTACAGGCTTGGGAAT TTTATGGTTGGGTGGTTTCTACCAA |
| 6698 | Table 1 | NA | | | 479G3 | 1 | GGGGGAGCTATATTACTGATTAAAAC CACCATTTCTTCACCCAACTTATG |
| 6699 | Table 1 | NA | | | 479G5 | 1 | AAGTCTTGTATTATGAGGTACTGGGG CTCTGGGGATATTGAGATGAGAA |
| 6700 | Table 1 | NA | | | 479G6 | 1 | AGTCCTGCTGAATCATTGGTTTATAG AAGACTATCTGGAGGGCCTGATAG |
| 6701 | Table 1 | NA | | | 479H4 | 1 | GGAGCTTCCAGTCTAATAGAAAAGAT GCACTTACGAATAGACTTTGGGTA |
| 6702 | Table 1 | NA | | | 479H5 | 1 | TCTGTGCTCTGTGGACCCGTCACCCT GAGCTCCTCAGTTGCTGAACCATC |
| 6703 | Table 1 | NA | | | 479H6 | 1 | TGCTGGCATGTGGATAGACTTTAGCA AATGGTAGTCATCTTCTAATTTCT |
| 6704 | Table 1 | NA | | | 479G12 | 1 | AATGGGAATCTTAAGGCCTCTCTGGA AAGGGTGTGAGGGGGTCGAGGGGG |
| 6705 | Table 1 | NA | | | 479H12 | 1 | TGCATATTGTCACTGACTGGCTAGGG TCTCTAAATTTATGAAACCTTACA |
| 6706 | Table 1 | NA | | | 482A5 | 1 | GTCAGCAACTAAAAAGGGAGATATAT CTTAGAGAGACTGGAATAAGCAACTC |
| 6707 | Table 3A | NA | | | 483G5 | 1 | GGAAGGACTCAAACTGGCCATAAAG GCAATACGGCATGTTCATTACACCA |
| 6708 | Table 1 | NA | | | 488C4 | 1 | TTTGTTGACTATGAAATAGTGGTCCT GGTTTTAACTCTTTGGGGTTCCCT |
| 6709 | Table 1 | NA | | | 490F10 | 1 | AATTATATTTTAGGCTGATGTGGGTG GTCTGTAATGCTCTCATTTACCCAC |
| 6710 | Table 1 | NA | | | 493C2 | 1 | CTGTGTTTCTGTATGGTATTGCATTTG TCCCGGCCTGTTGGGTTTGGTGG |
| 6711 | Table 1 | NA | | | 58G4 | 1 | TTCATGCTCATTAGGACATTGAACAA ATGGCAGAGTAAGAAAGTTTGGCC |
| 6712 | Table 3A | Hs.169370 | | | DNA sequence from PAC 66H14 on chromosome 6q21–22. Contains FYN (P59-FYN, SYN, SLK) gene coding for two isoforms. Contains ESTs and STSs/cds = (12, 1706) | 1 | GGGAATGGACTCATATGCAAGATTGC TGACTTCGGATTGGCCCGATTGAT |
| 6713 | Table 1 | NA | | | 598H2 | 1 | CAACACATGGGACGGGAAGGAAATC CTTCCGTGTGATTTTGTTAAAAATA |
| 6714 | Table 3A | NA | AA077131 | 1836605 | 7B08E10 Chromosome 7 Fetal Brain cDNA Library cDNA clone 7B08E10, mRNA sequence | 1 | CAGCCACCTCCTCAGGTCAGACAAG CCCAGCACCCCAAATACCACTATCTG |
| 6715 | Table 3A | NA | AA501725 | 2236692 | ng18e12.s1 NCI_CGAP_Lip2 cDNA clone IMAGE: 929806 similar to contains Alu repetitive element; mRNA | 1 | GGCTTCCCTATTACCTCCCAGCGAAA TTCGTAGTCTTTCTCTATGGAGTT |
| 6716 | Table 3A | NA | AA501934 | 2236901 | nh56a10.s1 NCI_CGAP_Pr6 cDNA clone IMAGE: 956346, mRNA sequence | 1 | TGCTGATGTGTTAGGTAGTTGTGGCA CACTCACCTGTCTTTCCTAAATGC |
| 6717 | Table 3A | NA | AA579400 | 2357584 | nf33d05.s1 NCI_CGAP_.3Pr1 cDNA clone IMAGE: 915561 similar to contains Alu repetitive element contains | 1 | TTCATGCTCAGCAAAACAACGTTTTA GGATGGTGAGAGAAGACAAAGTAA |
| 6718 | Table 3A | NA | AF249845 | 8099620 | isolate Slddi 10 hypervariable region I, mitochondrial sequence | 1 | TATTAACCACTCACGGGAGCTCTCCA TGCATTTGGTATTTTCGTCTGGGG |
| 6719 | db mining | Hs.277051 | AI630242 | 4681572 | ad07c09.y1 cDNA/clone = ad07c09-(random) | 1 | TTACCTGCTTTGCATGCTCTCCATCG TCAAAGTCTTCTGGAAACTTAGGC |
| 6720 | db mining | Hs.277052 | AI630342 | 4681672 | ad08g11.y1 cDNA/clone = ad08g11-(random) | 1 | CCCCACCCCAACACATACAAACGTTT CCCACCAATCCTTGAACTGCAAAA |
| 6721 | db mining | NA | AI732228 | 5053341 | nf19e05.x5 NCI_CGAP_Pr1 | 1 | TTCAAGGTCCCAATACCCAACTAACT |

TABLE 8-continued

| SEQ ID | Origin | Unigene | Locus | GI | Nominal Description | Strand | Probe Sequence |
|---|---|---|---|---|---|---|---|
| | | | | | cDNA clone IMAGE: 914240 similar to contains Alu repetitive element, mRNA s | | CGAAGGAAGAAATGGAAATCTATT |
| 6722 | Table 3A | Hs.197803 | AW379049 | 6883708 | mRNA for KIAA0180 gene, partial cds/cds = (0, 2413) | 1 | TGCACAGAACTCTTACTTACATGTCT CATCGAAACTCCAGAACACCGTCG |
| 6723 | Table 3A | Hs.232000 | AW380881 | 6885540 | UI-H-BI0p-abh-h-06-0-UI.s1 cDNA, 3' end/clone = IMAGE: 2712035/clone_end = 3' | 1 | TGCATGTATCCCGGTAATTCAAATCC AATTTCACAGCCACTGCTGAATAT |
| 6724 | Table 3A | Hs.325568 | AW384988 | 6889647 | 602386081F1 cDNA, 5' end/ clone = IMAGE: 4514972/ clone_end = 5' | 1 | TACAGGAAAATGAAACTAGACGGGTG GGGGACACTAGAATGAAAACCAGT |
| 6725 | Table 3A | NA | AW836389 | 7930363 | PM0-LT0030-101299-001-f08 LT0030 cDNA, mRNA sequence | 1 | AGTTTCTGCTTTCAGTGACTGAGGCT TTGCTTTAACCTGGTGACTCCCAA |
| 6726 | Table 3A | NA | AW837717 | 7931691 | CM2-LT0042-281299-062-e11 LT0042 cDNA, mRNA sequence | 1 | TCCCACTTCAAGTTAAGCACCAAAGC AATCACTAATTCTGGAGCACAGGA |
| 6727 | Table 3A | NA | AW837808 | 7931782 | CM1-LT0042-100300-140-105 LT0042 cDNA, mRNA sequence | 1 | CATGGATGGGGGCAGTGGTGTTTCT AGTGTGTGAGGAAGCAGAGCAGATG |
| 6728 | Table 3A | NA | AW842489 | 7936472 | PM4-CN0032-050200-002-c11 CN0032 cDNA, mRNA sequence | 1 | TCACCACAGATGGGAAGATCGTTTCC TGAAAACAGTCTATAAATCACAGA |
| 6729 | Table 3A | NA | AW846656 | 7942373 | QV3-CT0195-011099-001-c09 CT0195 cDNA, mRNA sequence | 1 | CAGACGCTCCAGTGCTGCCGAGGTT AGTGTGTTTATTAGACCTGAAATGA |
| 6730 | Table 3A | NA | AW856490 | 7952183 | PM4-CT0290-271099-001-c04 CT0290 cDNA, mRNA sequence | 1 | CCCTTTAGGCCTCTTGCCCGAACAGT GAACACTAATAGATATCCTAAGCT |
| 6731 | Table 3A | NA | AW891344 | 8055549 | PM2-NT0079-030500-001-a04 NT0079 cDNA, mRNA sequence | 1 | ATGGGGATCATGTTTTATTTTTCTCTA TATAATGGGCCAGTGTGTTCCCA |
| 6732 | Table 3A | NA | BE061115 | 8405765 | QV0-BT0041-011199-039-f09 BT0041 cDNA, mRNA sequence | 1 | AGCTGTAGACCATAAGCCACCTTCAG GTAGTGGTTTGGGAAATCAAGCAA |
| 6733 | Table 3A | NA | BE086076 | 8476469 | PM2-BT0672-130400-008-h09 BT0672 cDNA, mRNA sequence | 1 | TGTACTTATGCTTGTCTTCTCTACCTG TGTACTTATGCTTGTCTTCTCTACCTG |
| 6734 | Table 3A | NA | BE091932 | 8482364 | IL2-BT0733-130400-068-C11 BT0733 cDNA, mRNA sequence | 1 | GGAGGGTGTGGGAAGCAAGAGAAGA ACATTCTGTTAGGGGCAGAGAAGAA |
| 6735 | Table 3A | Hs.173334 | BE160822 | 8823543 | ELL-RELATED RNA POLY- MERASE II, ELONGATION FACTOR (ELL2), mRNA/cds = (0, 1922) | 1 | GCATCTCCAGCTTTCATAGTTACCCA ACTTGTAAACCAGAAGATGTGCTG |
| 6736 | Table 3A | NA | BE163106 | 8625827 | QV3-HT0457-060400-148-h10 HT0457 cDNA, mRNA sequence | 1 | GGCCAGTGCCAGACGGTAGCTAGTT GGATGCTAAAGGTAGAATTTAGATA |
| 6737 | Table 3A | Hs.301497 | BE168334 | 8631159 | arginine-tRNA-protein transferase 1-1p (ATE1) mRNA, alternatively spliced product, partial cds/cds = (0, 1544) | 1 | GGCATTGTAGGGTTGACACCAGC AAAGACTCAGAGTGACTTGAGCAT TGGA |
| 6738 | Table 3A | Hs.172780 | BE176373 | 869102 | 602343016F1 cDNA, 5' end/ clone = IMAGE: 4453468/ clone_end = 5' | 1 | AGCCCATTTGGATATGGCCCATCTTT ACCTAATGGCTACTATAGTGAGGT |
| 6739 | Table 3A | NA | BE177661 | 8656813 | RC1-HT0598-020300-011-h02 HT0598 cDNA, mRNA sequence | 1 | AATCACAGCAGTAACTCCCAGTAGGA AAGATTCTCAAAGGAATAGTTCTT |
| 6740 | Table 3A | NA | BE178880 | 8658032 | PM1-HT0609-060300-001-g03 HT0609 cDNA, mRNA sequence | 1 | AATGGTCAGGCACAGGTAGAATCAAA GTCCTGTATGTATGTTCACACAGA |
| 6741 | Table 3A | NA | BE247056 | 9098807 | TCBAP1D6404 Pediatric pre-B cell acute lymphoblastic leukemia Baylor-HGSC project = TCBA cDNA clone T | 1 | TACCTGAAGGTGTAGAGAGTGCCCG CATCCAGCAAGGCCAACAGCTCCAC |
| 6742 | Table 3A | Hs.11050 | BE763412 | 10193336 | mRNA; cDNA DKFZp434C0118 (from clone DKFZp434C0118); partial cds/cds = (0, 1644) | 1 | CTGTGTTTTTCCCAAAGCAACAATTTC AAACAAAGTGAGAGCCACTGACA |
| 6743 | Table 3A | NA | BF330908 | 11301656 | RC3-BT0333-310800-115-f11 BT0333 cDNA, mRNA sequence | 1 | GACTCCGAGCTCAAGTCAGTCTGTAC CCCCAACCCCTAACCCACTGCATC |
| 6744 | Table 3A | NA | BF357523 | 11316597 | CM2-HT0945-150900-379-g06 HT0945 cDNA, mRNA sequence | 1 | TGTAACTGACTTTATGTATCACTCAAG TCTTGCCTTTACTGAGTGCCTGA |
| 6745 | Table 3A | NA | BF364413 | 11326438 | RC6-NN1068-070600-011-B01 NN1088 cDNA, mRNA sequence | 1 | TCTCTCTAACCAAAACTGTAATCTTCA GGACCAGCAAACTCAGCCCAAGG |
| 6746 | Table 3A | NA | BF373638 | 11335663 | MR0-FT0176-040900-202-g09 FT0176 cDNA, mRNA sequence | 1 | AACTCTTGGTTAAATGGGTTAATAGA GGATTGAACACTTTGTTTGCTGT |
| 6747 | Table 3A | NA | BF740663 | 12067339 | QV1-HB0031-071200-562-h04 HB0031 cDNA, mRNA sequence | 1 | AGAAGCAAACCTGTGAAGCTACTATC GTTTATCATCAGTGTGAATGCACT |
| 6748 | Table 3A | NA | BF749089 | 12075765 | MR2-BN0388-051000-014-b04 BN0386 cDNA, mRNA sequence | 1 | GGACTAACTTCCACCTCCTCTGCTAC TTCCAGCTGCTTCTAATCACACTT |
| 6749 | Table 3A | NA | BF758480 | 12106360 | MR4-CT0539-141100-003-d05 CT0539 cDNA, mRNA sequence | 1 | AGTCTTCCACCCAGCATAGGTATCAC ACAACCAGCTCTGTTTTACTCCTG |
| 6750 | Table 3A | NA | BF773126 | 12121026 | CM3-IT0048-151200-568-f08 IT0048 cDNA, mRNA sequence | 1 | TTAGCTGGTACATTGTTCAGAGTTTA CTGGGAGCCGGTAAGATAGTCACC |
| 6751 | Table 3A | NA | BF773393 | 12121293 | CM2-IT0039-191200-638-h02 IT0039 cDNA, mRNA sequence | 1 | AGCGTGATGCTTCCTCATGTCGGTGA TTTTCTGTTGAGACATCTTCAAGC |
| 6752 | Table 3A | NA | NF805164 | 12134153 | QV1-CI0173-061100-456-f03 CI0173 cDNA, mRNA sequence | 1 | CAGGGTTAACAAAAGTATGGAATTCA ATTCTTTTTATATGCTGCAGCCATGTT CCT |

TABLE 8-continued

| SEQ ID | Origin | Unigene | Locus | GI | Nominal Description | Strand | Probe Sequence |
|---|---|---|---|---|---|---|---|
| 6753 | Table 3A | NA | BF818594 | 12156027 | MR3-CI0184-201200-009-a04 CI0184 cDNA, mRNA sequence | 1 | TGTAATTGATTTCCGCATAAACGGTC ATTACTGGCACCTATGGCAGCACC |
| 6754 | Table 3A | NA | BF827734 | 12171909 | RC8-HN0025-041200-002-F08 HN0025 cDNA, mRNA sequence | 1 | GTGATCCACTTGGAGCTGCTACTGGT CCCATTGAGTCCTATAGTACTTCA |
| 6755 | Table 3A | NA | BF645167 | 12201450 | RC5-HT1035-271200-012-F08 HT1035 cDNA, mRNA sequence | 1 | TGCCATGAAATCTCTATTAATTCTCAG AAAGATCAAAGGAGGTCCCGTGT |
| 6756 | Table 3A | NA | BF869167 | 12259297 | IL5-ET0119-181000-181-b11 ET0119 cDNA, mRNA sequence | 1 | CCCACCTGGCAAATCCTCAAGTGTGA CCCTAGTCATCTTTCTCCTTTTGG |
| 6757 | Table 3A | NA | BF875575 | 12265705 | QV3-ET0100-111100-391-c02 ET0100 cDNA, mRNA sequence | 1 | GCTAAACAGAAAAGAACCTGAAGTAC AGTTCCCGTCTTCAAAGAAGATGC |
| 6758 | Table 3A | NA | BF877979 | 12268109 | MR0-ET0109-171100-001-b02 ET0109 cDNA, mRNA sequence | 1 | ATCCTCCTCCCCTGGGATGGCATAGA AGAGACTTTAAAACCAAATGAGCC |
| 6759 | Table 3A | NA | BF897042 | 12288501 | IL2-MT0179-271100-254-C11 MT0179 cDNA, mRNA sequence | 1 | GTCAGTAAGCTCTGCCTGCCAAGAAG ACACAGTGAGAGGTGTCCACAGTC |
| 6760 | Table 3A | NA | BF898285 | 12289744 | QV1-MT0229-281100-508-e11 MT0229 cDNA, mRNA sequence | 1 | GTTTCCACTTAGTTACTTCTTCCTACC TGCTGTGAAGCTCTGCACCCTGC |
| 6761 | Table 3A | NA | BF899484 | 12290923 | IL5-MT0211-011200-317-f03 MT0211 cDNA, mRNA sequence | 1 | AGAGTAATCCACATCCCAGGGACAGT CACAATGACCTACGGCTTTAGCTG |
| 6762 | Table 3A | NA | BF904425 | 12295884 | CM1-MT0245-211200-662-d02 MT0245 cDNA, mRNA sequence | 1 | GCAGGGCTACACCAAGTCCATTGATA TTTGGTCTGTAGGCTGCATTCTGG |
| 6763 | Table 3A | NA | BF906114 | 12297573 | IL3-MT0267-281200-425-A05 MT0267 cDNA, mRNA sequence | 1 | TCTTCTCTAAAATGCCCTCCTCTCCTT CCTTTTTCCAGACCTGGTTTAAA |
| 6764 | Table 3A | NA | BF926187 | 12323197 | CM2-NT0193-301100-562-c07 NT0193 cDNA, mRNA sequence | 1 | TCGCCATTTGGTAGTTCCACAGTGAC TGCTCTTCTATTTTACGAAGCCAC |
| 6765 | Table 3A | NA | BF928844 | 12326772 | QV3-NT0216-061200-517-g03 NT0218 cDNA, mRNA sequence | 1 | GTAGATTACTATGAGACCAGCAGCCT CTGCTCCCAGCCAGCTGTGGTGTG |
| 6766 | Table 3A | NA | BG006820 | 12450388 | RC4-GN0227-271100-011-d03 GN0227 cDNA, mRNA sequence | 1 | TTTCCTTTTCGCTGACTTTCTCACTCA CTGTCTGTCTCTCATTTTCTCCA |
| 6767 | Table 3A | NA | F11941 | 708260 | HSC33F051 normalized infant brain cDNA cDNA clone c-33f05, mRNA sequence | 1 | TGGTAAGTTTCTGGCAGTGTGGAGAC AGGGGAATAATCTCAACAGTAGGT |
| 6768 | Table 3A | NA | U46388 | 1236904 | HSU46388 Human pancreatic cancer cell line Patu 8988t cDNA clone xs425, mRNA sequence | 1 | CCATGGTGGTGCTTGACTTTGCTTTG GGGCTTAATCCTAGTATCATTTGG |
| 6769 | Table 3A | NA | U75805 | 1938265 | HSU75805 Human cDNA clone f48, mRNA sequence | 1 | TCAGTGGGTGTTGGTTGTCCATTAGT TGAGACTTAGTTGTTGCTCTGGGA |
| 6770 | Table 3A | NA | W27858 | 1307658 | 36f10 Human retina cDNA randomly primed sublibrary cDNA, mRNA sequence | 1 | GGCTGGACAGCAGATGATTCAAATCT CAATACTACATGCCCATTCTGTGG |
| 6771 | Table 3A | NA | | | 38G5 | -1 | CAGGATGGAACAAGACTCCAGCCCC TGCCTGTCTCATGTATCTGCAAGGG |
| 6772 | Table 3A | NA | | | 38F11 | -1 | CTTCAGTGCGTACACGAGCTCAACGT TAGTGCCAGGAAAGACAACTACTC |
| 6773 | Table 1 | NA | | | 37G7 | -1 | ACTCGTATGCCAACTCTTCTGTCTTC ACTACTAGAGTGTAGATTGGACTC |
| 6774 | Table 1 | NA | | | 37G8 | -1 | TGGACTGGAACTTGACTCGAAGTTAT GTGGCTTAATGAGTAAGTTCAGCC |
| 6775 | Table 3A | Hs.197345 | | | thyroid autoantigen 70kD (Ku antigen) (G22P1), mRNA/cds = (17, 1846) | -1 | ACTGGTTCATTTGTTTCCCGATAGAG CTTTATTGGAGGAGGCTTGAGAGC |
| 6776 | Table 1 | NA | | | 40E4 | -1 | ACCATCTCCTTTAATCCTCACAGTGA TCCTGGAGCAATGTGTGCATTCCT |
| 6777 | Table 3A | NA | | | 41E9 | -1 | CATCACCTGCTCACCTAGGAACCAGG AGTACTGGGAACTGTTCCGTTACT |
| 6778 | Table 3A | Hs.169476 | | | *Homo sapiens*, glyceraldehyde-3-phosphate dehydrogenase, clone MGC: 10926 IMAGE: 3628129, mRNA, complete cds/cds = (2306, 3313) | -1 | TCATTGCTGATGATCTTGAGGCTGTT GTCGAACTTCTCATGGTTCACACC |
| 6779 | Table 3A | NA | | | 47E5 | -1 | TGGCACCACGCTGATTATTTTCCTTTT CAAATCCCAGCCTATACACCTCC |
| 6780 | Table 2 | NA | | | 46D11 | -1 | GCTGTCTGTCTTCCCAATATCCATGA CCTTGACTGATGCAGGTGTCTAGG |
| 6781 | Table 1 | NA | | | 50A11 | -1 | AGGCCTTTTTATTTGTCTGTTTAGATA CACTGCTTCCTATATCTGCTGGA |
| 6782 | Table 3A | Hs.132906 | | | DNA sequence from clone RP11-404F10 on chromosome 1q23.1–24.1. Contains the 5' end of the SLAM gene for signaling lymphocytic activation molecule a SET (SET translocation (myeloid leukemia-associated)) protein pseudogene, the CD48 gene for CD48 antigen (B-cell membrane protein), the gene for a novel LY9 (lymphocyte antigen 9) like | -1 | CCCGTGCCCCACCAGTCTCACTGCC TGACTCCAAGTCTCGTACACTAGAT |

TABLE 8-continued

| SEQ ID | Origin | Unigene | Locus | GI | Nominal Description | Strand | Probe Sequence |
|---|---|---|---|---|---|---|---|
| | | | | | protein and the 5' end of the LY9 gene. Contains ESTs, STSs and GSSs/cds = (41, 1048) | | |
| 6783 | Table 1 | NA | | 52B9 | | −1 | AGCGATGAACTGTTGCAAAAGAATTT TCCAGAGCATTTTCCATTAAACCA |
| 6784 | Table 1 | NA | | 53B1 | | −1 | CCATATTCTTGTTCCCCAGCCAGGTG CTGCACCTCCCCACTCTTTTAGTG |
| 6785 | Table 1 | NA | | 53E3 | | −1 | AAATGCTTAAAGGAACAATATATGTC CCTTTTCGAGGCACGTGATTCGTTT |
| 6786 | Table 1 | NA | | 53E10 | | −1 | TCTGGAGCCACACCCTTACCATCACC TTCCAAAGAAGAAATTGAACCCTT |
| 6787 | Table 2 | NA | | 53G7 | | −1 | AATCACACAAGGTCGAAAGTAGACAG TCCTCTTGGACTTGGAATTGTCCA |
| 6788 | Table 1 | NA | | 54F4 | | −1 | ACTTTCCTCCGGGAAGTTTGTATCTT AGCGTGGACAACAGGTTAACACAA |
| 6789 | Table 1 | NA | | 54G9 | | −1 | TCAGGATGCTCTCACTTTAAGAACCG GGCAAATAATAGAACACTGTGACA |
| 6790 | Table 1 | NA | | 59G1 | | −1 | ACTTCACTCAGAGTAAATGAAAAGAC TGGGTGCCTCATCAATATCATTGT |
| 6791 | Table 1 | Hs.48320 | | | mRNA for ring-IBR-ring domain containing protein Dorfin, complete cds/cds = (317, 2833) | −1 | TGACTGAAGGCAAGCTCACAGATGAA GCAGAGGACTGAAGATCTCGATCT |
| 6792 | Table 1 | NA | | 60G8 | | −1 | GCTGAGAAGGATGTGGTATAAATGTA TTAAGCAGCTTAGGGTCTCTGGCC |
| 6793 | Table 2 | NA | | 62C9 | | −1 | AAGTCCCCGTCTAGTGGGAAAGAAA GAAGTTGAACAAGTAATTCCAAGGG |
| 6794 | Table 3A | NA | | 62F11 | | −1 | CGCCCGGCAAGTACTGGGGTTTCTTA TAGCTTCTCTCTGCATCTACAAAG |
| 6795 | Table 1 | NA | | 63E1 | | −1 | CTGTTTCTCTATTTTAACTTACATTGG TTATTCTGTAAAGTCAGATGTGGCAG |
| 6796 | Table 2 | NA | | 65B1 | | −1 | GCACTGTCCTTCCCAGTTCTACATTT GAGTCTGAGTTGACTCGCAAGACT |
| 6797 | Table 2 | NA | | 65D10 | | −1 | AACAGATTGTGCTTCTGTTCTGAATC TTCTAAAGCCATCTGCACAGTGCT |
| 6798 | Table 2 | NA | | 65D11 | | −1 | AACAGATTGTGCTTCTGTTCTGAATC TTCCAAAGCCATCTGCACAGTGCT |
| 6799 | Table 2 | NA | | 65D12 | | −1 | ATCTGCACAGTGTTAGCATGGTGACT CCAGTGTCCTCCAAGACTCCATAG |
| 6800 | Table 1 | NA | | 68C9 | | −1 | TTTAGCATCCACTAGTTACTGTCTGG CACTGGCCACGAAGGGTGACAGGG |
| 6801 | Table 1 | NA | | 69F8 | | −1 | GAATCCCGGTCATCTCTACCCAAGTC CCGGTCTCTCTACCCTATTCTCTC |
| 6802 | Table 1 | NA | | 69H11 | | −1 | TGGTAACTTCAAAGTCCCTAACACAT TCGATATTTCTCCTAGCTTCCACT |
| 6803 | Table 3A | NA | | 70B6 | | −1 | ACTCCCACCAAACCCCACTTTGTAAT CACTGGTAGTAAAGAGAGATGCAG |
| 6804 | Table 3A | Hs.17109 | | | integral membrane protein 2A (ITM2A), mRNA/cds = (139, 930) | −1 | AAGAGTAAGAGGCAACAGATAGAGT GTCCTTGGTAATAAGAAGTCAGAGA |
| 6805 | Table 2 | NA | | 72D4 | | −1 | GAAATTGGAAGGTGATACTTGGGGAC CACAACACGCACATCTGGGAACTG |
| 6806 | Table 3A | Hs.234279 | | | microtubule-associated protein, RP/EB family, member 1 (MAPRE1), mRNA/cds = (64, 870) | −1 | TCATCTGTGGCATACAGAATGTCTAC AATCTTCTGCAATACAGGGTCGTT |
| 6807 | Table 2 | NA | | 72D8 | | −1 | GGCAAGGGAACAAACTTGAGTAAATC TAGCTCTTGAAGGGCTCGGGACCC |
| 6808 | Table 1 | NA | | 73C4 | | −1 | ACTCATTTGTCTCCTCATTCTCAAAAG TCTTCTGTGGTTTGGCTTCAGTG |
| 6809 | Table 1 | NA | | 73H4 | | −1 | TCGATGGGCCATTATCCACTCTGCTA TCTTCTGAAGAGTAATTTTCACCT |
| 6810 | Table 2 | NA | | 73A7 | | −1 | AAGGACGGAACTCACACATCTTCTTT AGACAGAAATGTAGTCTCACTGCA |
| 6811 | Table 3A | Hs.174228 | | | small inducible cytokine subfamily C, member 2 (SCYC2), mRNA/cds = (0, 344) | −1 | TATAATCCAGTCCATGAGGGTGTAA AGTGAAATGAGCTGGCTGGCTGGA |
| 6812 | Table 3A | Hs.3945 | | | CGI-107 protein (LOC51012), mRNA/cds = (84, 719) | −1 | GCTCTGTTCTGGGGTTGGTCCAAAGT CAGGTGGAGTTCCAATGTATGAAA |
| 6813 | Table 1 | NA | | 75A2 | | −1 | TCCCTGAGATCTAGGAGGGCAGCAT AGTATCATTTTTGTATTCCGGTGCT |
| 6814 | Table 3A | Hs.249495 | | | heterogeneous nuclear ribonucleo-protein A1 (HNRPA1), transcript variant 2, mRNA/cds = (104, 1222) | −1 | AGCTGCTACAAAGAAGACATGTTTTA GACAAATACTCATGTGTATGGGCA |
| 6815 | Table 2 | NA | | 75B12 | | −1 | AGGGATCTGAATACTTCGGGTGCAAA AATTTTCCTGCAGTTTAGATTTGC |
| 6816 | Table 2 | Hs.205442 | | | 601439689F1 cDNA, 5' end/ | −1 | TATGGTTTCCAATATCGACATGGCAT |

TABLE 8-continued

| SEQ ID | Origin | Unigene | Locus | GI | Nominal Description | Strand | Probe Sequence |
|---|---|---|---|---|---|---|---|
| | | | | | clone = IMAGE: 3924407/ clone_end = 5' | | CATTGGTTACATTAGCACTGGGCC |
| 6817 | Table 3A | NA | | | 101G7 | −1 | GGCCTGGGCATAGACTGTGGTGAGG TCACTAGATTATCTTGTTCTTCCCC |
| 6818 | Table 3A | Hs.179565 | | | minichromosome maintenance deficient (*S. cerevisiae*) 3 (MCM3), mRNA/cds = (44, 2470) | −1 | GAGTCCTGATCTCAGCTTCATCACCA ACATTCCTCGCCTTCAGTTGAATT |
| 6819 | Table 1 | Hs.119640 | | | hBKLF for basic kruppel like factor (LOC51274), mRNA/ cds = (55, 1092) | −1 | GGAGGTCTTTGCCACCAATGGGAGA TGAGCCCAAACTTTCGATATAGGTG |
| 6820 | Table 3A | Hs.215595 | | | guanine nucleotide binding protein (G protein), beta polypeptide 1 (GNB1), mRNA/cds = (280, 1302) | −1 | ACCAGAGGTAAACTTGAGTGTAATTG TCAGACAGACACACTTTTCCACCA |
| 6821 | Table 1 | NA | | | 105A10 | −1 | TGCATTTTACATTAGCTTCCAATATTT ATGGCAGTAACCAACAGTATTATCGT |
| 6822 | Table 1 | NA | | | 107G11 | −1 | TTTCCAATGCTCCTTGCTCCATTTTAA ACTTGCTGTCCTTTATAAGAGAA |
| 6823 | Table 1 | NA | | | 107H8 | −1 | TGTTTTCACGATAGAAATAAGGAAGG TCTAGAGCTTCTATTCTTTGGCCA |
| 6824 | Table 3A | Hs.64239 | | | DNA sequence from clone RP5-1174N9 on chromosome 1p34.1–35.3. Contains the gene for a novel protein with IBR domain, a (pseudo?) gene for a novel protein similar to MT1E (metallothionein 1E (functional)), ESTs, STSs, GSSs and two putative CpG islands/cds = (0, 2195) | −1 | TTTCATACAAAGCCAACAGAATTCAC AGCCACACACTGCACAGGTCATGT |
| 6825 | Table 1 | NA | | | 109H9 | −1 | AGGAAGCTGTGAGGGTGGGTTCATT AGTTGCAGGGATGGTAGTTATGTCA |
| 6826 | Table 3A | Hs.80261 | | | enhancer of filamentation 1 (cas-like docking; Crk-associated substrate related) (HEF1), mRNA/ cds = (163, 2667) | −1 | GAGACAAGCTGGAAGGCCGGACCTC AGACCGGAGGGGTTTATGTCATTC |
| 6827 | Table 3A | Hs.1422 | | | Gardner-Rasheed feline sarcoma viral (v-fgr) oncogene homolog (FGR), mRNA/cds = (147, 1736) | −1 | ATAACTAGACAAGGTCTGAGCACTTT GGGTGGGGATGGAGTGAGAAAGGC |
| 6828 | Table 3A | Hs.333114 | | | AV713318 cDNA, 5' end/clone = DCAAAC09/clone_end = 5' | −1 | ATTAAGTTGGGTAACGCCAGGGTTTT CCCAGTCACGACGTTGTAAAACGA |
| 6829 | Table 1 | NA | | | 129A12 | −1 | GCGTTCTAGCTGGGCCAACAGAGCA GGATTTCGTTTCAGAAAACAAAACA |
| 6830 | Table 1 | NA | | | 129F10 | −1 | ATCATGTCTCATTAACAGAGTGAAGA TGGAGCAACGTCATCCAGCTTCTG |
| 6831 | Table 3A | NA | | | 137D4 | −1 | TGGTCGCGCCCGAGGTACGGTTTTC ATGGTAGGGCTGAATGGAAGATGTG |
| 6832 | Table 1 | NA | | | 142F9 | −1 | CAGAAAGATAGGAGTGTGCAATGGC AAGGAAACTCAATTTAAAGCAAATT |
| 6833 | Table 3A | Hs.250655 | | | prothymosin, alpha (gene sequence 28) | −1 | TTGCAAATTCTCATGGTTTGGGTTGG GTGGTGGAGAGCGCGTGTCATCTG |
| 6834 | Table 3A | Hs.249495 | | | heterogeneous nuclear ribonucleo-protein A1 (HNRPA1), transcript variant 2, mRNA/cds = (104, 1222) | −1 | TTATTCAGCGTCACGATCAGACTGTT ACATTTAGCAATCAACAGCATGGG |
| 6835 | Table 1 | NA | | | 149G2 | −1 | TGTGTGTATGTGTGTAACCAGGTCTG ACTATAGCTTGGTCTGTCTGTGTC |
| 6836 | Table 1 | NA | | | 149A11 | −1 | AGCATTTGGGGTTTTAGCTTGGTGT CCTAAATTTCAGTGATCTTTGCCA |
| 6837 | Table 3A | NA | | | 151F11 | −1 | CATAAACCAGCAGCTCAGCGTTTCTA TAGCAAGCGGTCTCGAGCACAAGC |
| 6838 | Table 1 | NA | | | 162E8 | −1 | TAGTGATAGGCGTGGTGGCGGCGAA GGTCAGTAATGGGGCTTTTAACCAG |
| 6839 | Table 3A | Hs.334330 | | | calmodulin 3 (phosphonylase kinase, delta) (CALM3), mRNA/ cds = (123, 581) | −1 | TACTGTAGAAAGAAGAAGAGCACACA TGAGACAGAGAAGGAGGTGGATGC |
| 6840 | Table 1 | NA | | | 170F7 | −1 | CGAGGCGGCCCGGCAGGGTACCAAT TTGGATGAATTCTTGATAGATTTAA |
| 6841 | Table 2 | NA | | | 170F9 | −1 | TTGGGTTCAGAATAGCTTCATCTACT GCCGAGCAAAGTCAATACAGCACT |
| 6842 | Table 3A | NA | | | 177A3 | −1 | GGTAACAGCCATCCCACCACCAATAA TCATCTCATTGTCTTTGTCCAGCA |
| 6843 | Table 1 | NA | | | 331A3 | −1 | GTATGAATAGATTGCCCCATTCCCTG CCAGCCTGGTAGTGACTTTTCCAC |
| 6844 | Table 1 | NA | | | 331A5 | −1 | TATAATTTCTACCAAACTAAGTTTTAT TTTGTGCCCGCTCCCTGTCCCTT |

TABLE 8-continued

| SEQ ID | Origin | Unigene | Locus | GI | Nominal Description | Strand | Probe Sequence |
|---|---|---|---|---|---|---|---|
| 6845 | Table 3A | NA | | | 146C3 | −1 | CTGTAAAATTCTTTTCGGGTCCATCC TGGCTCTCATCTCCAGTGCTTTGA |
| 6846 | Table 1 | NA | | | 146D8 | −1 | AGGGTTAACAAAAGTATGGAATTCAA TTCTTTTTATATGCTGCAGCCATGTTC CTG |
| 6847 | Table 3A | Hs.153 | | | ribosomal protein L7 (RPL7), mRNA/cds = (10, 756) | −1 | CCCAATCTGAAGTCAGTAAATGAACT AATCTACAAGCGTGGTTATGGCAA |
| 6848 | Table 1 | NA | | | 158G6 | −1 | CCGAGGTACTCTCTTAGAGAAAGGTG ATTGGATGCTCCGGTTGCCTGTAA |
| 6849 | Table 1 | NA | | | 158H6 | −1 | GCGGGTTGGAAAATAGTCGAGAATTG ACAGTCCCTCTCGAAGATGCTTTT |
| 6850 | Table 3A | Hs.119598 | | | ribosomal protein L3 (RPL3), mRNA/cds = (6, 1217) | −1 | TTGAGACCCCACCAACTGCAAAATCT GTTCCTGGCATTAAGCTCCTTCTT |
| 6851 | Table 3A | NA | | | 158G11 | −1 | AATGAAAAACTCCAGCTCTCAGCTCA CAAATCTGTAATTAGGTGTCTCT |
| 6852 | Table 3A | Hs.326249 | | | ribosomal protein L22 (RPL22), mRNA/cds = (51, 437) | −1 | TCGTCCTGGTTAATCTGGAAGTAACG TAATTCGTAACTCTCTTTGCTGTT |
| 6853 | Table 3A | Hs.297753 | | | vimentin (VIM), mRNA/cds = (122, 1522) | −1 | TCGGTTGTTAAGAACTAGAGCTTATT CCTATTCCAAATCTATCTTGCGCT |
| 6854 | Table 3A | NA | | | 155H10 | −1 | AGATAAGAACTTCATCCTAAAGCATC CGGGCCTTGGCATCTTGTCCATGC |
| 6855 | Table 3A | Hs.108124 | | | cDNA: FLJ23088 fis, clone LNG07026/cds = UNKNOWN | −1 | ACTGATTTCATCAAGTTCGACACTGG TAACCTGTGTATGGTGACTGGAGG |
| 6856 | Table 1 | NA | | | 159F8 | −1 | AATCATTGGCTACCTCCTCCCCTTTT ACAGTCACAAGTCCAGATGTTTGG |
| 6857 | Table 3A | NA | | | 166F3 | −1 | AATAAATCCCATACCTCCCATTGAAC TACCACCCACCCCGACCACCATAA |
| 6858 | Table 1 | NA | | | 166F6 | −1 | CAAGACATTTCCAGCCAACTTCAGAA TGTAGATCTTTGAGCCAGACAGCT |
| 6859 | Table 1 | Hs.8121 | | | Notch (Drosophila) homolog 2 (NOTCH2), mRNA/cds = (12, 7427) | −1 | GAGGTACTGGCCTGTGAAGCCCTGA AGGCACTGGCACTGGTAGGAACCAG |
| 6860 | Table 2 | Hs.25130 | | | cDNA FLJ14923 fis, clone PLACE1008244, weakly similar to VEGETATIBLE INCOMPATI- BILITY PROTEIN HET-E-1/cds = UNKNOWN | −1 | ATCTTCTGTCAAAGTCAGTCGCTGCT CCAAGATTGAAACAGTCTGTGTCA |
| 6861 | Table 1 | NA | | | 188A9 | −1 | TGGATGGATTTCCAAGTGGCCTCATA TTTATCATGGTGCTTTAAATAGCA |
| 6862 | Table 1 | NA | | | 171F11 | −1 | TTCAGCTTAGGGAAAGAGAGATACAT TTTAGATTATAGAGCATCGCCTGC |
| 6863 | Table 3A | NA | | | 171G11 | −1 | ATCTTCCTATGTGCGCCAGATAATGA TCAAGTTCACAGGTGGTCTTACTT |
| 6864 | Table 1 | NA | | | 175D1 | −1 | AGTTTCTTAAGTCAAATGACACATTAG CCCACGCAATTCCCAGCCCCAGC |
| 6865 | Table 1 | NA | | | 182H1 | −1 | CCCTCTTCTGACATGAATTAGGCATA ATTTAGCAATCGGTTCTTCCCAAA |
| 6866 | Table 3A | NA | | | 184B5 | −1 | ATACAGTGAACTGGCCACTGGCTGTT TGCTATATAAATGGTATACTGCTT |
| 6867 | Table 3A | NA | | | 184D2 | −1 | AGGTTACTTAAAAGCATCATTGGCGT GGTCCTCTCACTACCAAAGGGCAG |
| 6868 | Table 1 | NA | | | 184H1 | −1 | CTGGGGTCAGCAAAGAGGGGTAGCA AGTGTGCCTTAGAGATGAAGAAATG |
| 6869 | Table 1 | NA | | | 46D1 | −1 | TTTAGAGTACTTAGAGGAGGACCAGG AAACACTGAGACAGACACGCAGGC |
| 6870 | Table 1 | NA | | | 98C1 | −1 | TGTTTGAAAACTACCTTCATGGGAGC AATGACAAGCACATGCTAGGATT |
| 6871 | Table 1 | NA | | | 98C3 | −1 | TTTGTGCCAAGGTTTGGGATTTTGTC TTCTAGAGCTTCTTCTCTCTATTGGT |
| 6872 | Table 2 | Hs.205442 | | | 601439689F1 cDNA, 5′ end/ clone = IMAGE: 3924407/ clone_end = 5′ | −1 | TTTTGACGCTCTCTCACTGGTCTTG GCATTTGATGTTTCTGTTGAAGCC |
| 6873 | Table 1 | NA | | | 98H4 | −1 | CCTATAATGGGGAAAGATGCTGGTT AGATGTTTATTTTAGTGGGCTTGC |
| 6874 | Table 1 | Hs.169363 | | | GLE1 (yeast homolog)-like, RNA export mediator (GLE1L), mRNA/ cds = (87, 2068) | −1 | CCACAAACACACCCTGCCACAAGACA TTTAGCACAGAGGAACAGATCCAT |
| 6875 | Table 3A | NA | | | 113F12 | −1 | GACACCACAACTCACCTCCTCTATTA TTAGAGATCCCGAGACATTACGGC |
| 6876 | Table 1 | Hs.30212 | | | thyroid receptor interacting protein 15 (TRIP15), mRNA/cds = (15, 1346) | −1 | TGTTACAATTTCAGCAGTTGAATTCA GTGAACACTGGTTGAGGAGTGCCT |
| 6877 | Table 3A | NA | | | 173A10 | −1 | CCTTCCGTATTCTCCCAAGTATTCAC AAGCCCTCCCTTAAAACCCTCTCT |
| 6878 | Table 3A | Hs.334853 | | | hypothetical protein FLJ23544 (FLJ23544), mRNA/cds = (125, | −1 | ACAGCCATCTGGGATGAGCCGCTTTT CAGCCACCATGTCTTCAAATTCAT |

TABLE 8-continued

| SEQ ID | Origin | Unigene | Locus | GI | Nominal Description | Strand | Probe Sequence |
|---|---|---|---|---|---|---|---|
| 6879 | Table 3A | Hs.20252 | | | 517) DNA sequence from clone RP4-646B12 on chromosome 1q42.11–42.3. Contains an FTH1 (femitin, heavy polypeptide 1) (FTHL6) pseudogene, the gene for a novel Ras family protein, ESTs, STSs, GSSs and a putative CpG islands/ cds = (0, 776) | −1 | TAACTGAATACAGTCTCATCTTGCCG CGCCTGGCTTACCTATCTGTGGAA |
| 6880 | Table 1 | NA | | | 174D1 | −1 | AGGTACTACACAAGGTGTCAGATGG GGTTGCCACAATGACTAGGACAAGA |
| 6881 | Table 1 | NA | | | 45B9 | −1 | CCAAGAAGACAGAAGGAAGTGTCGA ACACCATGACAAGAGCTTGCCAGAA |
| 6882 | Table 1 | NA | | | 45H8 | −1 | GAGAGCTTTCTCCCCGCCTTCAGTTT CTGATGGATCTAGCCATGTTGAAA |
| 6883 | Table 1 | NA | | | 111H6 | −1 | TAAAACTTTCTGCCAGGGTTCCAGAG AAAGAGTAATTTCCTTTGAGTACC |
| 6884 | Table 1 | NA | | | 111E12 | −1 | CGCTCGCCGGGCCAGGTACCAAAAC TTTCATAATAAAAGGTAGGAAGGAT |
| 6885 | Table 1 | NA | | | 111H11 | −1 | TGACTTCATTGAAGGCTCCATCACCC AAAGTAGATGTTAAAAACCTTAAT |
| 6886 | Table 1 | NA | | | 112H3 | −1 | TTTATGTGGAAGGCTTCCCTATTACC TCCCAGCGAAATTCGTAGTCTTTC |
| 6887 | Table 1 | NA | | | 112E9 | −1 | TAAAATGTTGCCAGTGGAGGACCGAA TCAAGGTTATTGCTGACCTCATTT |
| 6888 | Table 1 | NA | | | 114G3 | −1 | AGATATGTTCTGAGCCCCGCCCACAC ACTGCCTGGTTACAGGGAGAGAAG |
| 6889 | Table 1 | NA | | | 117H6 | −1 | GAGGTTCCTTCATCCCAGAAGAAGCA ACAGGATTTCCAGATCAGGGCAAC |
| 6890 | Table 1 | NA | | | 165E7 | −1 | CTGGTCTGTGTCGTTGGCTTTATGAC AGGAAGTGCCTGTGGGTTATCTTA |
| 6891 | Table 1 | NA | | | 165E11 | −1 | CCCAACGCTTGTGTGCGTATGTATGT GTGTATTTAACATCCTGTTCCCAT |
| 6892 | Table 1 | NA | | | 165F7 | −1 | GCATAAAGGCAGCCATTTCCATTCTC TACATTCTCTAGTGATAGCAGAGG |
| 6893 | Table 1 | NA | | | 176A6 | −1 | CGTTACGCAATGGAGAAGTCCCCTTG AGGCTGAATAATCACATCTGTATC |
| 6894 | Table 1 | NA | | | 176G2 | −1 | AGGCCAAATCACCGCACAGTTGAATT GCTGATTCTAATTGGTAACAATAA |
| 6895 | Table 1 | NA | | | 176E10 | −1 | TTGTAGTGTAATTGTGTGATACGCAA ACCTTTAGTTAACCCAAGTGATGA |
| 6896 | Table 3A | NA | | | 176F11 | −1 | CCTTGTTGCCGTGGGTATATGCATGA TCTTACCTTTTGTTTGACTATGAA |
| 6897 | Table 1 | Hs.232400 | | | heterogeneous nuclear ribonucleo-protein A2/B1 (HNRPA2B1), transcript variant B1, mRNA/ cds = (169, 1230) | −1 | AAATGATATGTTAAGCACCCAAATCTT CACATGGAGGGGAAGGGGGTGGG |
| 6898 | Table 1 | NA | | | 71F2 | −1 | GGCCAAAGCTGTTTATTATGAGATCT TTGAGTGGAATCAGCATGTCTCCC |
| 6899 | Table 1 | Hs.172028 | | | a disintegrin and metalloproteinase domain 10 (ADAM10), mRNA/ cds = (469, 2715) | −1 | TTAACAGCATTGAAGGTGAAACAGCA CAATGTCCCATTCCAAATTTATTT |
| 6900 | Table 1 | Hs.180610 | | | splicing factor proline/glutamine rich (polypyrimidine tract-binding protein-associated) (SFPQ), mRNA/cds = (85, 2208) | −1 | AGGTACGAAAATACATTCTGGCATCA CACCCTGAACCCAAGACTGTTCT |
| 6901 | Table 1 | NA | | | 124G4 | −1 | GAACTACCTACTGGCAGTTGGGTTCA GGGAGATGGGATTGACTTCGCCTT |
| 6902 | Table 1 | NA | | | 123C8 | −1 | AGAGCTAATATACAGAGTACCTGACA CACTACCTCACCAACAGTTTAACT |
| 6903 | Table 1 | NA | | | 124F9 | −1 | GCCCAGGCAACAAGAATACTTTTATC TTTGATCCGTTCTGTTTATCCAGT |
| 6904 | Table 3A | NA | | | 127A12 | −1 | CTGAGGGTAGACTGTGGGCAAAGAG GACAACTCTCCCTCCCCTAAGGGAC |
| 6905 | Table 1 | Hs.50180 | | | 601652275F1 cDNA, 5' end/ clone = IMAGE: 3935610/ clone_end = 5' | −1 | TGCCCAGACCTATTTCCTTAGGACAG TATTCTAAAGTTCAGTAGTCCAGT |
| 6906 | Table 1 | NA | | | 161E8 | −1 | GCCCTGTCCCTTGAGAGGCTCACAG CGATGGAGGCCACTTTTGTTGTTTG |
| 6907 | Table 1 | NA | | | 186E8 | −1 | ACCAAAAAGGGCTACATTACCACCAC TGTATCATAAAAGCCAGCCACCTT |
| 6908 | Table 2 | NA | | | 191F6 | −1 | AGCTGACCATTTTCTATCCCGGCCTA TAGTGCATGTATGGCAATTGAGCA |
| 6909 | Table 3A | NA | | | 193G3 | −1 | CCCCAAAACAAACAAAATAAACCACA CCAGATATCAGTCACATCCTTGAA |
| 6910 | Table 1 | NA | | | 194C2 | −1 | AGTCTGTTATTGCCTGATTTTGTCCC |

TABLE 8-continued

| SEQ ID | Origin | Unigene | Locus | GI | Nominal Description | Strand | Probe Sequence |
|---|---|---|---|---|---|---|---|
| 6911 | db mining | NA | | | 458C6 | −1 | CACCTTGTTCAAATTTCCAAAGCT CTCACAGCCGAAGCTCTGATCCTTTG |
| 6912 | Table 1 | NA | | | 458E4 | −1 | TTCTCAGGAAACACTCAGGAAGTG AGAGAAAATGAGAGACAGACAGTGA |
| 6913 | Table 1 | NA | | | 458G10 | −1 | GTGGGAAAGTCAGCGAAAAGGAAAA TCCTTGAGTTTATACACCGTGCTATG |
| 6914 | Table 1 | NA | | | 459B3 | −1 | AGTGATGACAGCCAATTCCCATGC TCGCTTCAGGGGTCAGCCAAAAGATA |
| 6915 | Table 1 | NA | | | 459D2 | −1 | GACAGCCAGGTAACTTGAGTGGAC GGACAGTACCAAACACTCCCCTCCTC |
| 6916 | Table 1 | NA | | | 459E6 | −1 | CCCTCTGCCTCTTTGCTTACTTAG GACCAAATACTGAACTTCCACCCTGC |
| 6917 | Table 3A | Hs.20830 | | | DNA sequence from cosmid ICK0721Q on chromosome 6. Contains a 60S Ribosomal Protein L35A LIKE pseudogene, a gene coding for a 60S Ribosomal Protein L12 LIKE protein in an intron of the HSET gene coding for a Kinesin related protein, the PHF1 (PHF2) gene coding for alternative splice products PHD finger proteins 1 and 2, the gene coding for five different alternatively spliced mRNAs coding for a protein similar to CYTA (CYCY) and identical to a polypeptide coded for by a known patented cDNA, and the first two exons of the gene coding for the homolog of the rat synaptic ras GTPase-activating protein p135 SynGAP. Contains three predicted CpG islands, ESTs and an STS/cds = (163, 2184) | −1 | ATAATAATCATGAACACCGCACCA AGGTGAGCAGTGCCTCAGATACCTG CAAAACCTTTCTGCACAAATGTGCT |
| 6918 | Table 3A | NA | | | 460D5 | −1 | CAGATCCAATGAGGGTCCCATCTCTT CCCACTTCAATCCCGTGTTGTTCT |
| 6919 | Table 1 | NA | | | 480B9 | −1 | CCAACCAAACCATCAAACAGCAGGGA GCTAGTGAAGAGGTCTATTGTTCC |
| 6920 | Table 3A | NA | | | 461A4 | −1 | ACATCGCCTAAAACCGTGCATCGTAA ACATTTACCCTCAAAGTCATCCTCT |
| 6921 | Table 1 | NA | | | 461G8 | −1 | TTTTCACTCCTCTCAGAGTCTACTCC ACCTCTCCTCACTCCCCAGGACAC |
| 6922 | Table 1 | NA | | | 461D9 | −1 | AGATCTGTGTTCGTCTCTAGGTAATA GGAAACACAATCCAGACATGATCT |
| 6923 | Table 3A | Hs.80788 | | | chloride channel 7 (CLCN7), mRNA/cds = (38, 2455) | −1 | TTCATGAACTCGGAGAGGTCCATGGT GCACTCCCGCTCGTCCTGGGACAC |
| 6924 | Table 1 | NA | | | 481H7 | −1 | CTGGCAATATTAACTTGGGTTCTGTT TCATCTCTGGCTATAAGCCATACA |
| 6925 | Table 1 | Hs.333513 | | | small inducible cytokine subfamily E, member 1 (endothelial monocyle-activating) (SCYE1), mRNA/cds = (49, 987) | −1 | TGCCATTCTTTTGTTGAACCTGTAAA GGTAAGGCCCAGATTCTGAAACCT |
| 6926 | Table 1 | NA | | | 483A5 | −1 | TAAAGCACTTATGAGAATGCTGCATT TGTACATGAGCTACGCCTCATCTT |
| 6927 | Table 1 | NA | | | 483B2 | −1 | GCACCCACCTCCTCAGTTCAGACAAG CCCAGCACCCAAATACCACTATCT |
| 6928 | Table 1 | NA | | | 483C5 | −1 | AGCGCATGAGTGACTCCCATCTATAT ATGTCAGTCGTCTCTGGTGCAAGG |
| 6929 | Table 3A | Hs.40919 | | | hypothetical protein FLJ14511 (FLJ14511), mRNA/cds = (22, 1272) | −1 | GAAACAGTGGCCCGGGTCGTAGTGC GCTGTCCAGATCTTCACGCTACACC |
| 6930 | Table 1 | NA | | | 463H5 | −1 | AGTGCATTCACACTGATGATAAACGA TAGTAGCTTCACAGGTTTGCTTCT |
| 6931 | Table 1 | NA | | | 463A7 | −1 | GCTTCAAAATTCCTTACCCCCAACCT CTGGCACCCCAAATTGTATCACTA |
| 6932 | Table 1 | NA | | | 463B10 | −1 | GAGGAAGGGCTGGCTCTTACTCCCC ACAAGAGGTGTTCCTTAGGCCACAC |
| 6933 | Table 1 | NA | | | 463C7 | −1 | CCAATCTAATTTAAACCCTCATAACAG GACATAAGCTTGCGCCCGCATCT |
| 6934 | Table 1 | NA | | | 463F10 | −1 | TGCTCAATGTTTTGCACTGATTTTATT CAATGTTTTGAAGGGCGTTATGA |
| 6935 | Table 1 | NA | | | 464C2 | −1 | TGCTAACAACAGCTTCTCGGTATGTT AATATTCTGCTAACTCCTTTCTCA |
| 6936 | Table 1 | NA | | | 464C5 | −1 | GGAGGAATGGCTGTGCCCGTCCCCT |

TABLE 8-continued

| SEQ ID | Origin | Unigene | Locus | GI | Nominal Description | Strand | Probe Sequence |
|---|---|---|---|---|---|---|---|
| 6937 | Table 1 | NA | | | 464C10 | −1 | CCACTTAAGCGACCTGAGTCTCCAG ACACACACTTAAGAGTACAGTGAGA GCCAAAAATAAGTGGCAGGTCTTT |
| 6938 | Table 1 | NA | | | 464D8 | −1 | TTTTGTGACTGTGCATGCTTGAAAAG AATAAGTTTTCTGCAGCTGTGTCT |
| 6939 | Table 1 | Hs.221695 | | | 7k30d01.x1 cDNA, 3' end/ clone = IMAGE: 3476765/ clone_end = 3' | −1 | CTTGTCTGTGGCGTGGCACACAGTA GGTGCTCGGTTTGTGTTGTTGAATG |
| 6940 | Table 1 | NA | | | 464E7 | −1 | GAATTCTGAATACATGTTGGACTGTG TTTCTTTGACCTGTGTTTCCTAGG |
| 6941 | Table 1 | NA | | | 464H12 | −1 | TGAGTCCTTGGCCTCAGCTTCTAATC TCAAACCTAAAATAGATTGCGTTT |
| 6942 | Table 2 | NA | | | 465B3 | −1 | TCTTCTCGTCTTTGCTATTAAATTTCT TCACGGACCATGCATCTGGAGGA |
| 6943 | Table 1 | NA | | | 465G2 | −1 | CCAGAGACTCCTAAGCAGAATCAAGG ATGTGTGGCATAAGCATGAGAGCC |
| 6944 | Table 1 | NA | | | 465H5 | −1 | CCCATAAAGAGGAATAAGCTACTGTC CTCAGCTCTTGTTAGCTCAGGCTT |
| 6945 | Table 1 | NA | | | 465A12 | −1 | AGAGTTTGTAACACAATCCAGTCCAC ATGCTTATCCAATCCCATCATCCA |
| 6946 | Table 1 | NA | | | 465F7 | −1 | AGCTCAAAATATGGCAAAGTGATGAT TTCGTGTTAATCCTAGAAACAGCA |
| 6947 | Table 1 | NA | | | 465G8 | −1 | TGGGTCTGCTTTCACATGAAAGTGCT ACGAATTCTCTTTTGTGCTGAGCC |
| 6948 | Table 1 | NA | | | 465H10 | −1 | GGATGAGCCCACTCACAGCACCAGA TTTGTACTGAAAGTACCTTAATATC |
| 6949 | Table 3A | Hs.136309 | | | DNA sequence from clone RP4-612B15 on chromosome 1p22.2–31.1. Contains the (possibly pseudo) gene for a novel protein similar to 60S ribosomal protein L17 (RPL17), the gene for CGI-61, endophilin B1 and KIAA0491, ESTs, STSs, GSSs and two CpG islands/cds = (1011, 1406) | −1 | AACCCAAATCCAAATGCCAGGATAGA AGAATTTGTTTATGAGAAACTGGA |
| 6950 | Table 1 | NA | | | 515C12 | −1 | CGCTTTTTGATCTGATTACTATTTCAC ACAGGTTACAGCTATGACCATGA |
| 6951 | Table 1 | NA | | | 515H10 | −1 | CTGCCGCTAATTCACTAGTAATTTCG ATCGTCCGCCCTCCAGGTACATAT |
| 6952 | Table 1 | NA | | | 55G3 | −1 | AGGCGTGCTATTAATTATCCCATACC CTCCTTACAGAAATTACACTCGCA |
| 6953 | Table 1 | NA | | | 55F9 | −1 | GGGAGAAGTTCTTTAAACTAAGGGTA CAAAATGAATTGAATGCTGGGGGC |
| 6954 | Table 3A | NA | | | 99E7 | −1 | ATTAGCGTGTTCGCGCCCGAGGTAC ACCAAAACCTTCAGAAAGCAAAGTT |
| 6955 | Table 1 | Hs.319825 | | | 103C4 | −1 | AAGATATGAAATATGCCTACCGGCAG AGCTTGGCACAAAGTGGAGTCAAT |
| 6956 | Table 1 | Hs.17481 | | | mRNA; cDNA DKFZp434G2415 (from clone DKFZp434G2415)/ cds = UNKNOWN | −1 | GTACAGAGATCGGATCACACAAGCC CGGAGACAGTGCAGCTTCTCCACTG |
| 6957 | Table 1 | NA | | | 116C9 | −1 | AATGCACTTGTGATAAACTGACAGCA GGGTTAGACATTACTTTCAAAGCT |
| 6958 | Table 1 | NA | | | 128F5 | −1 | CCACTGCTCAGGAAACTGCCTGTTCG GTGCTCCTCCAATTCAATTAAGCT |
| 6959 | Table 1 | NA | | | 135F10 | −1 | AGTGCTGGTATAACTGCAGAAAGAGA TAGAGAAGAGAGATCAGTGAGAGC |
| 6960 | Table 1 | NA | | | 189F3 | −1 | AAGTCAGGACCTTTGCACTTGCCCCG CCTCTGCCTTCACAGCTCTTCTCA |
| 6961 | Table 1 | NA | | | 189A8 | −1 | TAATCAGGGAAGAGCTTGAGATCATT AGCAACTGAACTGAACAGGGAGTT |
| 6962 | Table 1 | NA | | | 195H12 | −1 | CTGGGTCACGTCGCCCACCAATGGT ATCTGTGTGGTTAGGCATTAGGCTG |
| 6963 | Table 1 | Hs.292457 | | | *Homo sapiens*, clone MGC: 16362 IMAGE: 3927795, mRNA, complete cds/cds = (498, 835) | −1 | GGTGGTAGGTGAGTGGGTATTGCGG GCTAGTATCCGAGCAAAAGATGGTG |
| 6964 | Table 3A | NA | | | 466C4 | −1 | CAGCCCTGCTATCTCTGGTTGTTCAT GTACTTCTGTAAGGTGGGAGACCCT |
| 6965 | Table 1 | NA | | | 466D1 | −1 | GAAGGTGAGAAACCCGAGAGACACC AACTATGATTTTTACTTTTCCTGGT |
| 6966 | Table 1 | NA | | | 466G2 | −1 | ACCACCCCTCCCTTCCCTCCTTTAAC TCATCTCGAATCTCTCTCATACAT |
| 6967 | Table 1 | NA | | | 466H5 | −1 | CTCTTATCCTGCTCTGCCCTGGAACT TGAACCCCAGTGCCAATACTCATG |
| 6968 | Table 1 | NA | | | 466B7 | −1 | CGACCTAATCTCTGTCCCCAGAAGGC AGACCAGGACTCCAGCCCCAGGAG |
| 6969 | Table 2 | NA | | | 466B10 | −1 | GCCAAATCTTTGTCCTGTACAAAGTA |

TABLE 8-continued

| SEQ ID | Origin | Unigene | Locus | GI | Nominal Description | Strand | Probe Sequence |
|---|---|---|---|---|---|---|---|
| 6970 | Table 1 | NA | | | 466C9 | -1 | CAGATGTTTTTGACTGAAGTTCCA GCCACAGTGAATAAATACAAGGCAAG GCTCATAGGTAAAACAAGTTCTAT |
| 6971 | Table 1 | Hs.7187 | | | mRNA for KIAA1757 protein, partial cds/cds = (347, 4576) | -1 | AGTGGAGTGTTTACACCTTGCTGTAA CATTTGAACTTTCACAAGAGATGT |
| 6972 | Table 1 | NA | | | 121F1 | -1 | AAACCCACCCATCATTTGCCCTGACT ACCCATCTCCCGATTAATTCACCC |
| 6973 | Table 1 | NA | | | 121A11 | -1 | AGGGAACAGAGCCAGGATTTAAACTC TAACAATTTGTCTCCACAATTGCA |
| 6974 | Table 3A | NA | | | 121F8 | -1 | CTCCTGGCACGACAGAACTAGTAGTT TCCATGTCTTGAGGACATAGGTCC |
| 6975 | Table 1 | NA | | | 178B2 | -1 | TCGAACCTGTTCCAGGTATGCTGATA GATGTCGGTAGGGCATCCTTAATT |
| 6976 | Table 3A | NA | | | 178B5 | -1 | GAGGTACTATAAACCAGATGCCCAAA ACACCTGCCCTCCTGGGTTGGCCCG |
| 6977 | Table 1 | NA | | | 178F5 | -1 | ACATTCATCTGTTTCCACTGAGGTCT GAGTCTTCAAGTTTTCACCCCAGC |
| 6978 | Table 1 | NA | | | 178C12 | -1 | TTAGCCCTTTTCTGCGCTAATTAGAAT TTCAAGCGTCACAGAGCCTGGGG |
| 6979 | Table 1 | NA | | | 462A11 | -1 | TTCAACGAGGTGAACCAGTGTGATGT CTGTGGGGAAAACACGTAGTCAGG |
| 6980 | Table 1 | Hs.13231 | | | od15d12.s1 cDNA/clone = IMAGE: 1368023 | -1 | GGAAAAAAGAAATTTCCTGAGATTTC CAGTGTATACAGAAGTGTCTTTCCAT |
| 6981 | Table 1 | NA | | | 462D9 | -1 | GAGTTCACGTGGGGTGGCCCTCCTC AGTGCTCTTAGGGTACTGTACTGTC |
| 6982 | Table 1 | NA | | | 462E8 | -1 | CCACCTTCGAGGTCCCTTCCGGCCTA AGATGCCTGAAATCTCCAAGGAAA |
| 6983 | Table 1 | NA | | | 462F9 | -1 | ACAAGGCAAAGCTTAAAGAAACACTA AACGAATGAGTGAAAGAAGCGGAG |
| 6984 | Table 1 | NA | | | 462F11 | -1 | TTCTCAATAACAAACCCAGGGCTTTC ATAAATGCATGATCAAAATGTGGA |
| 6985 | Table 1 | NA | | | 462G12 | -1 | ACAGAAAATAGGGTGTATATCAGCAT TACGCTGATTCAGCAGAAGATAGC |
| 6986 | Table 1 | NA | | | 462H9 | -1 | TCTCGACTGACACCCACTATAAATTC CCTGGGTTGAAAAACTTTTCTTTT |
| 6987 | Table 1 | NA | | | 472B1 | -1 | TCCAAACCCCTCCATTACAATCTAAC ACACTTCCCCCTACATCGTCTCCT |
| 6988 | Table 1 | NA | | | 472C1 | -1 | GCATTTATTTTCTTCTACAGAGAACCT GGCGGCTGGGTCTGGGAAAGAGC |
| 6989 | Table 1 | NA | | | 472E6 | -1 | ACCCACAATTAGTGAGAGTGCCCTTG AGCTTGAGATTCCCATTCCTCCTT |
| 6990 | Table 1 | NA | | | 472F4 | -1 | TGGATATAAAGTGTGTGTTCTGACAG AAAATGGGGAGAAGGTGGCTATTT |
| 6991 | Table 1 | NA | | | 472G2 | -1 | GCCAGAAAATCCTGGTTTCCCTGGTG TCCCCTCCAATCTCTTTTACCAAA |
| 6992 | Table 1 | NA | | | 472D7 | -1 | CCATTGTCGCCCGGAGCTGGAAAGA TAGTTTAGAGAATGCCTTAGCACTT |
| 6993 | Table 1 | NA | | | 472G12 | -1 | CAGCACCCAGTCAGGTATGCAGGA AGGACTCGCTTGACTTAGAGAGTGG |
| 6994 | Table 1 | Hs.75354 | | | mRNA for KIAA0219 gene, partial cds/cds = (0, 7239) | -1 | AACACACCAGAAGGAAAAGACA CAGACAGGGAATGAAGCCTGCAAA GTCC |
| 6995 | Table 2 | NA | | | 64G9 | -1 | GTAACTCAGTGCCCCAAAGATTCAT AGTCAGCAGGATTGGCCAGCAAAT |
| 6996 | Table 1 | NA | | | 467E5 | -1 | CGCCCCAAATATAAAATCTCAATACC AGTTCCTTTTCCCCAGTACCCCAG |
| 6997 | Table 1 | NA | | | 467A8 | -1 | AGTCACAGGATGTTCTCTGCACCTCA TCTGCAACTCTGAGCCTTACTCAA |
| 6998 | Table 1 | NA | | | 467C9 | -1 | GTTAGAGCCCTCGTGCCCTGCTTCTT CAGCTACCATTTCTCTCTGTGACC |
| 6999 | Table 3A | NA | | | 467F8 | -1 | CCACCACAACCACACACACAAA AAGTCAACCCACACGAATATACCG GAAA |
| 7000 | Table 1 | NA | | | 468E6 | -1 | CAGTTGGCTGTTAGTAGTCTGCAC ACAGGTGAGAGGAGCAAGAGATCC |
| 7001 | Table 1 | NA | | | 468B9 | -1 | AATCTATTATCAGGCATTTAATCACTG AGCACTCTTCTGTCCCACACTGT |
| 7002 | Table 1 | NA | | | 468E10 | -1 | AGAGGAGTGACGGTGAATGGTACTG AAAGCGGTTGTAAATTGCGAGAGAG |
| 7003 | Table 1 | NA | | | 468F10 | -1 | TCTCCTTGTTCTGATTCTCTCCCCATC TACAACAACTCCACTCCCCAAAG |
| 7004 | Table 1 | NA | | | 468F11 | -1 | CACCTAACCAAGCGGGTTGGGCTGA TGACCGATGACCGTAAGCAGTAAGG |
| 7005 | Table 1 | NA | | | 468G12 | -1 | ACCTCTTCTTTAGCAACACTAACCAC TCCACACTGGGGAAATTATACTCT |
| 7006 | Table 1 | NA | | | 468H11 | -1 | ACTACCGCACAACAGAACACATGACC |

TABLE 8-continued

| SEQ ID | Origin | Unigene | Locus | GI | Nominal Description | Strand | Probe Sequence |
|---|---|---|---|---|---|---|---|
| 7007 | Table 1 | NA | | | 469B6 | −1 | AGGTGAGTGCAGACACGACATCAG CAGTTTTACTCCTGGTCATCTCTTGT |
| 7008 | Table 1 | NA | | | 469D2 | −1 | GAGTGTGGATTCTTCTCTGCCCCT TTTTATTTTGGCTGAAGTTTGGGTATG GCTGCTTGTTGGCCTCTGCTGGG |
| 7009 | Table 1 | NA | | | 469A10 | −1 | ACAGCTTATAAAGCACTTTCTCATGC ACTTCTTCTCGCCGTATTTGCACA |
| 7010 | Table 1 | NA | | | 469E12 | −1 | GGGGCTCAAACCTGTGACTTACTGCT AACTAACATCAAAGGAAAAGCTGG |
| 7011 | Table 1 | NA | | | 469F8 | −1 | ATGATCATTGATAGATATTCTAAGAG CATGCAGGAATGAGGATGCGTGCC |
| 7012 | Table 1 | NA | | | 469G8 | −1 | GACAACAAACCTGCTTGCTTGGTTAC CCACAGCGCACTGAGTATAGAAGT |
| 7013 | Table 1 | NA | | | 470B2 | −1 | TCTTCAATTATTCATGCTCTAAGGCA GTGTCTGTCTTCCCACCATCCCGC |
| 7014 | Table 1 | Hs.118174 | | | tetratricopeptide repeat domain 3 (TTC3), mRNA/cds = (2082, 7460) | −1 | TGAGTATTTTTAAAATCCCCTGTTTGG ATGCTTCCAGCTAAATAGTCTACCT |
| 7015 | Table 1 | NA | | | 470C3 | −1 | TGGGTTACTCAGATCTTCTCCTTCTT AAGTGAGAGTTTTAACCTACATTTT |
| 7016 | Table 1 | NA | | | 470D5 | −1 | GTCCAGAGCTAGAAGAACCAAGTCTT CCTTTCTTCATTCATTGTTCAGGT |
| 7017 | Table 1 | NA | | | 470E1 | −1 | CTTCTTCTTAGGATCTGGAGGGAGGG GAGTGTTAGAGCTTGTGAGCCATG |
| 7018 | Table 1 | NA | | | 470E5 | −1 | CTGAACGAACCAGTTCTTTTGGACTA CCAGTTCTTGAAGTGAAGCTCAGA |
| 7019 | Table 1 | NA | | | 470F3 | −1 | AACAAAAGCACTGACAAGCTCATATG AACAGGCTAAAAAGTGAGTGAAGT |
| 7020 | Table 1 | NA | | | 470G6 | −1 | TTCTCTTTCTATATCTAGCTAAATTGC CTGTGCGCCTCCCATCCTCCTCA |
| 7021 | Table 1 | NA | | | 470B8 | −1 | ACACACTTGATAAATTAGACCGATGC AAACCGCAAGAATCCAAATCAGCT |
| 7022 | Table 1 | NA | | | 470G10 | −1 | ATAGTAGGTGAGCCAGTAGTGTGAAT GCTTGTCAAGCTTCCAAGGATGGA |
| 7023 | Table 1 | NA | | | 471D6 | −1 | AACCACCACCCAGCTTCCTGGTACAA GCAGGGACTCTGGCTACAGTGCTA |
| 7024 | Table 1 | NA | | | 471F1 | −1 | TTTCCTCCCCTCCCTCCCCAATCCAC AAAACACGTAATCTGACTATCCA |
| 7025 | Table 1 | NA | | | 471F4 | −1 | CAACATTCACAAAACTGGTCCCCGAA TTAGTGAGAAGGTTCCAGGAGTGC |
| 7026 | Table 1 | NA | | | 471F6 | −1 | GAGAGATTATAGCACAGTCTCCCAGG GCTCAGTCAGGTCATCCGCAGCAA |
| 7027 | Table 1 | NA | | | 471E9 | −1 | TTCAATGCTTTGTCCTCCCCTCGCAG ATGTTTAGAACAGATCCTCCTTCT |
| 7028 | Table 1 | NA | | | 471E11 | −1 | TCCCTCTCTCAGGGCTGGGAAAGAAA GGTTCATCTTCACTCAGATGCAAG |
| 7029 | Table 1 | NA | | | 471H11 | −1 | TTCTGTTGGTCTGCCAGCTCATCCAT TCATCCATCACCTGCCAGCTAGAC |
| 7030 | Table 1 | NA | | | 473E4 | −1 | ACACAGTTTTGGCTCCCTTATTTTCC CCGTACTCGAAACATTTCCATGCA |
| 7031 | Table 1 | NA | | | 473F3 | −1 | ACCAAATCGCAAAAATACAGAATGCC TGTAAATTGAGTCACACCTTAAAA |
| 7032 | Table 1 | NA | | | 473E11 | −1 | GAGTCCATAAATCTGCATTTCATGTA GTTGTAAGACTTTCTCCCAAAGGT |
| 7033 | Table 1 | NA | | | 476C1 | −1 | TCCATTTGAGTTTTCTTCCCATCTCTC ACAGTTGATTGTTCTGTCCCTTC |
| 7034 | Table 1 | NA | | | 476D3 | −1 | AAAATTCAGCCCTCCTGGATTCACGT GCCCCAATGAAAGTCCCCAAACTAG |
| 7035 | Table 1 | NA | | | 476F5 | −1 | TTTAACAGGAAAAGCCCAAAATTATTT TTATGCTGTCTACAATCTGGGCC |
| 7036 | Table 1 | NA | | | 476G3 | −1 | AGTTGCACTGGTTGTTCTTGGCTGCG GTGCTTCTCACACAAGAAGCCCAG |
| 7037 | Table 2 | NA | | | 476G4 | −1 | TTTCCTTTTTCCCTTGTCCCTTGGCTT CCCCCATCACCGAATCCCCCTTC |
| 7038 | Table 1 | NA | | | 476A10 | −1 | CTCCCACGCCTGGCCGTAGTCCAGA GCTTCTTCTTTTTCATGGTTGGGTT |
| 7039 | Table 1 | NA | | | 476G8 | −1 | GCCAGTGTACGTTGCCAGGCATTTCA TGTAAGAGAAAACTCAAATAGCCA |
| 7040 | Table 1 | NA | | | 476H10 | −1 | CCGTCTTCTTTTGGGTGTTTCCTCCT AGTTTCGGCGGAAATCAGAGTTCA |
| 7041 | Table 2 | NA | | | 477E1 | −1 | ATGAACCCTCACCTGCTCTGCAGTGC AGTTTTGATTTTAGTCCCAGCAAA |
| 7042 | Table 1 | NA | | | 477E6 | −1 | AGATATAGATGGTAAAATGTGATGCA ATGTAAAAAATGGTAATACACACAC TCTCCA |
| 7043 | Table 2 | NA | | | 477A11 | −1 | TGAGTGGGCTTCTCTTATGGTACAGT |

TABLE 8-continued

| SEQ ID | Origin | Unigene | Locus | GI | Nominal Description | Strand | Probe Sequence |
|---|---|---|---|---|---|---|---|
| 7044 | Table 1 | NA | | | 477D9 | −1 | CTCTTCTCTATGAGGGGCTTCAAA TGGGCTTCCAAATGGTACAATGGAGT |
| 7045 | Table 1 | NA | | | 477D10 | −1 | AATCAAGCTCATGGACTGAGAGTT CTTGAAGCTACTTGTCCCTTCTGTG CCAGACCACTTAATGGCTACCCAC |
| 7046 | Table 2 | NA | | | 480A3 | −1 | TTCCCAGGGCGCTCCATCTACAGCCT TACTGTGACTCCACTCAGCACCAG |
| 7047 | Table 1 | NA | | | 480B5 | −1 | ATTCCCCCTAAGCTCCTGTCCCCCGC CATGCACGACTGGTCACATCAAAA |
| 7048 | Table 1 | NA | | | 480D2 | −1 | AAGACACACCCCTCCTGTTTAATAAA AGTTGTCCCCTCGACATGCATAAT |
| 7049 | Table 1 | NA | | | 480E2 | −1 | CCTGGTTACAATAATGAAACTGTCGT GGAGTAAAGAGGGAAACATGACCA |
| 7050 | Table 1 | NA | | | 480E3 | −1 | AGAACCCACACACTGGGAGACAATAA CTGCCATTCATATAACCAACAGAA |
| 7051 | Table 1 | NA | | | 480F3 | −1 | CGCCACTGCTTAAAGATTACAGACAA TTCCCAGGTAAAGTTGCCAGGACT |
| 7052 | Table 1 | NA | | | 480G4 | −1 | ACAATGATGTTTGAAACGCACTCTGA ATCTGTGAAAGCTAGATAAGTCCT |
| 7053 | Table 1 | NA | | | 480C8 | −1 | GCCTTCCTCCTCCTCCCTCTTGGGCC TATGTCCTAGATAAGCCTGTTAAA |
| 7054 | Table 1 | NA | | | 480D9 | −1 | TGTCAAGATGACAGATCTTAATCCAG AGTGGAGGCTCGTTCGGCCTGGAG |
| 7055 | Table 1 | NA | | | 480E7 | −1 | TTTATGTTTCAGCCTCTTTCTCTCCCG TTGAGTCCTGCCACAAGTCCTGC |
| 7056 | Table 1 | NA | | | 480E11 | −1 | ATTGTCCAGGTGACTTGACACTTGCC TACCGGAAAAGTTGGGATGTTCTT |
| 7057 | Table 1 | NA | | | 480F8 | −1 | TAAAATATGCCCTAATTTAAAGGGCG CAGGGTCCCACAACAAGCCACAGA |
| 7058 | Table 1 | NA | | | 487F11 | −1 | AAATCTCTTCTCACGTTCTGTTTGTCA TTTAATCACCAGGTTTTTAGCGC |
| 7059 | Table 3A | NA | | | 499G1 | −1 | GCTACTGATGGGTGGCCCTTTATTCT TGTCTTTATTTGTTGTGTGCAGGA |
| 7060 | Table 1 | NA | | | 518F10 | −1 | AAAAATTGGTAGCTGCCCCCATGTGG TATGATGTTTAATTTGAACAACAT |
| 7061 | Table 3A | NA | | | 524A12 | −1 | ACCCGGCACGTCTCCTCAACCCCTTA ATTCTTTTCCAGCTTTTCATATTA |
| 7062 | Table 1 | NA | | | 526B9 | −1 | CTCAAGAGGGCATAGACATTCCACAC GAGGACTGCATTCGTCAGGGTAAC |
| 7063 | Table 1 | NA | | | 583B5 | −1 | AACAAATACCCAATTAACTGTATTCCC CTTTCCCCTATGACTGCTGGTGT |
| 7064 | Table 1 | NA | | | 583D6 | −1 | CCGTTGTCCGAAAGCTTGCTTCCAAC TAAAGACCAGAGATGGGAGGGAGT |
| 7065 | Table 1 | NA | | | 583G8 | −1 | TTTAGCCCAAAGAAGACTTTCGCATA AATTCTGCCGTAACCCTTGTTGGA |
| 7066 | Table 3A | NA | | | 584A1 | −1 | CAAAGCAGCAAATACAGAGCAC ACAACAATCCTTGGCCTGAGCAGA ACAA |
| 7067 | Table 1 | NA | | | 584D3 | −1 | ATATGAAGATGGATTGGATGAGGACT GACAAAACGAAGACATGCCGGGCC |
| 7068 | Table 3A | NA | | | DNA sequence from clone RP4-620E11 on chromosome 20q11.2–12 Contains 1 | −1 | ATGCCTAGTCAGTCAGTATTTCTTCTT GCTGCAGGTGTCTAAAAACCCAC |
| 7069 | Table 3A | NA | | | 591H9 | −1 | CCTTCGCATTCCCCCATCCATGCTCC AAGATAATAGATTTTTCTTTAAAA |
| 7070 | Table 3A | Hs.6179 | | | DNA sequence from clone RP3-434P1 on chromosome 22 Contains the KCNJ4 gene for inwardly rectifying potassium channel J4 (hippocampal inward rectifier, HIR, HRK1, HIRK2, KIR2.3), the KDELR3 gene for KDEL (Lys—Asp—Glu—Leu) endoplasmic reticulum protein retention receptor 3, the DDX17 gene for DEAD/H (Asp—Glu—Ala—Asp/His) box polypeptide 17 (72kD), ESTs, STSs, GSSs and slx putative CpG islands/cds = (307, 2259) | −1 | GGGGAACACTTTGGTTTGAAAGCACA GAGCAGTTTGCCATGTTTCTTCTG |
| 7071 | Table 1 | Hs.44577 | | | 602388170F1 cDNA, 5' end/ clone = IMAGE: 4517129/ clone_end = 5' | −1 | ACTGAATGGTCGAAATCACATATGCA CCACACATACTGATCTTAAGTAAC |
| 7072 | Table 3A | Hs.108124 | | | cDNA: FLJ23088 fis, clone LNG07026/cds = UNKNOWN | −1 | CGAGGTACAGCAAAGCGACCCTTGG TGTCATAGATCAGACGGAAATTCTC |
| 7073 | Table 1 | NA | | | 119F12 | −1 | TACAGAAGAGCAGAGACCAACCTTCT |

TABLE 8-continued

| SEQ ID | Origin | Unigene | Locus | GI | Nominal Description | Strand | Probe Sequence |
|---|---|---|---|---|---|---|---|
| | | | | | | | CAAAGTTGGTGAGTATTAACCCAG |
| 7074 | Table 1 | NA | | | 119G10 | −1 | CCAGATTTGCTGATGTGTTAGGTAGT TGTGGCACACTCACCTGTCTTTCC |
| 7075 | Table 1 | NA | | | 485A8 | −1 | CTTTCCAGGTTTTCCCTTTCCGCCAT TGTTTTCCCGCTCGCTAAAGTGAC |
| 7076 | Table 1 | NA | | | 485D5 | −1 | TTGAACATTCGCAAAGTAACATCTCT CACTCCCAACACCACAGCTTATCG |
| 7077 | Table 1 | NA | | | 489H9 | −1 | AGTAACCACCCAAAGCATAGTTT TAGAAGGGCTTTCGCAAACCTAGC CTTT |
| 7078 | Table 2 | NA | | | 494B11 | −1 | TCTTGCTTGTTCTTCTCGTTTTTGTTT TATCTTCCGCCCGGCAGGGTCAG |
| 7079 | Table 1 | NA | | | 478E5 | −1 | GCTCTGAAACCCCTGGAACTCTTGAG CCTAAAATGTATTTTTACAATCTT |
| 7080 | Table 1 | NA | | | 478G6 | −1 | ATCTTTGATGTGAAGCCCTTTAAAAAT AAACGTGAAGGTGCCAGCTTGCA |
| 7081 | Table 3A | NA | | | 478H3 | −1 | ACCCAGCCTGATGTTCATCTTTTCCC CCTCTTCATTTTCCTTCTTTGTTT |
| 7082 | Table 1 | NA | | | 478C7 | −1 | AGAAAGACTAACACCAGAAATCATGC TGCAACACCAGAACATCCTTTGGA |
| 7083 | Table 1 | NA | | | 478G8 | −1 | TCACAAAATATGGCTCAAGGAGTATA AATCCCCTCTCACGCACCCACAAA |
| 7084 | Table 1 | NA | | | 478H7 | −1 | ACTAACCAACCAATGAGAATACTACT TACCTCCACCCATGCTGTGAACCC |
| 7085 | Table 3A | NA | | | 479B4 | −1 | TGACCGCCTCAAAGACCAAAAGGACT CTACTCCATATTCTTCTCACTGTC |
| 7086 | Table 1 | NA | | | 479D2 | −1 | GAATGACCACCTGACGCATTCAGAGC TCACCTTCTTGTTCTTCAGCTGTT |
| 7087 | Table 1 | NA | | | 479G2 | −1 | TTGGTAGAAACCACCCAACCATAAAA TTCCCAAGCCTGTACTGGTCAGCC |
| 7088 | Table 1 | NA | | | 479G3 | −1 | CATAAGTTGGGTGAAGAAATGGTGGT TTTAATCAGTAATATAGCTCCCCC |
| 7089 | Table 1 | NA | | | 479G5 | −1 | TTCTCATCTCAATATCCCCCAGAGCC CCAGTACCTCATAATACAAGACTT |
| 7090 | Table 1 | NA | | | 479G6 | −1 | CTATCAGGCCCTCCAGATAGTCTTCT ATAAACCAATGATTCAGCAGGACT |
| 7091 | Table 1 | NA | | | 479H4 | −1 | TACCCAAAGTCTATTCGTAAGTGCAT CTTTTCTATTAGACTGGAAGCTCC |
| 7092 | Table 1 | NA | | | 479H5 | −1 | GATGGTTCAGCAACTGAGGAGCTCA GGGTGACGGGTCCACAGAGCACAGA |
| 7093 | Table 1 | NA | | | 479H6 | −1 | AGAAATTAGAAGATGACTACCATTTG CTAAAGTCTATCCACATGCCAGCA |
| 7094 | Table 1 | NA | | | 479G12 | −1 | CCCCCTCGACCCCCTCACACCCTTTC CAGAGAGGCCTTAAGATTCCCATT |
| 7095 | Table 1 | NA | | | 479H12 | −1 | TGTAAGGTTTCATAAATTTAGAGACC CTAGCCCAGTCAGTGACAATATGCA |
| 7096 | Table 1 | NA | | | 482A5 | −1 | GAGTTGCTTATTCCAGTCTCTCTAAG ATATATCTCCCTTTTTAGTTGCTGAC |
| 7097 | Table 3A | NA | | | 483G5 | −1 | TGGTGTAATGAACATGCCGTATTGCC TTTATGGCCAGTTTGAGTCCTTCC |
| 7098 | Table 1 | NA | | | 488C4 | −1 | AGGGAACCCCAAAGAGTTAAAA CCAGGACCACTATTTCATAGTCAA CAAA |
| 7099 | Table 1 | NA | | | 490F10 | −1 | GTGGTAAATGAGAGCATTACAGACCA CCCACATCAGCCTAAAATATAATT |
| 7100 | Table 1 | NA | | | 493C2 | −1 | CCACCAAACCCAACAGGCCGGGACA AATGCAATACCATACAGAAACACAG |
| 7101 | Table 1 | NA | | | 58G4 | −1 | GGCCAAACTTTCTTACTCTGCCATTT GTTCAATGTCCTAATGAGCCATGAA |
| 7102 | Table 3A | Hs.169370 | | | DNA sequence from PAC 66H14 on chromosome 6q21–22. Contains FYN (P59-FYN, SYN, SLK) gene coding for two isoforms. Contains ESTs and STSs/cds = (12, 1706) | −1 | ATCAATCGGGCCAATCCGAAGTCAGC AATCTTGCATATGAGTCCATTCCC |
| 7103 | Table 1 | NA | | | 598H2 | −1 | TATTTTTAACAAAATCACACGGAAGG ATTTCCTTCCCGTCCCATGTGTTG |
| 7104 | Table 3A | NA | AA077131 | 1836605 | 7B08E10 Chromosome 7 Fetal Brain cDNA Library cDNA clone 7B08E10, mRNA sequence | −1 | CAGATAGTGGTATTTGGGTGCTGGG CTTGTCTGACCTGAGGAGGTGGCTG |
| 7105 | Table 3A | NA | AA501725 | 2236692 | ng18e12.s1 NCI_CGAP_Lip2 cDNA clone IMAGE: 929806 similar to contains Alu repetitive element; mRNA | −1 | AACTCCATAGAGAAAGACTACGAATT TCGCTGGGAGGTAATAGGGAAGCC |
| 7106 | Table 3A | NA | AA501934 | 2236901 | nh56a10.s1 NCI_CGAP_Pr6 cDNA clone IMAGE: 956346, mRNA sequence | −1 | GCATTAGGAAAGACAGGTGAGTGTG CCACAACTACCTAACACATCAGCA |

TABLE 8-continued

| SEQ ID | Origin | Unigene | Locus | GI | Nominal Description | Strand | Probe Sequence |
|---|---|---|---|---|---|---|---|
| 7107 | Table 3A | NA | AA579400 | 2357584 | nf33d05.s1 NCI_CGAP-3Pr1 cDNA clone IMAGE: 915561 similar to contains Alu repetitive element contains | −1 | TTACTTTGTCTTCTCTCACCATCCTAA AACGTTGTTTTGCTGAGCATGAA |
| 7108 | Table 3A | NA | AF249845 | 8099620 | isolate Slddi 10 hypervariable region I, mitochondrial sequence | −1 | CCCCAGACGAAAATACCAAATGCATG GAGAGCTCCCGTGAGTGGTTAATA |
| 7109 | db mining | Hs.277051 | AI630242 | 4681572 | ad07c09.y1 cDNA/clone = ad07c09-(random) | −1 | GCCTAAGTTTCCAGAAGACTTTGACG ATGGAGAGCATGCAAAGCAGGTAA |
| 7110 | db mining | Hs.277052 | AI630342 | 4681672 | ad08g11.y1 cDNA/clone = ad08g11-(random) | −1 | TTTTGCAGTTCAAGGATTGGTGGGAA ACGTTTGTATGTGTTGGGGTGGGG |
| 7111 | db mining | NA | AI732228 | 5053341 | nf19e05.x5 NCI_CGAP_Pr1 cDNA clone IMAGE: 914240 similar to contains Alu repetitive element, mRNA s | −1 | AATAGATTTCCATTTCTTCCTTCGAGT TAGTTGGGTATTGGGACCTTGAA |
| 7112 | Table 3A | Hs.197803 | AW379049 | 6883708 | RC3-HT0230-201199-013-c12 HT0230 cDNA, mRNA sequence | −1 | CGACGGTGTTCTGGAGTTTCGATGAG ACATGTAAGTAAGAGTTCTGTGCA |
| 7113 | Table 3A | Hs.232000 | AW380881 | 6885540 | UI-H-BI0p-abh-h-06-0-UI.s1 cDNA, 3' end/clone = IMAGE: 2712035/clone_end = 3' | −1 | ATATTCAGCAGTGGCTGTGAAATTGG ATTTGAATTACCGGGATACATGCA |
| 7114 | Table 3A | Hs.325568 | AW384988 | 6889647 | 602386081F1 cDNA, 5' end/ clone = IMAGE: 4514972/ clone_end = 5' | −1 | ACTGGTTTTCATTCTAGTGTCCCCCA CCCGTCTAGTTTCATTTTCCTGTA |
| 7115 | Table 3A | NA | AW836389 | 7930363 | PM0-LT0030-101299-001-f08 LT0030 cDNA, mRNA sequence | −1 | TTGGGAGTCACCAGGTTAAAGCAAAG CCTCAGTCACTGAAAGCAGAAACT |
| 7116 | Table 3A | NA | AW837717 | 7931691 | CM2-LT0042-281299-062-e11 LT0042 cDNA, mRNA sequence | −1 | TCCTGTGCTCCAGAATTAGTGATTGC TTTGGTGCTTAACTTGAAGTGGGA |
| 7117 | Table 3A | NA | AW837808 | 7931782 | CM1-LT0042-100300-140-105 LT0042 cDNA, mRNA sequence | −1 | CATCTGCTCTGCTTCCTCACACACTA GAAACACCACTGCCCCCATCCATG |
| 7118 | Table 3A | NA | AW842489 | 7936472 | PM4-CN0032-050200-002-c11 CN0032 cDNA, mRNA sequence | −1 | TCTGTGATTTATAGACTGTTTTCAGGA AACGATCTTCCCATCTGTGGTGA |
| 7119 | Table 3A | NA | AW846656 | 7942373 | QV3-CT0195-011099-001-c09 CT0195 cDNA, mRNA sequence | −1 | TCATTTCAGGTCTAATAAACACACTAA CCTCGGCAGCACTGGAGCGTCTG |
| 7120 | Table 3A | NA | AW856490 | 7952183 | PM4-CT0290-271099-001-c04 CT0290 cDNA, mRNA sequence | −1 | AGCTTAGGATATCTATTAGTGTTCACT GTTCGGGCAAGAGGCCTAAAGGG |
| 7121 | Table 3A | NA | AW891344 | 8055549 | PM2-NT0079-030500-001-a04 NT0079 cDNA, mRNA sequence | −1 | TGGGAACACACTGGCCCATTATATAG AGAAAAATAAAACATGATCCCCAT |
| 7122 | Table 3A | NA | BE061115 | 8405765 | QV0-BT0041-011199-039-f09 BT0041 cDNA, mRNA sequence | −1 | TTGCTTGATTTCCCAAACCACTACCT GAAGGTGGCTTATGGTCTACAGCT |
| 7123 | Table 3A | NA | BE086076 | 8476469 | PM2-BT0672-130400-008-h09 BT0672 cDNA, mRNA sequence | −1 | TTCCACCACTTCAAGACTGGGGGCA GGTAGAGAAGACAAGCATAAGTACA |
| 7124 | Table 3A | NA | BE091932 | 8482364 | IL2-BT0733-130400-068-C11 BT0733 cDNA, mRNA sequence | −1 | TTCTTCTCTGCCCCTAACAGAATGTT CTTCTCTTGCTTCCCACACCCTCC |
| 7125 | Table 3A | Hs.173334 | BE160822 | 8823543 | ELL-RELATED RNA POLY- MERASE II, ELONGATION FACTOR (ELL2), mRNA/cds = (0, 1922) | −1 | CAGCACATCTTCTGGTTTACAAGTTG GGTAACTATGAAAGCTGGAGATGC |
| 7126 | Table 3A | NA | BE163106 | 8625827 | QV3-HT0457-060400-148-h10 HT0457 cDNA, mRNA sequence | −1 | TATCTAAATTCTACCTTTAGCATCCAA CTAGCTACCGTCTGGCACTGGCC |
| 7127 | Table 3A | Hs.301497 | BE168334 | 8631159 | arginine-tRNA-protein transferase 1-1p (ATE1) mRNA, alternatively spliced product, partial cds/cds = (0, 1544) | −1 | TCCAATGCTCAAGTCACTCTGAGTCT TTGCTGGTGTCAACCTACAATGCC |
| 7128 | Table 3A | Hs.172780 | BE176373 | 869102 | 602343016F1 cDNA, 5' end/ clone = IMAGE: 4453468/ clone_end = 5' | −1 | ACCTCACTATAGTAGCCATTAGGTAA AGATGGGCCATATCCAAATGGGCT |
| 7129 | Table 3A | NA | BE177661 | 8656813 | RC1-HT0598-020300-011-h02 HT0598 cDNA, mRNA sequence | −1 | AAGAACTATTCCTTTGAGAATCTTTCC TACTGGGAGTTACTGCTGTGATT |
| 7130 | Table 3A | NA | BE178880 | 8658032 | PM1-HT0609-060300-001-g03 HT0609 cDNA, mRNA sequence | −1 | TCTGTGTGAACATACATACAGGACTT TGATTCTACCTGTGCCTGACCATT |
| 7131 | Table 3A | NA | BE247056 | 9098807 | TCBAP1D6404 Pediatric pre-B cell acute lymphoblastic leukemia Baylor-HGSC project = TCBA cDNA clone T | −1 | GTGGAGCTGTTGGCCCTTGCTGGATG CGGGCACTCTCTACACCTTCAGGTA |
| 7132 | Table 3A | Hs.11050 | BE763412 | 10193336 | mRNA; cDNA DKFZp434C0118 (from clone DKFZp434C0118); partial cds/cds = (0, 1644) | −1 | TGTCAGTGGCTCTCACTTTGTTTGAA ATTGTTGCTTTGGGAAAAACACAG |
| 7133 | Table 3A | NA | BF330908 | 11301656 | RC3-BT0333-310800-115-f11 BT0333 cDNA, mRNA sequence | −1 | GATGCAGTGGGTTAGGGGTTGGGGG TACAGACTGACTTGAGCTCGGAGTC |
| 7134 | Table 3A | NA | BF357523 | 11316597 | CM2-HT0945-150900-379-g06 HT0945 cDNA, mRNA sequence | −1 | TCAGGCACTCAGTAAAGGCAAGACTT GAGTGATACATAAAGTCAGTTACA |
| 7135 | Table 3A | NA | BF3644413 | 11326438 | RC6-NN1068-070600-011-B01 NN1088 cDNA, mRNA sequence | −1 | CCTTGGGCTGAGTTTGCTGGTCCTGA AGATTACAGTTTTGGTTAGAGAGA |
| 7136 | Table 3A | NA | BF373638 | 11335663 | MR0-FT0176-040900-202-g09 FT0176 cDNA, mRNA sequence | −1 | ACAGCAAACAAAAGTGTTCCAAT CCTCTATTAACCCATTAACCAAG AGTT |
| 7137 | Table 3A | NA | BF740663 | 12067339 | QV1-HB0031-071200-562-h04 | −1 | AGTGCATTCACACTGATGATAAACGA |

TABLE 8-continued

| SEQ ID | Origin | Unigene | Locus | GI | Nominal Description | Strand | Probe Sequence |
|---|---|---|---|---|---|---|---|
| 7138 | Table 3A | NA | BF749089 | 12075765 | HB0031 cDNA, mRNA sequence MR2-BN0388-051000-014-b04 BN0386 cDNA, mRNA sequence | −1 | TAGTAGCTTCACAGGTTTGCTTCT AAGTGTGATTAGAAAGCAGCTGG AAGTAGCAGAGGAGGTGGAAGTTA GTCC |
| 7139 | Table 3A | NA | BF758480 | 12106360 | MR4-CT0539-141100-003-d05 CT0539 cDNA, mRNA sequence | −1 | CAGGAGTAAAACAGAGCTGGTTGTGT GATACCTATGCTGGGTGGAAGACT |
| 7140 | Table 3A | NA | BF773126 | 12121026 | CM3-IT0048-151200-568-f08 IT0048 cDNA, mRNA sequence | −1 | GGTGACTATCTTACCGGCTCCAGTA AACTCTGAACAATGTACCAGCTAA |
| 7141 | Table 3A | NA | BF773393 | 12121293 | CM2-IT0039-191200-638-h02 IT0039 cDNA, mRNA sequence | −1 | GCTTGAAGATGTCTCAACAGAAAATC ACCGACATGAGGAAGCATCACGCT |
| 7142 | Table 3A | NA | NF805164 | 12134153 | QV1-CI0173-061100-456-f03 CI0173 cDNA, mRNA sequence | −1 | AGGAACATGGCTGCAGCATATAAAAA GAATTGAATTCCATACTTTTGTTAACC CTG |
| 7143 | Table 3A | NA | BF818594 | 12156027 | MR3-CI0184-201200-009-a04 CI0184 cDNA, mRNA sequence | −1 | GGTGCTGCCATAGGTGCCAGTAATG ACCGTTTATGCGGAAATCAATTACA |
| 7144 | Table 3A | NA | BF827734 | 12171909 | RC8-HN0025-041200-002-F08 HN0025 cDNA, mRNA sequence | −1 | TGAAGTACTATAGGACTCAATGGGAC CAGTAGCAGCTCCAAGTGGATCAC |
| 7145 | Table 3A | NA | BF645167 | 12201450 | RC5-HT1035-271200-012-F08 HT1035 cDNA, mRNA sequence | −1 | ACACGGGACCTCCTTTGATCTTTCTG AGAATTAATAGAGATTTCATGGCA |
| 7146 | Table 3A | NA | BF869167 | 12259297 | IL5-ET0119-181000-181-b11 ET0119 cDNA, mRNA sequence | −1 | CCAAAAGGAGAAAGATGACTAGGGT CACACTTGAGGATTTGCCAGGTGGG |
| 7147 | Table 3A | NA | BF875575 | 12265705 | QV3-ET0100-111100-391-c02 ET0100 cDNA, mRNA sequence | −1 | GCATCTTCTTTGAAGACGGGAACTGT ACTTCAGGTTCTTTTCTGTTTAGC |
| 7148 | Table 3A | NA | BF877979 | 12268109 | MR0-ET0109-171100-001-b02 ET0109 cDNA, mRNA sequence | −1 | GGCTCATTTGGTTTTAAAGTCTCTTCT ATGCCATCCCAGGGGAGGAGGAT |
| 7149 | Table 3A | NA | BF897042 | 12288501 | IL2-MT0179-271100-254-C11 MT0179 cDNA, mRNA sequence | −1 | GACTGTGGACACCTCTCACTGTGTCT TCTTGGCAGGCAGAGCTTACTGAC |
| 7150 | Table 3A | NA | BF898285 | 12289744 | QV1-MT0229-281100-508-e11 MT0229 cDNA, mRNA sequence | −1 | GCAGGGTGCAGAGCTTCACAGCAGG TAGGAAGAAGTAACTAAGTGGAAAC |
| 7151 | Table 3A | NA | BF899484 | 12290923 | IL5-MT0211-011200-317-f03 MT0211 cDNA, mRNA sequence | −1 | CAGCTAAAGCCGTAGGTCATTGTGAC TGTCCCTGGGATGTGGATTACTCT |
| 7152 | Table 3A | NA | BF904425 | 12295884 | CM1-MT0245-211200-662-d02 MT0245 cDNA, mRNA sequence | −1 | CCAGAATGCAGCCTACAGACCAAATA TCAATGGACTTGGTGTAGCCCTGC |
| 7153 | Table 3A | NA | BF906114 | 12297573 | IL3-MT0267-261100-425-A05 MT0267 cDNA, mRNA sequence | −1 | TTTAAACCAGGTCTGGAAAAGGAAG GAGAGGAGGCATTTTAGAGAAGA |
| 7154 | Table 3A | NA | BF926187 | 12323197 | CM2-NT0193-301100-562-c07 NT0193 cDNA, mRNA sequence | −1 | GTGGCTTCGTAAAATAGAAGAGCAGT CACTGTGGAACTACCAAATGGCGA |
| 7155 | Table 3A | NA | BF928844 | 12326772 | QV3-NT0216-061200-517-g03 NT0216 cDNA, mRNA sequence | −1 | CACACCACAGCTGGCTGGGAGCAGA GGCTGCTGGTCTCATAGTAATCTAC |
| 7156 | Table 3A | NA | BG006820 | 12450388 | RC4-GN0227-271100-011-d03 GN0227 cDNA, mRNA sequence | −1 | TGGAGAAATGAGAGACAGACAGTG AGTGAGAAAGTCAGCGAAAAGGAAA |
| 7157 | Table 3A | NA | F11941 | 707260 | HSC33F051 normalized infant brain cDNA cDNA clone c-33f05, mRNA sequence | −1 | ACCTACTGTTGAGATTATTCCCCTGT CTCCACACTGCCAGAAACTTACCA |
| 7158 | Table 3A | NA | U46388 | 1236904 | HSU46388 Human pancreatic cancer cell line Patu 8988t cDNA clone xs425, mRNA sequence | −1 | CCAAATGATACTAGGATTAAGCCCCA AAGCAAAGTCAAGCACCACCATGG |
| 7159 | Table 3A | NA | U75805 | 1938265 | HSU75805 Human cDNA clone f48, mRNA sequence | −1 | TCCCAGAGCAACAACTAAGTCTCAAC TAATGGACAACCAACACCCACTGA |
| 7160 | Table 3A | NA | W27858 | 1307658 | 36f10 Human retina cDNA randomly primed sublibrary cDNA, mRNA sequence | −1 | CCACAGAATGGGCATGTAGTATTGAG ATTTGAATCATCTGCTGTCCAGCC |
| 7161 | db mining | Hs.681 | nm_004146 | 10764846 | NADH dehydrogenase (ubiquinone) 1 beta subcomplex, 7 (18kD, B18) (NDUFB7), mRNA/ cds = (22, 435) | 1 | ACCTCATCCGGCTGCTCAAGTGCAAG CGTGACAGCTTCCCCAACTTCCTG |
| 7162 | db mining | Hs.943 | NM_004221 | 4758811 | natural killer cell transcript 4 (NK4), mRNA/cds = (59, 763) | 1 | GACCTGGTGCTGTCGCCCTGGCATC TTAATAAAACCTGCTTATACTTCCC |
| 7163 | db mining | Hs.1063 | NM_003093 | 4507126 | small nuclear ribonucleoprotein polypeptide C (SNRPC), mRNA/ cds = (15, 494) | 1 | GCATAAGGAAGACTTGCTCCCCTGTC CTATGAAAGAGAATAGTTTTGGAG |
| 7164 | db mining | Hs.1321 | NM_000505 | 9981354 | coagulation factor XII (Hageman factor) (F12), mRNA/cds = (49, 1896) | 1 | GGGACTCATCTTTCCCTCCTTGGTGA TTCCGCAGTGAGAGAGTGGCTGGG |
| 7165 | db mining | Hs.288856 | NM_003903 | 14110370 | prefoldin 5 (PFDN5), mRNA/cds = (423, 926) | 1 | AGACTGGATCGCACACCTTTGCAACA GATGTGTTCTGATTCTCTGAACCT |
| 7166 | db mining | Hs.1975 | NM_030794 | 13540575 | hypothetical protein FLJ21007 (FLJ21007), mRNA/cds = (257, 2212) | 1 | AAGCAAATACCTTTTACAAGTGAAAG GAAGAATTTTTCTTCTGCCGTCAA |
| 7167 | db mining | Hs.3804 | NM_014045 | 13027587 | DKFZP564C1940 protein (DKFZP564C1940), mRNA/cds = (565, 1260) | 1 | GCAACAAATGCTTCTATTCCATAGCT ACGGCATTGCTCAGTAAGTTGAGG |
| 7168 | db mining | Hs.3832 | NM_032493 | 14210503 | clathrin-associated protein AP47 (AP47), mRNA/cds = (76, 1347) | 1 | TCCGTGTAGAGGTTACAGCCTTTTAT GCTGTTGAGCTCCCAGGTACCAAA |
| 7169 | db mining | Hs.4113 | NM_006821 | 5729723 | S-adenosylhomocysteine hydrolase-like 1 (AHCYL1), | 1 | GCCCACTTGGATTTATAGTATAGCCC TTCCTCGACTCCCACCAGACTTGC |

TABLE 8-continued

| SEQ ID | Origin | Unigene | Locus | GI | Nominal Description | Strand | Probe Sequence |
|---|---|---|---|---|---|---|---|
| 7170 | db mining | Hs.83848 | NM_000991 | 13904865 | triosephosphate isomerase 1 (TPI1), mRNA/cds = (34, 783) mRNA/cds = (47, 1549) | 1 | AAGAGCTCCTGAGCCCCCTGCCCCC AGAGCAATAAAGTCAGCTGGCTTTC |
| 7171 | db mining | Hs.5076 | AK025781 | 10438401 | cDNA: FLJ22128 fis, clone HEP19543/cds = UNKNOWN | 1 | GCTCAACATGGAAAGAAGGTACAGAA AGTGATGTGTTCAAAACATTAGCA |
| 7172 | db mining | Hs.5298 | NM_015999 | 7705760 | CGI-45 protein (LOC51094), mRNA/cds = (182, 1294) | 1 | TTATATACCCTGGTCCCATCTTTCTAG GGCCTGGATCTGCTTATAGAGCA |
| 7173 | db mining | Hs.5473 | AW953785 | 8143488 | 602659798F1 cDNA, 5' end/ clone = IMAGE: 4802950/ clone_end = 5' | 1 | GTTTACTCCGTCCCTATCACTGGTGT GGCTGTGGGCAAACCACTTATTGC |
| 7174 | db mining | Hs.5831 | NM_003254 | 4507508 | tissue inhibitor of metalloproteinase 1 (erythroid potentiating activity, collagenase inhibitor) TIMP1), mRNA/cds = (62, 685) | 1 | GAACTGAAGCCTGCACAGTGTCCAC CCTGTTCCCACTCCCATCTTTCTTC |
| 7175 | db mining | Hs.5890 | BF698885 | 11984293 | hypothetical protein FLJ23306 (FLJ23306), mRNA/cds = (562, 930) | 1 | GAAGACCAAGAGAGACAACAGACGC AGCAAACAGCCGAAGCACCAGACAA |
| 7176 | db mining | Hs.6211 | NM_015846 | 7710138 | methyl-CpG binding domain protein 1 (MBD1), transcript variant 1, mRNA/cds = (139, 1956) | 1 | AATTCAGAAAATTGTTGGGAGGACAG CCCTTTTGTGAACCTTGTTTGGGG |
| 7177 | db mining | Hs.6285 | AL080220 | 5262711 | mRNA; cDNA DKFZp586P0123 (from clone DKFZp586P0123); partial cds/cds = (0, 1067) | 1 | TTTACCCAGCTCTGAAGGTCATTGTT CTTGCCTGTGTTTGAATAAAATCA |
| 7178 | db mining | Hs.6441 | AL110197 | 5817115 | mRNA; cDNA DKFZp586J021 (from clone DKFZp586J021)/ cds = UNKNOWN | 1 | GTCTCTGATGCTTTGTATCATTCTTGA GCAATCGCTCGGTCCGTGGACAA |
| 7179 | db mining | Hs.6459 | NM_024531 | 13375681 | hypothetical protein FLJ11856 (FLJ11856), mRNA/cds = (239, 1576) | 1 | GGTAAGCCCCTGAGCCTGGGACCTA CATGTGGTTTGCGTAATAAAACATT |
| 7180 | db mining | Hs.6618 | AL524742 | 12768235 | AL524742 cDNA/clone = CS0DC008YI07-(5-prime) | 1 | TCTGGCTCTGACCGGTTGATGGCTT GAGCGAATGAAATCATGAAATTGA |
| 7181 | db mining | Hs.6650 | NM_007259 | 6005775 | vacuolar protein sorting 45B (yeast homolog) (VPS45B), mRNA/cds = (33, 1745) | 1 | TGCCCTACATAGCAATTTTCTGTGGC ACTGAGAAACCATGTATGACCACA |
| 7182 | db mining | Hs.6763 | NM_015310 | 7662395 | KIAA0942 protein (KIAA0942), mRNA/cds = (52, 1658) | 1 | GCAGTGTACTGTGTGCAATACCAAGG GCATAGCTCCCTGTAATTTGGGAA |
| 7183 | db mining | Hs.6780 | NM_007284 | 6005845 | protein tyrosine kinase B-like (AB-related protein) (PTK9L), mRNA/cds = (104, 1153) | 1 | CTGAGACTAGGGTCCCAGCACAGCC CAGAACCTTTGGCCACAAGAAGTG |
| 7184 | db mining | Hs.6817 | NM_025200 | 13376793 | putative oncogene protein hlc14-06-p (HLC14-08-P), mRNA/ cds = (51, 635) | 1 | TCGCCTTCCATGGTTTTTAAATGCAG TAAATAACATTTCTGGATGAGACT |
| 7185 | db mining | Hs.7709 | U79457 | 4205083 | Homo sapiens, Similar to WW domain binding protein 1 clone MGC: 15305 IMAGE: 4309279 mRNA, complete cds/cds = (162, 971) | 1 | GCTTTACCCCCGCAGGACATACACAG GAGCCTTTGATCTCATTAAAGAGA |
| 7186 | db mining | Hs.7740 | AF288741 | 14209837 | oxysterol binding protein 2 (OSBP2) mRNA, complete cds/ cds = (112, 2748) | 1 | GGAATGTACCTCTCCCCAACACTGTT TTGTTAGCGAGCACCTTTTGACCA |
| 7187 | db mining | Hs.8108 | NM_021080 | 10835268 | disabled (Drosophila) homolog 1 (DAB1), mRNA/cds = (785, 2426) | 1 | ACTCGCTCAGAAGAGGGAACTAAGC ATTTTTGGCAACCAATGGGCAGATA |
| 7188 | db mining | Hs.8109 | NM_022743 | 12232400 | hypothetical protein FLJ21080 (FLJ21080), mRNA/cds = (127, 1236) | 1 | AGCTGTGTGAACCTCTCTTATTGGAA ATTCTGTTCCGTGTTTGTGTAGGT |
| 7189 | db mining | Hs.8207 | NM_020198 | 9910241 | GK001 protein (GK001), mRNA/ cds = (184, 1635) | 1 | AGTCCCATACATTTGGACCATGGCAG CTAATTTTGTAACTTAAGCATTCA |
| 7190 | db mining | Hs.226627 | BC007375 | 13938462 | leptin receptor short form (db) mRNA, complete cds/cds = (0, 2890 | 1 | CTGCCCCCTTCCTGGACTTCGTGCCT TACTGAGTCTCTAAGACTTTTTCT |

TABLE 8

| SEQ ID | Origin | Unigene | Locus | GI | Nominal Description | Strand | Probe Sequence |
|---|---|---|---|---|---|---|---|
| 7191 | db mining | Hs.8768 | NM_018243 | 8922711 | hypothetical protein FLJ10849 (FLJ10849), mRNA/cds = (93, 1382) | 1 | GGATAACATTTCTCATGAACCCACTG CCCCTCTGCSTTTTCCTCACTGGT |
| 7192 | db mining | Hs.8834 | NM_006315 | 5454011 | ring finger protein 3 (RNF3), mRNA/ cds = (114, 857) | 1 | CGCTTAAGAACATTGCCTCTGGGTGT CATGTGGACCAGACTTTCTGAATAG |
| 7193 | db mining | Hs.9683 | NM_006260 | 5453979 | protein-kinase, interferon-inducible double stranded RNA dependent | 1 | GGGTTCAATCCCTTCAGCTCAGGCG GACCATTTAGATTTAAATTCCACTT |

TABLE 8-continued

| SEQ ID | Origin | Unigene | Locus | GI | Nominal Description | Strand | Probe Sequence |
|---|---|---|---|---|---|---|---|
| | | | | | inhibitor (PRKRI), mRNA/ cds = (690, 2204) | | |
| 7194 | db mining | Hs.9825 | NM_016062 | 7706342 | CGI-128 protein (LOC51647), mRNA/ cds = (35, 526) | 1 | GCTCCTGCCAGGGCTGTTACCGTTGT TTTCTTGAATCACTCACAATGAGA |
| 7195 | db mining | Hs.10590 | AL031685 | 9368423 | DNA sequence from clone RP5-963K23 on chromosome 20q13.11-13.2 Contains a KRT18 (Keratin type 1, Cylosketetal 18 (Cytokeratin 18, CK18, CYK18), pseudogene, a gene for a novel protein, the gene for spermatogenesis associated protein PD1 (KIAA0757) and the 3' end of the gene for KIAA0939 (novel Sodium/hydrogen exchanger family member). Contains ESTs, STSs, GSSs and four putative CpG islands/ cds = (2, 688) | 1 | AATCTGGCGAAACCTTCGTTTGAGGG ACTGATGTGAGTGTATGTCCACCT |
| 7196 | db mining | Hs.11485 | NM_004832 | 4758483 | glutathions-S transferase like: glutathione transferase omega (GSTTLp28), mRNA/cds = (9, 734) | 1 | GACTATGGGCTCTGAAGGGGGCAGG AGTCAGCAATAAAGCTATGTCTGAT |
| 7197 | db mining | Hs.11538 | NM_005720 | 5031600 | actin related protein 2/3 complex, subunit 1A (41 kD) (ARPC18), mRNA/ cds = (80, 1198) | 1 | AGGGAGGGGACAGATGGGGAGCTTT TCTTACCTATTCAACGAATACGTGC |
| 7198 | db mining | Hs.12707 | AK023168 | 10434970 | cDNA FLJ13106 fis, clone NT2RP3002455, highly similar to mRNA for KIAA0678 protein/ cds = UNKNOWN | 1 | ACCTTCTGAAAGCTCACAGTACACAT TAGTATGTATAACTGGCTTTACCA |
| 7199 | db mining | Hs.12785 | AL031685 | 9368423 | DNA sequence from clone RP5-963K23 on chromosome 20q1311-13.2 Contains a KRT18 (Keratin type 1, Cytoskeletal 18 (Cytokeratin 18, CK18, CYK18)) pseudogene, a gene for a novel protein, the gene for spermatogenesis associated protein PD1 (KIAA0757) and the 3' end of the gene for KIAA0939 (novel Sodium/hydrogen exchanger family member). Contains ESTs, STSs, GSSs and four putative CpG islands/ cds = (0, 1313) | 1 | TTTAAGGGAGTCAGGAATAGATGTAT GAACAGTCGTGTCACTGGATGCCT |
| 7200 | db mining | Hs.13323 | NM_022752 | 12232416 | hypothetical protein FLJ22059 (FLJ22059), mRNA/cds = (783, 1967) | 1 | CCCACCTTCCACCTCTTAGCACTGGT GACCCCAAAAATGAAACCATCAAT |
| 7201 | db mining | Hs.13659 | AL080209 | 5262698 | Hypothetical protein DKFZp586F2423 | 1 | AGACCAGCAGTGTTAAATCTAAATA CGTTGTGAGTCTGTTATCTGTCCT |
| 7202 | db mining | Hs.14089 | NM_013379 | 7019510 | dipeptidyl peptidase 7 (DPP7), mRNA/ cds = (0, 1478) | 1 | ACCTCGACCTCAGAGCCTCCCACCC AGAAGATCCTGCTTCCGTGGTTGAG |
| 7203 | db mining | Hs.16488 | NM_004343 | 5921996 | calreticulin (CALR), mRNA/ cds = (88, 1321) | 1 | GGGCAGTGGGTCCCACATTGGCTCA CACTGAGAATGTAAGAACTACAAAC |
| 7204 | db mining | Hs.16580 | NM_018303 | 8922829 | hypothetical protein FLJ11026 (FLJ11026), mRNA/cds = (31, 2355) | 1 | TGGCCTTAAGTTTTCTAATTCAAGCG GGTTTTTGGAAAAATTTATGGTCT |
| 7205 | db mining | Hs.109438 | AB028950 | 5689390 | clone 24775 mRNA sequence/ cds = UNKNOWN | 1 | TGCAGAGTTATAAGCCCCAAACAGGT CATGCTCCAATAAAAATGATTCTA |
| 7206 | db mining | Hs.18588 | NM_014826 | 7662135 | KIAA0451 gene product (KIAA0451), mRNA/cds = (1482, 2219) | 1 | CCAAACAATGATGTGGATTCTTTTGC ACAGAAATATTTAAGGTGGGATGG |
| 7207 | db mining | Hs.19575 | NM_015941 | 7708261 | CGI-11 protein (LOC51606), mRNA/ cds = (233, 1684) | 1 | ACAAAAGTCAACTGTTGTCTCTTTTCA AACCAAATTGGGAGAATTGTTGC |
| 7208 | db mining | Hs.20529 | AK025464 | 10437985 | cDNA, FLJ21811 fis, clone HEP01037/ cds = UNKNOWN | 1 | GCTGGGGACTCTAGCCTCTGTGTTCA TAAAGACATTAAGAAGTGGATGGA |
| 7209 | db mining | Hs.20725 | NM_020963 | 14211539 | Mov10 (Moloney leukemia virus 10, mouse) homolog (MOV10), mRNA/ cds = (70, 3081) | 1 | GGAGAATGACACATCAAGCTGCTAAC AATTGGGGGAAGGGGAAGGAAGAA |
| 7210 | db mining | Hs.343590 | AB011104 | 3043587 | 601471579f1 cDNA, 5' end/ clone = IMAGE:3874747/clone_end = 5' | 1 | ACCTGGGTTTAATACAGCTCACATCA CTGAATGTTACACATGAGTTTAAA |
| 7211 | db mining | Hs.23449 | NM_018842 | 10047119 | insulin receptor tyrosine kinase substrate (LOC55971), mRNA/ cds = (333, 1553) | 1 | CTTAAGGACGCCTTTGCCTGGCCCCT TTATTACAGCCCAACACGGTAGGC |
| 7212 | db mining | Hs.23990 | NM_017838 | 8923443 | nucleolar protein family A, member 2 (H/ACA small nucleolar RNPs) (NOLA2), mRNA/cds = (66, 547) | 1 | TCCATCAGTGCCATTTCCTGTAGAAC TAAAGGCTGTTCCAAGAATGTGGG |
| 7213 | db mining | Hs.24024 | NM_015376 | 7662333 | KIAA0846 protein (KIAA0846), mRNA/cds = (272, 2341) | 1 | ATCTGTAAAGCACTCAGAAGGCAGCC ATCCCTAGATGTTGGTTTCATGTA |
| 7214 | db mining | Hs.334842 | BC008330 | 14249901 | tubulin, alpha, uiquitous (K-ALPHA-1), mRNA/cds = (67, 1422) | 1 | TGGTTAGATTGTTTTCACTTGGTGAT CATGTCTTTTCCATGTGTACCTGT |
| 7215 | db mining | Hs.24641 | AK022982 | 10434687 | cDNA FLJ12920 fis, clone NT2RP2004594/cds = (96, 2144) | 1 | CATGTCCCTTGAAACATGATAGTTAC ATACACAGTTTTCTCTCCACACAT |

TABLE 8-continued

| SEQ ID | Origin | Unigene | Locus | GI | Nominal Description | Strand | Probe Sequence |
|---|---|---|---|---|---|---|---|
| 7216 | db mining | Hs.321105 | NM_016462 | 7661683 | cDNA: FLJ21737 fis, clone COLF3396/cds = UNKNOWN | 1 | AGGTTTCACATGAACCTGTTCTAGGC TGTGGACATTGGTGTGGAGAGGTT |
| 7217 | db mining | Hs.26802 | NM_021158 | 11056039 | protein kinase domains containing protein similar to phosphoprotein C8FW (LOC57761), mRNA/cds = (294, 1370) | 1 | GACACTTGGGGTCCACAATCCCAGG TCCATACTCTAGGTTTTGGATACCA |
| 7218 | db mining | Hs.26892 | NM_018456 | 8922098 | uncharacterized bone marrow protein BM040 (BM040), mRNA/cds = (257, 749) | 1 | AGAAATGATTTGCAGCTGAGTGAATC AGGAAGTGACAGTGATGACTGAAG |
| 7219 | db mining | Hs.27076 | NM_003729 | 4506588 | RNA 3'-terminal phosphate cyclase (RPC), mRNA/cds = (170, 1270) | 1 | TCCTGAGAGATGGACAATGAAATATC AGTTGGTGGATATGTGTGATAGCT |
| 7220 | db mining | Hs.27445 | NM_018209 | 7706428 | unknown (LOC51693), mRNA/cds = (58, 480) | 1 | CTTTCAGGGCAGGCAGCTGTGCATG TTCTCTCAACTAAAGGTCTTGTGAG |
| 7221 | db mining | Hs.27633 | NM_015456 | 7661663 | DKFZP586B0519 protein (DKFZP586B0519), mRNA/cds = (75, 1199) | 1 | GCTGGACACACGGTGAGATTTTCTCG TATGTAAATAAAAGGCAATTTGGT |
| 7222 | db mining | Hs.28310 | BG260891 | 12770707 | 602372491F1 cDNA, 5' end/clone = IMAGE:4480510/clone_end = 5' | 1 | CTCAACGAAAGGCTCACACTAACAGG GGAGGATTACAGCACCACAATACT |
| 7223 | db mining | Hs.28914 | NM_000485 | 4502170 | adenine phosphoribosyltransferase (APRT), mRNA/cds = (71, 613) | 1 | CCACACTGAACCCAATTACACACAGC GGGAGAACGCAGTAAACAGCTTTC |
| 7224 | db mining | Hs.29893 | AL133426 | 6562628 | mRNA full length insert cDNA clone EUROIMAGE 146397/cds = UNKNOWN | 1 | AGGCCCTGGAAAATTTTGTGCTTCCA ACGTGGCCTTCAATTCTTGCTTTT |
| 7225 | db mining | Hs.30120 | BF970068 | 12337281 | 802272333F1 cDAN, 5' end/clone = IMAGE:4360233/clone_end = 5' | 1 | TATTAAGCTTGCCCAGGCTCCTGTTC ATGAAGGTTCCCCCAGCGGTGGCC |
| 7226 | db mining | Hs.30250 | AF055376 | 3335147 | short form transcription factor C-MAF (c-mal) mRNA, complete cds/cds = (807, 1926) | 1 | GCTATACCACTGACTGTATTGAAAAC CAAAGTATTAAGAGGGGAAACGCC |
| 7227 | db mining | Hs.30443 | AL138599 | 13276598 | mRNA: cDNA DKFZp564G1816 (from clone DKFZp5864G1816); complete cds/cds = (137, 3091) | 1 | TCGGGGTCAGTTAAGCCTCAGTATTC TTAGCTTTTGTTGATTTTGGCACT |
| 7228 | db mining | Hs.31137 | NM_006504 | 5729992 | protein tyrosine phosphatase, receptor type, E (PTPRE), mRNA/cds = (51, 2153) | 1 | ATGGTGCAAACCCTGGAACAGTATGA ATTCTGCTACAAAGTGGTACAAGA |
| 7229 | db mining | Hs.34114 | NM_000702 | 4502270 | ATPase, Na+/K+ transporting, alpha 2 (+)polypeptide (ATP1A2), mRNA/cds = (104, 3166) | 1 | AGAAGCAGCGAGTGCATGGGCTAAT TATCATCAATCTTTATGTATTTGTT |
| 7230 | db mining | Hs.35254 | NM_020119 | 9910221 | hypothetical protein FLB6421 (FLB6421), mRNA/cds = (310, 792) | 1 | GGAAATGTTGCTGTGGGGGATTCATT GTAACTCTCCTTGTGAACTGCTCA |
| 7231 | db mining | Hs.38735 | BG149337 | 12661367 | nad26g06.x1 cDNA, 3 end/clone = IMAGE:3365730/clone_end = 3' | 1 | ATGCCAAATTCCTGACACGTGGCGTT TGAAAATACCATGGAACGTTTCCA |
| 7232 | db mining | Hs.41322 | AI655467 | 4739446 | tt13b01.x1 cDNA 3' end/clone = IMAGE:2240617/clone_end = 3' | 1 | ACATTCTGACTCCATCTGCGGCCTCA TTAAGGTGATAGAAACATACTAGG |
| 7233 | db mining | Hs.42346 | AY013295 | 11693027 | calcineurin-binding protein calsarcin-1 mRNA, complete cds/cds = (131, 925) | 1 | ATGATAATGTTGGCATCTGTGATAAA CTATCAATGAGGCTCCCATCATGC |
| 7234 | db mining | Hs.42699 | AW956580 | 8146278 | EST368865 cDNA | 1 | AGAGTCACATGTAGAAAAGCCTCCAG TATTAAGCTCCTGAATTCATTCCT |
| 7235 | db mining | Hs.44131 | AB023191 | 4669591 | mRNA for KIAA0974 protein, partial cds/cds = (0, 1697) | 1 | ATGGCAACAATGCTGACAGCAAGCA GTAGATCCTCTGATTCCAATTACCA |
| 7236 | db mining | Hs.44441 | BE295812 | 9179366 | 601176827F1 cDNA, 5' end/clone = IMAGE:3532039/clone_end = 5' | 1 | GGGAACCCTCATTAATTAGACAAGAA CACCAAGGCTATGACCACAGCAGC |
| 7237 | db mining | Hs.46919 | AY007155 | 9956067 | clone CDABP0095 mRNA sequence/cds = UNKNOWN | 1 | GGCTCACCAGAGTACCCAGAAGAAT CAGTATGGAATTAGAGGACAGTGGC |
| 7238 | db mining | Hs.56009 | NM_006187 | 5453823 | 2'-5'-oligoadenylate synthetase 3 (100 kD) (OAS3), mRNA/cds = (34, 3297) | 1 | ATTCCAGGCCCTCAGTCTTTGGCAAT GGCCACCCTGGTGTTGGCATATTG |
| 7239 | db mining | Hs.57843 | W63785 | 1371386 | zd30g09.s1 cDNA, 3' end/clone = IMAGE:342208/clone_end = 3' | 1 | GCATACATAAAGGCAAAGAATGACAA AAGGCTTAATCCACCTAGAAGACA |
| 7240 | db mining | Hs.58373 | BF339746 | 11286202 | 602034942F1 cDNA, 5' end/clone = IMAGE:4182851/clone_end = 5' | 1 | ATATAGTGGGAGACAAAACACAGGAG GCGGGGGATATCATGTAGCAGAGC |
| 7241 | db mining | Hs.59238 | NM_032139 | 14149802 | hypothetical protien DKFZp434L0718 (DKFZP434L0718), mRNA/cds = (133, 3285) | 1 | TCTAATGTGCCTTGGATATGTGCCAA ATGATGGAMAGAAACAGTAAACT |
| 7242 | db mining | Hs.62406 | NM_024660 | 13375912 | hypothetical protein FLJ22573 (FLJ22573), mRNA/cds = (99, 1166) | 1 | GCTTGGCTCATCTGGGGTTTGCTGG GCTTAACACCCAATAAAGAACTTTG |
| 7243 | db mining | Hs.63042 | NM_018457 | 8922158 | DKFZp564J157 protein (DKFZp564J157), mRNA/cds = (77, 523) | 1 | CTGCGGTTTTGGAACCTTACCTCTCC TCCTTAGCCCAATATGCTGTCTTG |
| 7244 | db mining | Hs.65648 | NM_005105 | 4826971 | RNA binding motif protein 8A (RBM8A), mRNA/cds = (12, 536) | 1 | TCCAGGCCATTTTGCAGGGACTCTGA AGTGACCTTTAGTAGTAATAGTCT |
| 7245 | db mining | Hs.339868 | NM_003974 | 4503356 | oh47h10s1 cDNA, 3' end/ | 1 | TGGCAGCCAGGAACTGAGTATGACA |

TABLE 8-continued

| SEQ ID | Origin | Unigene | Locus | GI | Nominal Description | Strand | Probe Sequence |
|---|---|---|---|---|---|---|---|
| | | | | | clone = IMAGE:1469827/clone_end = 3' | | ATGTTGTACTAAAGAAAGGCCCAAA |
| 7246 | db mining | Hs.75056 | NM_003938 | 4501976 | adaptor-related protein complex 3, delta 1 subunit (AP3D1), mRNA/ cds = (209, 3547) | 1 | AGAGAGAGACATATCACGCTGCTGTC ATGATTTTGTGTCAAGATGATCCA |
| 7247 | db mining | Hs.75082 | NM_001665 | 4502218 | ras homolog gene family, member G (rho G) (ARHG), mRNA/cds = (129, 704) | 1 | CTTCTGGGGACCTTTCCTACCCCCAT CAGCATCAATAAAACCTCCTGTCT |
| 7248 | db mining | Hs.75309 | NM_001961 | 4503482 | eukaryctic translation elongation factor 2 (EEF2), mRNA/cds = (0, 2576) | 1 | TAGATGATTTCTAGCAGGCAGGAAGT CCTGTGCGGTGTCACCATGAGCAC |
| 7249 | db mining | Hs.75725 | NM_003584 | 4507356 | transgelin 2 (TAGLN2), mRNA/ cds = (73, 672) | 1 | CCATGGTCTGGGGCTTGAGGAAGAT GAGTTTGTTGATTAAATAAAGAAT |
| 7250 | db mining | Hs.75770 | NM_000321 | 4506434 | retinoblastoma 1 (including osteosarcoma) (RB1), mRNA/ cds = (138, 2924) | 1 | AGGTCAAGGGCTTACTATTTCTGGGT CTTTTGCTACTAAGTTCACATTAG |
| 7251 | db mining | Hs.75790 | NM_002642 | 4505794 | phosphatidylinositol glycan, class C (PIGC), mRNA/cds = (293, 1186) | 1 | TTTCTGGGGACCTCTTGAATTACATG CTGTAACATATGAAGTGATGTGGT |
| 7252 | db mining | Hs.76057 | NM_000403 | 9945333 | galactose-4-epimerase, UDP-(GALE), mRNA/cds = (76, 1122) | 1 | TGGCACAAAACCTCCTCCTCCCAGGC ACTCATTTATATTGCTCTGAAAGA |
| 7253 | db mining | Hs.76662 | NM_032327 | 14150105 | hypothetical protein MGC2993 (MGC2993), mRNA/cds = (158, 1048) | 1 | TGAGGTCACTGCCACTTCTCACATGC TGCTTAAGGGAGCACAAATAAAGG |
| 7254 | db mining | Hs.77266 | NM_002826 | 13325074 | quiescin Q6 (QSCN6), mRNA/ cds = (75, 2318) | 1 | CACGCTACCCCCTGCCTTGGGAGGT GTGTGGAATAAATTATTTTTGTTAA |
| 7255 | db mining | Hs.77290 | NM_006755 | 5803186 | transaldolase 1 (TALDO1), mRNA/ cds = (50, 1063) | 1 | AATGCAGAGAATGGAAAGTAGCGCAT CCCTGAGGCTGGACTCCAGATCTG |
| 7256 | db mining | Hs.77805 | NM_001696 | 4502316 | ATPase, H+ transporting, lysosomal (vacuolar proton pump) 31 kD (ATP6E), mRNA/cds = (75, 755) | 1 | GTGGCACACCACTCCTTCCAGCAGTA GTCGCTTTACTGTTACCTGTTTAG |
| 7257 | db mining | Hs.78592 | NM_001414 | 4503502 | eukaryotic translation initiation factor 2b, subunit 1 (alpha, 26 kD) (EIF281), mRNA/cds = (10, 927) | 1 | AGCAACAGTATTCTGCATGGTTCACT GCTTAAGAAAATGCCTTCTGGAAT |
| 7258 | db mining | Hs.78605 | BC006159 | 13544048 | Homo sapiens, clone IMAGE:3635549, mRNA, partial cds/cds = (0, 891) | 1 | AAACATGTCCCTGGAGAGTAGCCTGC TCCCACACTGTCACTGGATGTCAT |
| 7259 | db mining | Hs.78890 | AF171938 | 5852969 | NUMB isoform 1 (NUMB) mRNA, complete cds/cds = (270, 2225) | 1 | CAGTTGCAGCCTCTTGACCTCGGATA ACAATAAGAGAGCTCATCTCATTT |
| 7260 | db mining | Hs.79150 | NM_006430 | 5453604 | chaperonin containing TCP1, subunit 4 (delta) (CCT4), mRNA/cds = (0, 1619) | 1 | TGGGCTTGGTCTTCCAGTTGGCATTT GCCTGAAGTTGTATTGAAACAATT |
| 7261 | db mining | Hs.79259 | NM_016404 | 7705476 | hypothetical protein (HSPC152), mRNA/cds = (35, 412) | 1 | TTCTGCCGTGTGTATCCCCAACCCTT GACCCAATGACACCAAACACAGTG |
| 7262 | db mining | Hs.79358 | NM_006762 | 5803055 | Lysosomal-associated multispanning membrane protein-5 (LAPTM5), mRNA/cds = (75, 863) | 1 | TGTGTGCGACAGGGAGGAAGTTTCA ATAAAGCAACAACAAGCTTCAAGGA |
| 7263 | db mining | Hs.79572 | NM_001909 | 4503142 | cathepsin D (lysosomal aspartyl protease) (CTSD), mRNA/ cds = (2, 1240) | 1 | CTCCCCTTGGGCGGCTGAGAGCCCC AGCTGACATGGAAATACAGTTGTTG |
| 7264 | db mining | Hs.81337 | NM_009587 | 6806889 | lectin, galactoside-binding, soluble, 9 (galectin 9) (LGALS9), transcript variant long, mRNA/cds = (56, 1123) | 1 | CTCCACCACCTGACCAGAGTGTTCTC TTCAGAGGACTGGCTCCTTTCCCA |
| 7265 | db mining | Hs.82030 | NM_004184 | 7710155 | tryptophanyl-tRNA synthetase (WARS), mRNA/cds = (187, 1502) | 1 | CTCTGCCCTCCTGTCACCCAGTAGAG TAAATAAACTTCCTTGGCTCCTAA |
| 7266 | db mining | Hs.82396 | NM_016816 | 8051620 | 2',5'-oligoadenylate synthetase 1 (40-48 kD) (OAS1), transcript variant E18, mRNA/cds = (33, 1235) | 1 | AAATTCCAGCCTTGACTTTCTTCTGT GGACCTGATGGGAGGGTAATGTCT |
| 7267 | db mining | Hs.82933 | BC008739 | 14250568 | Homo sapiens, protein x 013, clone MGC:3073 IMAGE:3346340, mRNA, complete cds/cds = (101, 325) | 1 | CTGTAGGCCAGGGTGGAATGAAGTC AGCTCCTTTTATAGTTGAAATACA |
| 7268 | db mining | Hs.83753 | NM_003091 | 4507124 | small nuclear ribonucleoprotein polypeptides B and B1 (SNRPB), mRNA/cds = (0, 695) | 1 | TTGGCGGGCCATCCCAACAGGTGAT GACCCCACAAGGAAGAGGTACTGTT |
| 7269 | db mining | Hs.85838 | NM_004207 | 4759111 | solute carrier family 16 (monocarboxylic acid transporters), member 3 (SLC18A3), mRNA/ cds = (62, 1459) | 1 | GGAAGATGGAAATAAACCTGCGTGTG GGTGGAGTGTTCTCGTGCCGAATT |
| 7270 | db mining | Hs.306586 | NM_013341 | 9558756 | clone HQ0688/cds = UNKNOWN | 1 | AGTGAGGACAATGTGGGTTGCTCCTT TTTGAATCTACAGATAATGCATGT |
| 7271 | db mining | Hs.89497 | NM_005573 | 5031876 | lamin B1 (LMNB1), mRNA | 1 | GAGGGTGGGGAGGGAGGTGGAGG GAGGGAAGGGTTTCTCTATTAAAATG |
| 7272 | db mining | Hs.89525 | NM_004494 | 4758515 | heptoma-derived growth factor (high-mobility group protein 1-like) (HDGF), mRNA/cds = (315, 1037) | 1 | TGCTGACTGTAGCTTTGGAAGTTTAG CTCTGAGAACCGTAGATGATTTCA |
| 7273 | db mining | Hs.92208 | NM_003815 | 11497001 | a disintegrin and metalloproteinase domain 15 (metargidin) (ADAM15), mRNA/cds = (7, 2451) | 1 | GATTGAGGAAGGTCCGCACAGCCTG TCTCTGCTCAGTTGCAATAAACGTG |
| 7274 | db mining | Hs.103527 | NM_003975 | 4503632 | SH2 domain protein 2A (SH2D2A), mRNA/cds = (88, 1255) | 1 | GATTCTTGTCTGGCTAATAAATCATCA CCAACTGCCTTCTGCTACAGGGA |
| 7275 | db mining | Hs.104679 | BF347382 | 11294957 | Homo sapiens, clone MGC:18216 | 1 | AGATTCTTAGGGCACGTTTGTTCCCC |

TABLE 8-continued

| SEQ ID | Origin | Unigene | Locus | GI | Nominal Description | Strand | Probe Sequence |
|---|---|---|---|---|---|---|---|
| | | | | | IMAGE:4156235, mRNA, complete cds/cds = (2208, 2373) | | TTGGAGGGTTTTCCACACGGAGTC |
| 7276 | db mining | Hs.105749 | AB011125 | 3043629 | mRNA for KIAA0553 protein, partial cds/cds = (0, 3289) | 1 | GCCATACTCTGGCTGCCTCTTTGCCT TCCTAGGGGCATTTTCTTTAACTT |
| 7277 | db mining | Hs.105751 | AL138761 | 8573811 | DNA sequence from clone RO11-16H23 on chromosome 10. Contains the gene KIAA0204 (HSLK) for a protein kinase, the COL17A1 gene for collagen type XVII alpha 1 (BP180), ESTs and GSSs/cds = (0, 3557) | 1 | TGCCTCTTATCTACTTGAGAGCAACA TGTCTTTTCAATCATGGGATTGAC |
| 7278 | db mining | Hs.324406 | AK026741 | 10439662 | ribosomal protein L41 (RPL41), mRNA/ cds = (83, 180) | 1 | TGGACCTGTGACATTCTGGACTATTT CTGTGTTTATTTGTGGGCGAGTGT |
| 7279 | db mining | Hs.108371 | NM_001950 | 12669914 | E2F transcription factor 4, p107/p130-binding (E2F4), mRNA/cds = (62, 1303) | 1 | TGAAGGTGTCTGTGACCTCTTTGATG TGCCTGTTCTCAACCTCTGACTGA |
| 7280 | db mining | Hs.109760 | NM_002491 | 4505360 | NADH dehydrogenase (ubiquinone) 1 beta subcomplex, 3 (12 kD, B12) (NDUFB3), mRNA/cds = (252, 548) | 1 | CCTGGAGTCCCTGAATAAAGATAAGA AGCATCACTGAAGATAATACCTGG |
| 7281 | db mining | Hs.109857 | AF151783 | 14248494 | MEG3 (MEG3) mRNA, complete cds/ cds = (52, 2253) | 1 | TTGTCCCGAAGATTTGCGCCTTTAGT |
| 7282 | db mining | Hs.306417 | NM_014714 | 7662193 | cDNA FLJ10935 fis, clone OVARC1000661/cds = (250, 938) | 1 | CTGCTAGGTCTGCCCACCGGCCAC CAACACTCCTGTAATTCCAATAAAG |
| 7283 | db mining | Hs.114199 | BG621594 | 13672965 | 602617003F1 cDNA, 5' end/ clone = IMAGE:4730858/clone_end = 5' | 1 | TTAAAATACTGTCATTGGTTGGGAGG GGATTGCATTAAATGATTAGTCCA |
| 7284 | db mining | Hs.118786 | BF131637 | 10970677 | 601820457F1 cDNA, 5' end/ clone = IMAGE:4052246/clone_end = 5' | 1 | CTCACACACGCAGGCGACAGTCAGA ACAAACAGGAACAAAGCTACAACAC |
| 7285 | db mining | Hs.122559 | NM_024872 | 13376307 | hypothetical protein FLJ22570 (FLJ22570), mRNA/cds = (0, 1490) | 1 | TGAATAGTGTGCAGACTCACAGATAA TAAAGCTCAGAGCAGCTCCCGGCA |
| 7286 | db mining | Hs.123373 | AW963279 | 8153115 | 602853825F1 cDNA, 5' end/ clone = IMAGE:4994982/clone_end = 5' | 1 | CCCAGTGCTTCACGGAGTTAAAGGAA AGATCTGCTGGTAGTGTTTAGTCT |
| 7287 | db mining | Hs.125078 | AF090094 | 4063829 | clone IMAGE 172979/ cds = UNKNOWN | 1 | CGAGCCGACCATGTCTTCATTTGCTT CCACAAGAACCGCGAGGACAGAGC |
| 7288 | db mining | Hs.130740 | AK000315 | 7020316 | cDNA FLJ20308 fis, clone HEP07264/ cds = (90, 1226) | 1 | TTTTCCCCCTTTAGTCTCCTGGCTTTT TCCTTTCCCTTCCCTTCTCCACT |
| 7289 | db mining | Hs.132955 | AL132665 | 6137021 | mRNA; cDNA DKFZp566E034 (from clone DKFZp586E034); complete cds/ cds = UNKNOWN | 1 | AACCCGTTGTGGAGATTATTGGAATT AACTGAGCCAAAGTGATTATGCAT |
| 7290 | db mining | Hs.133230 | BC000085 | 12652672 | Homo sapiens, ribosomal protein S15, clone MGC:2295 IMAGE:3507983, mRNA, complete cds/cds = (14, 451) | 1 | GCCCCCGATCCTACACCCTGAGCCT CAGAGCACTGCTACTTTTTAAAATA |
| 7291 | db mining | Hs.142677 | AK024108 | 10436406 | cDNA FLJ14046 fis, clone HEMBA1006461/cds = UNKNOWN | 1 | AAGCGTCTCATGGAGTTCGGACTGGT TGGGGTGATAATATTTGTTTCTTT |
| 7292 | db mining | Hs.146170 | NM_022842 | 12383093 | hypothetical protein FLJ22969 (FLJ22969), mRNA/cds = (274, 2223) | 1 | AAGCCAGGCTTTGGGATACAAGTTCT TTCCTCTTCATTTGATGCCGTGCA |
| 7293 | db mining | Hs.148550 | Z82215 | 3135984 | DNA sequence from clone RP1-68O2 on chromosome 22 Contains the 5' end of the APOL2 gene for apolipoprotein L 2, the APOL gene for apolipoprotein L, the MYH9 gene for nonmuscle type myosin heavy chain 9, ESTs, STSs and GSSs/cds = (0, 5882) | 1 | AGCTGTCACCACTACAGTAAGCTGGT TTACAGATGTTTTCCACTGAGCAT |
| 7294 | db mining | Hs.149846 | NM_002213 | 4504772 | integrin, beta 5 (ITGB5), mRNA/ cds = (29, 2419) | 1 | TGAAGGTACATCGTTTGCAAATGTGA GTTTCCTCTCCTGTCCGTGTTTGT |
| 7295 | db mining | Hs.151738 | NM_004994 | 4828835 | matrix metalloproteinase 9 (gelatinase B, 92 kD gelatinase, 92 kD type IV collaenase) (MMP9), mRNA/ cds = (19, 2142) | 1 | GGATACAAACTGGTATTCTGTTCTGG AGGAAAGGGAGGAGTGGAGGTGGG |
| 7296 | db mining | Hs.336451 | NM_024519 | 13375657 | Nucleoside disphosphate kinase type 6 (inhibito of p53-induced apoptosis-alpha) | 1 | CTGCCGCTGCCCAGCCACATCCCTT GGTTTTGTATTTTATTTACAGAGTT |
| 7297 | db mining | Hs.154276 | NM_001186 | 4502352 | BTB and CNC homology 1, basic leucine zipper transcription factor 1 (BACH1), mRNA/cds = (118, 2328) | 1 | TGCAGTAGACGATACAGGTTGCATGT GGACACTCAGTCACATTAACAACT |
| 7298 | db mining | Hs.155975 | NM_005608 | 5032004 | protein tyrosine phosphatase, receptor type, C-associated protein (PTPRCAP), mRNA/cds = (63, 683) | 1 | CCCCAACCACAGGCATCAGGCAACC ATTTGAAATAAAACTCCTTCAGCCT |
| 7299 | db mining | Hs.159410 | NM_014484 | 7657338 | molybdopterin synthase sulfurylase (MOCS3), mRNA/cds = (2, 1384) | 1 | GTACTGAGGTGACTGGTATAGTCTGA TGAGAAAGATGTGGATTGCCATAA |
| 7300 | db mining | Hs.160999 | AV648418 | 9869432 | AV648418 cDNA, 3' end/ clone = GLCBJC04/clone_end = 3' | 1 | CACTTGTTCAATCATGGAACTTTCTA GAACGCTGCCACTCTTCAAAGGCT |
| 7301 | db mining | Hs.164036 | NM_002078 | 4504060 | glucosamine (N-acetyl)-8-sulfatase (Sanfilippo disease IIID) (GNS), mRNA/cds = (87, 1745) | 1 | TCATCACAGTGTGGTAAGGTTGCAAA TTCAAAACATGTCACCCAAGCTCT |

TABLE 8-continued

| SEQ ID | Origin | Unigene | Locus | GI | Nominal Description | Strand | Probe Sequence |
|---|---|---|---|---|---|---|---|
| 7302 | db mining | Hs.164478 | NM_022461 | 11988002 | hypothetical protein FLJ21939 similar to 5-azacytidine induced gene 2 (FLJ21939), mRNA/cds = (379, 1557) | 1 | ACAACCTGATCATTGAAGCCAACTTT GTCCCAGCACATTCCTTAAGTCCT |
| 7303 | db mining | Hs.169615 | NM_023080 | 12751496 | hypothetical protein FLJ20989 (FLJ20989), mRNA/cds = (52, 741) | 1 | ACTTGATTAGGCTCCGGTTTTCCTTT GGCTTCTGCTTTTCAGTGAATGGC |
| 7304 | db mining | Hs.171811 | AK023758 | 10435787 | cDNA FLJ13696 fis, clone PLACE2000140/cds = UNKNOWN | 1 | TTGCAGACAAATTCCTCTGAGCTTAG CTAGGAGTTCATTATGCTTCCTGT |
| 7305 | db mining | Hs.171992 | NM_002843 | 4506314 | protein tyrosine phosphatase, receptor type, J (PTPRJ), mRNA/cds = (349, 4362) | 1 | ACAGTAGCTTAGCATCAGAGGTTTGC TTCCTCAGTAACATTTCTGTTCTC |
| 7306 | db mining | Hs.173373 | AB023148 | 4589505 | mRNA for KIAA0931 protein, partial cds/cds = (0, 2204) | 1 | ATGTGAGCCAGAGCATGTTGCAGCAA ATCTATTGTTTGTAAAAATAACAA |
| 7307 | db mining | Hs.173638 | NM_030756 | 13540470 | transcription factor 7-like 2 (T-cell specific, HMG-box) (TCF7L2), mRNA/cds = (307, 2097) | 1 | TTTGTGCCATGTGGCTACATTAGTTG ATGTTTATCGAGTTCATTGGTCAA |
| 7308 | db mining | Hs.177534 | NM_007207 | 13518225 | dual specificity phosphatase 10 (DUSP10), mRNA/cds = (142, 1590) | 1 | AGCCCAACCATTAAAAATTTAATACAA CTTGGTTTCTCCCCCTTTTTCCT |
| 7309 | db mining | Hs.177592 | NM_001003 | 4506668 | 602791378F1 cDNA, 5' end/ clone = IMAGE:4896908/clone_end = 5' | 1 | GCAAAGAAAGAAGAATCCGAGGAGT CTGATGATGACATGGGCTTTGGTCT |
| 7310 | db mining | Hs.179661 | BC008791 | 14250651 | Homo sapiens, tubulin, beta5, clone MGC:4029 IMGAE:3817988, mRNA, complete cds/cds = (1705, 3039) | 1 | TTGAAAAGATGACATCGCCCCAAGAG CCAAAAATAAATGGGAATTGAAAA |
| 7311 | db mining | Hs.179988 | NM_005803 | 6552331 | flotilin 1 (FLOT1), mRNA/cds = (164, 1447) | 1 | TTTTCCTGACCAAGACTGAGGGATGG GCTGGAGGTTTTCAACTTTGCCTAC |
| 7312 | db mining | Hs.180859 | NM_016139 | 7705850 | 16.7 Kd protein (LOC51142), mRNA/cds = (81, 536) | 1 | TCTGGGACTGGGCAAATGTTTGTGTG GCCTCCTTAAACTAGCTGTTATGT |
| 7313 | db mining | Hs.181301 | AK024855 | 10437263 | cDNA; FLJ21202 fis, clone COL00293/cds = UNKNOWN | 1 | AACCTAAACGTATTTCACTAACTCTG GCTCCTTCTCCATAAAGCACATTT |
| 7314 | db mining | Hs.181311 | NM_004539 | 7262387 | asparaginyl-tRNA synthetase (NARS), mRNA/cds = (73, 1719) | 1 | CCACCAAATGCATGTCATGTATTCTC AATAGGCTGTATTCCCAGCAGTCA |
| 7315 | db mining | Hs.181391 | AL390158 | 9388848 | mRNA; cDNA DKFZp781G2113 (from clone DKFZp781G2113)/cds = (0, 564) | 1 | TGTACAGGTAGCTAACTTTGTAAACG CTCTGTATTCCCTCTGCCCCCATG |
| 7316 | db mining | Hs.182281 | NM_016407 | 7705482 | hypothetical protein (HSPC164), mRNA/cds = (70, 990) | 1 | TCTCATCATTTCGAAGATAGCAGAGT CATAGTTGGGCACCCAGTGATTGG |
| 7317 | db mining | Hs.183180 | NM_016476 | 13324711 | anaphase promoting complex subunit 11 (yeast APC11 homolog) (ANAPC11), mRNA/cds = (0, 398) | 1 | CAACAAGGTGGAAACAAGGGGTGGA GCTGCGTTTGTTTTGCCATCACTAT |
| 7318 | db mining | Hs.183593 | NM_006965 | 5902161 | zinc finger protein 24 (KOX 17) (ZNF24), mRNA/cds = (164, 1270) | 1 | GAGCATTCCTCAGGGGAGGTCACCT GTGAGGTTCCCAGAACTGTAGTTTT |
| 7319 | db mining | Hs.184029 | AL137509 | 6808164 | Homo sapiens, clone MGC:2764 IMAGE:2958229, mRNA, complete cds/cds = (70, 1785) | 1 | TGCAGGTGTTGACAAGATCCGCCATC TGTAATGTCCTTGGCACAATAAAA |
| 7320 | db mining | Hs.187652 | AA833892 | 2907491 | od84g04.s1 cDNA/clone = IMAGE:1372758 | 1 | AAGAGTCTGACTTCTCACTAGGAGCA TGTCTGTTGTACTTACTTCAAACA |
| 7321 | db mining | Hs.188751 | BG111636 | 12605142 | 60228268F1 cDNA, 5' end/clone = IMAGE:4369892/clone_end = 5' | 1 | CAAACACCAAACCAAGATAACACCGG AACGATAAACAGCAGAAACAGAGA |
| 7322 | db mining | Hs.193392 | U46120 | 1164779 | expressed unknown mRNA/cds = UNKNOWN | 1 | TGGGTTTGTCCAGTTCAGGCTAGATG TGCATCATGGCAGGAAGAAAGAAG |
| 7323 | db mining | Hs.195453 | NM_001030 | 4506710 | ribosomal protein S27 (metallopanstimulin 1) (RPS27), mRNA/cds = (35, 289) | 1 | AAGGATGTTCCTTCAGGAGGAAGCA GCACTAAAAGCACTCTGAGTCAAGA |
| 7324 | db mining | Hs.196914 | D86978 | 1504025 | mRNA for KIAA0223 gene, partial cds/cds = (0, 3498) | 1 | CGGAAGCCACCGTGTGGTTCTTTCAC AGGCACGTTTATTTTGCTGAAATA |
| 7325 | db mining | Hs.198281 | NM_002654 | 4505838 | pyruvate kinase, muscle (PKM2), mRNA/cds = (109, 1704) | 1 | CCTCCACTCAGCTGTCCTGCAGCCAA CACTCCACCCTCCACCTTCCATTT |
| 7326 | db mining | Hs.200317 | AB037825 | 7243188 | mRNA for KIAA1404 protein, partial cds/cds = (64, 5841) | 1 | TCCCTCCTTCCAGTGTTCCTTAGAAC AGACATTTAGGTATCTCAGGTCCT |
| 7327 | db mining | Hs.202613 | BG284262 | 13035032 | 802407238F1 cDNA, 5' end/clone = IMAGE:4519449/clone_end = 5' | 1 | CAGCCGCAGCATCTAAACGAACAACA GAGGAGAACGACGAGGACAGAGTT |
| 7328 | db mining | Hs.210778 | AL136679 | 12052881 | mRNA; cDNA DKFZp584C1278 (from clone DKFZp584C1278); complete cds/cds = (104, 1690) | 1 | TCACTGGATTTCTGTGTCTTCACTAG AACACCATTGTCATCTCATATTGA |
| 7329 | db mining | Hs.211594 | NM_006503 | 5729990 | proteasome (prosome, macropain) 28S subunit, ATPase, 4 (PSMC4), mRNA/cds = (12, 1268) | 1 | GCTTCTCTCGCACCCCCAGCACCTCT GTCCCAAAACCTCATTCCCTTTTT |
| 7330 | db mining | Hs.226307 | NM_004900 | 4758159 | phorbolin (similar to apolipoprotein B mRNA editing protein) (DJ742C19.2), mRNA/cds = (79, 651) | 1 | AGCTGCTCACAGACACCAGCACAGC AATGTGCTCCTGATCAAGTAGATTT |
| 7331 | db mining | Hs.326048 | NM_008319 | 5453905 | cDNA FLJ14188 fis, clone NT2RP2005726/cds = UNKNOWN | 1 | ATGCTCATGTGGTGTCCCCACCGCC CACTTGTTTGATGTCACTGACTGTC |
| 7332 | db mining | Hs.227835 | NM_014972 | 14149656 | KIAA1049 protein (KIAA1049), mRNA/cds = (96, 2126) | 1 | GCTGAGTGTGTCGCTCCCTGGTCCA CTGTTTCTCCTATAAATGTAAATGG |
| 7333 | db mining | Hs.231967 | NM_014423 | 7656878 | ALL 1 fused gene from 5q31 | 1 | TGCAGCACATTGATAAGATGGTTTCC |

TABLE 8-continued

| SEQ ID | Origin | Unigene | Locus | GI | Nominal Description | Strand | Probe Sequence |
|---|---|---|---|---|---|---|---|
| 7334 | db mining | Hs.232400 | NM_031243 | 14043071 | (AF5Q31), mRNA/cds = (337, 3828) heterogeneous nuclear ribonucleoprotein A2/B1 (HNRPA2B1), transcript variant B1, mRNA/cds = (169, 1230) | 1 | GTGAGCTATGATAAGATTGAAATT ATAAATATGCAGTGATATGGCAGAAG ACACCAGAGCAGATGCAGAGAGCC |
| 7335 | db mining | Hs.236131 | NM_022740 | 13430859 | homeodomain-interacting protein kinase 2 (HIPK2), mRNA/cds = (108, 3704) | 1 | TTGAACCGGGGAGTGGGAGGACGTA GAGCAGAGAAGAGAACATTTTTAAA |
| 7336 | db mining | Hs.343558 | AF090896 | 6690168 | clone HQ0131 PRO0131 mRNA, partial cds/cds = (0, 233) | 1 | TTTGCTCATTCTAAACTCAAGCTTTTA AGCCTCACAGGATTTACAGGGGT |
| 7337 | db mining | Hs.238936 | BG538032 | 13530264 | 602563534F1 cDNA, 5' end/clone = IMAGE:4688193/clone_end = 5' | 1 | GCCATAGGCTTACATGGGGCATACTC |
| 7338 | db mining | Hs.241412 | NM_030882 | 13582089 | apolipoprotein L, 2 (APOL2), mRNA/cds = (477, 1490) | 1 | GGTCTCTCGCTCTGTCTTTCCAGCAT CCACTCTCCCTTGTCCTTCTGGGG |
| 7339 | db mining | Hs.241471 | AL133642 | 6599293 | mRNA; cDNA DKFZp58BG1721 (from clone DKFZp586G1721); partial cds/cds = (0, 669) | 1 | TCAGCACCAAGTCATGTTTAAAAGAC CAGAGAGACAAGCATTTTGCCAAG |
| 7340 | db mining | Hs.245188 | NM_000362 | 9257248 | tissue inhibitor of metalloproteinase 3 (Sorsby fundus dystrophy, pseudoinflammatory) (TIMP3), mRNA/cds = (1183, 1818) | 1 | CGAACCCTGTCTAGAAGGAATGTATT TGTTGCTAAATTTCGTAGCACTGT |
| 7341 | db mining | Hs.249170 | NM_012476 | 7110734 | ventral anterior homeobox 2 (VAX2), mRNA/cds = (32, 904) | 1 | CAAATGGCCTTGGTCCCGCAGCTTGT GTGCGTGAGTGCAGTGTGAGTGTG |
| 7342 | db mining | Hs.258551 | NM_012100 | 6912247 | aspartyl aminopeptidase (DNPEP), mRNA/cds = (151, 1578) | 1 | CTCTTGGAAAGACTTCTCTCCCATCC CTTTGCACCTGAGAGGGGAAGTTC |
| 7343 | db mining | Hs.259412 | BG772376 | 14083029 | 602722490F1 cDNA, 5' end/clone = IMAGE:4839143/clone_end = 5' | 1 | GGCGCGGTGACCCACTTATGGGACT TGGCCTTTCTTTGTTGTTTGTTTAA |
| 7344 | db mining | Hs.259577 | AW665292 | 7457838 | hj02c11.x1 cDNA, 3' end/clone = IMAGE:2980628/clone_end = 3' | 1 | ACCCAGTTCATGATTACTTCTACTCTT AACACTCAATCCCCCTAATTAAACC |
| 7345 | db mining | Hs.259679 | AW956608 | 8146291 | EST388878 cDNA | 1 | TTCGATAAACAGCGTTGACTTGCTTG TACCACTTAAGAGTTGTGAGTGCT |
| 7346 | db mining | Hs.265827 | NM_022873 | 13259549 | interferon, alpha-inducible protein (clone IFI-6-16) (G1P3), transcript variant 3, mRNA/cds = (107, 523) | 1 | TCCAGAACTTTGTCTATCACTCTCCC CAACAACCTAGATGTGAAAACAGA |
| 7347 | db mining | Hs.265891 | AK001503 | 7022798 | cDNA FLJ10641 fis, clone NT2RP2005748/cds = UNKNOWN | 1 | GGGATCTTTCAAATGGATAGTGAGTT GCCTTTTCCTATAGGTGACAATCA |
| 7348 | db mining | Hs.266456 | AW768893 | 7700715 | hk65e11.x1 cDNA, 3' end/clone = IMAGE:3001580/clone_end = 3' | 1 | AGAGCAAGCATTACAGAAAATAGGTC TGGAAGACAGGAAAAGGACAAAGA |
| 7349 | db mining | Hs.267368 | NM_017842 | 8923451 | hypothetical protein FLJ20489 (FLJ20489), mRNA/cds = (482, 1201) | 1 | ATGTGTCCTGCCCCTCAGCTCTTTGC CTTATCTGTGTCACTGTCACTTTA |
| 7350 | db mining | Hs.267812 | NM_003794 | 4507144 | sorting nexin 4 (SNX4), mRNA/cds = (0, 1352) | 1 | TCCTGTGAATTGAATTTCTCTTCAATC AAAGTGCCCCAAACAGAAGCACA |
| 7351 | db mining | Hs.272027 | NM_012177 | 6912365 | F-box only protein 5 (FBXO5), mRAN/cds = (61, 1404) | 1 | AGGTCCCCTGCCTGGTACAAAGAAAA GCAAAAAGAATTTACGAAGATTGT |
| 7352 | ob mining | Hs.272534 | AL080068 | 5262475 | mRNA; cDNA DKFZp584J082 (from clone DKFZp564J082)/cds = UNKNOWN | 1 | GCCAGAAGCATAATTACCAGAGACG AGAACAGGGTGTGGGAGAGAGGAA |
| 7353 | db mining | Hs.273415 | NM_000034 | 4557304 | aldolase A, fructose-bisphosphate (ALDOA), mRNA/cds = (187, 1261) | 1 | TCTTTCTTCCCTCGTGACAGTGGTG GTGGTGTCGTCTGTGAATGCTAAG |
| 7354 | db mining | Hs.273830 | AK022804 | 10434416 | cDNA FLJ12742 fis, clone NT2RP2000844/cds = UNKNOWN | 1 | CAGTCAAACATTTTACCTTGTGCCTT GGGTCACTCTGTGCCTTTTCTCCA |
| 7355 | db mining | Hs.274287 | AK001508 | 7022805 | cDNA FLJ10648 fis, clone NT2RP2005773, highly similar to pyrroline 5-carboxylate reductase isoform mRNA/cds = UNKNOWN | 1 | ACAGGAAACGGGCTTTCTCTGAATTG GTAAATGGGAAAGAAGTGAGCAAC |
| 7356 | db mining | Hs.275163 | NM_002512 | 4505408 | non-metastalic cells 2, protein (NM23B) expressedin (NME2), nuclear gene encoding mitochondrial protein, mRNA/cds = (72, 530) | 1 | GTCCCTGGACACAGCTCTTCATTCCA TTGACTTAGAGGCAACAGGATTGA |
| 7357 | db mining | Hs.276818 | AI435118 | 4300940 | th95e09.x1 cDNA, 3' end/clone = IMAGE:2126440/clone_end = 3' | 1 | ACCCTCGCCACAAGATTCTGCAATCT CCTAAAGTACAGATGAGAAAGGAA |
| 7358 | db mining | Hs.278582 | AF135794 | 4574743 | AKT3 proein kinase mRNA, complete cds/cds = (0, 1439) | 1 | TGCCAAGGGGTTAATGAAACAAATAG CTGTTGACGTTTGCTCATTTAAGA |
| 7359 | db mining | Hs.279535 | AK027035 | 10440049 | cDNA; FLJ23382 fis, clone HEP16349/cds = UNKNOWN | 1 | CAGTGGCACACCTTAACCAGTCACTA ATTTTCACTGTTGTGAAAGTGATT |
| 7360 | db mining | Hs.283007 | NM_006227 | 5453913 | phospholipid transfer protein (PLTP), mRNA/cds = (87, 1588) | 1 | CCCAGTGCCACAGAGAAGACGGGAT TTGAAGCTGTACCCAAATTTAATTCC |
| 7361 | db mining | Hs.283585 | NM_005438 | 4885242 | FOS-like antigen-1 (FOSL1), mRNA/cds = (34, 849) | 1 | TGAGCCCTACTCCCTGCAGATGCCAC CCTAGCCAATGTCTCCTCCCCTTC |
| 7362 | db mining | Hs.284296 | AK026646 | 10439543 | cDNA; FLJ22993 fis, clone KAT11914/cds = UNKNOWN | 1 | GCAGGGAGGGGAGGATAAGTGGGAT CTACCAATTGATTCTGGCAAAACAA |

TABLE 8-continued

| SEQ ID | Origin | Unigene | Locus | GI | Nominal Description | Strand | Probe Sequence |
|---|---|---|---|---|---|---|---|
| 7363 | db mining | Hs.284892 | AF246229 | 10419514 | AF246229 cDNA/clone = RB82 | 1 | GGCCACTACCTTTGTTGGAAACAAAG CATAAGGGAGTGAAAGTGTCTAAA |
| 7364 | db mining | Hs.284893 | AF246230 | 10419515 | AF246230 cDNA/clone = RB16 | 1 | GCTGGCCCGATCTCTCCCCACAGTT GCAAGAAGCATTTTCAAAGAATAGT |
| 7365 | db mining | Hs.285280 | AK024885 | 10437298 | cDNA; FLJ21232 fis, clone COL00752/ cds = UNKNOWN | 1 | ATTGGGATGAAACTACTTTAGCAAAG TCCACAGATCAGAAACCAGACGGT |
| 7366 | db mining | Hs.288038 | NM_006625 | 12056474 | TLS-associated serine-arginine protein 1 (TASR1), mRNA/cds = (72, 623) | 1 | AGGAGACTGGGTCCTATAATTAGATT ATTTTGAGGCAGACAGAGAGCTGT |
| 7367 | db mining | Hs.288283 | AK026008 | 10438707 | cDNA; FLJ22355 fis, clone HRC06344/ cds = UNKNOWN | 1 | AGCCTGCAAGGTTAGGACTTGAAGA GGGAAGGTATTTAATAACTGGGCGA |
| 7368 | db mining | Hs.289043 | AL138719 | 12052956 | mRNA; cDNA DKFZp566G0346 (from clone DKFZp566G0346); complete cds/ cds = (278, 790) | 1 | TTAGTGCAGTTGGAATGAATGTGTAT AGGTCAGAGGTCTTCGTGTTCACA |
| 7369 | db mining | Hs.289087 | AK024468 | 10440449 | mRNA for FLJ00061 protein, partial cds/cds = (0, 522) | 1 | TCACCTCTCAGTTGAAAGATTTCTTCT TTGAAAGGTCAAGACCGTGAACT |
| 7370 | db mining | Hs.290494 | BF475245 | 11544422 | EST 003 cDNA, 5' end/clone_end = 5' | 1 | AGTCTGGATGTAAGGCCTGCCTCAAA GAGACACTAATGGGAGGGAACAAA |
| 7371 | db mining | Hs.290874 | BE730505 | 10144599 | 601562627F1 cDNA, 5'end/ clone = IMAGE:3832302/clone_end = 5' | 1 | AAAGGAAGAAGCACGATGCAAACAG AAACAACACGACACAGAGTGAGCGA |
| 7372 | db mining | Hs.332403 | NM_024113 | 13129129 | hypothetical protein MGC4707 (MGC4707), mRNA/cds = (72, 1067) | 1 | ACTCCTTCAAGTCTTGACCCCTTTGT GTCTAATAGCTAAACAAACATGTG |
| 7373 | db mining | Hs.292998 | AW972292 | 8162138 | EST384381 cDNA | 1 | AACAATAGGAATAAGGTTACTTCAGC CTTAAGGGGCTTATCATACTGCTG |
| 7374 | db mining | Hs.293984 | NM_032323 | 14150097 | hypothetical protein MGC13102 (MGC13102), mRNA/cds = (161, 1345) | 1 | GACAGGGAAATCTGCCTACCAAGAG GGGTGTGTGTGTCTTTGTGCCCACA |
| 7375 | db mining | Hs.295362 | AK027385 | 14041993 | cDNA FLJ14459 fis, clone HEMBB1002409/cds = UNKNOWN | 1 | AACAAGTCCATGACTCCCAAGGGTTT AAGGACCAATGGTTCAGTGAGACA |
| 7376 | db mining | Hs.297964 | BF836049 | 12187621 | RC1-HT0975-161100-011-g07 cDNA | 1 | ACACTCATACTCATATGTACGTGCTC AGICGAACGGACTGCAGTCCGTTC |
| 7377 | db mining | Hs.299329 | AK000770 | 7021066 | cDNA FLJ20763 fis, clone COL09911/ cds = UNKNOWN | 1 | TACTGCTATGGAATGAGACCACCACT TCTCCTGTTGTCCTTCCCAGCTTC |
| 7378 | db mining | Hs.300631 | AK022958 | 10434651 | cDNA FLJ12896 fis, clone NT2RP2004194, weakly similar to *Rattus norvegicus* Golgi SNARE GS15 mRNA/cds = UNKNOWN | 1 | TGCCAAGTGAGGACAAACTGCTAGG CTGTATCCCATAATTTCAGGATGAG |
| 7379 | db mining | Hs.301417 | M80899 | 178282 | novel protein AHNAK mRNA, partial sequence/cds = (0, 3835) | 1 | AAACCGACCGCCTGTAGGCTCCTGG AACTATACAGATAGGTAAAGAGTTC |
| 7380 | db mining | Hs.301612 | NM_005253 | 4885244 | FOS-like antigen 2 (FOSL2), mRNA/ cds = (3, 983) | 1 | GACCAATCATCAGACTCCTTGAACTC CCCCACTCTGCTGGCTCTGTAACC |
| 7381 | db mining | Hs.301636 | NM_000287 | 4505728 | peroxisomal biogenesis factor 6 (PEX6), mRNA/cds = (70, 3012) | 1 | AGAGATCCAGGGCAAGTGGATTGA GACAGCAGCAACAGCTCAAGAGATA |
| 7382 | db mining | Hs.337774 | NM_004723 | 4758871 | rho/rac guanine nucleotide exchange factor (GEF) 2 (ARHGEF2), mRNA/ cds = (112, 2988) | 1 | ATGTCCCTTTCTCCTCTCCCCTCTTC CTCTTACTGCTGTTCTCCCTTTCT |
| 7383 | db mining | Hs.318568 | BF475243 | 11544420 | EST 001 cDNA, 5' end/clone_end = 5' | 1 | ACATCCATAGAACAATACATCAAAGT TGTTGAAGTGTTGCAGGGGAGGGC |
| 7384 | db mining | Hs.318569 | BF475244 | 11544421 | EST 002 cDNA, 5' end/clone_end = 5' | 1 | AGCACTTACTGTCAGGCATTCAGAAT GTGAGCAATGACAATAATTTACCT |
| 7385 | db mining | Hs.321709 | NM_002560 | 4505548 | purinergic receptor P2X, ligand-gated ion channel, 4 (P2RX4), mRNA/ cds = (27, 1193) | 1 | AATCTGATTGAGTCTCCACTCCACAA GCACTCAGGGTTCCCCAGCAGCTC |
| 7386 | db mining | Hs.322478 | D38491 | 559327 | mRNA for KIAA0117 gene, partial cds/ cds = (0, 883) | 1 | AACCCAAGAAAAGAGTTGCTCTTACT ATCTACTGCTGACTCTTGAACTTT |
| 7387 | db mining | Hs.323114 | AK023846 | 10435906 | cDNA FLJ13784 fis, clone PLACE400593/cds = UNKNOWN | 1 | TTCGTAGGTGGGCTTTTCCTATCAGA GCTTGGCTCATAACCAAATAAAGT |
| 7388 | db mining | Hs.323949 | NM_002231 | 13259537 | kangai 1 (suppression of lumorigenicity 6, prostate; CD82 antigen (R2 leukocyte antigen, antigen detected by monoclonal and antibody IA4)) (KAI1), mRNA/cds = (181, 984) | 1 | AGGTGGGCTGGACTTCTACCTGCCC TCAAGGGTGTGTATATTGTATAGGG |
| 7389 | db mining | Hs.324507 | NM_024524 | 13375667 | hypothetical protein FLJ02986 (FLJ20986), mRNA/cds = (182, 2056) | 1 | TGTGTCAGAATGGCACTAGTTCAGTT TATGTCCCTTCTGATATAGTAGCT |
| 7390 | db mining | Hs.326447 | BC004857 | 13436058 | *Homo sapiens*, clone IMAGE:3690478, mRNA, partial cds/cds = (0, 71) | 1 | CTATCAGCCCCAAGTGGAGCAGAAC AGAGGGATTTGGGAGGAATGTCCTC |
| 7391 | db mining | Hs.333558 | BG577468 | 13592532 | gu.seq cDNA | 1 | TGCTAAGGAGAGGGGCCATGAAGAG TTTTGTTGAGAACATCGTGTCTGA |
| 7392 | db mining | Hs.334303 | BG642392 | 13777102 | gu.seq395250 cDNA | 1 | AGTCAGAACTTCAAGTCCCCATTAAA GGGGCTGGAAAATACAAGTACAGT |
| 7393 | db mining | Hs.334804 | NM_000558 | 6715603 | hemoglobin, alpha 1 (HBA1), mRNA/ cds = (37, 485) | 1 | CTCCCCTTCCTGCACCCGTACCCCC GTGGTCTTTGAATAAAGTCTGAGTG |
| 7394 | db mining | Hs.334853 | NM_032241 | 14149953 | hypothetical protein FLJ23544 (FLJ23544), mRNA/cds = (125, 517) | 1 | CAGATGGTTGTGGGGTCAAGTACATC CCCAGTCGTGGCCCTTTGGACAAG |
| 7395 | db mining | Hs.250655 | NM_032695 | 14249283 | Prothymosin, alpha (gene sequence 28) | 1 | TTTTGGCCTGTTTGATGTATGTGTGA AACAATGTTGTCCAACAATAAACA |
| 7396 | db mining | Hs.336689 | AA493477 | 2223318 | ESTs | 1 | AGCCTAGGTGACAGAGCAAGACTCC |

TABLE 8-continued

| SEQ ID | Origin | Unigene | Locus | GI | Nominal Description | Strand | Probe Sequence |
|---|---|---|---|---|---|---|---|
| 7397 | db mining | Hs.180450 | BF791433 | 1206487 | ribosomal protein S24 (RPS24), transcript variant 1, mRNA/ cds = (37, 429) | 1 | ATTTCAAAAACAAAACAAAACAAAA ACACTGAGAATACACGACATACACGC ACGCACAAGACAACAACAGACAGC |
| 7398 | Table 3A | NA | AA077131 | 1836605 | 7B08E10 Chromosome 7 Fetal Brain cDNA Library cDNA clone 7B08E10, mRNA sequence | 1 | CAGCCACCTCCTCAGGTCAGACAAG CCCAGCACCCAAATACCACTATCTG |
| 7399 | Table 3A | NA | AA501725 | 2236692 | ng18e12.s1 NCI_CGAP_Lip2 cDNA clone IMAGE:929806 similar to contains Alu repetitive element; mRNA | 1 | GGCTTCCCTATTACCTCCCAGCGAAA TTCGTAGTCTTTCTCTATGGAGTT |
| 7400 | Table 3A | NA | AA501934 | 2236901 | nh56a10.s1 NCI_CGAp_Pr8 cDNa clone IMAGE:956348, mRNA sequence | 1 | TGCTGATGTGTTAGGTAGTTGTGGCA CACTCACCTGTCTTTCCTAAATGC |
| 7401 | Table 3A | NA | AA579400 | 2357584 | nf33d05.s1 NCI_CGAP_Pr1 cDNA clone IMAGE:915561 similar to contains Alu repetitive element; contains | 1 | TTCATGCTCAGCAAAACAACGTTTTA GGATGGTGAGAGAAGACAAAGTAA |
| 7402 | Table 3A | NA | AF249845 | 8099620 | isolate Siddi 10 hypervariable region 1, mitochondrial sequence | 1 | TATTAACCACTCACGGGAGCTCTCCA TGCATTTGGTATTTTCGTCTGGGG |
| 7403 | db mining | Hs.277051 | AI630242 | 4681572 | ad07c09.y1 cDNA/clone = ad07c09- (random) | 1 | TTACCTGCTTTGCATGCTCTCCATCG TCAAAGTCTTCTGGAAACTTAGGC |
| 7404 | db mining | Hs.277052 | AI630342 | 4681672 | ad08g11.y1 cDNA/clone = ad08g11- (random) | 1 | CCCCACCCCAACACATACAACGTTT CCCACCAATCCTTGAACTGCAAAA |
| 7405 | db mining | NA | AI732228 | 5053341 | nf19e05.x5 NCI_CGAP_Pr1 cDNA clone IMAGE:914240 similar to contains Alu repetitive element; mRNAs | 1 | TTCAAGGTCCCAATACCCAACTAACT CGAAGGAAGAAATGGAAATCTATT |
| 7406 | Table 3A | Hs.197803 | AW379049 | 6883708 | mRNA for KIAA0160 gene, partial cds/ cds = (0, 2413) | 1 | TGCACAGAACTCTTACTTACATGTCT CATCGAAACTCCAGAACACCCGTCG |
| 7407 | Table 3A | Hs.232000 | AW380881 | 6885540 | UI-H-B10p-abh-h-06-0-UI.s1 cDNA, 3' end/clone = IMAGE:2712035/ clone_end = 3' | 1 | TGCATGTATCCCGGTAATTCAAATCC AATTTCACAGCCACTGCTGAATAT |
| 7408 | Table 3A | Hs.325568 | AW384988 | 6889647 | 602386081F1 cDNA, 5' end/ clone = IMAGE:4514972/clone_end = 5' | 1 | TACAGGAAAATGAAACTAGACGGGTG GGGGACACTAGAATGAAAACCAGT |
| 7409 | Table 3A | NA | AW836389 | 7930383 | PM0-LT0030-101299-001-f08 LT0030 cDNA, mRNA sequence | 1 | AGTTCTGCTTTCAGTGACTGAGGCT TTGCTTTAACCTGGTGACTCCCAA |
| 7410 | Table 3A | NA | AW837717 | 7931691 | CM2-LT0042-281299-062-e11 LT0042 cDNA, mRNA sequence | 1 | TCCCACTTCAAGTTAAGCACCAAAGC AATCACTAATTCTGGAGCACAGGA |
| 7411 | Table 3A | NA | AW837808 | 7931782 | CM1-LT0042-100300-140-f05 LT0042 cDNA, mRNA sequence | 1 | CATGGATGGGGGCAGTGGTGTTTCT AGTGTGTGAGGAAGCAGAGCAGATG |
| 7412 | Table 3A | NA | AW842489 | 7938472 | PM4-CN0032-050200-002-c11 CN0032 cDNA, mRNA sequence | 1 | TCACCACAGATGGGAAGATCGTTTCC TGAAAACAGTCTATAAATCACAGA |
| 7413 | Table 3A | NA | AW846856 | 7942373 | QV3-CT0195-011099-001-c09 CT0195 cDNA, mRNA sequence | 1 | CAGACGCTCCAGTGCTGCCGAGGTT AGTGTGTTTATTAGACCTGAAATGA |
| 7414 | Table 3A | NA | AW856490 | 7952183 | PM4-CT0290-271099-001-c04 CT0290 cDNA, mRNA sequence | 1 | CCCTTTAGGCCTCTTGCCCGAACAGT GAACACTAATAGATATCCTAAGCT |
| 7415 | Table 3A | NA | AW891344 | 8055549 | PM2-NT0079-030500-001-a04 NT0079 cDNA, mRNA sequence | 1 | ATGGGGATCATGTTTATTTTCTCTA TATAATGGGCCAGTGTGTTCCCA |
| 7416 | Table 3A | NA | BE061115 | 8405765 | QV0-BT0041-011199-039-f09 BT0041 cDNA, mRNA sequence | 1 | AGCTGTAGACCATAAGCCACCTTCAG GTAGTGGTTTGGGAAATCAAGCAA |
| 7417 | Table 3A | NA | BE086076 | 8476469 | PM2-BT0672-130400-006-h09 BT0672 cDNA, mRNA sequence | 1 | TGTACTTATGCTTGTCTTCTCTACCTG CCCCCAGTCTTGAAGTGGTGGAA |
| 7418 | Table 3A | NA | BE091932 | 8482384 | IL-2BT0733-130400-068-C11 BT0733 cDNA, mRNA sequence | 1 | GGAGGGTGTGGGAAGCAGAGAGAAGA ACATTCTGTTAGGGGCAGAGAAGAA |
| 7419 | Table 3A | Hs.173334 | BE160822 | 8623543 | ELL-RELATED RNA POLYMERASE II, ELONGATION FACTOR (ELL2), mRNA/cds = (0, 1922) | 1 | GCATCTCCAGCTTTCATAGTTACCCA ACTTGTAAACCAGAAGATGTGCTG |
| 7420 | Table 3A | NA | BE163106 | 8625827 | QV3-HT0457-060400-146-h10 HT0457 cDNA, mRNA sequence | 1 | GGCCAGTGCCAGACGGTAGCTAGTT GGATGCTAAAGGTAGAATTTAGATA |
| 7421 | Table 3A | Hs.301497 | BE168334 | 8631159 | arginine-tRNA-protein transferase 1-1p (ATE1) mRNA, alternatively spliced product, partial cds/cds = (0, 1544) | 1 | GGCATTGTAGGTTGACACCAGCAAAG ACTCAGAGTGACTTGAGCATTGGA |
| 7422 | Table 3A | Hs.172780 | BE176373 | 8639102 | 602343016F1 cDNA, 5' end/ clone = IMAGE:4453468/clone_end = 5' | 1 | AGCCCATTTGGATATGGCCCATCTTT ACCTAATGGCTACTATAGTGAGGT |
| 7423 | Table 3A | NA | BE177661 | 8658813 | RC1-HT0598-020300-011-h02 HT0598 cDNA, mRNA sequence | 1 | AATCACAGCAGTAACTCCCAGTAGGA AAGATTCTCAAAGGAATAGTTCTT |
| 7424 | Table 3A | NA | BE178880 | 8658032 | PM1-HT0509-060300-001-g03 HT0609 cDNA, mRNA sequence | 1 | AATGGTCAGGCACAGGTAGAATCAAA GTCCTGTATGTATGTTCACACAGA |
| 7425 | Table 3A | NA | BE247056 | 9098807 | TCBAP1D6404 Pediatric pre-B cell acute lymphoblastic leukemia Baylor-HGSC project = TCBA cDNA clone T | 1 | TACCTGAAGGTGTAGAGAGTGCCCG CATCCAGCAAGGCCAACAGCTCCAC |
| 7426 | Table 3A | Hs.11050 | BE763412 | 10193336 | mRNA; cDNA DKFZp434C0118 (from clone DKFZp434C0118); partial cds/ cds = (0, 1644) | 1 | CTGTGTTTTTCCCAAAGCAACAATTTC AAACAATGAGAGCCACTGACA |

TABLE 8-continued

| SEQ ID | Origin | Unigene | Locus | GI | Nominal Description | Strand | Probe Sequence |
|---|---|---|---|---|---|---|---|
| 7427 | Table 3A | NA | BF330908 | 11301656 | RC3-BT0333-310800-115-f11 BT0333 cDNA, mRNA sequence | 1 | GACTCCGAGCTCAAGTCAGTCTGTAC CCCCAACCCCTAACCCACTGCATC |
| 7428 | Table 3A | NA | bf357523 | 11316597 | CM2-HT0945-150900-379-g08 HT0945 cDNA, mRNA sequence | 1 | TGTAACTGACTTTATGTATCACTCAAG TCTTGCCTTTACTGAGTGCCTGA |
| 7429 | Table 3A | NA | BF364413 | 11326438 | RC6-NN1068-070600-011-B01 NN1068 cDNA, mRNA sequence | 1 | TCTCTCTAACCAAAACTGTAATCTTCA GGACCAGCAAACTCAGCCCAAGG |
| 7430 | Table 3A | NA | BF373638 | 11335663 | MR0-FT0176-040900-202-g09 FT0176 cDNA, mRNA sequence | 1 | AACTCTTGGTTAAATGGGTTAATAGA GGATTGGAACACTTTGTTTGCTGT |
| 7431 | Table 3A | NA | BF740663 | 12067339 | QV1-HB0031-071200-582-h04 HB0031 cDNA, mRNA sequence | 1 | AGAAGCAAACCTGTGAAGCTACTATC GTTTATCATCAGTGTGAATGCACT |
| 7432 | Table 3A | NA | BF749089 | 12075765 | MR2-BN0386-051000-014-b04 BN0386 cDNA, mRNA sequence | 1 | GGACTAACTTCCACCTCCTCTGCTAC TTCCAGCTGCTTCTAATCACACTT |
| 7433 | Table 3A | NA | BF758480 | 12106380 | MR4-CT0539-141100-003-d05 CT0539 cDNA, mRNA sequence | 1 | AGTCTTCCACCCAGACAYAGGTA TCACACACCAGCTCTGTTTTACT CCTG |
| 7434 | Table 3A | NA | BF773126 | 12121026 | CM3-IT0048-151200-568-f08 IT0048 cDNA, mRNA sequence | 1 | TTAGCTGGTACATTGTTCAGAGTTTA CTGGGAGCCGGTAAGATAGTCACC |
| 7435 | Table 3A | NA | BF773393 | 12121293 | CM2-IT0039-191200-638-h02 IT0039 cDNA, mRNA sequence | 1 | AGCGTGATGCTTCCTCATGTCGGTGA TTTTCTGTTGAGACATCTTCAAGC |
| 7436 | Table 3A | NA | BF805164 | 12134153 | QV1-C10173-061100-456-f03 CI0173 cDNA, mRNA sequence | 1 | ACAAAAGTATGGAATTCAATTCTTTTT ATATGCTGCAGCCATGTTCCTGCCCT AGA |
| 7437 | Table 3A | NA | BF818594 | 12156027 | MR3-CI0184-201200-009-e04 CI0184 cDNA, mRNA sequence | 1 | TGTAATTGATTTCCGCATAAACGGTC ATTACTGGCACCTATGGCAGCACC |
| 7438 | Table 3A | NA | BF827734 | 12171909 | RC5-HN0025-041200-022-F08 HN0025 cDNA, mRNA sequence | 1 | GTGATCCACTTGGAGCTGCTACTGGT CCCATTGAGTCCTATAGTACTTCA |
| 7439 | Table 3A | NA | BF845167 | 12201450 | RC5-HT1035-271200-012-F08 HT1035 cDNA, mRNA sequence | 1 | TGCCATGAAATCTCTATTAATTCTCAG AAAGATCAAAGGAGGTCCCGTGT |
| 7740 | Table 3A | NA | BF869167 | 12259297 | IL5-ET0119-181000-181-b11 ET0119 cDNA, mRNA sequence | 1 | CCCACCTGGCAAATCCTCAAGTGTGA CCCTAGTCATCTTTCTCCTTTTGG |
| 7441 | Table 3A | NA | BF875575 | 12255705 | QV3-ET0100-111100-391-c02 ET0100 cDNA, mRNA sequence | 1 | GCTAAACAGAAAAGAACCTGAAGTAC AGTTCCCGTCTTCAAAGAAGATGC |
| 7442 | Table 3A | NA | BF877979 | 12268109 | MR0-ET0109-171100-001-b02 ET0109 cDNA, mRNA sequence | 1 | ATCCTCCTCCCCTGGGATGGCATAGA AGAGACTTTAAAACCAAATGAGCC |
| 7443 | Table 3A | NA | BF897042 | 12288501 | IL2-MT0179-271100-254-C11 MT0179 cDNA, mRNA sequence | 1 | GTCAGTAAAGCTCTGCCTGCCAA GAAGACACAGTGAGAGGTGTCCAC AGTC |
| 7444 | Table 3A | NA | BF898285 | 12289744 | QV1-MT0229-281100-508-e11 MT0229 cDNA, mRNA sequence | 1 | GTTTCCACTTAGTTACTTCTTCCTACC TGCTGTGAAGCTCTGCACCCTGC |
| 7445 | Table 3A | NA | BF899464 | 12290923 | IL5-MT0211-011200-317-f03 MT0211 cDNA, mRNA sequence | 1 | AGAGTAATCCACATCCCAGGGACAGT CACAATGACCTACGGCTTTAGCTG |
| 7446 | Table 3A | Hs.324473 | BF904425 | 12295884 | 40 kDa protein kinase related to rat ERK2/cds = (134, 1180) | 1 | GCAGGGCTACACCAAGTCCATTGATA TTTGGTCTGTAGGCTGCATTCTGG |
| 7447 | Table 3A | NA | BF906114 | 12297573 | IL3-MT0267-281200-425-A05 MT0267 cDNA, mRNA sequence | 1 | TCTTCTCTAAAATGCCCTCCTCTCCTT CCTTTTTCCAGACCTGGTTTAAA |
| 7448 | Table 3A | Hs.104679 | BF926187 | 12323197 | Homo sapiens, clone MGC-18218 IMAGE:4156235, mRNA, complete cds/cds = (2206, 2373) | 1 | TCGCCATTTGGTAGTTCCACAGTGAC TGCTCTTTCTATTTTACGAAGCCAC |
| 7449 | Table 3A | Hs.75703 | BF928844 | 12326772 | small inducible cytokine A4 (homologous to mouse Mip-1b) (SCYA4), mRNA/cds = (108, 386) | 1 | GTAATTACTATGAGACCAGCAGCCT CTGCTCCCAGCCAGCTGTGGTGTG |
| 7450 | Table 3A | NA | BG006820 | 12450386 | RC4-GN0227-271100-011-d03 GN0227 cDNA, mRNA sequence | 1 | TTTCCTTTTCGCTGACTTTCTCACTCA CTGTCTGTCTCTCATTTTCTCCA |
| 7451 | Table 3A | NA | F11941 | 706260 | HSC33F051 normalized infant brain cDNA cDNA clone c-33f05, mRNA sequence | 1 | TGGTAAGTTTCTGGCAGTGTGGAGAC AGGGGAATAATCTCAACAGTAGGT |
| 7452 | Table 3A | NA | U46388 | 1235904 | HSU46388 Human pancreatic cancer cell line Patu 8988t cDNA clone xs425, mRNA sequence | 1 | CCATGGTGGTGCTTGACTTTGCTTTG GGGCTTAATCCTAGTATCATTTGG |
| 7453 | Table 3A | NA | U75805 | 1938265 | HSU75805 Human cDNA clone f46, mRNA sequence | 1 | TCAGTGGGTGTTGGTTGTCCATTAGT TGAGACTTAGTTGTTGCTCTGGGA |
| 7454 | Table 3A | NA | W27656 | 1307658 | 36f10 Human retina cDNA randomly primed sublibrary cDNA, mRNA sequence | 1 | GGCTGGACAGCAGATGATTCAAATCT CAATACTACATGCCCATTCTGTGG |
| 7455 | literature | NA | X17403 | 59591 | Human cytomegalovirus strain AD169 complete genome | 1 | AATAATAGATTAGCAGAAGGAATAAT CCGTGCGACCGAGCTTGTGCTTCT |
| 7456 | literature | NA | X17404 | 59591 | Human cytomegalovirus strain AD169 complete genome | 1 | TTTTGCGAACTTTTAGGAACCAGCAA GTCAACAAAAGACTAACAAAGAAA |
| 7457 | literature | Hs.2799 | X17405 | 59591 | Cartilage linking protein 1 | 1 | GAGATCGACATCGTCATCGACCGAC CTCCGCAGCAACCCCTACCCAATCC |
| 7458 | literature | Hs.2159 | X17406 | 59591 | mRNA for cartilege specific proteoglycan | 1 | ACATTCAAAAGTTTGAGCGTCTTCAT GTACGCCGTTTTCGGCCTCACGAG |
| 7459 | literature | NA | X17407 | 59591 | Human cytomegalovirus strain AD169 complete genome | 1 | CCAACGACACATCCACAAAAATCCCC CATCGACTCTCACAATCGCATCAT |
| 7460 | literature | NA | X17408 | 59591 | Human cytomegalovirus strain AD169 complete genome | 1 | CTTTGAGCAGGTTCTCAAGGCTGTAA CTAACGTGCTGTCGCCCGTCTTTC |

TABLE 8-continued

| SEQ ID | Origin | Unigene | Locus | GI | Nominal Description | Strand | Probe Sequence |
|---|---|---|---|---|---|---|---|
| 7461 | literature | NA | X17409 | 59591 | Human cytomegalovirus strain AD169 complete genome | 1 | GATGTCCGTCTACGCGCTATCGGCC ATCATCGGCATCTATCTGCTCTACC |
| 7462 | literature | NA | X17410 | 59591 | Human cytomegalovirus strain AD169 complete genome | 1 | TCTTCTGGGACGCCAACGACATCTAC CGCATCTTCGCCGAATTGGAAGGC |
| 7463 | literature | NA | X17411 | 59591 | Human cytomegalovirus strain AD169 complete genome | 1 | ACGAACAGAAATCTCAAAAGACGCTG ACCCGATAAGTACCGTCACGGAGA |
| 7464 | literature | NA | X17412 | 59591 | Human cytomegalovirus strain AD169 complete genome | 1 | AGAGAACAACAAACCACCACGACGA TGAAACAAACGCTCAACCAAACA |
| 7465 | literature | NA | X17413 | 59591 | Human cytomegalovirus strain AD169 complete genome | 1 | CTGCATCGTCGTCGTCCTCCTCCTCT CGGAGATCGCGACGGAGAAACAAC |
| 7466 | literature | NA | X17414 | 59591 | Human cytomegalovirus strain AD169 complete genome | 1 | CTGAGCCTGGCCATCGAGGCAGCCA TCCAGGACCTGAGGAACAAGTCTCA |
| 7467 | literature | NA | X17415 | 59591 | Human cytomegalovirus strain AD169 complete genome | 1 | CCTCTGGAGGCAAGAGCACCCACCC TATGGTGACTAGAAGCAACHHCTGAC |
| 7468 | literature | NA | X17416 | 59591 | Human cytomegalovirus strain AD169 complete genome | 1 | TTCGTGGGCACCAAGTTTCGCAAGAA CTACACTGTCTGCTGGCCGAGTTT |
| 7469 | literature | NA | J01917 | 209811 | Adenovirus type 2, complete genome | 1 | CTGTGGAATGTATCGAGGACTTGCTT AACGAGTCTGGGCAACCTTTGGAC |
| 7470 | literature | NA | J01918 | 209811 | Adenovirus type 2, complete genome | 1 | GCTGGCCTGCACCCGCGCTGAGTTT GGCTCTAGCGATGAAGATACAGATT |
| 7471 | literature | NA | J01919 | 209811 | Adenovirus type 2, complete genome | 1 | GGGGCGGTTAGGCTGTCCTCCTTCT CGACTGACTCCATGATCTTTTTCTG |
| 7472 | literature | NA | J01920 | 209811 | Adenovirus type 2, complete genome | 1 | TGTTTGCCTTATTATTATGTGGCTTAT TTGTTGCCTAAAGCGCAGACGC |
| 7473 | literature | Hs.250596 | J01921 | 209811 | xy45f10.x1 cDNA, 3' end/ clone = IMAGE:2856139/clone_end = 3' | 1 | ACGGTGATCAATATAAGCTATGTGGT GGTGGGGCTATACTACTGAATGAA |
| 7474 | literature | NA | J01922 | 209811 | Adenovirus type 2, complete genome | 1 | TTTCTGCCCTGAAGGCTTCCTCCCCT CCCAATGCGGTTTAAAACATAAAT |
| 7475 | literature | NA | J01923 | 209811 | Adenovirus type 2, complete genome | 1 | GGCTTATGCCCATGTATCTGAACATC CAGAGTCACCTTTACCACGTCCTG |
| 7476 | literature | NA | J01924 | 209811 | Adenovirus type 2, complete genome | 1 | CTACTGCCGTACAGCGAAAGCCGCC CCAACCCGCGAAACGAGGAGATATG |
| 7477 | Table 3A | NA | AA077131 | 1836605 | 7B08E10 Chromosome 7 Fetal Brain cDNA Library cDNA clone 7B08E10, mRNA sequence | −1 | CAGATAGTGGTATTTGGGTGCTGGG CTTGTCTGACCTGAGGAGGTGGCTG |
| 7478 | Table 3A | NA | AA501725 | 2236692 | ng18e12.s1 NCI_CGAP_Lip2 cDNA clone IMAGE:929808 similar to contains Alu repetitive element; mRNA | −1 | AACTCCATAGAGAAAGACTACGAATT TCGCTGGGAGGTAATAGGGAAGCC |
| 7479 | Table 3A | NA | AA501934 | 226901 | nh56a10.s1 NCI_CGAP_Pr8 cDNA clone IMAGE:958346, mRNA sequence | −1 | GCATTAGGAAAGACAGGTGAGTGTG CCACAACTACCTAACACATCAGCA |
| 7480 | Table 3A | NA | AA579400 | 2357584 | nf33d05.s1 NCI_CGAP_Pr1 cDNA clone IMAGE:91581 similar to contains Alu repetitive element:contains | −1 | TTACTTTGTCTTCTCTCACCATCCTAA |
| 7481 | Table 3A | NA | AF249845 | 8099620 | isolate Siddi 10 hypervariable region 1, mitochondrial sequence | −1 | CCCCAGACGAAAATACCAAATGCATG GAGAGCTCCCGTGAGTGGTTAATA |
| 7482 | db mining | Hs.277051 | AI630242 | 4881572 | ad07c09.y1 cDNA/clone = ad07c09- (random) | −1 | GCCTAAGTTTCCAGAAGACTTTGACG ATGGAGAGCATGCAAAGCAGGTAA |
| 7483 | db mining | Hs.277052 | AI830342 | 4681672 | ad08g11.y1 cDNA/clone = ad08g11- (random) | −1 | TTTTGCAGTTCAAGGATTGGTGGGAA ACGTTTGTATGTGTTGGGGTGGGG |
| 7484 | db mining | NA | AI732228 | 5053341 | nf19e05.x5 NCI_CGAP_Pr1 cDNA clone IMAGE:91420 similar to contains Alu repetitive element; mRNA s | −1 | AATAGATTTCCATTCTTCCTTCGAGT TAGTTGGGTATTGGGACCTTGAA |
| 7485 | Table 3A | Hs.197803 | AW379049 | 6883708 | mRNA for KIAA0160 gene, partial cds/ CDS = (0, 2413) | −1 | CGACGGTGTTCTGGAGTTTCGATGAG ACATGTAAGTAAGAGTTCTGTGCA |
| 7486 | Table 3A | Hs.232000 | AW380881 | 6885540 | UI-H-B10p-abh-h-06-UI.s1 cDNA 3' end/clone = IMAGE:2712035/ clone_end = 3' | −1 | ATATTCAGCAGTGGCTGTGAAATTGG ATTTGAATTACCGGGATACATGCA |
| 7487 | Table 3A | Hs.325588 | AW384988 | 6889647 | 602386081F1 cDNA 5' end/ clone = IMAGE:4514972/clone_end = 5' | −1 | ACTGGTTTTCATTCTAGTGTCCCCCA CCCGTCTAGTTTCATTTTCCTGTA |
| 7488 | Table 3A | NA | AW836389 | 7930363 | PM0-LT0030-101299-001-f08 LT0030 cDNA, mRNA sequence | −1 | TTGGGAGTCACCAGGTTAAAGCAAAG |
| 7489 | Table 3A | NA | AW837717 | 7931691 | CM2-LT0042-2612990-062-e11 LT0042 cDNA, mRNA sequence | −1 | TCCTGTGCTCCAGAATTAGTGATTGC TTTGGTGCTTAACTTGAAGTGGGA |
| 7490 | Table 3A | NA | AW837608 | 7931782 | CM1-LT0042-100300-140-f05 LT0042 cDNA, mRNA sequence | −1 | CATCTGCTCTGCTTCCTCACACACTA GAAACACCACTGCCCCCATCCATG |
| 7491 | Table 3A | NA | AW842489 | 7936472 | PM4-CN0032-050200-002-c11 CN0032 cDNA, mRNA sequence | −1 | TCTGTGATTTATAGACTGTTTTCAGGA AACGATCTTCCCATCTGTGGTGA |
| 7492 | Table 3A | NA | AW848856 | 7942373 | QV3-CT0195-011099-001-c09 CT0195 cDNA, mRNA sequence | −1 | TCATTTCAGGTCTAATAAACACACTAA CCTCGGCAGCACTGGAGCGTCTG |
| 7493 | Table 3A | NA | AW856490 | 7952183 | PM4-CT0290-271099-001-c04 CT0290 cDNA, mRNA sequence | −1 | AGCTTAGGATATCTATTAGTGTTCACT GTTCGGGCAAGAGGCCTAAAGGG |

TABLE 8-continued

| SEQ ID | Origin | Unigene | Locus | GI | Nominal Description | Strand | Probe Sequence |
|---|---|---|---|---|---|---|---|
| 7494 | Table 3A | NA | AW891344 | 8055549 | PM2-NT0079-030500-001-a04 NT0079 cDNA, mRNA sequence | −1 | TGGGAACACACTGGCCCATTATATAG AGAAAAATAAAACATGATCCCCAT |
| 7495 | Table 3A | NA | BE061115 | 8405785 | QV0-BT0041-011199-039-f09 BT0041 cDNA, mRNA sequence | −1 | TTGCTTGATTTCCCAAACCACTACCT GAAGGTGGCTTATGGTCTACAGCT |
| 7496 | Table 3A | NA | BE086076 | 8476469 | PM2-BT0672-130400-008-h09 BT0672 cDNA, mRNA sequence | −1 | TTCCACCACTTCAAGACTGGGGGCA GGTAGAGAAGACAAGCATAAGTACA |
| 7497 | Table 3A | NA | BE091932 | 8482384 | IL2-BT0733-130400-068-C11 BT0733 cDNA, mRNA sequence | −1 | TTCTTCTCTGCCCCTAACAGAATGTT CTTCTCTTGCTTCCCACACCCTCC |
| 7498 | Table 3A | Hs.173334 | BE160822 | 8623543 | ELL-RELATED RNA POLYMERASE II, ELONGATION FACTOR (ELL2), mRNA/cds = (0, 1922) | −1 | CAGCACATCTTCTGGTTTACAAGTTG GGTAACTATGAAAGCTGGAGATGC |
| 7499 | Table 3A | NA | BE163106 | 8825827 | QV3-HT0457-050400-146-h10 HT0457 cDNA, mRNA sequence | −1 | TATCTAAATTCTACCTTTAGCATCCAA CTAGCTACCGTCTGGCACTGGCC |
| 7500 | Table 3A | Hs.301497 | BE168334 | 8631159 | arginine-tRNA-protein transferase 1-1p (ATE1) mRNA, alternatively spliced, product, partial cds/cds = (0, 1544) | −1 | TCCAATGCTCAAGTCACTCTGAGTCT TTGCTGGTGTCAACCTACAATGCC |
| 7501 | Table 3A | Hs.172780 | BE176373 | 8839102 | 602343016F1 cDNA, 5' end/ clone = IMAGE:4453466/clone_end = 5' | −1 | ACCTCACTATAGTAGCCATTAGGTAA AGATGGGCCATATCCAAATGGGCT |
| 7502 | Table 3A | NA | BE177681 | 8656813 | RC1-HT0598-020300-011-h02 HT0598 cDNA, mRNA sequence | −1 | AAGAACTATTCCTTTGAGAATCTTTCC TACTGGAGTTACTGCTGTGATT |
| 7503 | Table 3A | NA | BE178880 | 8658032 | PM1-HT0609-060300-001-g03 HT0609 cDNA, mRNA sequence | −1 | TCTGTGTGAACATACATACAGGACTT TGATTCTACCTGTGCCTGACCATT |
| 7504 | Table 3A | Hs.88543 | BE247056 | 9098807 | 602495247F1 cDNA, 5' end/ clone = IMAGE:4609330/clone_end = 5' | −1 | GTGGAGCTGTTGGCCTTGCTGGATG CGGGCACTCTCTACACCTTCAGGTA |
| 7505 | Table 3A | Hs.11050 | BE763412 | 10193336 | mRNA; cDNA KDFZp434C0118 (from clone DKFZp434C0228); partial cds/ cds = (0, 1644) | −1 | TGTCAGTGGCTCTCACTTTGTTTGAA ATTGTTGCTTTGGGAAAAACACAG |
| 7506 | Table 3A | NA | BF330908 | 11301656 | RC3-BT0333-310800-115-f11 BT0333 cDNA, mRNA sequence | −1 | GATGCAGTGGGTTAGGGGTTGGGGG TACAGACTGACTTGAGCTCGGAGTC |
| 7507 | Table 3A | NA | BF357523 | 11316597 | CM2-HT0945-150900-379-g06 HT0945 cDNA, mRNA sequence | −1 | TCAGGCACTCAGTAAAGGCAAGACTT GAGTGATACATAAAGTCAGTTACA |
| 7508 | Table 3A | NA | BF384413 | 11326438 | RC6-NN1068-070600-011-B01 NN1068 cDNA, mRNA sequence | −1 | CCTTGGGCTGAGTTTGCTGGTCCTGA AGATTACAGTTTTGGTTAGAGAGA |
| 7509 | Table 3A | NA | BF373838 | 11335663 | MR0-FT0176-040900-202-g09 FT0173 cDNA, mRNA sequence | −1 | ACAGCAAACAAAGTGTTCCAATCCTC TATTAACCCATTTAACCAAGAGTT |
| 7510 | Table 3A | NA | BF740663 | 12067339 | QV1-HB0031-071200-582-h04 HB0031 cDNA, mRNA sequence | −1 | AGTGCATTCACACTGATGATAAACGA TAGTAGCTTCACAGGTTTGCTTCT |
| 7511 | Table 3A | NA | BF749089 | 12075765 | MR2-BN0388-051000-014-b04 BN0386 cDNA, mRNA sequence | −1 | AAGTGTGATTAGAAGCAGCTGGAAGT AGCAGAGGAGGTGGAAGTTAGTCC |
| 7512 | Table 3A | NA | BF756480 | 12108380 | MR4-CT0539-141100-003-d05 CT0539 cDNA, mRNA sequence | −1 | CAGGAGTAAAACAGAGCTGGTTGTGT GATACCTATGCTGGGTGGAAGACT |
| 7513 | Table 3A | NA | BF773126 | 12121026 | CM3-IT0048-151200-568-f08 IT0048 cDNA, mRNA sequence | −1 | GGTGACTATCTTACCGGCTCCCAGTA AACTCTGAACAATGTACCAGCTAA |
| 7514 | Table 3A | NA | BF773393 | 12121293 | CM2-IT0039-191200-638-h02 IT0039 cDNA, mRNA sequence | −1 | GCTTGAAGATGTCTCAACAGAAAATC ACCGACATGAGGAAGCATCACGCT |
| 7515 | Table 3A | NA | BF805184 | 12134153 | QV1-CI0173-061100-456-f03 CI0173 cDNA, mRNA sequence | −1 | TCTAGGGCAGGAACATGGCTGCAGC ATATAAAAAGAATTGAATTCCATACTT TTGT |
| 7516 | Table 3A | NA | BF818594 | 12156027 | MR3-CI0184-201200-009-a04 CI0184 cDNA, mRNA sequence | −1 | GGTGCTGCCATAGGTGCCAGTAATG ACCGTTATGCGGAAATCAATTACA |
| 7517 | Table 3A | NA | BF8277734 | 12171909 | RC6-HN0025-041200-022-F08 HN0025 cDNA, mRNA sequence | −1 | TGAAGTACTATAGGACTCAATGGGAC CAGTAGCAGCTCCAAGTGGATCAC |
| 7518 | Table 3A | NA | BF845167 | 12201450 | RC5-HT1035-271200-012-F08 HT1035 cDNA, mRNA sequence | −1 | ACACGGGACCTCCTTTGATCTTTCTG AGAATTAATAGAGATTTCATGGCA |
| 7519 | Table 3A | NA | BF869167 | 12259297 | IL5-ET0119-181000-181-b11 ET0119 cDNA, mRNA sequence | −1 | CCAAAAGGAGAAAGATGACTAGGGT CACACTTGAGGATTTGCCAGGTGGG |
| 7520 | Table 3A | NA | BF875575 | 12265705 | QV3-ET0100-111100-391-c02 ET0100 cDNA, mRNA sequence | −1 | GCATCTTCTTTGAAGACGGGAACTGT ACTTCAGGTTCTTTTCTGTTTAGC |
| 7521 | Table 3A | NA | BF877979 | 12268109 | MR0-ET0109-171100-001-b02 ET0109 cDNA, mRNA sequence | −1 | GGCTCATTTGGTTTTAAAGTCTCTTCT ATGCCATCCCAGGGGAGGAGGAT |
| 7522 | Table 3A | NA | BF897042 | 12288501 | IL2-MT0179-271100-254-C11 MT0179 cDNA, mRNA sequence | −1 | GACTGTGGACACCTCTCACTGTGTCT TCTTGGCAGGCAGAGCTTACTGAC |
| 7523 | Table 3A | NA | BF898285 | 12289744 | QV1-MT0229-28100-508-e11 MT0229 cDNA, mRNA sequence | −1 | GCAGGGTGCAGAGCTTCACAGCAGG TAGGAAGAAGTAACTAAGTGGAAAC |
| 7524 | Table 3A | NA | BF899464 | 12290923 | IL5-MT0211-011200-317-f03 MT0211 cDNA, mRNA sequence | −1 | CAGCTAAAGCCGTAGGTCATTGTGAC TGTCCCTGGGATGTGGATTACTCT |
| 7525 | Table 3A | Hs.324473 | BF904425 | 12295884 | 40 kDa protein kinase related to rat ERK2/cds = (134, 1180) | −1 | CCAGAATGCAGCCTACAGACCAAATA TCAATGGACTTGGTGTAGCCCTGC |
| 7526 | Table 3A | NA | BF906114 | 12297573 | IL3-MT0267-281200-425-A05 MT0267 cDNA, mRNA sequence | −1 | TTTAAACCAGGTCTGGAAAAAGGAG GAGAGGAGGGCATTTTAGAGAAGA |
| 7527 | Table 3A | Hs.104679 | BF926187 | 12323197 | *Homo sapiens*, clone MGC:18216 IMAGE:4156235, mRNA, complete cds/cds = (2208, 2373) | −1 | GTGGCTTCGTAAAATAGAAGAGCAGT CACTGTGGAACTACCAAATGGCGA |
| 7528 | Table 3A | Hs.75703 | BF928644 | 12326772 | small inducible cytokine A4 | −1 | CACACCACAGCTGGCTGGGAGCAGA |

TABLE 8-continued

| SEQ ID | Origin | Unigene | Locus | GI | Nominal Description | Strand | Probe Sequence |
|---|---|---|---|---|---|---|---|
| | | | | | (homologous to mouse Mip-1b) (SCYA4), mRNA/cds = (108, 386) | | GGCTGCTGGTCTCATAGTAATCTAC |
| 7529 | Table 3A | NA | BG006820 | 12450386 | RC4-GN0227-271100-001-d03 GN0227 cDNA, mRNA sequence | −1 | TGGAGAAAATGAGAGACAGACAGTG AGTGAGAAAGTCAGCGAAAAGGAAA |
| 7530 | Table 3A | NA | F11941 | 706260 | HSC33F051 normalized infant brain cDNA cDNA clone c-33f05, mRNA sequence | −1 | ACCTACTGTTGAGATTATTCCCCTGT CTCCACACTGCCAGAAACTTACCA |
| 7531 | Table 3A | NA | U46388 | 1236904 | HSU46388 Human pancreatic cancer cell line Palu 89881 cDNA clone xs425, mRNA sequence | −1 | CCAAATGATACTAGGATTAAGCCCCA AAGCAAAGTCAAGCACCACCATGG |
| 7532 | Table 3A | NA | U75805 | 1938265 | HSU75805 Human cDNA clone f48, mRNA sequence | −1 | TCCCAGAGCAACAACTAAGTCTCAAC TAATGGACAACCAACACCCACTGA |
| 7533 | Table 3A | NA | W27658 | 1307658 | 38f10 Human retina cDNA randomly primed sublibrary cDNA, mRNA sequence | −1 | CCACAGAATGGGCATGTAGTATTGAG ATTTGAATCATCTGCTGCCAGCC |
| 7534 | literature | Hs.99962 | BC005929 | 13543541 | proteoglycan 2, bone marrow (natural killer cell activator, eosinophil granule major basic protein) (PRG2), mRNA/cds = (857, 1525) | 1 | TACTGGCGTCGAGCCCACTGCCTCA GAAGACTTCCTTTCATCTGTTCCTA |
| 7535 | literature | Hs.46295 | X14348 | 31182 | eosinophil peroxidase (EPX), mRNA/cds = (0, 2147) | 1 | GTTTCAAGGGACATCTTCAGAGCCAA CATCTACCCTCGGGGCTTTGTGAA |
| 7536 | literature | Hs.1256 | J05225 | 179078 | arylsulfatase B (ARSB), mRNA/cds = (559, 2160) | 1 | CTACAGTTCTACCATAAACACTCAGT CCCCGTGTACTTCCCTGCACAGGA |
| 7537 | literature | Hs.728 | M28129 | 556208 | ribonucleae, RNase A family, 2 (liver, eosinophil-derived neurotoxin) (RNASE2), mRNA/cds = (71, 556) | 1 | TAGTTGCATGTGACAACAGAGATCAA CGACGAGACCCTCCACAGTATCCG |
| 7538 | literature | Hs.889 | NM_001828 | 6325464 | Charol-Leyden crystal protein (CLC), mRNA/cds = (33, 461) | 1 | TTGACCATAGAATCAAGCCTGAGGCT GTGAAGATGGTGCAAGTGTGGAGA |
| 7539 | literature | Hs.135626 | M69138 | 180539 | chymase 1, mast cell (CMA1), mRNA/cds = (0, 743) | 1 | CTGCTGTCTTCACCCGAATCTCCCAT TACCGGCCCTGGATCAACCAGATC |
| 7540 | literature | Hs.334455 | NM_003293 | 13699841 | tryptase, alpha (TPS1), mRNA/cds = (17, 844) | 1 | GTCACTGGAGGACCAACCCCTGCTG |
| 7541 | literature | NA | NC_001345 | 9625578 | Human herpesvirus 4, complete genome | 1 | CATGCCATGCATATTTCAACTGGGCT GTCTATTTTTGACACCAGCTTATT |
| 7542 | literature | NA | NC_001345 | 9625578 | Human herpesvirus 4, complete genome | 1 | GAGAAGCACCTCAACCTGGAGACAAT TCTACTGTTCAAACAGCAGCAGCA |
| 7543 | literature | NA | NC_001345 | 9625578 | Human herpesvirus 4, complete genome | 1 | ACTTGTCAGGGCCATTCTCTCTCCGG GCACTGGGTCACTAGGACTGTTTT |
| 7544 | literature | NA | NC_001345 | 9625578 | Human herpesvirus 4, complete genome | 1 | GACAGCGTCCTAGAAACCCTGGCGA CCATTGCCTCCAGCGGGATAGAGTG |
| 7545 | literature | NA | NC_001345 | 9625578 | Human herpesvirus 4, complete genome | 1 | CATCCTCTGGAGCCTGACCTGTGATC GTCGCATCATAGACCGCCAGTAGA |
| 7546 | literature | NA | NC_001345 | 9625578 | Human herpesvirus 4, complete genome | 1 | GCCTCCACACGACATCACACCATATA CCGCAAGGAATATCAGGGATGCTG |
| 7547 | literature | Hs.279852 | BC004555 | 13528716 | G protein-coupled receptor (G2A), mRNA/cds = (900, 2042) | 1 | ACAGCCATCCTCCCCTTGAGAGTCAT CAGAAAAATACATTAGGAAAATGT |
| 7548 | literature | NA | NC_001345 | 9625578 | Human herpesvirus 4, complete genome | 1 | ACCTTCGTCTTCTGAGTCTCATGCCT CAAAACCTAGTTTGATAGACAGGA |
| 7549 | literature | NA | NC_001345 | 9625578 | Human herpesvirus 4, complete genome | 1 | AGATGGCTACCCTTCTGATTATGATC CTTTCGTAGAAAATGCTCAAATCT |
| 7550 | literature | NA | NC_001345 | 9625578 | Human herpesvirus 4, complete genome | 1 | ATGCATCGCCGACAAGTCTTGAATTA GGATTGTCGAAATTAGACAAAGAA |
| 7551 | literature | NA | NC_001345 | 9625578 | Human herpesvirus 4, complete genome | 1 | CGGGTGTGTTCAATCATCGACGGTGA CAATCCTATCTCCATCTATAATCC |
| 7552 | literature | NA | NC_001345 | 9625578 | Human herpesvirus 4, complete genome | 1 | GAAGAGCGAAATGCAATCTTCTGCTT CTTCAGTAGAGACTTTACAGTCTT |
| 7553 | literature | NA | NC_001345 | 9625578 | Human herpesvirus 4, complete genome | 1 | GCACATCCATCGCCCAAAGTGAAGTC TGCAAGGATGCCATTTATTGGTTG |
| 7554 | literature | NA | NC_001345 | 9625578 | Human herpesvirus 4, complete genome | 1 | TCTCGGTTTACCTTTTTGCTGTTGTG GTTCTTTGTTCTTGCTGGTTTGCT |
| 7555 | literature | NA | NC_001345 | 9625578 | Human herpesvirus 4, complete genome | 1 | TCTGAATACTCTACAAAACGCTCCTT GTCTGCTCTTAAAACCATCTGTGT |
| 7556 | literature | NA | NC_001345 | 9625578 | Human herpesvirus 6, complete genome | 1 | TGAAGCTGACACCTGTGAAACTAACT TAAACGCATGTTCTTCTGACTCAG |
| 7557 | literature | NA | NC_001345 | 9625578 | Human herpesvirus 6, complete genome | 1 | TTCTGTTTTGGGCCAGGAACCGTTCT ATAAATTGTTTTATTGACTACACG |
| 7558 | literature | NA | NC_001345 | 9625578 | Human herpesvirus 6, complete genome | 1 | TAACACCGTCCAAGAAATTTTGCCGT TGTGTCCCCATACTTCTCTAGGGC |
| 7559 | literature | NA | NC_001345 | 9625578 | Human herpesvirus 6, complete genome | 1 | AGAAGAAGGATCAGATGGAGAGTTG AAAACTTTAGCTGGTAAGTACATGA |
| 7560 | literature | NA | NC_001345 | 9625578 | Human herpesvirus 6, complete genome | 1 | CCGATACCGGCAAGATCTGTCGTCTG GCAAACTCGTTTTCCACCTTATGG |
| 7561 | literature | NA | NC_001664 | 9628290 | Human herpesvirus 6, complete genome | 1 | CTGTGGGTCCCTCCCCCTCATCTGTT ATTCCCTTCCCCTCTGCCACCGAT |
| 7562 | db mining | Hs.159568 | AI382620 | 4195401 | qz04e10.x1 cDNa, 3' end/ clone = IMAGE:2020554/clone_end = | 1 | ACTACATTTTAATTAAAGATTAATGGG CATATTAGAAGTTTCTCAAAGTTAGG |

TABLE 8-continued

| SEQ ID | Origin | Unigene | Locus | GI | Nominal Description | Strand | Probe Sequence |
|---|---|---|---|---|---|---|---|
| 7563 | db mining | Hs.129055 | NM_002540 | 4505490 | 3' Homo sapiens. Similar to outer dense fiber of sperm tails 2, clone MGC:9034 IMAGE:3874501, mRNA, complete cds/cds = (656, 2947) | 1 | CT AAAAGGAGTGAGCTATCATCAGTGCT GTGAAATAAAAGTCTGGTGTGCCA |
| 7564 | db mining | Hs.12329 | AB014597 | 3327207 | mRNA for KIAA0697 protein, partial cds/cds = (0, 2906) | 1 | AAAGCCACCACTGTTCCCAGTCAGCA TATACAAGCTCTTAATATTCTGTT |
| 7565 | db mining | Hs.119177 | NM_001659 | 4502202 | ADP-ribosylation factor 3 (ARF3), mRNA/cds = (311, 856) | 1 | AAATGTGGGATAACGCGATGACTGTG ACCCTGGTTGGAAATTAAACTTGT |
| 7566 | db mining | Hs.12379 | BC003376 | 13097227 | Homo sapiens, ELAV (embryonic lethal, abnormal vision, Drosphila)-like 1 (Hu antigen R), clone MGC:5084 IMAGE:2901220, mRNA, complete cds/cds = (142, 1122) | 1 | AACACAGAAACATTTGAGCATTGTAT TTCTCGCATCCCTTCTCGTGAGCG |
| 7567 | db mining | Hs.319886 | AL589290 | 13243062 | DKFZp451F1715_r1 cDNA, 5' end/ clone = DKFZp451F1715/clone_end = 5' | 1 | AACCTATCAAAGCCTAGCCTAAGGGC TGCCATCTCTGTCTAAATTCTAGT |
| 7568 | db mining | Hs.315597 | NM_015960 | 7705727 | cDNA FLJ10280 fis, clone HEMBB1001288, highly similar to CGI-32 protein mRNA/cds = UNKNOWN | 1 | AACTGCATGGTATGAATTCAGAGTGT GACTTAAGGGTCAATTCAAAGCAG |
| 7569 | db mining | Hs.110457 | AF071594 | 3249714 | MMSET type I (WHSC1) mRNA, complete cds/cds = (29, 1972) | 1 | ACAGACTTTGTTAATGTAGGAAATCT CTCCAAGTGGAAACGTGCTAACTT |
| 7570 | db mining | Hs.144904 | NM_006311 | 5454137 | nuclear receptor co-repressor 1 (NCOR1), mRNA/cds = (240, 7562) | 1 | ACAGGCAATTCAGTGGACTATAATAA TAGTGGAGGGTTGAGATGTAGAGT |
| 7571 | db mining | Hs.118064 | NM_022731 | 12232386 | similar to rel nuclear ubiquitous casein kinase 2 (NUCKS), mRNA/ cds = (68, 557) | 1 | ACAGGTCACAGTGGATTTCTTTTCAA ACTGACAATGTTTAGGTTTTAAGC |
| 7572 | db mining | Hs.337616 | NM_000753 | 4502924 | phosphodiesterase 3B, cGMP-inhibited (PDE3B), mRNA/ cds = (0, 3338) | 1 | ACCTCAAGCAGATGAGATTCAGGTAA TTGAAGAGGCAGATGAAGAGGAAT |
| 7573 | db mining | Hs.152049 | AW962287 | 8152099 | EST374360 cDNA | 1 | ACCTTCTACACCACTGGAAAATAACA TGGAGGTTTAGAGCCGTGCAAAAT |
| 7574 | db mining | Hs.115325 | NM_03929 | 4506374 | RAB7, member RAS oncogene family-like 1 (RAB7L1), mRNA/cds = (40, 851) | 1 | ACTAAACTCTGAGGCCTGAAGTTCTG TGATAGACCTTAAATAAGTGTCCT |
| 7575 | db mining | Hs.119178 | AK024468 | 10440445 | mRNA for FLJ00059 protein, partial cds/cds = (2624, 4057) | 1 | ACTGGGGTGGTGATGTTTTCGTTCTG TTTTATTTTTCTAACTCTGCTGAC |
| 7576 | db mining | Hs.183898 | NM_000269 | 4557796 | ribosomal protein L29 (RPL29), mRNA/cds = (29, 508) | 1 | ACTTCATCATAATTTGGAGGGAAGCT CTTGGAGCTGTGAGTTCTCCCTGT |
| 7577 | db mining | Hs.15787 | AB023166 | 4589541 | mRNA for KIAA0949 protein, partial cds/cds = (0, 2822) | 1 | AGAACGAGGAAGAGAACACAAGGAA TGATTCAAGATCCACCTTGAGAGGA |
| 7578 | db mining | Hs.108104 | NM_003347 | 4507788 | ubiquitin-conjugating enzyme E2L3 (UBE2L3), mRNA/cds = (15, 479) | 1 | AGAGAATAGGCTTTCTAAGATGCTGC GATCCCGTTCTGCTGCCCGTAATA |
| 7579 | db mining | Hs.163593 | NM_000980 | 11415025 | ribosomal protein L18a (RPL18A), mRNA/cds = (19, 549) | 1 | AGCACAAGCCACGCTTCACCACCAA GAGGCCCAACACCTTCTTCTAGGTG |
| 7580 | db mining | Hs.121044 | L39061 | 632997 | transcription factor SL1 mRNA, partial cds/cds = (0, 1670) | 1 | AGGCCAATCACTGCTGACTAAGAATT CATTATATTGGCTTAGTACACAGA |
| 7581 | db mining | Hs.309348 | NM_032472 | 14277125 | lc93c11.x1 cDNA 3' end/ clone = IMAGE:2073716/clone_end = 3' | 1 | AGGGAAGATTTCTGTATACTTGCTGG AGAGGAGGAATGTGTATAGTTACT |
| 7582 | db mining | Hs.16493 | AK027866 | 14042851 | cDNA FLJ14960 fis, clone PLACE4000192, weakly similar to ZINC FINGER PROTEIN 142/ cds = (114, 3659) | 1 | AGTTTTAATACCTTAAGCTTTTCAAG ACCTAACTGCAGCCGCTTTGGGA |
| 7583 | db mining | Hs.1342 | NM_001882 | 4502982 | cytochrome c oxidase subunit Vb (COX5B), nuclear gene encoding mitochondrial protein, mRNA/ cds = (21, 410) | 1 | ATGTGCTGTAAAGTTTCTTCTTTCCAG TAAAGACTAGCCATTGCATTGGC |
| 7584 | db mining | Hs.111076 | NM_005918 | 5174540 | malate dehydrogenase 2, NAD (mitochondrial) (MDH2), nuclear gene encoding mitochondrial protein, mRNA/ cds = (86, 1102) | 1 | ATTGTGGGTGGCTCTGTGGGCGAT CAATAAAAGCCGTCCTTGATTTTAT |
| 7585 | db mining | Hs.107476 | NM_006476 | 5453560 | ATP synthase, H+ transporting, mitochondrial F1F0, subunit g (ATP5JG), mRNA/cds = (73, 384) | 1 | ATTTGAGTGTTGTTGGACCATGTGTG ATCAGACTGCTATCTGAATAAAAT |
| 7586 | db mining | Hs.146354 | NM_005809 | 5902725 | peroxiredoxin 2 (PRDX2), mRNA/ cds = (89, 685) | 1 | CAAGCCCACCCAGCCGCACACAGGC CTAGAGGTAACCAATAAAGTATTAG |
| 7587 | db mining | Hs.12124 | NM_018127 | 11875212 | elaC (E. coli) homolog 2 (ELAC2), mRNA/cds = (0, 2480) | 1 | CACCAGAGACAAGCAGAGTAACAGG ATCAGTGGGTCTAAGTGTCCGAGAC |
| 7588 | db mining | Hs.154023 | AB011145 | 3043669 | mRNA for KIAA0573 protein, partial cds/cds = (0, 1356) | 1 | CAGGAGGTAGGGATCTGGCTGAGAG GGAATAATCTGAGCAAAGGTATGAA |
| 7589 | db mining | Hs.109051 | NM_031288 | 13775197 | SH3BGRL3-like protein (SH3BGRL3), mRNA/cds = (71, 352) | 1 | CAGTCCCTCTCCCAGGAGGACCCTA GAGGCAATTAAATGATGTCCTGTTC |
| 7590 | db mining | Hs.125307 | AA836204 | 2910523 | od22g11.s1 cDNA/ clone = IMAGE:1368740 | 1 | CATGAGAAGTATCTGCAATAACCCA AGTCAACATTTAGGTTTGTGTACA |

TABLE 8-continued

| SEQ ID | Origin | Unigene | Locus | GI | Nominal Description | Strand | Probe Sequence |
|---|---|---|---|---|---|---|---|
| 7591 | db mining | Hs.16803 | NM_018032 | 8922296 | LUC7 (*S. cerevisiae*)-like (LUC7L), mRNA/cds = (71, 1048) | 1 | CATGTTGAGTAGGAATAAATAAATCT GATGCTGCCTCCTGAGGCTGCGGG |
| 7592 | db mining | Hs.148580 | NM_001975 | 5803010 | enolase 2, (gamma, neuronal) (ENO2), mRNA/cds = (222, 1526) | 1 | CCACCACCTCTGTGGCATTGAAATGA GCACCTCCATTAAAGTCTGAATCA |
| 7593 | db mining | Hs14169 | AK027567 | 1402333 | cDNA FLJ14681 fis, clone NT2RP2002710, weakly similar to SH3-BINDING PROTEIN 3BP-1/cds = (70, 2481) | 1 | CCATGCCGCCTCGTTGGATTGTCGG AATGTAGACAGAAATGTACTGTTCT |
| 7594 | db mining | Hs.118625 | NM_000188 | 4504390 | hexokinase 1 (HK1), nuclear gene encoding mitochondrial protein, mRNA/cds = (81, 2834) | 1 | CCCACCGCTTTGTGAGCCGTGTCGTA TGACCTAGTAAACTTTGTACCAAT |
| 7595 | db mining | Hs.144505 | NM_015653 | 13124762 | DKFZP566F0546 protein (DKFZP566F0546), mRNA/cds = (377, 1308) | 1 | CCCACGGGAGACTATTTCACACAATT TAATACAGGAAGTCGATAATGAGG |
| 7596 | db mining | Hs.155751 | NM_004889 | 4757811 | ATP synthase, H+ transporting, mitochondrial F0 complex, subunit 1, isoform 2 (ATP5J2), mRNA/cds = (27, 311) | 1 | CCCTCCGTGAGGAACACAACTCAAT CGTTGCTGAATCCTTTCATATCCT |
| 7597 | db mining | Hs.10267 | NM_015367 | 7662505 | ML1 protein (ML1), nuclear gene encoding mitochondrial protein, mRNA/cds = (71, 1231) | 1 | CCGTGTCTTTCCAGCCCTAAAGGAAG GGCAGACCCGTGTCTTTCCATGCC |
| 7598 | db mining | Hs.14632 | BC008013 | 14124973 | *Homo sapiens*. Similar to CG12113 gene product, clone IMAGE:3532726, mRNA, partial cds/cds = (0, 2372) | 1 | CCTGAAGCACTTCACCTGGAATTGAT GTGTAGGCTTAAGGAGTATGTGAC |
| 7599 | db mining | Hs.125156 | NM_001488 | 4503956 | transcriptional adaptor 2 (ADA2, yeast, homolog)-like (TADA2L), mRNA/cds = (0, 1091) | 1 | CGCAGGCAAGAGCACTCATCAAGATA GATGTGAACAAAACCCGGAAAATC |
| 7600 | db mining | Hs.159545 | NM_013308 | 7019400 | platelet activating receptor homolog (H963), mRNA/cds = (219, 1178) | 1 | CGCTCAAAGGTCACTGAGACTTTTGC CTCACCTAAAGAGACCAAGGCTCA |
| 7601 | db mining | Hs.152936 | NM_004068 | 4757993 | adaptor-related protein complex 2, mu 1 subunit (AP2M1), mRNA/cds = (135, 1442) | 1 | CGGCCTCAGTCCCTACTCTGCTTTGG GATAGTGTGAGCTTCATTTTGTAC |
| 7602 | db mining | Hs.110857 | NM_016310 | 7706498 | polymerase (RNA) III (DNA directed) polypeptide K (12.3 kDa) (POLR3K), mRNA/cds = (39, 365) | 1 | CTAGTGTGTGCTTGCCTTGTCCCTCG GGGTAGATGCTTAGCTGGCAGTAT |
| 7603 | db mining | Hs.118666 | NM_025207 | 13376805 | hypothetical protein PP591 (PP591), mRNA/cds = (820, 1704) | 1 | CTTTCAGATTCCCTCTGGTCTCCGTC CGAAACGTCTACCTCTTCCCAGGC |
| 7604 | db mining | Hs.16390 | AK024453 | 10440419 | mRNA for FLJ0045 protein, partial cds/cds = (106, 924) | 1 | GAAATTCACAGGCCAGGGCACATCTT TTATTTATTTCATTATGTTGGCCA |
| 7605 | db mining | Hs.109302 | AA808018 | 2877424 | nv64d09.s1 cDNA, 3' end/clone = IMAGE:1234577/clone_end = 3' | 1 | GACTCCCTCAACACCCAAAACTCTA |
| 7606 | db mining | Hs.111126 | NM_004339 | 11038870 | pituitary tumor-transforming 1 interacting protein (PTTG1iP), mRNA/cds = (210, 752) | 1 | GAGCAGCCACAAAACTGTAACCTCAA GGAAACCATAAAGCTTGGAGTGCC |
| 7607 | db mining | Hs.127376 | NM_021645 | 11063982 | KIAA0266 gene product (KIAA0266), mRNA/cds = (733, 3033) | 1 | GCAGCAAACAGAGGGTCAGTCACAG GATGTTCTGACACACCATTGTAACT |
| 7608 | db mining | Hs.108196 | NM_016095 | 7706366 | HSPC037 protein (LOC51659), mRNA/cds = (78, 635) | 1 | GCCAACAATGCTGACCGGTGCTTATC CTCTAAGCCCTGATCCACAATAAA |
| 7609 | db mining | Hs.117487 | AF040965 | 2792365 | unknown protein IT 12 mRNA, partial cds/cds = (0, 2622) | 1 | GCCAGTGTAATTTCTGTCAACCACGG ACGTTTGCCTTCATGTGTAGAATT |
| 7610 | db mining | Hs.107882 | NM_018171 | 8922576 | hypothetical protein FLJ10659 (FLJ10659), mRNA/cds = (38, 1000) | 1 | GCCCAAGCACTAGTAGAGATGCGCG ATACAGGTCTAGTTTCGGTAACTGT |
| 7611 | db mining | Hs.147585 | NM_024785 | 13376147 | hypothetical protein FLJ22746 (FLJ22746), mRNA/cds = (266, 1072) | 1 | GGCCAGATTTTGACTCCCAGATTCCT TTACAAAACGCACTCATTCATTCA |
| 7612 | db mining | Hs.153357 | NM_001084 | 4505890 | procollagen-lysine, 2-oxoglutarate 5-dioxygenase 3 (PLOD3), mRNA/cds = (216, 2432) | 1 | GGGACTCCCCGCGTGATAAATTATTA ATGTTCCGCAGTCTCACTCTGAAT |
| 7613 | db mining | Hs.148495 | NM_002810 | 5292160 | proteasome (prosome, macropain) 26S Subunit, non-ATPase, 4 (ODMD4), mRNA/cds = (62, 1195) | 1 | GGGACTGCATGGGAAGCACGGAATA TAGGGTTAGATGTGTGTTATCTGTA |
| 7614 | db mining | Hs.13144 | NM_014182 | 7661819 | HSPC160 protein (HSPC160), mRNA/cds = (53, 514) | 1 | GGGGTTCGTGTCTTTGGCATCAACAA ATACTGAGGGATGGGTTTTGGGAC |
| 7615 | db mining | Hs.1189 | NM_001949 | 12669913 | E2F transcription factor (E2F3) mRNA, complete cds/cds = (66, 1463) | 1 | GGGTGACCTGTTCTCTAGCTGTGATC TTACCACTTCAAATGGGTGTAATT |
| 7616 | db mining | Hs.12284 | BC001699 | 12804564 | *Homo sapiens*, clone IMAGE:2989556, mRNA, partial cds/cds = (0, 370) | 1 | GGTGTGAACGGGCTGACTTGGTGAA TTGGGCAACTCCTTATAGTGTTGTG |
| 7617 | db mining | Hs.158380 | AI381581 | 4194362 | td05e04.x1 cDNA, 3' end/clone = IMAGE:2074782/clone_end = 3' | 1 | GTACCACTTGAATGATTTCAGTCAATT TTGAACCCCTTTGGAAAGAGGTG |
| 7618 | db mining | Hs.1390 | BC000268 | 12653014 | *Homo sapiens*, proteasome (prosome, macropain) subunit, beta type, 2, clone MGC:1664 IMAGE:3352313, mRNA, complete cds/cds = (58, 683) | 1 | GTGAAACCCCGTCTCTGCTAAAAATA CAAAAATTAGCTGGGCGTGGTGGC |
| 7619 | db mining | Hs.115808 | NM_002287 | 11231175 | leukocyte-associated tg-like receptor 1 (LAIR1), transcript variant a, mRNA/ | 1 | GTTCTCTGGGTTGTGCTTTACTCCAC GCATCAATAAATAATTTTGAAGGC |

TABLE 8-continued

| SEQ ID | Origin | Unigene | Locus | GI | Nominal Description | Strand | Probe Sequence |
|---|---|---|---|---|---|---|---|
| | | | | | cds = (57, 920) | | |
| 7620 | db mining | Hs.119960 | AL117477 | 5911950 | mRNA; cDNA DKFZp727G051 (from clone DKFZp727G051); partial cds/cds = (0, 1423) | 1 | TACTGCCAACTGACCTTATAACCCTC TGCACCTTCAAAAAGATTCATGGT |
| 7621 | db mining | Hs.154073 | NM_005827 | 5032212 | UDP-galactose transporter related (UGTREL1), mRNA/cds = (87, 1055) | 1 | TCAAACAGTGACATCTCTTGGGAAAA TGGACTTAATAGGAATATGGGACT |
| 7622 | db mining | Hs.11747 | NM_017798 | 8923363 | hypothetical protein FLJ20391 (FLJ20391), mRNA/cds = (9, 602) | 1 | TCACTTCCTCTGAACTGTTACTGCCT GAATGGAGTCCTGGACGACATTGG |
| 7623 | db mining | Hs.10881 | AB011113 | 3043605 | mRNA for KIAA0541 protein, partial cds/cds = (0, 3484) | 1 | TCCACTTAATAGACTCTATGTGTGCT GAATGTTCCTGTGTACATATGTGT |
| 7624 | db mining | Hs.153850 | AK024476 | 10440465 | mRNA for FLJ00069 protein, partial cds/cds = (2657, 4396) | 1 | TCCCGCAGAGTGCAGAGACAGGAAG CTGGAGATGTCTTTATAAAGTCACA |
| 7625 | db mining | Hs.247870 | AL035694 | 4678462 | DNA sequence from clone 33L1 on chromosome 6q14.1-15. Contains the gene for novel T-box (Brachyury) family protein. Contains ESTs, STSs, GSSs and two putative CpG islands/cds-(0, 1505) | 1 | TCTAGGACCCTAGGAAGCTTAACTCT GTCATCATCTCAAGTATCTGCACA |
| 7626 | db mining | Hs.324648 | NM_003128 | 4507194 | cDNA FLJ13700 fis, clone PLACE2000216, highly similar to SPECTRIN BETA CHAIN, BRAIN/cds = UNKNOWN | 1 | TCTTCCGCCATCTCCTCTGATAAACA CGAGGTGTCTGCCAGCACCCAGAG |
| 7627 | db mining | Hs.118722 | NM_004480 | 4758407 | fucosyltransferase 8 (alpha (1, 6) fucosyltransferase) (FUT8), mRNA/cds = (716, 2443) | 1 | TGATATGTTGATCAGCCTTATGTGGA AGAACTGTGATAAAAAGAGGAGCT |
| 7628 | db mining | NA | AL134726 | 6602913 | DKFZp547A1290_r1 cDNA, 5' end/clone = DKFZp547A1290/clone_end = 5' | 1 | TGCAGTATTTTTCAAACTTCTGGTCG |
| 7629 | db mining | Hs.166887 | NM_003915 | 4503012 | copine I (CPNE1), mRNA/cds = (156, 1769) | 1 | TGCTGCTCTTGATCCCACCTTTGCTC CTGACAACCCTCATTCAATAAAGA |
| 7630 | db mining | Hs.146324 | AK023182 | 10434993 | cDNA FLJ13120 fis, clone NT2RP3002882, highly similar to CGI-145 protein mRNA/cds = (176, 961) | 1 | TGGTTTGTTCATGGATGTATTCTAAG AGCTGAGAACAGGGCCTGGACACA |
| 7631 | db mining | Hs.12438 | AK026309 | 10439130 | cDNA; FLJ22656 fis, clone HS107655/cds = UNKNOWN | 1 | TGTTCTGAATGTTGGTAGACCCTTCA TAGCTTTGTTACAATGAAACCTTG |
| 7632 | db mining | Hs.15164 | NM_006333 | 5453582 | nuclear DNA-binding protein (C1D), mRNA/cds = (117, 542) | 1 | TGTTGATGGATGAATTTTGGCATGAT GACTGTACTCTCAATAAAGGCTGA |
| 7633 | db mining | Hs.130743 | AA642459 | 2567877 | ns30d01.s1 cDNA, 3' end/clone = IMAGE:1185121/clone_end = 3' | 1 | TTCATCCTGTGAGTGCTGGGGAGGA |
| 7634 | db mining | Hs.16492 | NM_015497 | 13794264 | DKFZP546G2022 protein (DKFZP564G2022), mRNA/cds = (42, 1709) | 1 | TTCATTTTCCTGGGAAGTCAAGGTTA CATCTTGCAGAGGTTGTTTGAG |
| 7635 | db mining | Hs.122552 | NM_016266 | 7705291 | G-2 and S-phase expressed 1 (GTSE1), mRNA/cds = (70, 2232) | 1 | TTCTAAGCCCGAACCAAATCCTTTGCC TTGAAAGAACAGCCCTAAAGTGGT |
| 7636 | db mining | Hs.312510 | AI74807 | 6361196 | HA2528 cDNA | 1 | TTTGTTTGTTTGTTTCAGATAGGGTCT CCCTCTGTCACCCAGGCTGCAGT |
| 7637 | db mining | Hs.108258 | NM_012090 | 10048480 | actin cross-linking factor (ACF7), transcript varient 1, mRNA/cds = (51, 16343) | 1 | TTTTGTAAATCACGGACACCTCAATTA GCAAGAACTGAGGGGAGGGCTTT |
| 7638 | db mining | Hs.111092 | NM_024724 | 13376033 | hypothetical protein FLJ22332 (FLJ2232), mRNA/cds = (275, 1255) | 1 | CGGTGTGGAAAATGTTGTCCTTTGAG TGGCAAGAATTAGAAAAATCTTCA |
| 7639 | db mining | Hs.114311 | NM_003504 | 4502712 | CDC45 (cell division cycle 45, S. cerevisiae, homolog)-like (CDC45L), mRNA/cds = (24, 1724) | 1 | CTGAAAGCTGAGGATCGGAGCAAGT TTCTGGACGCACTTATTTCCCTCCT |
| 7640 | db mining | Hs.11081 | NM_02541 | 13376853 | UBX domain-containing gene 1 (UBXD1), mRNA/cds = (96, 1421) | 1 | GTTGGCCTCAGCCCTGTGGGTCTGT CTCATGCTCTCCCTGTTCCTCTCCC |
| 7641 | db mining | Hs.100217 | NM_005892 | 5174400 | formin-like (FMNL), mRNA/cds = (39, 1430) | 1 | TAGCCATACTTAGCCTCAGCAGGAGC CTGGCCTGTAACTTATAAAGTGCA |
| 7642 | db mining | Hs.12258 | AL137728 | 6808258 | mRNA, cDNA DKFZp434B0920 (from clone DKFZp4348B0920)/cds = UNKNOWN | 1 | TGAGGGCTGTGCTGACCTTTGAGAG GATTTGAAATTGCTTCATATTGTGA |
| 7643 | db mining | Hs.155462 | NM_005915 | 7427518 | minichromosome maintenance deficient (mis5, S. pombe) 6 (MCM6), mRNA/cds = (61, 2526) | 1 | TGTGTAAGAAAAGGCCATTACTTTT AAGGTATGTGCTGTCCTATTGAGC |
| 7644 | db mining | Hs.165998 | NM_015640 | 7661625 | PAI-1 mRNA-binding protein (PAI-RBP1), mRNA/cds = (85, 1248) | 1 | TTGTTGGTAGGCACATCGTGTCAAGT GAAGTAGTTTTATAGGTATGGGTT |
| 7645 | db mining | Hs.164207 | NM_024805 | 13376184 | hypothetical protein FLJ21172 (FLJ21172), mRNA/cds = (138, 1169) | 1 | TTTCTAGCTTTTCCGTGTATCTAAACA CAATTTGCTACACAAGTCACTGT |
| 7646 | db mining | Hs.150275 | D87682 | 1663899 | mRNA for KIAA0241 gene, partial cds/cds = (0, 1568) | 1 | ACTGTGGCACATGTTTTGATCAGAAA GGTAGTTCTCTTTGCTCTGGTAGT |
| 7647 | db mining | Hs.11039 | NM_024102 | 13129109 | hypothetical protein MGC2722 (MGC2722), mRNA/cds = (69, 1097) | 1 | CATCTTCTGCCCTGGTCCCCTTTCTC TTGATGTGGAAAGTCTGAATGCAG |
| 7648 | db mining | Hs.102708 | NM_015396 | 7661561 | DKFZP434A043 protein (DKFZP434A043), mRNA/cds = (697, 1425) | 1 | CGCTCTAATACTGCATTCTGTTTCTC CTTTTGTGCCCTGATTGTAATCCA |

TABLE 8-continued

| SEQ ID | Origin | Unigene | Locus | GI | Nominal Description | Strand | Probe Sequence |
|---|---|---|---|---|---|---|---|
| 7649 | db mining | Hs.109646 | NM_002493 | 4505364 | NADH dehydrogenase (ubiquinone) 1 beta subcomplex, 6 (17kD, B17) (NDUFB8), mRNA/cds = (68, 454) | 1 | CTGGAGACTGGAGAAGTAATTCCACC AATGAAAGATTTCCTGATCAACA |
| 7650 | db mining | Hs.142307 | AL137273 | 6807710 | mRNA; cDNA DKFZp43410714 (from clone DKFZp43410714)/cds = (0.412) | 1 | TCAGTGTTTCGTTATTCCATATCAGTG GCTTTTACTGTCAAAGATTGTGT |
| 7651 | db mining | Hs.16297 | NM_005694 | 5031844 | COX17 (yeast) homolog, cytochrome c oxidase assembly protein (COX17), mRNA/cds = (86, 277) | 1 | TGCATGAGAGCCCTAGGATTTAAAAT ATGAAATGGTGGTCTGCTGTGTGA |
| 7652 | db mining | Hs.11184 | NM_017811 | 8923387 | hypothetical protein FLJ20419 (FLJ20419), mRNA/cds = (191, 907) | 1 | TGTGCTAAGCCTGATGAAATGTGCTC CTTCAATCTCCATGAAACCATCGT |
| 7653 | db mining | Hs.12013 | NM_002940 | 4506558 | ATP-binding cassette, sub-family E (OABP), member 1 (ABCE1), mRNA/cds = (117, 1918) | 1 | AAATGATCTCCCTTTATTACCCTCCCA AAGGTTACCAGCGTTTGAATTTA |
| 7654 | db mining | Hs.155485 | NM_005339 | 12545382 | huntingtin interacting protein 2 (HIP2), mRNA/cds = (77, 679) | 1 | ACACACTAATGTAACCATTTTATGAAG GTTGAAGTGGATTTATGCAGGCA |
| 7655 | db mining | Hs.154573 | AW955094 | 8144777 | EST367164 cDNA | 1 | ATCAGGAGAATGTCAAAGAAGTCCTT TATGTGGATTGCCCGAGCTTCTCT |
| 7656 | db mining | Hs.142157 | AF080255 | 5733121 | iodestar protein mRNA, complete cds/cds = (30, 3518) | 1 | ATTGTGCCACTGTTTTCCAGCCTGGG CAATACAGTGAGACCCTGTCTCAA |
| 7657 | db mining | Hs.1191 | AK025679 | 10438273 | cDNA; FLJ22026 fis, clone HEP08537/cds = UNKNOWN | 1 | CGTCAAAGTCAATCCCAAAACAGATA AGCCCTATGAGGATGTCAGCATCA |
| 7658 | db mining | Hs.13340 | NM_003642 | 4504340 | histone acetyltransferase 1 (HAT1), mRNA/cds = (38, 1295) | 1 | ACGACTTGCTCAAGAGTAAAGATTAT ACTGCTCTGTACAGGAAGCTTGCA |
| 7659 | db mining | Hs.108110 | NM_014034 | 7681591 | DKFZP547E2110 protein (DKFZP547E2110), mRNA/cds = (192, 806) | 1 | TGTTGAGGAAAGGAAAAGGGCATTTG TCTAAACATGGATTCTGAGTTGTA |
| 7660 | db mining | Hs.123295 | AA833793 | 2908561 | od61g07.s1 cDNA/clone = IMAGE:1372476 | 1 | GTGGATGAGTAGGGAGTGGGCGAGA CAGGGACGAGATGAGCAGGGTCAAG |
| 7661 | db mining | Hs.126565 | AB020688 | 420210 | mRNA for KIAA0861 protein, partial cds/cds = (0, 2948) | 1 | GGTGTTCGTGTTAGTGCCAAGATTGC TTCGTTGTAGAGAGAGTTCGTTCC |
| 7662 | db mining | Hs.155174 | AB007892 | 2887434 | KIAA0432 mRNA, complete cds/cds = (0, 2251) | 1 | ACTAGAGTCCAGGTAATAGTAGTGGA GATATGTGGAGAGACATGATAGGT |
| 7663 | db mining | Hs.116445 | AA648776 | 2575205 | ns24d11.s1 cDNA, 3' end/clone = IMAGE:1184565/clone_end = 3' | 1 | TTCCTGTGTGAGATTTCTCGCCATTC CTCAATTCAACAAATATGCCTTTT |
| 7664 | db mining | Hs.124933 | AA825303 | 2898805 | oc67e04.s1 cDNA, 3' end/clone = IMAGE:1354782/clone_end = 3' | 1 | TATACTTTGATCCCTCAGCAAGTTGT CCTCACTGTTGTGTGAACCTGTTT |
| 7665 | db mining | Hs.313267 | AW295641 | 6702277 | UI-H-BW0-aip-e-12-0-UI.s1 cDNA, 3' end/clone = IMAGE:2729975/clone_end = 3' | 1 | TTTCCTGAATACTTTATGACAACTGAG TTTGCCGGGTAGAGTGGCCGTTT |
| 7666 | db mining | Hs.313203 | AW293882 | 6700518 | UI-H-BW0-ain-e-07-0-UI.s1 cDNA, 3' end/clone = IMAGE:2729941/clone_end = 3' | 1 | AAACTAGAATTCCGGTTTCCCAAGGT GGCTTATGACAACCAGAATCCTTT |
| 7667 | db mining | Hs.105488 | AA521017 | 2261560 | aa70f05.s1 cDNA, 3' end/clone = IMAGE:826305/clone_end = 3' | 1 | GGCTTCCCGCCTGTGCAGTCATTTGT ATGTGTTTATATATTGGAGTGTT |
| 7668 | db mining | Hs.125802 | AA06833 | 2876049 | oc29b10.s1 cDNA, 3' end/clone = IMAGE:1351099/clone_end = 3' | 1 | ACAAAATATAAGGGTGTGACTTTGGAT CCTGACTCAAACCAACCAGCTGTT |
| 7669 | db mining | Hs.313274 | AW295745 | 6702381 | UI-H-BW0-aiw-g-10-UI.s1 cDNA, 3' end/clone = IMAGE:2730834/clone_end = 3' | 1 | TCAAAATCCGTTACTCTTTCCACAACA ATTGAGGGTAATGGTGTTCAGTT |
| 7670 | db mining | Hs.320376 | BF512113 | 11597325 | UI-H-BW1-ami-h-04-0-UI.s1 cDNA, 3' end/clone = IMAGE:3070302/clone_end = 3' | 1 | GCCATTCCGGGCTTCTCTATTTGAAAA CAGTTACCATATTCCCCCTCAGTT |
| 7671 | db mining | Hs.315341 | BE675056 | 10035597 | 7f02/10.x1 cDNA, 3' end/clone = IMAGE:3293419/clone_end = 3' | 1 | ATTTGGTAGAGACGGGGTTTCACCTT ATTGCCCAGGCCATCATGTATCTT |
| 7672 | db mining | Hs.320407 | BF512394 | 11597660 | UI-H-BW1-amc-f-01-0-UI.s1 cDNA, 3' end/clone = IMAGE:3069456/clone_end = 3' | 1 | TGTCATTTGCCCTTTCCCCCATATAT GTAGAATTGGGTCTTTTTCAACTT |
| 7673 | db mining | Hs.313347 | AW297156 | 6703802 | UI-H-BW0-ajd-b-05-0-UI.s1 cDNA, 3' end/clone = IMAGE:2731329/clone_end = 3' | 1 | AACAGGGAGAGACTACACACAA GCCAACCTCAATCTCATCTTTATGC CATT |
| 7674 | db mining | Hs.123298 | AA809468 | 2878874 | ob85a10.s1 cDNA, 3' end/clone = IMAGE:1338138/clone_end = 3' | 1 | TCTTCTTTTTGATGTGAATTACTCTTG AAATGCCGGAGAAGGGACAAATT |
| 7675 | db mining | Hs.320416 | BF512570 | 11597749 | UI-H-BW1-amf-e-12-0-UI.s1 cDNA, 3' end/clone = IMAGE:3069791/clone_end = 3' | 1 | AGATAGAGTCATATTCTATTTAGCTTG GGACATGGCAGGTACTCAGTTGT |
| 7676 | db mining | Hs.309262 | AI440532 | 4300887 | CM4-NT0290-150101-684-e05 cDNA | 1 | AGCCTTTTTGGGAGTGAGGGTTTATA TGATGTCTGATTCTGTAATACTGT |
| 7677 | db mining | Hs.313338 | AW297010 | 6703646 | UI-H-BW0-ejf-d-01-0-UI.s1 cDNA, 3' end/clone = IMAGE:2731441/clone_end = 3' | 1 | GCAGCCCTGAGCCTGGAATAGATACT TTTTGGTCTTTTGGTTGTAGATGT |

TABLE 8-continued

| SEQ ID | Origin | Unigene | Locus | GI | Nominal Description | Strand | Probe Sequence |
|---|---|---|---|---|---|---|---|
| 7678 | db mining | Hs.315325 | BE646400 | 9970711 | 7e66c01.x1 cDNA, 3' end/clone = IMAGE:3292032/clone_end = 3' | 1 | CCCTCCCTATCTTTTTATGGGTAATTTGATTATACACGGTGCTTGAATGT |
| 7679 | db mining | Hs.313172 | AW293016 | 6699652 | UI-H-BW0-aih-f-04-0-UI.s1 cDNA, 3' end/clone = IMAGE:2729239/clone_end = 3' | 1 | TATGTCTTCTTACCCCAGCACCCCTAATTTAAAATACAGATCCCTGAGGT |
| 7680 | db mining | Hs.313361 | AW297413 | 5704049 | UI-H-BW0-ais-b-09-0-UI.s1 cDNA, 3' end/clone = IMAGE:2730208/clone_end = 3' | 1 | AAAACCTTGACAGTTCATTTCACCAAGCACCTATCAGGTATTTGGCAGGT |
| 7681 | db mining | Hs.313365 | AW297482 | 6704118 | UI-H-BW0-aja-a-05-0-UI.s1 cDNA, 3' end/clone = IMAGE:2730920/clone_end = 3' | 1 | AGTGCCCATGCTGTTTCAGATGCTCTTCTAGCTCCTGGAGATACATCAGT |
| 7682 | db mining | Hs.313558 | AW297377 | 6704013 | UI-H-BW0-eir-f-11-0-UI.s1 cDNA, 3' end/clone = IMAGE:2730381/clone_end = 3' | 1 | TGAGCTTCTGCTAGTAATTCCTTCAGGGGATTTCCTCCATGGCCGTAAGT |
| 7683 | db mining | Hs.320474 | BF513180 | 11598359 | UI-H-BW1-amj-d-06-0-UI.s1 cDNA, 3' end/clone = IMAGE:3070115/clone_end = 3' | 1 | GAGGGTGTCTGCTAATGATTTCCGAAAAGTTCTTCAAAACACTCCGAAGT |
| 7684 | db mining | Hs.313382 | AW297707 | 6704343 | UI-H-BW0-ajh-f-10-0-UI.s1 cDNA, 3' end/clone = IMAGE:2731915/clone_end = 3' | 1 | ACCAGTGTCATGAGTTTTGACAAGAGACAAAAGGAAAGGGTGGGAGAAGT |
| 7685 | db mining | Hs.125779 | AA810831 | 2880442 | oa78d09.s1 cDNA, 3' end/clone = IMAGE:1318193/clone_end = 3' | 1 | GCTGGTTGTTGCCTTTCAAGACAGCCAACTACCATTTATTCAACAGAAGT |
| 7686 | db mining | Hs.313389 | AW297882 | 6704507 | UI-H-BW0-aju-e-07-0-UI.s1 cDNA, 3' end/clone = IMAGE:2733038/clone_end = 3' | 1 | AGTCTGTCTATTCTCTTCTCTTTAGCTCTGTCTGTTGCTCAAATTCAAGT |
| 7687 | db mining | Hs.313391 | AW297905 | 6704541 | UI-H-BW0-eju-h-11-0-UI.s1 cDNA, 3' end/clone = IMAGE:2733188/clone_end = 3' | 1 | GCCAAGGTGAGTCAAAACACTGCTCTTCAGAAAGCAATTATTTGAAAAGT |
| 7688 | db mining | Hs.309446 | AI492055 | 4393058 | tg12a01.x1 cDNA, 3' end clone = IMAGE:2108520/clone_end = 3' | 1 | CATTGTCCCTCCCGCTGTGCTCTCAGGCAATAAATGATTTGATTATTTCT |
| 7689 | db mining | Hs.313311 | AW296433 | 6703069 | UI-H-BWD-aiq-a-05-0-UI.s1 cDNA, 3' end/clone = IMAGE:2730128/clone_end = 3' | 1 | GGTCAGAAACAGGCCCACAGAGACTCTGGAGGGTTCTTCCTTTGTGTTCT |
| 7690 | db mining | Hs.319887 | BF507608 | 11590906 | UI-H-BW1-ana-e-05-0-UI.s1 cDNA, 3' end/clone = IMAGE:3071720/clone_end = 3' | 1 | TTCAACTGCTTTGGCACTGCCATGGGTACCTGAGGATAAGAGAGATGTCT |
| 7691 | db mining | Hs.225237 | AW293790 | 6700426 | UI-H-B12-ahp-e-06-0-UI.s1 cDNA, 3' end/clone = IMAGE:2727635/clone_end = 3' | 1 | GGGTTGACTAAATGCACATGGGCTTATCTTTACCTCTTCCAGAAATGTCT |
| 7692 | db mining | Hs.313383 | AW297459 | 6704095 | UI-H-BW0-ais-g-03-0-UI.s1 cDNA, 3' end/clone = IMAGE:2730436/clone_end = 3' | 1 | TGCATGACCAGAAACACTGCCTGATACAGTAAGCAGAGGTAGCTGTCTCT |
| 7693 | db mining | Hs.320367 | BF512169 | 11597272 | UI-H-BW1-ami-c-10-0-UI.s1 cDNA, 3' end/clone = IMAGE:3070074/clone_end = 3' | 1 | ACCTGCCAGCCAGCCCACAACTATAAACTGTGTGACACCCAAATTTATCT |
| 7694 | db mining | Hs.320440 | BF512733 | 15597912 | UI-H-BW1-amm-d-04-0-UI.s1 cDNA, 3' end/clone = IMAGE:3070494/clone_end = 3' | 1 | GGTTTCTGAGGTGATTCTAATATGCAGTCATGGTTAAGAACCTGTGATCT |
| 7695 | db mining | Hs.313374 | AW297607 | 6704243 | UI-H-BW0-ajg-e-04-0-UI.s1 cDNA, 3' end/clone = IMAGE:2731854/clone_end = 3' | 1 | AAGCCTTGGACCAGCTTCCCGTTTCTCTCTTGTCTCCTGCCAAAAGATCT |
| 7696 | db mining | Hs.313355 | AW297325 | 6703961 | UI-H-BW0-air-a-08-0-UI.s1 cDNA, 3' end/clone = IMAGE:2730135/clone_end = 3' | 1 | ACCCAAAGGATGGTGTCTCCTGTCCCAGTTGAAAAGGTTTCTACCTAGCT |
| 7697 | db mining | Hs.320420 | BF512599 | 11597778 | UI-H-BW1-anf-h-07-0-UI.s1 cDNA, 3' end/clone = IMAGE:3069925/clone_end = 3' | 1 | TGGTTGAATACGCAGGAACACCCACAGTACCCAGGGACTAATAAATAGCT |
| 7698 | db mining | Hs.118899 | AA243283 | 1874126 | zs13g11.s1 cDNA, 3' end/clone = IMAGE:685124/clone_end = 3' | 1 | TTAGGGCAGTGGAGAATCAGGGTGTATCTAATAAATTCCTTCATGGAGCT |
| 7699 | db mining | Hs.105226 | AA489212 | 2218814 | aa57d11.s1 cDNA, 3' end/clone = IMAGE:825045/clone_end = 3' | 1 | GCAGATGTCTGCGTCATGGTTTATTACTCCTGTGTTCGTTTCAAGGAGCT |
| 7700 | db mining | Hs.297505 | BF514865 | 11600044 | UI-H-BW1-anj-f-12-0-UI.s1 cDNA, 3' end/clone = IMAGE:3082534/clone_end = 3' | 1 | TGTCTGTATTTGGAGTCCAGTAGTACACTGAAAATAATCCCGTAAAAGCT |
| 7701 | db mining | Hs.320492 | BF513340 | 11598519 | UI-H-BW1-amk-b-10-0-UI.s1 cDNA, 3' end/clone = IMAGE:3070050/clone_end = 3' | 1 | CTCCCTTCCCACCATACACACACTCCCAGCTCATTTTGATTCCTTTTCCT |
| 7702 | db mining | Hs.304837 | AW292802 | 6699438 | UI-H-BW0-aij-f-12-0-UI.s1 cDNA, 3' end/clone = IMAGE:2729615/clone_end = 3' | 1 | GGTGAAATTGACTGGGTTCCTCTCCCACCTCTCTTTCCGTAGCAATTCCT |
| 7703 | db mining | Hs.24656 | BF507762 | 11591060 | KIAA0907 protein (KIAA0907), | 1 | ACTAATTCCCGTGTCTGGCCCTGAAC |

TABLE 8-continued

| SEQ ID | Origin | Unigene | Locus | GI | Nominal Description | Strand | Probe Sequence |
|---|---|---|---|---|---|---|---|
| 7704 | db mining | Hs.320460 | BF512975 | 11598154 | mRNA/cds = (26, 1720) UI-H-BW1-amh-b-06-0-UI.s1 cDNA, 3' end/clone = IMAGE:3069559 clone_end = 3' | 1 | ATGAAGATATAATGGACGATCCCT TTAAAGGCTCAAACCTACCTCAGACA CTGCTCTACCCATCCCCATCCCCT |
| 7705 | db mining | Hs.313384 | AW297745 | 6704381 | UI-H-BW0-aiy-b-10-0-UI.s1 cDNA, 3' end/clone = IMAGE:2730954/ clone_end = 3' | 1 | CCCTTTGTGAGAAGAAGCAGGTTTCC TTTCCTATGGATTGATGTGACCCT |
| 7706 | db mining | Hs.105105 | AA419402 | 2079198 | zu99a12.s1 cDNA, 3' end/ clone = IMAGE:746110/clone_end = 3' | 1 | TTCTACCCATCACACAGATTCTTCCA CTTAATAAAATCCATCACCTACCT |
| 7707 | db mining | Hs.123180 | AA805419 | 2874169 | oc13g03.s1 cDNA, 3' end/ clone = IMAGE:1340788/clone_end = 3' | 1 | TCATTACTGTTGTGAAGGCTCTTCAA GAGAGAAAGATGAAGCTGAAACCT |
| 7708 | db mining | Hs.297396 | BF515183 | 11600450 | UI-H-BW1-ani-c-01-0-UI.s1 cDNA, 3' end/clone = IMAGE:30827728/ clone_end = 3' | 1 | GCTGTCCGTGAAAGCACTCTCAAGTC AGGAACTGAACTAAGAACTTTACT |
| 7709 | db mining | Hs.334992 | AI084211 | 3422634 | RST20881 cDNA | 1 | CTCCTGTAATCCCAGCACTGGAGCTT GCAGTGAGCCAAGATCATGCCACT |
| 7710 | db mining | Hs.313273 | AW295743 | 6702379 | UI-H-BW0-aiw-g-08-0-UI.s1 cDNA, 3' end/clone = IMAGE:2730830/ clone_end = 3' | 1 | TTGGTCACCACACCTGGGTGTCTGAA TGTCTTGTCCTTCTAAAGGTAACT |
| 7711 | db mining | Hs.319891 | BF507631 | 11590929 | UI-H-BW1-and-h-01-0-UI.s2 cDNA, 3' end/clone = IMAGE:3071856 clone_end = 3' | 1 | GCAACAATTCTTTGGAAAGTGACTCT CTAGGGTGCGGAGAATGGTGTGAT |
| 7712 | db mining | Hs.320422 | BF512614 | 11597793 | UI-H-BW1-amg-a-12-0-UI.s1 cDNA, 3' end/clone = IMAGE:3069822 clone_end = 3' | 1 | TCATCTCTGTAGGTCTTCCTAATCCTA TGCGGAGCCAAATATAGACGGAT |
| 7713 | db mining | Hs.319872 | BF507414 | 11590721 | UI-H-BW1-amz-a-11-0-UI.s2 cDNA, 3' end/clone = IMAGE:3071517/ clone_end = 3' | 1 | CTTTGTATTTCAAAGAAAGTAGCCCC TTGGCTCTGATATTAGTTGCAGAT |
| 7714 | db mining | Hs.264120 | AI523841 | 4437776 | 601435078F1 cDNA, 5' end/ clone = IMAGE:3921187/clone_end = 5' | 1 | TTAGGAGCTGACCATACATGATGAG TGATACAGCCTGTACTTTGCTCAT |
| 7715 | db mining | Hs.105284 | AA491263 | 2220436 | aa49d04.s1 cDNA, 3' end/ clone = IMAGE:824283/clone_end = 3' | 1 | ACTGGGATGAGATGAGATTCAAGGCA CTTTTGGAGGGTGTAGCTAGCCAT |
| 7716 | db mining | Hs.124376 | AA831043 | 2904142 | oc58h02.s1 cDNA, 3' end/ clone = IMAGE:1353939/clone_end = 3' | 1 | AGGCTGTTGCTGCACGGGCTTTTCAA AAGCGACTCATTATGAAGAAGAAT |
| 7717 | db mining | Hs.309144 | AI384035 | 4196816 | td05c02.x1 cDNA, 3' end/ clone = IMAGE:2074754/clone_end = 3' | 1 | GCACTCCAGCCTGGGCAACAAGAGC GAAACTCTGCCTCCAATAAATAAAT |
| 7718 | db mining | Hs.301325 | BF514004 | 11599183 | UI-H-BW1-amv-e-04-0-UI.s1 cDNA, 3' end/clone = IMAGE:3071311/ clone_end = 3' | 1 | CGGGCGGTGGCGGCTGCCTGGGAG AAGATGAATCTTTCATGAGTGATTTG |
| 7719 | db mining | Hs.319904 | BF507742 | 11591040 | UI-H-BW1-anc-f-02-0-UI.s2 cDNA, 3' end/clone = IMAGE:3072122/ clone_end = 3' | 1 | GATGGAACTCAAGGTGCTTTACGCTT TCCTCAGTCTTACCAGGAGGCTTG |
| 7720 | db mining | Hs.320092 | AI392740 | 4222287 | tg23f02.x1 cDNA, 3' end/ clone = IMAGE:2109267/clone_end = 3' | 1 | ACCAACCCTATGGACAACTTGATCTT GAACTTCTAGCTTTCAGACCTGTG |
| 7721 | db mining | Hs.313371 | AW297578 | 6704214 | UI-H-BW0-aig-b-03-UI.s1 cDNA, 3' end/clone = IMAGE:2731708/ clone_end = 3' | 1 | AATGTAGCTGACATTGGAGCCACCGC CCATAGAAGAAGGCTAAAACTGTG |
| 7722 | db mining | Hs.320444 | BF512784 | 11597963 | UI-H-BW1-amm-h-10-0-UI.s1 cDNA, 3' end/clone = IMAGE:3070698/ clone_end = 3' | 1 | CTTCACTGACGATCTGAGACACTAGG CAGGTTGGAAAGGGTGGAGTGGTG |
| 7723 | db mining | Hs.320473 | BF513155 | 11598334 | UI-H-BW1-amj-b-03-0-UI.s1 cDNA, 3' end/clone = IMAGE:3070013/ clone_end = 3' | 1 | GCCCCTGGTGGTTGGAAAAGTGTTCT GAATCCAATAAAAGGAAAGCGGTG |
| 7724 | db mining | Hs.320419 | BF512597 | 11597776 | UI-H-BW1-amf-h-05-0-UI.s1 cDNA, 3' end/clone = IMAGE:3089921/ clone_end = 3' | 1 | CAACAGTGGCAAGAGTAGCCAGCCC ATAGGACGGAATGAAAATCAAGGTG |
| 7725 | db mining | Hs.320365 | BF512157 | 11597260 | UI-H-BW1-ami-b-20-0-UI.s1 cDNA, 3' end/clone = IMAGE:3070026/ clone_end = 3' | 1 | CATCCTTAGATGCCAGTCTTCACTTT GGGTATTTTCCTGCCTCCTCAGTG |
| 7726 | db mining | Hs.299471 | BF513893 | 1599072 | UI-H-BW1-aq-d-02-0-UI.s1 cDNA, 3' end/clone = IMAGE:3070874/ clone_end = 3' | 1 | ACCAACAGTACCGTTATTGCCACCAC AAGTAAACCAGTCCCTCACTTCTG |
| 7727 | db mining | Hs.313368 | AW297544 | 6704180 | UI-H-BW0-aja-g-01-0-UI.s1 cDNA, 3' end/clone = IMAGE:2731200/ clone_end = 3' | 1 | AGGCTAAATCAGAGCTTTCCTCCCCA GATAAAGGAAATTTTCCCTCCCTG |
| 7728 | db mining | Hs.105170 | AA481410 | 2210962 | zv02g12.s1 cDNA, 3' end/ clone = IMAGE:746374/clone_end = 3' | 1 | AACTTCCAGAGGCAGGAGATTAGACA GGGATGACAGTTAAGGGGTTACTG |
| 7729 | db mining | Hs.313251 | AW295130 | 6701766 | UI-H-BW0-alt-h-08-0-UI.s1 cDNA, 3' | 1 | ACCTCTTCGTTGTATTTTACCTTTCAC |

TABLE 8-continued

| SEQ ID | Origin | Unigene | Locus | GI | Nominal Description | Strand | Probe Sequence |
|---|---|---|---|---|---|---|---|
| | | | | | end/clone = IMAGE:2730495/ clone_end = 3' | | TTACAAACAAGCTCATGCCACTG |
| 7730 | db mining | Hs.297392 | BF514201 | 11599380 | UI-H-BW1-ani-d-05-0-UI.s1 cDNA, 3' end/clone = IMAGE:3082401/ clone_end = 3' | 1 | GATCAAAACAAGGTCCTTGACTTTTT GCAGGGGCAGCCTGGCAATCAATG |
| 7731 | db mining | Hs.122417 | AA761212 | 2810142 | nz20c03.s1 cDNA, 3' end/ clone = IMAGE:1288324/clone_end = 3' | 1 | CCTAAATGTTGTCCCTCAGAGATGCA CAGATGTATATGGGTAAGGAAATG |
| 7732 | db mining | Hs.297469 | BF512785 | 11597964 | UI-H-BW1-amm-h-11-0-UI.s1 cDNA, 3' end/clone = IMAGE = 3070700/ clone_end = 3' | 1 | CCAACCATAGTCATGAAGCTGCTTCT GTTCCCAATGCAATCCCATTGTGG |
| 7733 | db mining | Hs.313275 | AW295750 | 6702386 | UI-H-BW0-aiw-h-03-0-UI.s1 cDNA, 3' end/clone = IMAGE:2730868/ clone_end = 3' | 1 | GCTTTTCAATGCTTCCGAAACTGAGT GCTAACAGGGGCAATTAGTGCTGG |
| 7734 | db mining | Hs.313173 | AW293031 | 6899667 | UI-H-BW0-aih-g-10-0-UI.s1 cDNA, 3' end/clone = IMAGE:2729299/ clone_end = 3' | 1 | AGTTCTTGTAACAGTTAAAACTTTCTT GCCAGCTCTCAGGTTATCACTGG |
| 7735 | db mining | Hs.320386 | BF512295 | 11597474 | UI-H-BW0-amb-e-03-0-UI.s1 cDNA, 3' end/clone = IMAGE:3069389/ clone_end = 3' | 1 | GTGTGTAAATGAGTGTCAGATCTTTT CTTGAAAACAGGTTTGGATTGGGG |
| 7736 | db mining | Hs.320429 | BF512664 | 11597843 | UI-H-BW1-amg-f-03-0-UI.s1 cDNA, 3' end/clone = IMAGE:3069844/ clone_end = 3' | 1 | AGGGTCCACAAGGAGAATATTTTCTT AAAGTAACTCCCTGATTTGCGGGG |
| 7737 | db mining | Hs.123352 | AA811133 | 2880744 | oa98b10.s1 cDNA, 3' end/ clone = IMAGE:1320283/clone_end = 3' | 1 | GCTCCCCTATGCCTGTGTAGCAGAAT CTAAAAGATAATCATGTGAACGGG |
| 7738 | db mining | Hs.320389 | BF512323 | 11597502 | UI-H-BW1-amb-g-09-0-UI.s1 cDNA, 3' end/clone = IMAGE:3069497/ clone_end = 3' | 1 | TTGTCTTGTTTCTTTTATCTCCCCTAT GTTTCATCTTAGTGCAGGCAGGG |
| 7739 | db mining | Hs.120563 | AA741118 | 2779708 | nz04f08.s1 cDNA, 3' end/ clone = IMAGE:1286823/clone_end = 3' | 1 | ACAGTTGCCTTTGAGATTCCTGTATTT CTGCATGAATAAATCCATAAGGG |
| 7740 | db mining | Hs.320373 | BF512098 | 11597310 | UI-H-BW1-ami-f-12-0-UI.s1 cDNA, 3' end/clone = IMAGE:3070222/ clone_end = 3' | 1 | GTCCTTGGAAGGTAACACTTGTGATT GGAACCACTCTTCAAGCTGAACGG |
| 7741 | db mining | Hs.320490 | BF513327 | 11598508 | UI-H-BW1-amk-a-07-0-UI.s1 cDNA, 3' end/clone = IMAGE:3069996 clone_end = 3' | 1 | ATTCATTCATTCATTCAACAAGCACTT AAAAACAATGCCTGTGTGCCAGG |
| 7742 | db mining | Hs.313290 | AW296074 | 6702710 | UI-H-BW0-aiu-h-07-0-UI.s1 cDNA, 3' end/clone = IMAGE:2730852/ clone_end = 3' | 1 | CACACCCAGCCCCATTCACAAAGGAC TATAAAATCTACACCCCAGTCACG |
| 7743 | db mining | Hs.320390 | BF512330 | 11597509 | UI-H-BW1-amb-h-05-0-UI.s1 cDNA, 3' end/clone = IMAGE:3069537/ clone_end = 3' | 1 | GGCATAGTAGTGCTAAACAGAGGTG GAAGTAGTGAAGGGAGTTTTGAACG |
| 7744 | db mining | Hs.297397 | BF507606 | 11590904 | UI-H-BW1-ana-e-02-0-UI.s2 cDNA, 3' end/clone = IMAGE:3071714/ clone_end = 3' | 1 | CTAGTCCTGCCCCCACCTCCCCAAGT ATTACCCCTCCTAAGTCCTGCTAG |
| 7745 | db mining | Hs.309256 | AI373161 | 4153027 | qz13a01.x1 cDNA, 3' end/ clone = IMAGE:2021352/clone_end = 3' | 1 | AGATAAGCAGGATAAACAAGACAGGT TGGATTGTGATCAGCTCTATGGAG |
| 7746 | db mining | Hs.343303 | BF13322 | 11598501 | UI-H-BW1-amk-a-02-0-UI.s1 cDNA, 3' end/clone = IMAGE:3069986/ clone_end = 3' | 1 | GATGGCTAGGACAAGATGATTTACAA GAGCGTGGCGGGAGGGACGGCGAG |
| 7747 | db mining | Hs.301870 | BF507614 | 11590912 | UI-H-BW1-ana-f-03-0-UI.s2 cDNA, 3' end/clone = IMAGE:3071764/ clone_end = 3' | 1 | CCGTGTCTGGAATTGTGTGTCTTACTT CTAAAGGTGCACATACTTCATAAG |
| 7748 | db mining | Hs.300479 | AW452510 | 6993286 | UI-H-BW1-ame-a-12-0-UI.s1 cDNA, 3' end/clone = IMAGE:3069598/ clone_end = 3' | 1 | GTATCTCTGCACCTCACTACTACCCT TCACTCCTTGGAGACCTGGGCAAG |
| 7749 | db mining | Hs.320387 | BF512301 | 11597480 | UI-H-BW1-amb-e-09-0-UI.s1 cDNA, 3' end/clone = IMAGE:3069401/ clone_end = 3' | 1 | AACACACCACCAAACATTCTTCCCAT CCTTCTTCACCAACCAGCTACAAG |
| 7750 | db mining | Hs.122854 | AA292626 | 1940611 | zs57h08.r1 cDNA, 5' end/ clone = IMAGE:701631/clone_end = 5' | 1 | ACAATTGGAGTTGGGGCTGTCACCAC CTGAAGTGTGTCAACCACAGAAAG |
| 7751 | db mining | Hs.300488 | AW453029 | 6993805 | UI-H-BW1-ama-c-10-0-UI.s1 cDNA, 3' end/clone = IMAGE:3069306/ clone_end = 3' | 1 | TTAGGGCAAAAGTCCTAGTGGCGGC AGCTTTCTTGTCTAGACCCTGGTTC |
| 7752 | db mining | Hs.335081 | AI380942 | 4190801 | tg18c08.x1 cDNA, 3' end/ clone = IMAGE:2109134/clone_end = 3' | 1 | AGTGATGCTTGCCTTTTCGCTTTCCT AAAGATGTCATTTGAAAACAAGTC |
| 7753 | db mining | Hs.313822 | AW452916 | 6993692 | UI-H-BW1-amd-b-02-0-UI.s1 cDNA, 3' end/clone = IMAGE:3069267/ clone_end = 3' | 1 | CCCAGCTTCATTAATGTGAATGGTGG CAGACACCTCTAGCTATAGAGCTC |
| 7754 | db mining | Hs.309486 | AI523959 | 4438094 | tg98f09.x1 cDNA, 3' end/ clone = IMAGE:2115841/clone_end = | 1 | GAGCCAAGATTGGGCCACTGCACTC CAGCCTGGGTGACAGAGTGAGACTC |

TABLE 8-continued

| SEQ ID | Origin | Unigene | Locus | GI | Nominal Description | Strand | Probe Sequence |
|---|---|---|---|---|---|---|---|
| 7755 | db mining | Hs.303926 | AI084223 | 3422646 | oy72g05.x1 cDNA, 3' end/clone = IMAGE:1571416/clone_end = 3' | 1 | GAGCCGAGATTGCATCACTGCACTCC AGCCTGGTCAACAGAGCGAGACTC |
| 7756 | db mining | Hs.313170 | AW292942 | 6699578 | UI-H-BW0-aig-f-11-0-UI.s1 cDNA, 3' end/clone = IMAGE:2729252/clone_end = 3' | 1 | TTCAGTCATGCAGCAACATCCGCTTA ATGCCTCCTAAGTGCAGAACACTC |
| 7757 | db mining | Hs.313795 | AW452553 | 6993329 | UI-H-BW1-ame-e-11-0-UI.s1 cDNA, 3' end/clone = IMAGE:3069788/clone_end = 3' | 1 | GGTCCTCTTCTCTCTACTCTCCCTAG TAACTAACCACCAAAGCCTAAATC |
| 7758 | db mining | Hs.319883 | BF507567 | 11590865 | UI-H-BW1-amr-h-08-0-UI.s1 cDNA, 3' end/clone = IMAGE:3071079/clone_end = 3' | 1 | TTGTTTGTTTGTTTATTTATTTATTTG AGGCAGCGTCTTGCTCTGTTGC |
| 7759 | db mining | Hs.320476 | BF513187 | 11598365 | UI-H-BW1-amj-e-02-0-UI.s1 cDNA, 3' end/clone = IMAGE:3070155/clone_end = 3' | 1 | TGCCATCTTTACATCTAATCAAGAGG TAGAGCTTCCCCTGGTGTTCCTGC |
| 7760 | db mining | Hs.313828 | AW453000 | 6993776 | UI-H-BW1-ama-a-05-0-UI.s1 cDNA, 3' end/clone = IMAGE:3069200/clone_end = 3' | 1 | TGCTCTGCTCTTCCCAAATCAAGGAA TGTAGATCTTGCTAACAGAACTGC |
| 7761 | db mining | Hs.120251 | AA731388 | 2753542 | nz86f07.s1 cDNA, 3' end/clone = IMAGE:1302373/clone_end = 3' | 1 | TGGCACCAACTTACACTTCCAGAAGA GAGTGGTTCAGGAAATTACTATGC |
| 7762 | db mining | Hs.313392 | AW297908 | 6704544 | UI-H-BW0-ajn-a-04-0-UI.s1 cDNA, 3' end/clone = IMAGE:2732071/clone_end = 3' | 1 | AACTTTGGGAAGTGAGACTCTGTCTT GGGTTTTTGATAATAAATGTGGGC |
| 7763 | db mining | Hs.343320 | BF512697 | 11597876 | UI-H-BW1-amm-a-02-0-UI.s1 cDNA, 3' end/clone = IMAGE:3070348/clone_end = 3' | 1 | CCGAGAAAGTACGGCTGGAGCGGAC TGGGGAGACGGAAATATTGAGTCGC |
| 7764 | db mining | Hs.304178 | AI540182 | 4457555 | td10f04.x1 cDNA, 3' end/clone = IMAGE:2075263/clone_end = 3' | 1 | CGAAGAAAGAATTGGATGCAGAATTG TTGCCTAACCTGGGTGACAAGAGC |
| 7765 | db mining | Hs.320425 | BF512629 | 11597808 | UI-H-BW1-amg-c-03-0-UI.s1 cDNA, 3' end/clone = IMAGE:3069700/clone_end = 3' | 1 | AGTGCCTGTGATTCCACCCCCTTACC TCCCACTCAAGTGACAATGTAAGC |
| 7766 | db mining | Hs.313236 | AW294711 | 6701347 | UI-H-BW0-aim-b-12-0-UI.s1 cDNA, 3' end/clone = IMAGE:2729806/clone_end = 3' | 1 | AGAAAGTTAGGAGTCGGCAACCTTAA GGAGGAGTTTCCTATCATCTCTCC |
| 7767 | db mining | Hs.313379 | AW297666 | 6704302 | UI-H-BW0-ajh-c-02-0-UI.s1 cDNA, 3' end/clone = IMAGE:2731755/clone_end = 3' | 1 | TGTCACAAAGATGAAGCAAGGTGGCT CAGGGAACGTGCTCAGAAACCTCC |
| 7768 | db mining | Hs.123341 | AA810927 | 2880538 | oa77d07.s1 cDNA, 3' end/clone = IMAGE:1318285/clone_end = 3' | 1 | GCAAAGTGAAAGTTTTCCCTTTGGCC CTAAAATATGAAAGCAAAGCATCC |
| 7769 | db mining | Hs.313208 | AW293991 | 6700627 | UI-H-BW0-aik-h-08-0-UI.s1 cDNA, 3' end/clone = IMAGE:2729726/clone_end = 3' | 1 | CCCTGTCCATCTTTTCCTGTTCCTATC CAGCCTTCCCTCTCCTTTTTGCC |
| 7770 | db mining | Hs.123344 | AA811024 | 2880635 | ca82g05.s1 cDNA, 3' end/clone = IMAGE:1318808/clone_end = 3' | 1 | CCACGGAGGGCTCCCCATCTAAAGG GAGTTTAATAAACAAAGGAATGGCC |
| 7771 | db mining | Hs.320450 | BF512839 | 11598018 | UI-H-BW1-amu-e-10-0-UI.s1 cDNA, 3' end/clone = IMAGE:3071322/clone_end = 3' | 1 | CAATTGGTACATTCTCGGCAAACCCT TGCCCACAATTTCCTCAGGAAGCC |
| 7772 | db mining | Hs.313359 | AW297549 | 6704185 | UI-H-BW0-aja-g-08-0-UI.s1 cDNA, 3' end/clone = IMAGE:2731214/clone_end = 3' | 1 | AGGGTGTCCCTGTGATTTTAAATTC ACTATCTAGCTGTCCCTATCCCCC |
| 7773 | db mining | Hs.297527 | BF515924 | 11501103 | UI-H-BW1-aoa-e-01-0-UI.s1 cDNA, 3' end/clone = IMAGE:3084001/clone_end = 3' | 1 | CTTATATTATGTTTTCTCTGTGACAAG CACCTCACCTCCCAACCCACCCC |
| 7774 | db mining | Hs.297513 | BF515498 | 11600677 | UI-H-BW1-ann-g-04-0-UI.s1 cDNA, 3' end/clone = IMAGE:3082950/clone_end = 3' | 1 | GAGAATTCAAATTAAATGCAGAGTCC TAGGCCCACCCTGGCATACCACCC |
| 7775 | db mining | Hs.105218 | AA488881 | 2218483 | aa55f06.s1 cDNA, 3' end/clone = IMAGE:824867/clone_end = 3' | 1 | ACAACCAATGCCTCACACTTAAGCTC CTAGAAGTCACTAGGGACCAGACC |
| 7776 | db mining | Hs.309447 | AI492062 | 4393085 | tg12a11.x1 cDNA, 3' end/clone = IMAGE:2108540/clone_end = 3' | 1 | GCCCTCACCAGAATTCAATCATGCTG GCACCTTATCTTGGACTTTCAACC |
| 7777 | db mining | Hs.309483 | AI523758 | 4437893 | tg94e10.x1 cDNA, 3' end/clone = IMAGE:2116458/clone_end = 3' | 1 | AGGGTAAGAGTTCCAGACCTGACTG GACAATAAAGTGAGACTGTCTCTAC |
| 7778 | db mining | Hs.343333 | BF515310 | 11600412 | UI-H-BW1-ank-g-09-0-UI.s1 cDNA, 3' end/clone = IMAGE:3082577/clone_end = 3' | 1 | CTCCGTCTGCCGCCTCCGTAGCCAC AGCGACTTTGGAAGTGATATTTGAC |
| 7779 | db mining | Hs.309687 | AI401187 | 4244274 | tg26h10.x1 cDNA, 3' end/clone = IMAGE:2109955/clone_end = 3' | 1 | CCCTGGAGAAGGAGGGTGATTATTT TCAACTTTCTGATTTACCACCGAC |

TABLE 8-continued

| SEQ ID | Origin | Unigene | Locus | GI | Nominal Description | Strand | Probe Sequence |
|---|---|---|---|---|---|---|---|
| 7780 | db mining | Hs.314730 | AI523958 | 4438093 | tg98f08.x1 cDNA, 3' end/ clone = IMAGE:2116839/clone_end = 3' | 1 | GATTGTTTGAGCCTGGGAGTTCCACA CCAGCCTGGGCTACATAGGGAGAC |
| 7781 | db mining | Hs.313337 | AW297006 | 6703842 | UI-H-BW0-ajf-c-09-0-UI.s1 cDNA, 3' end/clone = IMAGE:2731409/ clone_end = 3' | 1 | CTGCTCTAGACTGAGCACAGCCACTG ACAGGTGACCTTCAGAATCCTCAC |
| 7782 | db mining | Hs.116455 | AA649141 | 2575570 | ns32g12.s1 cDNA, 3' end/ clone = IMAGE:1185382/clone_end = 3' | 1 | ACCCCTGCTTACTGTGACAGACATA TAGTTTGTCATACATAAAACCCAC |
| 7783 | db mining | Hs.123313 | AA810089 | 2879495 | od12f12.s1 cDNA, 3' end/ clone = IMAGE:1367758/clone_end = 3' | 1 | ACCTAACAGAAATTTGGATTCGGGTT GTCTAAATACACCCTGGTGGGTTA |
| 7784 | db mining | Hs.319668 | BF507353 | 11590660 | UI-H-BW1-amx-c-04-0-UI.s1 cDNA, 3' end/clone = IMAGE:3071239/ clone_end = 3' | 1 | GCCTTTCCCACCAACAGTTTATGTGA TTCCCTGCCCTACCCTTACCATTA |
| 7785 | db mining | Hs.123342 | AA811005 | 2880618 | oa73g11.s1 cDNA, 3' end/ clone = IMAGE:1317956/clone_end = 3' | 1 | TCCCATTGCATGTCCCGTATATTGAA AGCTGCCTCTACTTCTCTCTGGTA |
| 7786 | db mining | Hs.313288 | AW296061 | 6702697 | UI-H-BW0-aiu-g-06-0-UI.s1 cDNA, 3' end/clone = IMAGE:2730802/ clone_end = 3' | 1 | GGCAGGGGATGAACCA- GATAATTTTCC AGCCCTTCTTGGTAGCTCTTCGTA |
| 7787 | db mining | Hs.308998 | AI358553 | 4108174 | qz27h12.x1 cDNA, 3+ end/ clone = IMAGE:2028167/clone_end = 3' | 1 | GCTTAGGAGTTTGGGACCAGCCTGG GTAACATAGTGAAACCCTGTCTCTA |
| 7788 | db mining | Hs.313328 | AW296796 | 6703432 | UI-H-BW0-ajb-e-06-0-UI.s1 cDNA, 3' end/clone = IMAGE:2731115/ clone_end = 3' | 1 | TTGCAGCTATTTTCAAGTTGTAAGAAA TGAACTTGCAACACATAGGGCTA |
| 7789 | db mining | Hs.320462 | BF512988 | 11598185 | UI-H-BW1-amh-c-06-0-UI.s1 cDNA, 3' end/clone = IMAGE:3069707/ clone_end = 3' | 1 | TCTCTTGCCACAGGGATTTCCTCCAA GCTGGAATCACCATTTCCTTCCTA |
| 7790 | db mining | Hs.297514 | BF516300 | 11601479 | UI-H-BW1-anz-e-06-0-UI.s1 cDNA, 3' end/clone = IMAGE:3084010/ clone_end = 3' | 1 | CCCACCCACCAGTAGGTTGTGATTCA ACTGAACCATTTCAGGAGCACCTA |
| 7791 | db mining | Hs.124358 | AA803650 | 2903749 | oc52g02.s1 cDNA, 3' end/ clone = IMAGE:135362/clone_end = 3' | 1 | GAACCCAGCTAAGCCACACCCAGATT CTGACCCAGGGATACTCTGAAATA |
| 7792 | db mining | Hs.313345 | AW297163 | 6703789 | UI-H-BW0-ajd-a-04-0-UI.s1 cDNA, 3' end/clone = IMAGE:2731279/ clone_end = 3' | 1 | GTGTGTGCTGGCGTGCCTTATAGGT GTGCGTGTTTCCCTGTCAGTTTTGA |
| 7793 | db mining | Hs.320484 | BF513248 | 11598425 | UI-H-BW1-amo-b-06-0-UI.s1 cDNA, 3' end/clone = IMAGE:3070426/ clone_end = 3' | 1 | AGGAAAACTCAGAAATAATTTCTGCC CCCTGGATTCTCTAAGATTTGTGA |
| 7794 | db mining | Hs.105130 | AA482030 | 2209708 | zu98g04.s1 cDNA, 3' end/ clone = IMAGE:746070/clone_end = 3' | 1 | GTGGAAAGAATCCTACAACGAACACT ATTAAAGTCTGCACCTAGATCGA |
| 7795 | db mining | Hs.104176 | AA214530 | 1813155 | zr92a06.s1 cDNA, 3' end/ clone = IMAGE:683122/clone_end = 3' | 1 | GGCCTAGGTTCCAGCATTCAGTCATC AAGTCTTGTTACAGAAATAAATGA |
| 7796 | db mining | Hs.121118 | AA721101 | 2737236 | nz67a0.s1 cDNA, 3 end/ clone = IMAGE:1300488/clone_end = 3' | 1 | CCCCATTTGGAGTCTAGTCAAAACAG CAGCTTCTTTGAGTTACCATTGGA |
| 7797 | db mining | Hs.313313 | AW296455 | 6703091 | UI-H-BW0-aiq-c-05-0-UI.s1 cDNA, 3' end/clone = IMAGE:2730224/ clone_end = 3' | 1 | AAGGCTTGTAACTGTAGGCCCTTGTA CTACACTGTGCTATACCTGGTAGA |
| 7798 | db mining | Hs.335116 | AI524072 | 4438207 | th01d07.x1 cDNA, 3' end/ clone = IMAGE:2117005/clone_end = 3' | 1 | CACTTTGGGAGGCAGAGGTGAGCAG ATCACTTGAGGCCAGGAGTTTGAGA |
| 7799 | db mining | Hs.309130 | AI382229 | 4195010 | td04d04.x1 cDNA, 3' end/ clone = IMAGE:2074663/clone_end = 3' | 1 | GGATCACTTGAAGCCAGCAGTTTGAG ACCAGCCTGGGCAATAAAATGAGA |
| 7800 | db mining | Hs.297504 | BF514819 | 11599998 | UI-H-BW1-anj-b-10-0-UI.s1 cDNA, 3' end/clone = IMAGE:3082338/ clone_end = 3' | 1 | TCAGTTGTGATGGGATTTCTTGATGG ATGAGATGTGTCGTGTGACAGAGA |
| 7801 | db mining | Hs.297473 | BF513074 | 11598253 | UI-H-BW1-amn-c-03-0-UI.s1 cDNA, 3' end/clone = IMAGE:3070445/ clone_end = 3' | 1 | CCTCCTAGAACTGGAACCAAGACTGC TCCATCAGAGTTAAAGGTGTAAGA |
| 7802 | db mining | Hs.313168 | AW292924 | 6699560 | UI-H-BW0-aig-d-05-0-UI.s1 cDNA, 3' end/clone = IMAGE:2729144/ clone_end = 3' | 1 | GCTCACCCTTGCACCTCCTTCCCAAA TCTGCTGTCACATTTTCTCAAAGA |
| 7803 | db mining | Hs.319885 | BF507583 | 11590881 | UI-H-BW1-ana-b-03-0-UI.s2 cDNA, 3' end/clone = IMAGE:3071572/ clone_end = 3' | 1 | TTCCTGTCTCCATGTTGTGGTCAAGA TTGCCATTTGCTTCCTGAGTTTCA |
| 7804 | db mining | Hs.320411 | BF512514 | 11597693 | UI-H-BW1-amc-h-10-0-UI.s1 cDNA, 3' end/clone = IMAGE:3069570/ clone_end = 3' | 1 | CTGGTTCTAGTGCAGTCTCCTCACTT TCCTGGTGTTTGGTTTATCTTTTCA |

TABLE 8-continued

| SEQ ID | Origin | Unigene | Locus | GI | Nominal Description | Strand | Probe Sequence |
|---|---|---|---|---|---|---|---|
| 7805 | db mining | Hs.116501 | AA651832 | 2583484 | ns40b05.s1 cDNA, 3' end/clone-IMAGE:1188065/clone_end = 3' | 1 | TGACATGATTACCTGACTGATGTTTC TCCTCCATTAGACTGAATGCTTCA |
| 7806 | db mining | Hs.320438 | BF512719 | 11597898 | UI-H-BW1-amm-c-01-0-UI.s1 cDNA, 3' end/clone = IMAGE:3070440/clone_end = 3' | 1 | TGGCAAAAAGCCTAACACTGACTCAT CCCATTCTATCAGCACAAACTTCA |
| 7807 | db mining | Hs.319888 | BF507612 | 11590910 | UI-H-BW1-ana-e-12-0-UI.s2 cDNA, 3' end/clone = IMAGE:3071734/clone_end = 3' | 1 | GTTTACAAGGGATACTAGTTCCTGGA GGGACGAAGGAGGCTCTGTTTGCA |
| 7808 | db mining | Hs.250726 | AW298545 | 6705181 | UI-H-BW0-ajm-g-01-0-UI.s1 cDNA, 3' end/clone = IMAGE:2732352/clone_end = 3' | 1 | TCCTCAACTCGGAGATTCCTGTATGG AGAGAATCAATTTCATATATTTGCA |
| 7809 | db mining | Hs.120738 | AA749236 | 2789194 | nx99c09.s1 cDNA, 3' end/clone = IMAGE:1270384/clone_end = 3' | 1 | ACATTTCTTAGGTGTGTGTAGTGG TGAAGGAAAATAGTGGAAGATGTC TGCA |
| 7810 | db mining | Hs.320404 | BF512350 | 11597616 | UI-H-BW1-amc-b-01-0-UI.s1 cDNA, 3' end/clone = IMAGE:3069264/clone_end = 3' | 1 | TCAGGAGGCTTGAAAAGACTCAAGGT TTCTACACTATGGGAAATAAGGCA |
| 7811 | db mining | Hs.319880 | BF507510 | 11590808 | UI-H-BW1-amr-c-04-0-UI.s1 cDNA, 3' end/clone = IMAGE:3070831/clone_end = 3' | 1 | GTTTTCACTTGTCATACTAACTATTGT TTTTCTCCCCCATGCCAAGAGCA |
| 7812 | db mining | Hs.320371 | BF512091 | 11597303 | UI-H-BW1-ami-f-05-0-UI.s1 cDNA, 3' end/clone = IMAGE:3070208/clone_end = 3' | 1 | AGCCAAGGGAGCATATTATTCTCTTA TTTTAAACCTCTCCGTAGGCAGCA |
| 7813 | db mining | Hs.307837 | AI052783 | 3308774 | oy78h09.x1 cDNA, e' end/clone = IMAGE:1872001/clone_end = 3' | 1 | AGAAGGACCCCTGGTTGAGAACCAC GGTTGTATAGAAAGGAATTGAAGCA |
| 7814 | db mining | Hs.124383 | AA831706 | 2904805 | oc85b04.s1 cDNA, 3' end/clone = IMAGE:1356463/clone_end = 3' | 1 | TTGACTGCCATAGCCAAGAGTTAATA TAGTTGCGTTTTCTTAAGGAAGCA |
| 7815 | db mining | Hs.123304 | AA809672 | 2879078 | nz99b08.s1 cDNA, 3' end/clone = IMAGE:1303575/clone_end = 3' | 1 | CTTACTGTGTCTTTAGGTTTTGT TGCTTTCTGTCTGTATGCTATGT TCCA |
| 7816 | db mining | Hs.123368 | AA811539 | 2881150 | ob45d08.s1 cDNA, 3' end/clone = IMAGE:1334319/clone_end = 3' | 1 | TGCAGTTAGGAGTGTGGACACTCTGC CCATCTCCATTGAATTAAATTCCA |
| 7817 | db mining | Hs.313178 | AW293164 | 6699800 | UI-H-BW0-aii-c-01-0-UI.s1 cDNA, 3' end/clone = IMAGE:2729448/clone_end = 3' | 1 | ACTTGGGTTCTATCCCCACGATAACT TGTTATGTATATGCCAATATCCCA |
| 7818 | db mining | Hs.313171 | AW292976 | 8699812 | UI-H-BW0-aih-b-08-0-UI.s1 cDNA, 3' end/clone:IMAGE:2729055 clone_end = 3' | 1 | AGCTAGAAAATGTCCCTTTTCTTCTT TGGAGGTCTTTAACCAAGGCCCA |
| 7819 | db mining | Hs.343308 | BF508886 | 11592184 | UI-H-B14-aos-a-03-0-UI.s1 cDNA, 3' end/clone = IMAGE:3085732/clone_end = 3' | 1 | ATCACCAATCTTATTAGCACTGTGG ATGCCGTTTTGCAAATGTCACCCA |
| 7820 | db mining | Hs.320468 | BF513104 | 11598283 | UI-H-BW1-amn-e-10-0-UI.s1 cDNA, 3' end/clone = IMAGE:3070555/clone_end = 3' | 1 | TGACTTAAGGTTGGAATATCTCCTAC TACTCCCCTGTCCTCCTTGGACCA |
| 7821 | db mining | Hs.120585 | AA743221 | 2782727 | ny21c06.s1 cDNA, 3' end/clone = IMAGE:1272394/clone_end = 3' | 1 | TGTGGTTTGCAATGGTTACTGATGA GACAGCAAAAATGAGACAGGACCA |
| 7822 | db mining | Hs.297468 | BF513126 | 11598305 | UI-H-BW1-amn-g-09-0-UI.s1 cDNA, 3' end/clone = IMAGE:3070649/clone_end = 3' | 1 | TGGCGAGCCAGTCTCTGGATGGGAT TCTGATCAACAGAAGTTCTCATACA |
| 7823 | db mining | Hs.313205 | AW293932 | 67000568 | UI-H-BW0-aik-b-02-0-UI.s1 cDNA, 3' end/clone = IMAGE:2729426/clone_end = 3' | 1 | TGCCCATCCTTTGCTGTTTTCTCTTT CAGTCATGGCCTATTTGGAGACA |
| 7824 | db mining | Hs.343329 | BF515646 | 11500825 | UI-H-BW1-anu-d-06-0-UI.s1 cDNA, 3' end/clone = IMAGE:3083555/clone_end = 3' | 1 | CTCAACCTTGGCCCTAAACTAACAGT GACAGGGAGTTCCCCAGCCTCAC |
| 7825 | db mining | Hs.319906 | BF507755 | 11591053 | UI-H-BW1-anc-g-07-UI.s2 cDNA, 3' end/clone = IMAGE:3072180/clone_end = 3' | 1 | TCCTGACCGTTGACAGAGAGCTTTA CAGAAGTCTTAGGCAGTACACACA |
| 7826 | db mining | Hs.320465 | BF513053 | 11598232 | UI-H-BW1-amn-a-05-0-UI.s1 cDNA, 3' end/clone = IMAGE:3070355/clone_end = 3' | 1 | AGTGTGTGGCACCCAGGATCACTG TATGAGAATTTTCCTGAACAACAACA |
| 7827 | db mining | Hs.320430 | BF512667 | 11597846 | UI-H-BW1-amg-f-08-0-UI.s1 cDNA, 3' end/clone = IMAGE:3069850/clone_end = 3' | 1 | GCTGTAAGTCCCTTCCTTACTCATCT TCCCTCTCAAATACAACAACAACA |
| 7828 | db mining | Hs.120718 | AA748539 | 2788497 | ny05h12.s1 cDNA, 3' end/3' end/clone = IMAGE:1270919/clone_end = 3' | 1 | GCCAGTTGGCACCATTTATGAAACAC ACCACCTTGTAACCACTGAATTAA |
| 7829 | db mining | Hs.320472 | BF513154 | 11598333 | UI-H-BW1-amj-b-02-0-UI.s1 cDNA, 3' end/clone = IMAGE:3070011/clone_end = 3' | 1 | TCAACCTAGCACAGTGCCTGGCTGAT AGGTGTTGAATATTTCCACTCTAA |

TABLE 8-continued

| SEQ ID | Origin | Unigene | Locus | GI | Nominal Description | Strand | Probe Sequence |
|---|---|---|---|---|---|---|---|
| 7830 | db mining | Hs.319899 | BF507695 | 11590993 | UI-H-BW1-anb-h-05-0-UI.s2 cDNA, 3' end/clone = IMAGE:3071885/ clone_end = 3' | 1 | GCAACCCTCTGCCCCTGCAAAGAGAT ATTGTGACAAAGATATTCACTGAA |
| 7831 | db mining | Hs.124932 | AA825273 | 2898575 | oc67a02.s1 cDNA, 3' end/ clone = IMAGE:1354730/clone_end = 3' | 1 | TAACATTCCTGGCACAGTCCCTGGCA TAGGGTAGATAATAAATGGTGGAA |
| 7832 | db mining | Hs.313354 | AW297308 | 6703944 | UI-H-BW0-aji-h-03-0-UI.s1 cDNA, 3' end/clone = IMAGE:2732020/ clone_end = 3' | 1 | TCTCTAACCATCAAGGAAGGTCAAGG GCCATGTATCTCTTTTAGGGAGAA |
| 7833 | db mining | Hs.127178 | AA938725 | 3096753 | oc10g07.s1 cDNA, 3' end/ clone = IMAGE:1340508/clone_end = 3' | 1 | TTCCACAAACTCAGGTGTGCAAGAAA CAATGCATTACTTTATTTTCAGAA |
| 7834 | db mining | Hs.320445 | BF512786 | 11597965 | UI-H-BW1-amm-h-12-0-UI.s1 cDNA, 3' end/clone = IMAGE:3070702/ clone_end = 3' | 1 | CAGGAGTTTGAGACCAGCCTGGGCA ACATAGTAAGTCTCCATCTCTTCAA |
| 7835 | db mining | Hs.319902 | BF507708 | 11591006 | UI-H-BW1-and-b-02-UI.s2 cDNA, 3' end/clone = IMAGE:3071930/ clone_end = 3' | 1 | TCCCTAGTCCTGGAGACTCGGGAACT AAAACAATCAATTCCCCTGAGCAA |
| 7836 | db mining | Hs.104348 | AA251338 | 1886301 | zs08a06.s1 cDNA, 3' end/ clone = IMAGE:684562/clone_end = 3' | 1 | TCCTCTTCATTGGAGACCCCTCCCTG TCACAGCACAATGTGGGTAATAAA |
| 7837 | db mining | Hs.320442 | BF512761 | 11597940 | UI-H-BW1-amm-f-08-0-UI.s1 cDNA, 3' end/clone = IMAGE:3070598/ clone_end = 3' | 1 | CAGAACAAGGCCCACAGTGTGAAAG GTGCTGCTGAACAAAGATAAATAAA |
| 7838 | db mining | Hs.320470 | BF513152 | 11598331 | UI-H-BW1-amj-a-12-0-UI.s1 cDNA, 3' end/clone = IMAGE:3069983/ clone_end = 3' | 1 | GAGTCAGCAACAGTGGTCCTCTTGCC TTGGTTGATGCTTTTGAACTGAAA |
| 7839 | db mining | Hs.300359 | BF516423 | 11601602 | UI-H-BW1-aob-h-05-0-UI.s1 cDNA, 3' end/clone = IMAGE:3084512/ clone_end = 3' | 1 | TAAGGATGTATCCCTATGGGCAGGAA ACCCAATTCTAAGAAACTTACAAA |
| 7840 | db mining | Hs.309152 | AI392970 | 4222517 | tg22d05.s1 cDNA, 3' end/ clone = IMAGE:2109513/clone_end = 3' | 1 | GCCACTGCACTCCAGCCTGGGCAAC AGAGCGAGACCTTGACTCTTTAAAA |
| 7841 | db mining | Hs.122448 | AA761767 | 2810697 | nz31e08.s1 cDNA, 3' end/ clone = IMAGE:1289414/clone_end = 3' | 1 | CACAACACCCAAAAGGCTGCATTGCA TAACATGTATTTGTTGAATGAAAA |
| 7842 | db mining | Hs.319874 | BF507452 | 11590750 | UI-H-BW1-amz-e-06-0-UI.s2 cDNA, 3' end/clone = IMAGE:3071699/ clone_end = 3' | 1 | GGGGTCCTTGCTCACAGAGCTCCCA AGATGGTGGTGGGCCACTTCCAAAA |
| 7843 | db mining | Hs.104177 | AA214542 | 1813167 | zr92b09.s1 cDNA, 3' end/ clone = IMAGE:683129/clone_end = 3' | 1 | TCCCTCTATAGGTAAAAGACCTGTTT GTCTGAAATGTGTGGAACCTGTCT |
| 7844 | db mining | Hs.104182 | AA521405 | 2261948 | aa68c0.s1 cDNA, 3' end/ clone = IMAGE:826090/clone_end = 3' | 1 | GCTGCCGTGTCTTTTGGCATTTTCAG CATGACTATATGTTTTTGTAATGT |
| 7845 | db mining | Hs.255522 | AW296182 | 6702818 | UI-H-B12-aia-c-01-0-UI.s1 cDNA, 3' end/clone = IMAGE:2728680/ clone_end = 3' | 1 | CCGAAGGCCCGTGTGGCGCTTCTCC TATTCTGTAGAGTGGTAGTTTGTTT |
| 7846 | db mining | Hs.124926 | AA765668 | 2816906 | ca04f02.s1 cDNA, 3' end/ clone = IMAGE:1303995/clone_end = 3' | 1 | AAAGAGGTAAACGCAAGTTCTCTCTT GTAGGTCGGGCTACAGGTGACTTT |
| 7847 | db mining | Hs.320388 | BF512314 | 11597493 | UI-H-BW1-amb-f-11-0-UI.s1 cDNA, 3' end/clone = IMAGE:3069453/ clone_end = 3' | 1 | TGGTTCTCAGCCTGGGTGAACAGAG AAGGGGTCTAATTTGGTCTTTTGTT |
| 7848 | db mining | Hs.123161 | AA807319 | 2876895 | oc38b01.s1 cDNA, 3' end/ clone = IMAGE:1351945/clone_end = 3' | 1 | TGTTCTTGGCACCCTGCACTGTCAGG CTATATCATTTCTGTTTGTTTCTT |
| 7849 | db mining | Hs.120608 | AA743877 | 2783228 | ny25b04.s1 cDNA, 3' end/ clone = IMAGE:1272751/clone_end = 3' | 1 | TCTCATTTTCTTTTCCTAGCTGTGATG CAAAGTGTCAGTGGTCCCATCTT |
| 7850 | db mining | Hs.120554 | AA741010 | 2779602 | ny99a10.s1 cDNA, 3' end/ clone = IMAGE:1286394/clone_end = 3' | 1 | TGTCCAACCTTCCTTTTGCTACAAAC AAAGAATGCCTAGGGATTCAACTT |
| 7851 | db mining | Hs.330148 | BE676227 | 10036768 | xm80f05.x1 cDNA, 3' end/ clone = IMAGE:2690529/clone_end = 3' | 1 | CAAGTGGCCTTGGTGTTTAAATCTTG CCCTAAATTGTAACTCACATGATT |
| 7852 | db mining | Hs.120259 | AA731522 | 2753678 | nw59h09.s1 cDNA, 3' end/ clone = IMAGE:1250945/clone_end = 3' | 1 | ACCAACCAGTGGTGTGCTGGAGCTG TCTCATACTATCTTGAGAGTCCATT |
| 7853 | db mining | Hs.124333 | AA829233 | 2902332 | od05a10.s1 cDNA, 3' end/ clone = IMAGE:1358298/clone_end = 3' | 1 | AGCACTTGCTTTGTTCCAGACATTGT CCTTAGCTCCTTTCTTGTGTAATT |
| 7854 | db mining | Hs.124281 | AA825840 | 2899152 | od59d02.s1 cDNA, 3' end/ clone = IMAGE:132227/clone_end = 3' | 1 | TGCAGCAAAAATTGAATTTCATAGGC CATTCAGTGTTCTCTGCGATAATT |
| 7855 | db mining | Hs.120716 | AA748500 | 2788458 | ny01h10.s1 cDNA, 3' end/ | 1 | CCAGGAATGGAAATACGCCAACCCA |

TABLE 8-continued

| SEQ ID | Origin | Unigene | Locus | GI | Nominal Description | Strand | Probe Sequence |
|---|---|---|---|---|---|---|---|
| | | | | | clone = IMAGE:1270531/clone_end = 3' | | GGTTAGGCACCTCTATTGCAGAATT |
| 7856 | db mining | Hs.320428 | BF512663 | 11597842 | UI-H-BW1-amg-f-02-0-UI.s1 cDNA, 3' end/clone = IMAGE:3089642/ clone_end = 3' | 1 | AGGAAATTGGTTGAAGTCGTTTTCT CTTGTTAGTCTCATGTTAAGCTGT |
| 7857 | db mining | Hs.123593 | AA814828 | 2884424 | ob73d07.s1 cDNA, 3' end/ clone = IMAGE:1337005/clone_end = 3' | 1 | TCGCCTGGGGAGATTTAAAATCTAA GTCGCTGGAAGTCCCTTTGTATGT |
| 7858 | db mining | Hs.120214 | AA730985 | 2752189 | nw67a04.s1 cDNA, 3' end/ clone = IMAGE:1251630/clone_end = 3' | 1 | ACCTGTAGGAAGGGTTTGTGAATATT CTGTTGCTCTGAATTATTAGCGGT |
| 7859 | db mining | Hs.123365 | AA811469 | 2881080 | ob83c11.s1 cDNA, 3' end/ clone = IMAGE:1337972/clone_end = 3' | 1 | TGAGAGGATCTTGAGACATTCTTGTG TTATTTGCCCTCTATGTTTTAGGT |
| 7860 | db mining | Hs.127156 | AA938155 | 3096266 | oc10a09.s1 cDNA, 3' end/ clone = IMAGE:130440/clone_end = 3' | 1 | TCCCAAGCATGAGACAAGTACCACCA GTGGTTCAGGAGATGATTTTAGGT |
| 7861 | db mining | Hs.320488 | BF513278 | 11598455 | UI-H-BW1-amo-e-01-0-UI.s1 cDNA, 3' end/clone = IMAGE:3070560/ clone_end = 3' | 1 | ACAAGACAGCAGCCTTCCCGAAATGT CACTACTAAGAATTATTCAGAGGT |
| 7862 | db mining | Hs.343330 | BF514718 | 11599897 | UI-H-BW1 = ans-a-12-0-UI.s1 cDNA, 3' end/clone = IMAGE:3083063/ clone_end = 3' | 1 | GCTGCCCAAACTTCCATTTATTTACC CTCCAAACATCACTTCCTTCCTCT |
| 7863 | db mining | Hs.123584 | AA814349 | 2883945 | nz06h06.s1 cDNA, 3' end/ clone = IMAGE:1287035/clone_end = 3' | 1 | ACATTTGCCAATGCACTTGATGTAAA GTTGTTGAGGATGTTGACTCTCCT |
| 7864 | db mining | Hs.123376 | AA811751 | 2881362 | nb80e12.s1 cDNA, 3' end/ clone = IMAGE:1337710/clone_end = 3' | 1 | TCCCCCTTCCTAACACCAATTTGGGA ACATCACTACTTGTATATTATCCT |
| 7865 | db mining | Hs.122860 | AA766374 | 2817612 | oa36b03.s1 cDNA, 3' end/ clone = IMAGE:1307021/clone_end = 3' | 1 | TCAAGACCCTTAGAGTAAGTTAACTC CCAAGGAAATGTAGTTAGTTCCCT |
| 7866 | db mining | Hs.105268 | AA490812 | 2219985 | aa49e05.s1 cDNA, 3' end/ clone = IMAGE:824288/clone_end = 3' | 1 | AACCCACAATCCAACTCCCTTGATGA GGATGATCATTAACAACAATCACT |
| 7867 | db mining | Hs.297485 | BF512677 | 11597856 | UI-H-BW-amg-g-04-0-UI.s1 cDNA, 3' end/clone = IMAGE:3069894/ clone_end = 3' | 1 | TTTGAAGCCTCTGGTACTTCCCCTTC CCAAACCAGTCACAGGAAACACT |
| 7868 | db mining | Hs.127167 | AA938326 | 3096437 | oc11c08.s1 cDNA, 3' end/ clone = IMAGE:1340558/clone_end = 3' | 1 | TTGGAGGTTAACAGTATTCCTTTGAG TGGTGTGATTAAAGGTGCTTTTAT |
| 7869 | db mining | Hs.123361 | AA811359 | 2880970 | ob82a07.s1 cDNA, 3' end/ clone = IMAGE:1337844/clone_end = 3' | 1 | CCACCTCCAGAACTGCCTATCTAAC TCATCTGTGGTGATGGAATGCTAT |
| 7870 | db mining | Hs.105282 | AA491247 | 2220420 | aa49b01.s1 cDNA, 3' end/ clone = IMAGE:824233/clone_end = 3' | 1 | AGTGGCTCTCTGCTGTTAGCATGGTT ACTAATCTTTTGGTTACTTTTCAT |
| 7871 | db mining | Hs.320385 | BF512292 | 11597471 | UI-H-BW-amb-d-12-0-UI.s1 cDNA, 3' end/clone = IMAGE:3089359/ clone_end = 3' | 1 | TGACCTCAGTGTCTACTTCAGCAGAA CCTGTGGGTATATGCCTACCTCAT |
| 7872 | db mining | Hs.105506 | AA521196 | 2261739 | aa74c04.s1 cDNA, 3' end/ clone = IMAGE:826662/clone_end = 3' | 1 | AAGGAGAACTGTCAACTGAATCTCAA ATGCAGTCAAATGAAGAGAGGCAT |
| 7873 | db mining | Hs.124928 | AA765759 | 2816997 | ao07h05.s1 cDNA, 3' end/ clone = IMAGE:1304313/clone_end = 3' | 1 | TTCAAGTCATTATAGGTTTGGGCATA CAGGGTTAACCTTGTGATGTACAT |
| 7874 | db mining | Hs.320488 | BF513286 | 11598465 | UI-H-BW1-amo-e-11-0-UI.s1 cDNA, 3' end/clone = IMAGE:3070580/ clone_end = 3' | 1 | AGCAGAACAACATGTGTTTGACACTT TTCCTTCTCTGTAATGAGGTACAT |
| 7875 | db mining | Hs.122891 | AA767601 | 2818816 | ao45h09.s1 cDNA, 3' end/ clone = IMAGE:1307969/clone_end = 3' | 1 | TGCCTGTGTGGGTCAAAGGAATCATC TATGCTAATGTATTTGAGCCAAAT |
| 7876 | db mining | Hs.116435 | AA848285 | 2574714 | ns20d12.s1 cDNA, 3' end/ clone = IMAGE:1184183/clone_end = 3' | 1 | ACCGAAAGCAGCATTTTCAATGTTTA ATTAAATCGATGCAGGAAATTGTG |
| 7877 | db mining | Hs.300303 | AW292760 | 6699396 | UI-H-BW0-aij-c-03-0-UI.s1 cDNA, 3' end/clone = IMAGE:2729453/ clone_end = 3' | 1 | GTCCCTGGCCCTTCACTCTTCGTCCA GGCTCTCTGACCTCTTTCCCTCTG |
| 7878 | db mining | Hs.123154 | AA688058 | 2674964 | nv58c04.s1 cDNA, 3' end/ clone = IMAGE:1233990/clone_end = 3' | 1 | TGTCCGCTGTTTTACCTCACTGCTCC TGTTTATGCCCTTAACTTCTGCTG |
| 7879 | db mining | Hs.320489 | BF513296 | 11598475 | UI-H-BW1-amo-f-11-0-UI.s1 cDNa, 3' end/clone = IMAGE:3070628/ clone_end = 3' | 1 | GCACAAGACCTCACTTGGAACAAGTA CCAGGCAGAAGAGAGCATTACCTG |
| 7880 | db mining | Hs.124353 | AA830448 | 2903547 | oc51d05.s1 cDNA, 3' end/ clone = IMAGE:1353225/clone_end = | 1 | TTTCATATCTTGGCAGTTGGATGCGG TAAGAGCCACAGAGAAACCACCTG |

TABLE 8-continued

| SEQ ID | Origin | Unigene | Locus | GI | Nominal Description | Strand | Probe Sequence |
|---|---|---|---|---|---|---|---|
| 7881 | db mining | Hs.122824 | AA765319 | 2616557 | ao01f11.s1 cDNA, 3' end/clone = IMAGE:1303725/clone_end = 3' | 1 | AGGACCCTTTTCCCATATTTCTGGCTATATACAAGGATATCCAGACACTG |
| 7882 | db mining | Hs.124317 | AA827178 | 2901175 | ob53g04.s1 cDNA, 3' end/clone = IMAGE:1335126/clone_end = 3' | 1 | ACCAGGCCTAGAATTTAGGTTCTAGGTGTAAACTATTGGCCTATCAGATG |
| 7883 | db mining | Hs.300373 | AW297820 | 6704445 | UI-H-BW0-aiy-h-04-0-UI.s1 cDNA, 3' end/clone = IMAGE:2731230/clone_end = 3' | 1 | GTGCATTTTAGCAACAGACTTCCAGGTTTCCAGCGCGGGCCAGGAAGGGG |
| 7884 | db mining | Hs.320464 | BF513050 | 11598229 | UI-H-BW1-amn-a-03-0-UI.s1 cDNA, 3' end/clone = IMAGE:3070349/clone_end = 3' | 1 | CTGTCATGCACCACCTCATCCCCTCCTTCAGGGCCAGGGACAGTCCCTAG |
| 7885 | db mining | Hs.313366 | AW297537 | 6704173 | UI-H-BW0-aja-f-05-0-UI.s1 cDNA, 3' end/clone = IMAGE:2731160/clone_end = 3' | 1 | AGAGGAGGAGGGGGTAGAATGAATTTCATTTAAAGCTCAACCTAGTTCAG |
| 7886 | db mining | Hs.320427 | BF512648 | 11597827 | UI-H-BW1-amg-d-19-0-UI.s1 cDNA, 3' end/clone = IMAGE:3069762/clone_end = 3' | 1 | CAGTCTCCCAGCTTTCTTGGCCTCCTCTGCCAACTGGATGCAAGGCTCAG |
| 7887 | db mining | Hs.252840 | AW015143 | 5883960 | UI-H-B10p-abb-e-07-0-UI.s1 cDNA, 3' end/clone = IMAGE:2711149/clone_end = 3' | 1 | TGGAGAGAAGGTTCGGGAAGACGAGGGGGCTGGGAGGTTTGGAAAGACAG |
| 7888 | db mining | Hs.313161 | AW292801 | 6699437 | UI-H-BW0-aij-f-11-0-UI.s1 cDNA, end/clone = IMAGE:2729613/clone_end = 3' | 1 | CTGAAATGGGGGAAGGTGGGTTATGACAAAGTTCATGGAGAGGCCTGAAG |
| 7889 | db mining | Hs.309124 | AI380478 | 4190331 | tf95a09.x1 cDNA, 3' end/clone = IMAGE:2107000/clone_end = 3' | 1 | TAAAGCGGTACGGGATTCCGCACCCTACTCCAGCAAGAAAGAGCCTGAAG |
| 7890 | db mining | Hs.120562 | AA741096 | 2779688 | ny99g07.s1 cDNA, 3' end/clone = IMAGE:1286460/clone_end = 3' | 1 | AGCATTCATTCCTCCAAACACACTCCCAGGGTTAGGTCTCTTACCTCTGC |
| 7891 | db mining | Hs.105530 | AA521450 | 2261993 | aa69d11.s1 cDNA, 3' end/clone = IMAGE:826197/clone_end = 3' | 1 | GGTGTTGAATATTTATACGGATTGGCATCATAAGATACCGCGATACCTGC |
| 7892 | db mining | Hs.123194 | AA805997 | 2874747 | oc18g05.s1 cDNA, 3' end/clone = IMAGE:1341272/clone_end = 3' | 1 | ACCTTAGTCTAACTGCCTTCTGTAAAGTGGGTTGCTATAGTCTTTAAGCC |
| 7893 | db mining | Hs.122833 | AA765597 | 2816835 | ao08a10.s1 cDNA, 3' end/clone = IMAGE:1304346/clone_end = 3' | 1 | TGAGGTTTGGATGGTGGCAGGTAAAACAGAAAGGCAAGATGTCATCTGAC |
| 7894 | db mining | Hs.313827 | AW452984 | 5993760 | UI-H-BW1-amd-g-11-UI.s1 cDNA, 3' end/clone = IMAGE:3069525/clone_end = 3' | 1 | TGGAGCTGCTACATAATTATTTCAGGTCTCAAAGCTTCCAAGAAGTGGAC |
| 7895 | db mining | Hs.122383 | AA789140 | 2849260 | aa66g10.s1 cDNA, 3' end/clone = IMAGE:825954/clone_end = 3' | 1 | AGACGGAACCTGAGATGTTGGATGTTGTTGATCTTAGCAAACAGACTTTA |
| 7896 | db mining | Hs.120226 | AA731687 | 2752576 | nw58f05.s1 cDNA, 3' end/clone = IMAGE:1250817/clone_end = 3' | 1 | AGATCTGTAATCTTTGGCAAATGGAACTCACCTGCAACGATACCTACTTA |
| 7897 | db mining | Hs.120288 | AA731998 | 2753949 | nw61b04.s1 cDNA, 3' end/clone = IMAGE:1251055/clone_end = 3' | 1 | GAGGACTTCCATTCCCCATTTCCCGCATACCTGCTGTTCTGTCTGAATTA |
| 7898 | db mining | Hs.123168 | AA804519 | 2873850 | ns28a11.s1 cDNA, 3' end/clone = IMAGE:1184924/clone_end = 3' | 1 | AGCTCACACCTGTTCCTTCATGGGTCAGTTCCTTTCATTTTCACTTTTGA |
| 7899 | db mining | Hs.124369 | AA830835 | 2903934 | oc54b06.s1 cDNA, 3' end/clone = IMAGE:135491/clone_end = 3' | 1 | AGCTGCTGCTTCTCTTTCAGTTGCAAATGCAAACCTGTTATAATCTTTGA |
| 7900 | db mining | Hs.122482 | AA767335 | 2818350 | nz65h02.s1 cDNA, 3' end/clone = IMAGE:1300371/clone_end = 3' | 1 | TCAATATCTGTGTGTCTTTTCATGAGTGGCTGTTACTTGTGAAGAATTGA |
| 7901 | db mining | Hs.313287 | AW296059 | 6702695 | UI.H.BW0-aiu-g-03-0-UI.s1 cDNA, 3' end/clone = IMAGE:2730796/clone_end = 3' | 1 | TGAGTGGACTGAGGAATGAATAGAAAACGTGGATATATGTAGAAAGCTGA |
| 7902 | db mining | Hs.120705 | AA748015 | 2787973 | nx87c05.s1 cDNA, 3' end/clone = IMAGE:1269224/clone_end = 3' | 1 | ACCAGCCCCTGGGAATGTTATGAGCAAATGATACTCCATGAGTAAAATGA |
| 7903 | db mining | Hs.320495 | BF513385 | 11598564 | UI-H-BW1 = amk-f-10-0-UI.s1 cDNa, 3' end/clone = IMAGE:3070242/clone_end = 3' | 1 | TCGTGTGAGTGTGAGAGACATGTTCATTGTGAAAAGATACTCCAGTGGAA |
| 7904 | db mining | Hs.121104 | AA721020 | 2737155 | nx89f11.s1 cDNA, 3' end/clone = IMAGE:1269453/clone_end = 3' | 1 | TTTGTCAAATGCCTGTTCACCATCTGTGGAAGTCATTATATGATTCAGGA |
| 7905 | db mining | Hs.124297 | AA827809 | 2900172 | od08c04.s1 cDNA, 3' end/clone = IMAGE:1387334/clone_end = 3' | 1 | ACACTTTTCTTCTAAGGAGAGCTTTCTTAGGCATTTCAAAGAACTTTCGA |

TABLE 8-continued

| SEQ ID | Origin | Unigene | Locus | GI | Nominal Description | Strand | Probe Sequence |
|---|---|---|---|---|---|---|---|
| 7906 | db mining | Hs.320372 | BF512096 | 11597308 | UI-H-BW1-ami-f-10-0-UI.s1 cDNA, 3' end/clone = IMAGE:3070218/ clone_end = 3' | 1 | ACCAAATGAGTACCATCTGTTGAACA CAGGGTGGCGATCCAAGTGTTTCA |
| 7907 | HUVEC cDNA | Hs.92381 | AB007956 | 3413930 | mRNA, chromosome 1 transcript KIAA0487/cds = UNKNOWN | 1 | ACCTGACTTCCACGATAAAATGGAGA TGAGTGCAGGGGTGAGTGTATAGT |
| 7908 | HUVEC cDNA | Hs.24950 | AB008109 | 2554613 | regulator of G-protein signalling 5 (RGS5), mRNA/cds = (81, 626) | 1 | TGCAGATTTATACTCCTGACGTGTCT CATTCACAGCTAAATAATAGGCCA |
| 7909 | HUVEC cDNA | Hs.306193 | AB011087 | 3043553 | hypothetical protein (LQFBS-1), mRNA/cds = (0, 743) | 1 | ACCCTCGCCCTTTCCCTCCGGTTCAG TACCTATTGTTTCTCCTTTCAAAT |
| 7910 | HUVEC cDNA | Hs.154919 | AB014525 | 3327063 | mRNA for KIAA0625 protein, partial cds/cds = (0, 2377) | 1 | AAGAGGAAATGGCAGAATTAAAAGCA GAAACAAGAAGATGGACATGGATT |
| 7911 | HUVEC cDNA | Hs.153026 | AB014540 | 3327093 | mRNA for KIAA0640 protein, partial cds/cds = (0, 1812) | 1 | AAGAGTGTTTGAGTGCTTGTCATCAG GTGTTTTCCTTAATAAGTAGGGAT |
| 7912 | HUVEC cDNA | Hs.24439 | AB014546 | 3327105 | ring finger protein (C3HC4 type) 8 (RNF8), mRNA/cds = (112, 1569) | 1 | CTGCTGTCCACTTTCCTTCAGGCTCT GTGAATACTTCAACCTGCTGTGAT |
| 7913 | HUVEC cDNA | Hs.155829 | AB014576 | 3327185 | mRNA for KIAA0676 protein, partial cds/cds = (0, 3789) | 1 | TTCCTTGGATTCATTTCACTTGGCTA GAAATTACACTGTGCTCAATGCCT |
| 7914 | HUVEC cDNA | Hs.93675 | AB022718 | 4204189 | decidual protein induced by progesterone (DEPP), mRNA/ cds = (218, 856) | 1 | AGGTCTCTGCCACCTCCTTCTCTGTG AGCTGTCAGTCAGGTTATTCTCT |
| 7915 | HUVEC cDNA | Hs.104305 | AB023143 | 4589483 | death effector filament-forming Ced-4-like apoptosis protein (DEFCAP), transcript variant B, mRNA/ cds = (522, 4811) | 1 | GAATAGGAGGGACATGGAACCATTTG CCTCTGGCTGTGTCACAGGGTGAG |
| 7916 | HUVEC cDNA | Hs.103329 | AB023187 | 14133228 | KIAA0970 protein (KIAA0970), mRNA/cds = (334, 2667) | 1 | CCTGTTTAAGAAAGTGAAATGTTATG GTCTCCCCTCTTCCAATGAGCTTA |
| 7917 | HUVEC cDNA | Hs.155182 | AB017848 | 5689408 | KIAA1036 protein (KIAA1036), mRNA/cds = (385, 1482) | 1 | TTTCACTTTCACACTTCATCTCATTCC TGTTGTCACTTTCCCCGAAACGA |
| 7918 | HUVEC cDNA | Hs.129218 | AB028997 | 5689484 | DNA sequence from clone RP11-154E8 on chromosome 10. Contains the gene KIAA1074, the 3' end of the YME1L1 gene for YME1 (S. cerevisiae)-like 1, ESTs, STSs, GSSs and a CpG island/cds = (166, 5298) | 1 | TCTGGATCAATAGCTTCCCCTCTAGG GTCTACTGATGAGTCAAATCTAAA |
| 7919 | HUVEC cDNA | Hs.8383 | AB032255 | 6663499 | bromodomain adjacent to zinc finger domain, 2B (BAZ2B), mRNA/ cds = (366, 6284) | 1 | TTTATCTACTGTGTGTTGTGGTGGCC TGTTGGAGGCAAATAGATCAGATT |
| 7920 | HUVEC cDNA | Hs.15165 | AB037755 | 7243048 | novel retinal pigment epithellal gene (NORPEG), mRNA/cds = (111, 3053) | 1 | GACATTTTGTAGGATGCCTGACGAG GTGTAGCCTTTTATCTTGTTTCCG |
| 7921 | HUVEC cDNA | Hs.82113 | AB049113 | 10257384 | dUTP pyrophosphatase (OUT), mRNA/ cds = (29, 523) | 1 | CCCAGTTTGTGGAAGCACAGGCAAG AGTGTTCTTTTCTGGTGATTCTCCA |
| 7922 | HUVEC cDNA | Hs.8180 | AF000652 | 2795862 | syndecan binding protein (syntenin) (SDCBP), mRNA/cds = (148, 1044) | 1 | TGTTCCTTTTCCTGACTCCTCCTTGC AAACAAAATGATAGTTGACACTTT |
| 7923 | HUVEC cDNA | Hs.147918 | AF000982 | 2580549 | DEAD/H (Asp-Glu-Ala-Asp/His) box polypeptide 3 (DDX3), transcript variant 2, mRNA/cds = (856, 2844) | 1 | GTGACTTGTACATTCAGCAATAGCAT TTGAGCAAGTTTTATCAGCAAGCA |
| 7924 | HUVEC cDNA | Hs.75056 | AF002163 | 2290769 | adaptor-related protein complex 3, delta 1 subunit (AP3D1), mRNA/ cds = (209, 3547) | 1 | TTGCTATCGACATTCCCGTATAAAGA GAGAGACATATCACGCTGCTGTCA |
| 7925 | HUVEC cDNA | Hs.42915 | AF006082 | 2282029 | ARP2 (actin-related protein 2, yeast) homolog (ACTR2), mRNA/ cds = (74, 1258) | 1 | CCRFCCAGTGTCAGAAAATCCTATTT ATGAATCCTGTCGGTATTCCTTGG |
| 7926 | HUVEC cDNA | Hs.11538 | AF006084 | 2282033 | actin related protein 2/3 complex, subunit 1A (41 kD) (ARPC1B), mRNA/ CDS = (80, 1198) | 1 | AGGGAGGGGACAGATGGGGAGCTTT TCTTACCTATTCAAGGAATACGTGC |
| 7927 | HUVEC cDNA | Hs.6895 | AF006086 | 2282037 | actin related protein 2/3 complex, subunit 3 (21 kD) (ARPC3), mRNA/ cds = (25, 561) | 1 | TCAAGAATTTGGGTGGGAGAAAAGAA AGTGGGTTATCAAAGGGTGATTGA |
| 7928 | HUVEC cDNA | Hs.286027 | AF010313 | 6468761 | etoposide-induced mRNA (PIG8), mRNA/cds = (72, 1151) | 1 | TGTGATTAGGTTGTTTTCCTGTCATTT TTGAGAGACTAAAATTGTGGGGG |
| 7929 | HUVEC cDNA | Hs.79150 | AF026291 | 2559007 | chaperonin containing TCP1, subunit 4 (delta) (CCT4), mRNA/cds = (0, 1619) | 1 | TGGGCTTGGTCTTCCAGTTGGCATTT GCCTGAAGTTGTATTGAAACAATT |
| 7930 | HUVEC cDNA | Hs.81452 | AF030555 | 3158350 | fatty-acid-Coenzyme A ligase, long-chain 4 (FACL4), transcript variant 2, mRNA/cds = (506, 2641) | 1 | AACAAGATGAGAACAGATAAAGATTG TGTGGTGTTTTGGATTTGGAGAGA |
| 7931 | HUVEC cDNA | Hs.139851 | AF035752 | 2665791 | caveolin 2 (CAV2), mRNA/ cds = (20, 508) | 1 | TGTAGCTCCCACAAGGTAAACTTCAT TGGTAAGATTGCACTGTTCTGATT |
| 7932 | HUVEC cDNA | Hs.194709 | AF037364 | 14030860 | paraneoplastic antigen MA1 (PNMA1), mRNA/cds = (664, 1725) | 1 | TCACTCCCCATTTCACTTCTTTGTCA GAGAATAGTTCTTGTTCATACTG |
| 7933 | HUVEC | Hs.79516 | AF039656 | 2773159 | brain acid-soluble protein 1 (BASP1), mRNA/cds = (52, 735) | 1 | TGGGAGTGACAAACATTCTCTCATCC TACTTAGCACTACCTAGATTTCTCA |
| 7934 | HUVEC cDNA | Hs.29417 | AF039942 | 4730926 | HCF-binding transcription factor Zhangfei (ZF), mRNA/cds = (457, 1275) | 1 | AATGGAAGGATTAGTATGGCCTATTT TTAAAGCTGCTTTGTTAGGTTCCT |
| 7935 | HUVEC | Hs.26232 | AF044414 | 6136293 | mannosidase, alpha, class 2C, | 1 | CCCCAGCCTAAAGCAGGGATCAGTC |

TABLE 8-continued

| SEQ ID | Origin | Unigene | Locus | GI | Nominal Description | Strand | Probe Sequence |
|---|---|---|---|---|---|---|---|
| | cDNA | | | | member 1 (MAN2C1), mRNA/ cds = (56, 3244) | | TTTTCTTGTGGAATAAATCCTTGGA |
| 7936 | HUVEC cDNA | Hs.3776 | AF062072 | 3668065 | zinc finger protein 216 (ZNF216), mRNA/cds = (288, 929) | 1 | TGTGGTAATGCCTGTTTTCATCTGTA AATAGTTAAGTATGTACACGAGGC |
| 7937 | HUVEC cDNA | Hs.74034 | AF070648 | 3283922 | clone 24651 mRNA sequence/ cds = UNKNOWN | 1 | AGATGCTTAGTCCCTCATGCAAATCA ATTACTGGTCCAAAAGATTGCTGA |
| 7938 | HUVEC cDNA | Hs.274230 | AF074331 | 5052074 | PAPS synthetase-2 (PAPSS2) mRNA, complete cds/cds = (63, 1907) | 1 | AAAACTGCTCTTCTGCTCTAGTACCA TGCTTAGTGCAAATGATTATTTCT |
| 7939 | HUVEC cDNA | Hs.12540 | AF081281 | 3415122 | lysophospholipase (LYPLA1), mRNA/ cds = (35, 727) | 1 | AGCTATTAGGATCTTCAACCCAGGTA ACAGGAATAATTCTGTGGTTTCAT |
| 7940 | HUVEC cDNA | Hs.159629 | AF092131 | 5138911 | myosin IXB (MYO9B), mRNA/ cds = (0, 6068) | 1 | TCCTGCGTCTATCCATGTGGAATGCT GGACAATAAAGCGAGTGCTGCCCA |
| 7941 | HUVEC cDNA | Hs.273385 | AF105253 | 7532779 | guanine nucleotide binding protein (G protein), alpha stimulating activity polypeptide 1 (GNAS1), mRNA/ cds = (68, 1252) | 1 | GCCACAAAAGTTCCCTCTCACTTTCA GTAAAAATAAATAAAACAGCAGCA |
| 7942 | HUVEC cDNA | Hs.2934 | AF107045 | 5006419 | ribonucleotide reductase M1 polypeptide (RRM1), mRNA/ cds = (187, 2565) | 1 | ACTGCTTTGACTGGTGGGTCTCTAGA AGCAAAACTGAGTGATAACTCATG |
| 7943 | HUVEC cDNA | Hs.158237 | AF112345 | 6650627 | integrin alpha 10 subunit (ITGA10) mRNA, complete cds/cds = (76, 3579) | 1 | GGCATTGTCTCTGTTTCCCAGTGGGG TGGACAGTATATCAGATGGTCAGA |
| 7944 | HUVEC cDNA | Hs.183698 | AF116627 | 7959755 | ribosomal protein L29 (RPL29), mRNA/cds = (29, 508) | 1 | CCCTGGGCTACCATCTGCATGGGGC TGGGGTCCTCCTGTGCTATTTTGTAC |
| 7945 | HUVEC cDNA | Hs.2186 | AF119852 | 7770136 | Homo sapiens, eukaryctic translation elongation factor 1 gamma, clone MGC:4501 IMAGE:2964623, mRNA, complete cds/cds = (2278, 3231) | 1 | TCAAGTGAACATCTCTTGCCATCACC TAGCTGCCTGCACCTGCCCTTCAG |
| 7946 | HUVEC cDNA | Hs.22900 | AF134891 | 7381111 | nuclear factor (erythroid-derived 2)-like 3 (NFE2L3), mRNA/cds = (492, 1694) | 1 | TCTTGGCAGCCATCCTTTTTAAGAGT AAGTTGGTTACTTCAAAAAGAGCA |
| 7947 | HUVEC cDNA | Hs.108258 | AF141968 | 6273777 | actin cross-linking factor (ACF7), transcript variant 1, mRNA/ cds = (51, 16343) | 1 | AGCTAAAGAGAGGGAACCTCATCTAA GTAACATTTGCACATGATACAGCA |
| 7948 | HUVEC cDNA | Hs.11158 | AF151072 | 7106885 | hypothetical protein (LOC51255), mRNA/cds = (0, 461) | 1 | GCTGAGTGCTGGCCCTCTGCGTCTT CCTTATTAACCTTGAATCCTCATTA |
| 7949 | HUVEC cDNA | Hs.179573 | AF193556 | 6907041 | collagen, type 1, alpha 2 (COL1A2), mRNA/cds = (139, 4239) | 1 | TGAATGATCAGAACTGACATTTAATTC ATGTTTGTCTCGCCATGCTTCTT |
| 7950 | HUVEC cDNA | Hs.41135 | AF205940 | 8547214 | endomucin-2 (LOC51705), mRNA/ cds = (78, 863) | 1 | TCCGGGCCAAGAATTTTTATCCATGA AGACTTTCCTACTTTTCTCGGTGT |
| 7951 | HUVEC cDNA | Hs.142908 | AF219119 | 7158848 | E2F-like protein (LOC51270), mRNA/ cds = (278, 979) | 1 | GCAGAGTTCATTGTTGCCCCTTAACA GTTTTTCCTGAGTTTACTGAAGAA |
| 7952 | HUVEC cDNA | Hs.154721 | AF261088 | 9802307 | aconitase 1, soluble (ACO1), mRNA/ cds = (107, 2776) | 1 | TTATCAAGCAGAGACCTTTGTTGGGA GGCGGTTTGGGAGAACACATTTCT |
| 7953 | HUVEC cDNA | Hs.78288 | AF261089 | 8802309 | calpain 2, (m/ll) large subunit (CAPN2), mRNA/cds = (142, 2244) | 1 | GGGTATGCTGCCTCTGTAAATTCATG TATTCAAAGGAAAAGACACCTTGC |
| 7954 | HUVEC cDNA | Hs.152707 | AJ001259 | 2769253 | glioblastoma amplified sequence (GBAS), mRNA/cds = (8, 868) | 1 | TTGTCTGCCCCACAATCAAGAATGTA TGTGTAAAGTGTGAATAAATCTCA |
| 7955 | HUVEC cDNA | Hs.5097 | AJ002308 | 2959871 | synaplogyrin 2 (SYNGR2), mRNA/ cds = (29, 703) | 1 | ATGCCCGGCCTGGGATGCTGTTTGG AGACGGAATAAATGTTTTCTCATTC |
| 7956 | HUVEC cDNA | Hs.143323 | AJ243706 | 6572290 | mRNA for RB-binding protein (rbbo2h1a gene)/cds = (757, 5802) | 1 | AGCAGTTTGTGATATAGCAGAGGTTT AAATGTACCCTCCCCTTTTATGCA |
| 7957 | HUVEC cDNA | Hs.1197 | NM_002157 | 4504522 | Heat shock 10 kD protein 1 (chaperonin 10) | 1 | TGATGCTGCCCATTCCACTGAAGTTC TGAAATCTTTCGTCATGTAAATAA |
| 7958 | HUVEC cDNA | Hs.79037 | BC010112 | 14603308 | Homo sapiens, heat shock 60 kD protein 1 (chaperonin), clone MGC:19755 IMAGE:3630225, mRNA, complete cds/cds = (1705, 3396) | 1 | AGCAGCCTTTCTGTGGAGAGTGAGAA TAATTGTGTACAAAGTAGAGAAGT |
| 7959 | HUVEC cDNA | Hs.279860 | AJ400717 | 7573518 | tumor protein, translationally-controlled 1 (TPT1), mRNA/cds = (94, 612) | 1 | CATCTGAAGTGTGGAGCCTTACCCAT TTCATCACCTACAACGGAAGTAGT |
| 7960 | HUVEC cDNA | Hs.165563 | AK024508 | 10440535 | DNA sequence form clone RP4-591C20 on chromosome 20. Contains ESTs, STSs, GSSs and CpG islands. Contains a novel gene for a protein similar to NG26, the TPD52L2 gene for two isoforms of tumor protein D52-like protein 2, a gene for a novel DnaJ domain protein similar to mouse and bovine cysteine string protein with two isoforms, a gene for a novel phosphoribulokinase with three isoforms, the KIAA1196 gene and the 5' part of the TOM gene for a putative mitochondrial outer membrane protein import receptor similar to yeast pre-mRNA splicing factors Prp1/Zer1 and Prp6/cds = (0, 503) | 1 | GCCAGGCTGGTTCCGCATGGTGATC TCCGTCTTGTATGTCTGAATGTTGG |
| 7961 | HUVEC | Hs.91146 | AL050147 | 4884153 | protein kinase D2 mRNA, complete | 1 | CTATTTCCAAGGCCCCTCCCTGTTTC |

TABLE 8-continued

| SEQ ID | Origin | Unigene | Locus | GI | Nominal Description | Strand | Probe Sequence |
|---|---|---|---|---|---|---|---|
| | cDNA | | | | cds/cds = (39, 2675) | | CCCAGCAATTAAAACGGACTCATC |
| 7962 | HUVEC cDNA | Hs.66762 | AL050367 | 4914600 | mRNA, cDNA DKFZp584A026 (from clone DKFZp564A026)/ cds = UNKNOWN | 1 | AAAGTGCCAGAATGACTCTTCTGTGC ATTCTTCTTAAAGAGCTGCTTGGT |
| 7963 | HUVEC cDNA | Hs.165998 | AL080119 | 5262550 | PAI-1 mRNA-binding protein (PAI-RBP1), mRNA/cds = (85, 1248) | 1 | TTGTTGGTAGGCACATCGTGTCAAGT GAAGTAGTTTTATAGGTATGGGTT |
| 7964 | HUVEC cDNA | Hs.111801 | AL096723 | 5419856 | mRNA; cDNA DKFZp564H2023 (from clone DKFZp584H2023)/ cds = UNKNOWN | 1 | AGTCCTGTATCATCCATACTTGTACTA CCTTGTCCTATGAAGCTCTGAGA |
| 7965 | HUVEC cDNA | Hs.89434 | AL110225 | 5817161 | drebrin 1 (DBN1), mRNA/ cds = (97, 2046) | 1 | TTGGCCGCTTCCCTACCCACAGGGC CTGACTTTTACAGCTTTTCTCTTTT |
| 7966 | HUVEC cDNA | Hs.7527 | AL110239 | 5817182 | small fragment nuclease (DKFZP588E144), mRNA/ cds = (77, 790) | 1 | TATGACACAGCAGCTCCTTTGTAAGT ACCAGGTCATGTCCATCCCTTGGT |
| 7967 | HUVEC cDNA | Hs.187991 | AL110269 | 5817043 | DKFZP564A122 protein (DKFZP564A122), mRNA/ cds = (2570, 2908) | 1 | TTGGTGAGTTGCCAAAGAAGCAATAC AGCATATCTGCTTTTGCCTTCTGT |
| 7968 | HUVEC cDNA | Hs.25882 | AL117665 | 5912262 | mRNA; cDNA DKFZp586M1824 (from clone DKFZp586M1824); partial cds/ cds = (0, 3671) | 1 | TGCATAGATGACCTTTGGATTATTGG ACTCTGACTATTGGGACCCTAAAT |
| 7969 | HUVEC cDNA | Hs.17428 | AL133010 | 6453416 | RBP1-like protein (BCAA), transcript variant 2, mRNA/cds = (468, 4143) | 1 | TGGACGCCCTAAGAAACAGAGA AAACAGAAATAACAACCAGGAACT GCTT |
| 7970 | HUVEC cDNA | Hs.278242 | AL137300 | 6807762 | Homo sapiens, clone MGC:3214 IMAGE:3502820, mRNA complete cds/ cds = (2066, 3421) | 1 | CAATAGCTTGTGGGTCTGTGAAGACT GCGGTGTTTGAGTTTCTCACACCC |
| 7971 | HUVEC cDNA | Hs.7378 | AL137663 | 6807784 | mRNA; cDNA DKFZp434G227 (from clone DKFZp434G227)/ cds = UNKNOWN | 1 | TGCACTGTACTCTCTTCATAGGATTG TAAAGGTGTTCTAATCCAATTGCA |
| 7972 | HUVEC cDNA | Hs.61289 | AL157424 | 7018453 | mRNA; cDNA DKFZp761E1512 (from clone DKFZp761E1512)/ cds = UNKNOWN | 1 | TGAAGTCATTTCATTGGGAAGGAAAG CTGCCAAAGATTATTGGGGACTAG |
| 7973 | HUVEC cDNA | Hs.240013 | AL390148 | 9388882 | mRNA; cDNA DKFZp547A166 (from clone DKFZp547A166)/ cds = UNKNOWN | 1 | TTTCATCTGGCCCACCCTCCTTAGAC TCTCCTCCCTTCAAGAGTTGGAGC |
| 7974 | HUVEC cDNA | Hs.22629 | AW887820 | 8049833 | 602281231F1 cDNA, 5' end/ clone = IMAGE:4368943/clone_end = 5' | 1 | GTGTAGAATTCGGATCCAGTCATCTC ACAGAACTTTCCACTAGGGTGCCA |
| 7975 | HUVEC cDNA | Hs.333414 | BE562833 | 9806553 | hypothetical protein MGC14151 (MGC14151), mRNA/cds = (108, 485) | 1 | CGGACCCCAGTTCTTGTACCAAGGG GGAAACATGCGGGGACCCCAATGG |
| 7976 | HUVEC cDNA | NA | BE612847 | 9894444 | 601452239F1 NH_MGC_68 cDNA clone IMAGE:3856304 5', mRNA sequence | 1 | TAAAGATGTCCGGGTACACTTCGCCA AGGGTTAGCGTCTTTGGGCATTTC |
| 7977 | HUVEC cDNA | Hs.86412 | BE876332 | 10325018 | chromosome 9 open reading frame 5 (C9orf5), mRNA/cds = (32, 2767) | 1 | AACACAACACTAAAACCGAACA CACACGTACTAACACACCCACGAC CCAA |
| 7978 | HUVEC cDNA | Hs.285814 | BE906689 | 10400012 | sprouly (Drosophila) homolog 4 (SPRY4), mRNA/cds = (205, 525) | 1 | CCTTCTGGTTCTGCTTTTGACCAGA TTTTTGTGCCCCTCTGTTACTGTG |
| 7979 | HUVEC cDNA | Hs.113029 | BF025727 | 10733439 | ribosomal protein S25 (RPS25), mRNA/cds = (63, 440) | 1 | GATATACGAAACACACCACTGGACGA TGCGAAAAACGAGACGACATAAGC |
| 7980 | HUVEC cDNA | Hs.263339 | BF107006 | 10889631 | 602377929F1 cDNA, 5' end/ clone = IMAGE:4508646/clone_end = 5' | 1 | TGGACAGGCATGAAAGGTTACAAATG GGAGAAAACTCACACACGTTATGT |
| 7981 | HUVEC cDNA | Hs.182426 | BF204683 | 11098269 | 601887521F1 cDNA, 5' end/ clone = IMAGE:4110052/clone_end = 5' | 1 | GCAGGAGAGCGAGAGAGGAGAAGAA GAGGCAGGAGGGAGAAAGAGCGTAC |
| 7982 | HUVEC cDNA | Hs.75968 | BF217687 | 11111273 | thymosin, beta 4, X chromosome (TMSB4X), mRNA/cds = (77, 211) | 1 | CAAGAAGCAGAAGCAGCAACCAGAG ACAGAGAGACAAACGCAGAACAACA |
| 7983 | HUVEC cDNA | Hs.112318 | BF237710 | 11151828 | cDNA FLJ4633 fis, clone NT2RP2000938/cds = UNKNOWN | 1 | AGAGGAAAGAATAGGACCAGTGCCG AGGTATAGGGAGGAGGGCATACTA |
| 7984 | HUVEC cDNA | Hs.293981 | BF247088 | 11162147 | Homo sapiens, clone MGC:16393 IMAGE:3939021, mRNA, complete cds/cds = (506, 1900) | 1 | TCGGAGTAAGGGCGATTGTCTCGTTA GGTAATACATCATCTTCGTGCATA |
| 7985 | HUVEC cDNA | Hs.157850 | BF303931 | 11250608 | Homo sapiens, clone MGC:15545 IMAGE:3050745, mRNA, complete cds/cds = (1045, 1623) | 1 | AGACAAGACGAGCAACGACAACCAC AGCAGCTCCATACACTCTGCCTCTC |
| 7986 | HUVEC cDNA | Hs.217493 | D00017 | 219909 | annexin A2 (ANXA2), mRNA/ cds = (49, 1068) | 1 | AGTGAAGTCTATGATGTGAAACACTT TGCCTCCTGTGTACTGTGTCATAA |
| 7987 | HUVEC cDNA | Hs.76549 | D00099 | 219941 | mRNA for Na, K-ATPase alpha-subunit, complete cds/cds = (318, 3389) | 1 | TCACAAGACAGTCATCAGAACCAGTA AATATCCGTCTGCCAGTTCGATCA |
| 7988 | HUVEC cDNA | Hs.330716 | D10522 | 219893 | cDNA FLJ4368 fis, clone HEMBA 1001122/cds = UNKNOWN | 1 | AAACTCCTGCTTAAGGTGTTCTAATTT TCTGTGAGCACACTAAAAGCGAA |
| 7989 | HUVEC cDNA | Hs.75929 | D21255 | 575578 | mRNA for O8-cadherin-2, complete cds/cds = (476, 2557) | 1 | CGTGCCAGATATAACTGTCTTGTTTC AGTGAGAGACGCCCTATTTCTATG |
| 7990 | HUVEC cDNA | Hs.178710 | D21260 | 434760 | clathrin, heavy polypeptide (Hc) (CLTC), mRNA/cds = (172, 5199) | 1 | TCCCTGAGGCTTGTGTATGTTGGATA TTGTGGTGTTTTAGATCACTGAGT |

TABLE 8-continued

| SEQ ID | Origin | Unigene | Locus | GI | Nominal Description | Strand | Probe Sequence |
|---|---|---|---|---|---|---|---|
| 7991 | HUVEC cDNA | Hs.334822 | D23660 | 432358 | *Homo sapiens*. Similar to ribosomal protein L4, clone MGC:2968 IMAGE:3139805, mRNA, complete cds/cds = (1616, 2617) | 1 | CAGAGAAGAAACCTACTACAGAGGA GAAGAAGCCTGCTGCATAAACTCTT |
| 7992 | HUVEC cDNA | Hs.262823 | D28500 | 7678803 | hypothetical protein FLJ10326 (FLJ10326), mRNA/cds = (2, 2296) | 1 | TCAGAACATAGATATGTATTCAGCTT GTCTTCAAATACGGCCAAGCAGAA |
| 7993 | HUVEC cDNA | Hs.151761 | D43947 | 603948 | KIAA0100 gene product (KIAA0100), mRNA/cds = (329, 6607) | 1 | TTGGGGTCAAGTGAAAGGGTAGGGG GATAGTCCTGATCAAGTGTGATAAA |
| 7994 | HUVEC cDNA | Hs.699 | D50525 | 1167502 | peptidylprolyl isomerase B (cyclophilin B) (PPIB), mRNA/cds = (21, 671) | 1 | CAGCAAATCCATCTGAACTGTGGAGG AGAAGCTCTCTTTACTGAGGGTGC |
| 7995 | HUVEC cDNA | Hs.278607 | D50911 | 6633996 | mRNA; cDNA DKFZp434N0735 (from clone DKFZp434N0735); partial cds/cds = (0, 1577) | 1 | CCTTCTCTTCATGTGTGTAAATCTGTA ATATACCATTCTCTGTGGCCTGT |
| 7996 | HUVEC cDNA | Hs.57729 | D50922 | 1469188 | Ketch-like ECH associated protein 1 (KIAA0132), mRNA/cds = (112, 1986) | 1 | GGATGGCACTTCCCCACCGGGATGGA CAGTTATTTTGTTGATAAGTAACCC |
| 7997 | HUVEC cDNA | Hs.240770 | D59253 | 1060898 | *Homo sapiens*, nuclear cap binding protein subunit 2, 20 kD, clone MGC:4991 IMAGE:3458927, mRNA, complete cds/cds = (26, 496) | 1 | TGAGTCAGTGTCTTTACTGAGCTGGA AGCCTCTGAAAGTTATTAAAGGCA |
| 7998 | HUVEC cDNA | Hs.155595 | D83878 | 981447 | neural precursor cell expressed, developmentally down-regulated 5 (NEDD5), mRNA/cds = (258, 1343) | 1 | CCCACACTGCTACACTTCTGATCCCC TTTGGTTTTACTACCCAAATCTAA |
| 7999 | HUVEC cDNA | Hs.80712 | D86957 | 1503987 | septin 2 (SEP2) mRNA, partial cds/cds = (0, 1527) | 1 | GTGGCTTGCTAGTCTGTTACGTTAAC ATGCTTTTCTAAAATTGCTTCACG |
| 8000 | HUVEC cDNA | Hs.75822 | D86970 | 1504013 | mRNA for KIAA0216 gene, complete cds/cds = (484, 5229) | 1 | TTGTACTCACTGGGCTGTGCTCTCCC CTGTTTACCCGATGTATGGAAATA |
| 8001 | HUVEC cDNA | Hs.170311 | D89678 | 3128539 | heterogeneous nuclear ribonucleoprotein D-like (HNRPDL), transcript variant 1, mRNA/cds = (580, 1842) | 1 | TTTATGATTAGGTGACGAGTTGACAT TGAGATTGTCCTTTTCCCCTGATC |
| 8002 | HUVEC cDNA | Hs.83213 | J02874 | 178348 | fatty acid binding protein 4, adipocyte (FABP4), mRNA/cds = (47, 445) | 1 | TTGTTGTTTTCCCTGATTTAGCAAGCA AGTAATTTTCTCCCAAGCTGATT |
| 8003 | HUVEC cDNA | Hs.177766 | J03473 | 337423 | ADP-ribosyltransferase (NAD+; poly (ADP-ribose) polymerase) (ADPRT), mRNA/cds = (159, 3203) | 1 | TTAGAAACAAAAAGAGCTTTCCTTCT CCAGGAATACTGAACATGGGAGCT |
| 8004 | HUVEC cDNA | Hs.155560 | L10284 | 186522 | calnexin (CANX), mRNA/cds = (89, 1887) | 1 | CCATTGTTGTCAAATGCCCAGTGTCC ATCAGATGTGTTCCTCCATTTTCT |
| 8005 | HUVEC cDNA | Hs.75693 | L13977 | 431320 | prolylcarboxypeptidase (anglotensinase C) (PRCP), mRNA/cds = (29, 1519) | 1 | GATGTCTGGTGCCCAATCCCAGGAA GTGAGAGCCATTTCTTTTGTACTGG |
| 8006 | HUVEC cDNA | Hs.539 | L31610 | 1220380 | ribosomal protein S29 (RPS29), mRNA/cds = (30, 200) | 1 | AGTTGGACTAAATGCTCTTCCTTCAG AGGATTATCCGGGGCATCTACTCA |
| 8007 | HUVEC cDNA | Hs.1742 | L33075 | 536843 | IQ motif containing GTPase activating protein 1 (IQGAP1), mRNA/cds = (467, 5440) | 1 | TGAATTTACTTCCTCCCAAGAGTTTG GACTGCCCGTCAGATTGTTTCTGC |
| 8008 | HUVEC cDNA | Hs.180446 | L38951 | 893287 | Importin beta subunit mRNA, complete cds/cds = (337, 2967) | 1 | AAACACATACACACAAAACAGC AAACTTCAGGTAACTATTTTGGAT TGCA |
| 8009 | HUVEC cDNA | Hs.79572 | M11233 | 181179 | cathepsin D (lysosomal aspartyl protease) (CTSD), mRNA/cds = (2 1240) | 1 | CTGAGGATGAGCTGGAAGGAGTGAG AGGGGACAAAACCCACCTTGTTGGA |
| 8010 | HUVEC cDNA | Hs.273415 | M11580 | 178350 | aldolase A, fructose-bisphosphate (ALDOA), mRNA/cds = (167, 1261) | 1 | TCTTTCTTCCCTCGTGACAGTGGTGT GTGGTGTCGTCTGTGAATGCTAAG |
| 8011 | HUVEC cDNA | Hs.254105 | M14328 | 182113 | anolase 1, (alpha) (ENO1), mRNA/cds = (94, 1398) | 1 | GCTAGATCCCCGGTGGTTTTGTGCTC AAAATAAAAAGCCTCAGTGACCCA |
| 8012 | HUVEC cDNA | Hs.237519 | M20867 | 183059 | yz35c09.s1 cDnA, 3' end/clone = IMAGE:285040/clone_end = 3' | 1 | GCATGGCTTAACCTGGTGATAAAAGC AGTTATTAAAAGTCTACGTTTTCC |
| 8013 | HUVEC cDNA | Hs.1239 | M22324 | 178535 | alanyl (membrane) aminopeptidase (aminopeptidase N, aminopeptidase M, microsomal aminopeptidase, CD13, p150) (ANPEP), mRNA/cds = (120, 3023) | 1 | CCGCCCTGTACCCTCTTTCACCTTTC CCTAAAGACCCTAAATCTGAGGAA |
| 8014 | HUVEC cDNA | Hs.118126 | M22960 | 190282 | protective protein for beta-galactosidase (galactoslaidosis) (PPGB), mRNA/cds = (6, 1448) | 1 | GGACAGCCCACAGGGAGGTGGTGGA CGGACTGTAATTGATAGATTGATTA |
| 8015 | HUVEC cDNA | Hs.198281 | M26252 | 338826 | pyruvate kinase, muscle (PKM2), mRNA/cds = (109, 1704) | 1 | ATTGAAGCCGACTCTGGCCCTGGCC CTTACTTGCTTCTCTAGCTCTCTAG |
| 8016 | HUVEC cDNA | Hs.2050 | M31166 | 339991 | pentaxin-related gene, rapidly induced by IL-1 beta (PTX3), mRNA/cds = (87, 1212) | 1 | ACTAGACTTTATGCCATGGTGCTTTC AGTTTAATGCTGTGTCTCTGTCAG |
| 8017 | HUVEC cDNA | Hs.99853 | M59849 | 182591 | fibrillarin (FBL), mRNA/cds = (59, 1024) | 1 | GAGCCATATGAAAGAGACCATGCCGT GGTCGTGGGAGTGTACAGGCCACC |
| 8018 | HUVEC cDNA | Hs.283473 | M64098 | 183891 | hypothetical protein PRO2900 (PRO2900), mRNA/cds = (271, 501) | 1 | ATAACAGACTCCAGCTCCTGGTCCAC CCGGCATGTCAGTCAGCACTCTGG |
| 8019 | HUVEC | Hs.211573 | M85289 | 184426 | heparan sulfate proleoglycan 2 | 1 | CTGGCCTCTGTGTCCTAGAAGGGAC |

TABLE 8-continued

| SEQ ID | Origin | Unigene | Locus | GI | Nominal Description | Strand | Probe Sequence |
|---|---|---|---|---|---|---|---|
| | cDNA | | | | (perlecan) (HSPG2), mRNA/ cds = (40, 13221) | | CCTCCTGTGGTCTTTGTCTTGATTT |
| 8020 | HUVEC cDNA | Hs.75103 | M86400 | 189952 | tyrosine 3-monooxygenase/tryptophen 5-monooxygenase activation protein, zeta polypeptide (YWHAZ), mRNA/ cds = (84, 821) | 1 | CCCAAAGCTCACTTTACAAAATATTTC CTCAGTACTTTGCAGAAAACACC |
| 8021 | HUVEC cDNA cDNA | Hs.59271 | M98982 | 338262 | U2(RNU2) small nuclear RNA auxillary factor 1 (non-standard symbol) (U2AF1), mRNA/cds = (38, 760) | 1 | ATGTCTGCTAGAAAGTGTTGTAGTTG ATTGACCAAACCAGTTCATAAGGG |
| 8022 | HUVEC cDNA | Hs.110802 | NM_000552 | 9257255 | von Willebrand factor (VWF), mRNA/ cds = (310, 8751) | 1 | CTCTGCATGTTCTGCTCTTGTGCCCT TCTGAGCCCACAATAAAGGCTGAG |
| 8023 | HUVEC cDNA | Hs.274466 | NM_001403 | 4503472 | eukaryotic translation elongation factor 1 alpha 1-like 14 (EEF1A1L14), mRNA/cds = (620, 1816) | 1 | TGCATCGTAAAACCTTTCAGAAGGAA AGGAGAATGTTTTGTGGACACGTT |
| 8024 | HUVEC cDNA | Hs.279518 | NM_001642 | 4502146 | amyloid beta (A4) precursor-like protein 2 (APLP2), mRNA/ cds = (72, 2363) | 1 | AGCCCTATTCATGTCTCTACCCACTA TGCACAGATTAAACTTCACCTACA |
| 8025 | HUVEC cDNA | Hs.76224 | NM_004105 | 9865261 | EGF-containing fibulin-like extracellular matrix protein 1 (EFEMP1), transcript variant 1, mRNA/ cds = (149, 1630) | 1 | AGTGACAGTGAACTTAAGCAAATTAC CCTCCTACCCAATTCTATGGAATA |
| 8026 | HUVEC cDNA | Hs.19545 | NM_012193 | 6912383 | frizzled (Drosophila) homolog 4 (FZD4), mRNA/cds = (306, 1919) | 1 | ACACATGCCCTGAATGAATTGCTAAA TTTCAAAGGAAATGGACCCTGCTT |
| 8027 | HUVEC cDNA | Hs.87125 | NM_014600 | 7657055 | EH-domain containing 3 (EHD3), mRNA/cds = (285, 1892) | 1 | GCCACTGAACCAATCACTTTGTATGC TATGCTCCTACTGTGATGGAAAAC |
| 8028 | HUVEC cDNA | Hs.119503 | NM_016091 | 7705432 | HSPC025 (HSPC025), mRNA/ cds = (33, 1727) | 1 | AGGACCGAAGTGTTTCAAGTGGATCT CAGTAAAGGATCTTTGGAGCCAGA |
| 8029 | HUVEC cDNA | Hs.7905 | NM_016224 | 7706705 | SH3 and PX domain-containing protein SH3PX1 (SH3PX1), mRNA/ cds = (43, 1830) | 1 | TTCAATGGAAAATGAGGGGTTTCTCC CCACTGATATTTTACATAGAGTCA |
| 8030 | HUVEC cDNA | Hs.283722 | NM_020151 | 9910251 | GTT1 protein (GTT1), mRNA/ cds = (553, 1440) | 1 | GCTCCATGTTCTGACTTAGGGCAATT TGATTCTGCACTTGGGGTCTGTCT |
| 8031 | HUVEC cDNA | Hs.286233 | NM_020414 | 14251213 | sperm autoantigenic protein 17 (SPA17), mRNA/cds = (1210, 1685) | 1 | GCAGCAGCTTAATTTTTCTGTATTGC AGTGTTTATAGGCTTCTTGTGTGT |
| 8032 | HUVEC cDNA | Hs.272822 | S56985 | 298485 | RuvB (E. coli homolog)-like 1 (RUBVL1), mRNA/cds = (76, 1446) | 1 | ACCTCCCACTTTGTCTGTACATACTG GCCTCTGTGATTACATAGATCAGC |
| 8033 | HUVEC cDNA | Hs.279518 | S60099 | 300168 | amyloid beta (A4) precursor-like protein 2 (APLP2), mRNA/ cds = (72, 2383) | 1 | AGCCCTATTCATGTCTCTACCCACTA TGCACAGATTAAACTTCACCTACA |
| 8034 | HUVEC cDNA | Hs.194662 | S80582 | 1245968 | calporin 3, acidic (CNN3), mRNA/ cds = (83, 1072) | 1 | ACATGGAAGACTAAACTCATGCTTAT TGCTAAATGTGGTCTTTGCCAACT |
| 8035 | HUVEC cDNA | Hs.76869 | U08021 | 494988 | nicotinamide N-methyltransferase (NNMT), mRNA/cds = (117, 911) | 1 | AGACCCCTGTGATGCCTGTGACCTCA ATTAAAGCAATTCCTTTGACCTGT |
| 8036 | HUVEC cDNA | Hs.89657 | U13991 | 582076 | TATA box binding protein (TBP)- associated factor, RNA polymerase II, h, 30 kD (TAF2H), mRNA/ cds = (17, 673) | 1 | CGCACTACTTCACCTGAGCCACCCAA CCTAAATGTACTTATCTGTCCCCA |
| 8037 | HUVEC cDNA | Hs.1516 | U20982 | 695253 | insulin-like growth factor binding protein 4 (IGFBP4) gene promoter and complete | 1 | CTGTAGACTCAGTGCCAGCCCAC AGCTTCAGAGATTGTGCTCACATG GTAT |
| 8038 | HUVEC cDNA | Hs.183648 | U22816 | 930342 | protein tyrosine phosphate, receptor type, I polypeptide (PTPRF), interacting protein (liprin), alpha 1 (PPFIA1), mRNA/cds = (229, 3837) | 1 | TGACAAAGGATTTTACGTTTATAAAAT TATGACAGAAGCCATGTGCCCCG |
| 8039 | HUVEC cDNA | Hs.83383 | U25182 | 799380 | thioredoxin peroxidase (antioxidant enzyme) (ADE372), mRNA/ cds = (43, 828) | 1 | GTCTGCCCTGCTGGCTGGAAACCTG GTAGTGAAACAATAATCCCAGATCC |
| 8040 | HUVEC cDNA | Hs.75888 | U30255 | 984324 | phosphogluconate dehydrogenase (PGD), mRNA/cds = (6, 1457) | 1 | CTCGTCATACAATGCCTGATGGGCTC CTGCTACCCTCCACGTCTCCACAG |
| 8041 | HUVEC cDNA | Hs.169478 | U34995 | 1497857 | Homo sapiens, glyceraldehyde-3- phosphate dehydrogenase, clone MCG:10926 IMAGE:3828129, mRNA, complete cds/cds = (2308, 3313) | 1 | CTAGGGAGCCGCACCTTATCATGTAC CATCAATAAAGTACCCTGTGCTCA |
| 8042 | HUVEC cDNA | Hs.192023 | U39067 | 1718194 | eukaryolic translation initiation factor 3, subunit 2 (beta, 36 kD) (EIF3S2), mRNA/cds = (17, 994) | 1 | TCCGTATCCATTACTTCGACCCACAG TACTTTGAATTTGAGTTTGAGGCT |
| 8043 | HUVEC cDNA | Hs.155637 | U47077 | 13570016 | DNA-dependent protein kinase catalytic subunit (DNA-PKcs) mRNA, complete cds/cds = (57, 12443) | 1 | CCAGTCCTCCACACCCAAACTGTTTC TGATTGGCTTTTAGCTTTTTGTTG |
| 8044 | HUVEC cDNA | Hs.285313 | U51869 | 2745959 | core promoter element binding protein (COPEB), mRNA/cds = (117, 968) | 1 | CTGTTGTCTCTCTGAGGCTGCCAGTT GTTGTGTGTTACCGATGCCAGAAG |
| 8045 | HUVEC cDNA | Hs.184270 | U56637 | 1336098 | capping protein (actin filament) muscle Z-line, alpha 1 (CAPZA1), mRNA/ cds = (0, 860) | 1 | AATATAGTCAAGCAAGTTTGTTCCAG GTGACCCATTGAGCTGTGTATGCA |
| 8046 | HUVEC cDNA | Hs.75064 | U61234 | 1465773 | tubulin-specific chaperone c (TBCC), mRNA/cds = (23, 1063) | 1 | TTTGCTATTTTCGTCATGCCTTTGAGA CTGAGTCTTACTCCGTCCCCCAG |

TABLE 8-continued

| SEQ ID | Origin | Unigene | Locus | GI | Nominal Description | Strand | Probe Sequence |
|---|---|---|---|---|---|---|---|
| 8047 | HUVEC cDNA | Hs.183684 | U73824 | 1857236 | eukaryotic translation initiation factor 4 gamma, 2 (EIF4G2), mRNA/cds = (306, 3029) | 1 | TTGTGGGTGTGAAACAAATGGTGAGA ATTTGAATTGGTCCCTCCTATTAT |
| 8048 | HUVEC cDNA | Hs.165283 | U89278 | 1877500 | early development regulator 2 (homolog of polyhomeotic 2) (EDR2), mRNA/cds = (8, 1309) | 1 | CAGGAAGGAGGTAGGCACCTTTCTG AGCTTATTCTATTCCCCACCCACAC |
| 8049 | HUVEC cDNA | Hs.334703 | W29012 | 1308969 | Homo sapiens, clone IMAGE:3875338, mRNA, partial cds/cds = (0, 930) | 1 | GGGAGCCATCCCTCTCTACCAAGGT GGCAATGATGGAGGGAACTTGCATG |
| 8050 | HUVEC cDNA | Hs.287820 | X02761 | 31396 | mRNA for fibronectin (FN precursor)/cds = (0, 6987) | 1 | TGGCCCGCAATACTGTAGGAACAAG CATGATCTTGTTACTGTGATATTTT |
| 8051 | HUVEC cDNA | Hs.14378 | X04098 | 28338 | actin, gamma 1 (ACTG1), mRNA/cds = (74, 1201) | 1 | GGTTTTCTACTGTTATGTGAACATT AGGCCCCAGCAACACGTCATTGT |
| 8052 | HUVEC cDNA | Hs.290070 | X04412 | 35447 | gelsolin (amyloidosis, Finnish type) (GSN), mRNA/cds = (14, 2362) | 1 | AGCCCTGCAAAAATTCAGAGTCCTTG CAAAATTGTCTAAAATGTCAGTGT |
| 8053 | HUVEC cDNA | Hs.79088 | X06323 | 34753 | mitochondrial ribosomal protein L3 (MRPL3), mRNA/cds = (78, 1122) | 1 | TGGGGACTATAGTGCAACCTATTTGG GTAAAGAAACCATTTGCTAAAATG |
| 8054 | HUVEC cDNA | Hs.287797 | X07979 | 31441 | mRNA for FLJ00043 protein, partial cds/cds = (0, 4248) | 1 | ACCACTGTATGTTTACTTCTCACCATT TGAGTTGCCCATCTTGTTTCACA |
| 8055 | HUVEC cDNA | Hs.87409 | X14787 | 37464 | thrombospandin 1 (THBS1), mRNA/cds/cds = (111, 3623) | 1 | TTGACCTCCCATTTTTACTATTTGCCA ATACCTTTTTCTAGGAATGTGCT |
| 8056 | HUVEC cDNA | Hs.82202 | X53777 | 34198 | ribosomal protein L17 (RPL17), mRNA/cds = (286, 840) | 1 | GAGGAGGTTGCCCAGAAGAAAAAGA TATCCCAGAAGAAACTGAAGAAACA |
| 8057 | HUVEC cDNA | Hs.233936 | X54304 | 34755 | myosin, light polypeptide, regulatory, non-sarcomeric (20 kD) (MLCB), mRNA/cds = (114, 629) | 1 | AACCTACCAGCCCTTCTCCCCAATA ACTGTGGGTCTATACAGAGTCAAT |
| 8058 | HUVEC cDNA | Hs.74405 | X57347 | 32463 | tyrosine 3-monooxygenase/tryptophan 5-monooxygenase activation protein, theta polypeptide (YWHAQ), mRNA/cds = (100, 837) | 1 | AGAGAGTTGGACCACTATTGTGTGTT GCTAATCATTGACTGTAGTCCCAA |
| 8059 | HUVEC cDNA | Hs.77813 | X59960 | 402620 | sphingomyelin phosphodiesterase 1, acid lysosomal (acid sphingomyelinase) (SMPD1), mRNA/cds = (0, 1889) | 1 | CCCTGTACTGCTGCTGCGACCTGATG CTGCCAGTCTGTTAAAATAAAGAT |
| 8060 | HUVEC cDNA | Hs.172690 | X62535 | 30822 | diacylglycerol kinase, alpha (80 kD) (DGKA), mRNA/cds = (103, 2310) | 1 | ACACACATACACACACACCCCAAA ACACATACATTGAAAGTGCCTCAT CTGA |
| 8061 | HUVEC cDNA | Hs.272822 | X63527 | 36127 | RuvB (E. coli homolog)-like 1 (RUVBL1), mRNA/cds = (78, 1446) | 1 | ACCTCCCACTTTGTCTGTACATACTG GCCTCTGTGATTACATAGATCAGC |
| 8062 | HUVEC cDNA | Hs.119529 | X67698 | 37476 | epididymal secretory protein (19.5 kD) (HE1), mRNA/cds = (10, 465) | 1 | AACAACATTAACTTGTGGCCTCTTTCT ACACCTGGAAATTTACTCTTGAA |
| 8063 | HUVEC cDNA | Hs.211579 | X68264 | 433891 | MUC18 gene exons 1&2/cds = (26, 1966) | 1 | TCTCTGCTCAATCTCTGCTTGGCTCC AAGGACCTGGGATCTCCTGGTACG |
| 8064 | HUVEC cDNA | Hs.75061 | X70326 | 38434 | macrophage myrisloylated alanine-rich C kinase substrate (MACMARCKS), mRNA/cds = (13, 800) | 1 | TGTCTTACTCAAGTTCAAACCTCCAG CCTGTGAATCAACTGTGTCTCTTT |
| 8065 | HUVEC cDNA | Hs.31314 | X72841 | 297903 | retinoblastoma-binding protein 7 (RBBP7), mRNA/cds = (287, 1564) | 1 | AACTTTTACACTTTTTCCTTCCAACAC TTCTTGATTGGCTTTGCAGAAAT |
| 8066 | HUVEC cDNA | Hs.79088 | X78869 | 469884 | reticulocalbin, 2, EF-hand calcium binding domain (RCN2), mRNA/cds = (66, 1019) | 1 | TGGTGAGTGGAATTTGACATTGTCCA AACCTTTTTCATTTTTGAGTGATT |
| 8067 | HUVEC cDNA | Hs.7957 | X79448 | 2326523 | adenosine deaminase, RNA-specific (ADAR), transcript variant ADAR-a, mRNA/cds = (187, 3867) | 1 | GAGTGAGGAAGACCCCCAAGCATAG ACTCGGGTACTGTGATGATGGCTGC |
| 8068 | HUVEC cDNA | Hs.76206 | X79981 | 599833 | cadherin 5, type 2, VE-cadherin (vascular epithelium) (CDH5), mRNA/cds = (120, 2474) | 1 | TGGCAAAGCCCCTCACACTGCAAGG GATTGTAGATAACACTGACTTGTTT |
| 8069 | HUVEC cDNA | Hs.172182 | Y00345 | 35569 | poly(A)-binding protein, cytoplasmic 1 (PABPC1), mRNA/cds = (502, 2403) | 1 | GGAAAGGAAACTTTGAACCTTATGTA CCGAGCAAATGCCAGGTCTAGCAA |
| 8070 | HUVEC cDNA | Hs.180414 | Y00371 | 32466 | hsc70 gene for 71 kd heat shock cognate protein | 1 | AGTTAAGATTATTCAGAAGGTCGGGG ATTGGAGCTAAGCTGCCACCTGGT |
| 8071 | HUVEC cDNA | Hs.75216 | Y00815 | 34266 | protein tyrosine phosphatase, receptor type F (PT cds = (370, 6083) | 1 | TTACCTTGTGGATGCTAGTGCTGTAG AGTTCACTGTTGTACACAGTCTGT |
| 8072 | HUVEC cDNA | Hs.65114 | Y07604 | 1945761 | keratin 18 (KRT18), mRNA/cds = (51, 1343) | 1 | GGGGTCTTCACATTATCATAACCTCT CCTCTAAAGGGGAGGCATTAAAAT |
| 8073 | HUVEC cDNA | Hs.113503 | Y08890 | 2253155 | Homo sapiens mRNA for Ran_GTP binding protein 5 (RanBP5(importin5) gene)/cds = (236, 3529) | 1 | TTTCCTTGTGCAATTCAGACTTAAGC ATCGAGTTTTACCATCTTCCACT |
| 8074 | HUVEC cDNA | Hs.44499 | Y09703 | 4581462 | pinin, desmosome associated protein (PNN), mRNA/cds = (30, 2261) | 1 | ACATGTGCAAATAAATGTGGCTTAGA CTTGTGTGACTGCTTAAGACTAAA |
| 8075 | HUVEC cDNA | Hs.8867 | Y11307 | 2791897 | cysteine-rich, angiogenic inducer, 61 (CYR61), mRNA/cds = (80, 1225) | 1 | AAATGTAGCTTTTGGGGAGGGAGGG GAAATGTAATACTGGAATAATTTGT |
| 8076 | HUVEC cDNA | Hs.90061 | Y12711 | 6759555 | progesterone receptor membrane component 1 (PGRMC1), mRNA/cds = (78, 665) | 1 | ACCCACTGCAAAAGTAGTAGTCAAGT GTCTAGGTCTTTGATATTGCTCTT |
| 8077 | HUVEC | Hs.101033 | Y14391 | 6562622 | Pseudoautosomal GTP-binding protein | 1 | GCCTGCTGTGAACTGCTTTCCCTCGG |

TABLE 8-continued

| SEQ ID | Origin | Unigene | Locus | GI | Nominal Description | Strand | Probe Sequence |
|---|---|---|---|---|---|---|---|
| | cDNA | | | | like (PGPL), mRNA/cds = (329, 1540) | | AATGTTTCCGTAACAGGACATTAA |
| 8078 | HUVEC cDNA | Hs.24322 | Y15286 | 2584788 | ATPase, H+ transporting, lysosomal (vacuolar proton pump) 9 kD (ATP6H), mRNA/cds = (82, 307) | 1 | GAAGAGCCATCTCAACAGAATCGCAC CAAACTATACTTTCAGGATGAATT |
| 8079 | HUVEC cDNA | Hs.291904 | Z31696 | 479156 | accessory proteins BAP31/BAP29 (DXS1357E), mRNA/cds = (136, 878) | 1 | AGGAGGGTGGGTGGAACAGGTGGAC TGGAGTTTCTCTTGAGGGCAATAAA |
| 8080 | HUVEC cDNA | Hs.180877 | Z48950 | 761715 | clone PP781 unknown mRNA/ cds = (113, 523) | 1 | TGCTTGATTAAGATGCCATAATAGTG CTGTATTTGCAGTGTGGGCTAAGA |
| 8081 | HUVEC cDNA | Hs.289101 | Z49835 | 860985 | glucose regulated protein, 58 kD (GRP58), mRNA/cds = (0, 1517) | 1 | TTGGGGGAAATGTTGTGGGGGTGGG GTTGAGTTGGGGGTATTTTCTAATT |
| 8082 | HUVEC cDNA | Hs.10340 | AK000452 | 7020548 | hypothetical protein FLJ20445 (FLJ20445), mRNA/cds = (334, 1170) | 1 | AGCATGGTAAACCTGGGTTTTTGTTCA TATTTTCTCCAGACAGAAATGCAA |
| 8083 | HUVEC cDNA | Hs.194676 | AK001313 | 7022490 | tumor necrosis factor receptor superfamily, member 6b, decoy (TNFRSF6B), transcript variant 2, mRNA/cds = (827, 4488) | 1 | GGTCTCTTTGACTAATCACCAAAAAG CAACCAACTTAGCCAGTTTTATTT |
| 8084 | HUVEC cDNA | Hs.808 | AK001364 | 7022577 | heterogaeneous nuclear ribonucleoprotein F (HNRPF), mRNA/ cds = (323, 1570) | 1 | GCCCTTGATGCTGGAGTCACATCTGT TGATAGCTGGAGAACTTTAGTTTC |
| 8085 | HUVEC cDNA | Hs.15978 | AK002211 | 7023952 | cDNA FLJ11349 fis, clone PLACE4000650, weakly similar to TUBERIN/cds = UNKNOWN | 1 | GCCGATTCCAAGCGAGGGATTTAATC CTTACATTTTTGCCCATTTGGCTC |
| 8086 | HUVEC cDNA | Hs.29692 | AK021498 | 10432693 | cDNA FLJ11436 fis, clone HEMBA1001213/cds = UNKNOWN | 1 | TTCCCTGGACAGTTTGATGTGCTTAT GGTTGAGATTTATAATCTGCTTGT |
| 8087 | HUVEC cDNA | Hs.109672 | AK023900 | 10435975 | Homo sapiens. Similar to sialytransferase 7 ((alpha-N-acetylneuraminyl 2,3-betagalactosyl-1,3)-N-acetyl galactosaminide alpha-2,6-slaytransferase) F, clone MGC:14252 IMAGE:4128833, mRNA, complete cds/cds = (128, 1129) | 1 | GGCGGTGACTGCCCCAGACTTGGTT TTGTAATGATTTGTACAGGAATAAA |
| 8088 | HUVEC cDNA | Hs.25635 | AK024039 | 10436304 | cDNA FLJ13977 fis, clone Y79AA1001603, weakly similar to POLYPEPTIDE N-ACETYLGALACTOSAMINYL-TRANSFERASE (EC 2.4.1.41)/cds = (418, 1791) | 1 | TGACCATTTGGAGGGGCGGGGCCTC CTAGAAGAACCTTCTTAGACAATGG |
| 8089 | HUVEC cDNA | Hs.288967 | AK024167 | 10438481 | cDNA FLJ14105 fis, clone MAMMA1001202/cds = UNKNOWN | 1 | CAGTCCTCACACCAGCCAAGGTCACA GGCAAGAGCAAGAAGAGAAACTGA |
| 8090 | HUVEC cDNA | Hs.25001 | AK024230 | 10436557 | cDNA FLJ14168 fis, clone NT2RP2001440, highly similar to mRNA for 14-3-3gamma/ cds = UNKNOWN | 1 | CCTCAGTGATGGAATATCATGAATGT GAGTCATTATGTAGCTGTCGTACA |
| 8091 | HUVEC cDNA | Hs.6101 | AK025006 | 10437439 | hypothetical protein MGC3716 (MGC3178), mRNA/cds = (81, 1055) | 1 | ACACACAACTTCAGCTTTGCATCACG AGTCTTGTATTCCAAGAAAATCAA |
| 8092 | HUVEC cDNA | Hs.322680 | AK025200 | 10437664 | cDNA; FLJ21547 fis, clone COL08206/ cds = UNKNOWN | 1 | GGAAATTTCGCACCAGAGGACCCACC ACGTCCTCGCTTCGACATCTTGAAC |
| 8093 | HUVEC cDNA | Hs.288061 | AK025375 | 10437878 | actin, beta (ACTB), mRNA/ cds = (73, 1200) | 1 | GGAGGCAGCCAGGGCTTACCTGTAC ACTGACTTGAGACCAGTTGAATAAA |
| 8094 | HUVEC cDNA | Hs.288869 | AK025842 | 10438480 | nuclear receptor subfamily 2, group F, member 2 (NR2F2), mRNA/ cds = (342, 1588) | 1 | CAGAGAAAGAAAAGGCAAAAGACTG GTTTGTTTGCTTAATTTCCTTCTGT |
| 8095 | HUVEC cDNA | Hs.251653 | AK026594 | 10439481 | tubulin beta, 2 (TUBB2), mRNA/ cds = (0, 1337) | 1 | GAAAGCAGGGAAGCAGTGTGAACTC TTTATTCACTCCCAGCCTGTCCTGT |
| 8096 | HUVEC cDNA | Hs.334842 | AK026632 | 10439528 | tubulin, alpha, ubiquitous (K-ALPHA-1), mRNA/cds = (67, 1422) | 1 | TGGTTAGATTGTTTTCACTTGGTGAT CATGTCTTTTCCATGTGTACCTGT |
| 8097 | HUVEC cDNA | Hs.288036 | AK026650 | 10439548 | tRNA isopentenylpyrophosphate transferase (IPT), mRNA/ cds = (60, 1040) | 1 | TGCATCGTAAAACCTTCAGAAGGAAA GGAGAATGTTTTGTGGACCACTTT |
| 8098 | HUVEC cDNA | Hs.324406 | AK026741 | 10439662 | ribosomal protein L41 (RPL41), mRNA/cds = (83, 160) | 1 | TGGACCTGTGACATTCTGGACTATTT CTGTGTTTATTTGTGGCCGAGTGT |
| 8099 | HUVEC cDNA | Hs.274388 | AK026775 | 10439706 | MSTP032 protein (MSTP032), mRNA/ cds = (68, 319) | 1 | TGCAACTAGCAACTCATCTTCGGAAG ACACAGCCAGGAGAATGAAGTAGA |
| 8100 | HUVEC cDNA | Hs.289071 | AK027187 | 10440255 | cDNA; FLJ22245 fis, clone HRC02612/ cds = UNKNOWN | 1 | GACTTCCTCTCTGCGAGCTTCTACT TCTAAGTCTGAATCCAGTCAGAAA |
| 8101 | HUVEC cDNA | Hs.334788 | BG385658 | 13278634 | hypothetical protein FLJ14639 (FLJ14639), mRNA/cds = (273, 689) | 1 | GTTTCTCTTTGGTTTTCCAGATTTTCT TTAGAACGGTGACTGACCCTCCT |
| 8102 | HUVEC cDNA | NA | NC_002090 | 9507429 | many cloning vectors, kanamycin resistance, gene | 1 | CTGAGCAATAACTAGCATAACCCCTT GGGGCCTCTAAACGGGTCTTGAGG |
| 8103 | HUVEC cDNA | NA | IJ07360 | 478289 | Human DXS1178 locus dinucleotide repeat polymorphism sequence | 1 | TGCCCATTTCACATTGCTCATTACTCA TGCAAATTTCTTCTTGCTAACCT |
| 8104 | HUVEC cDNA | Hs.230165 | AA449779 | 316529 | zx09e02.s1 cDNA, 3' end/ clone = IMAGE:785978/clone_end = 3' | 1 | ACCCACCATTGGTAAAATATTCAGGG GAACTTGGTTAAAAGTTTATGCT |
| 8105 | HUVEC cDNA | NA | AI000459 | 3191013 | c107c08.s1 NCI_CGAP_GC3 cDNA clone IMAGE:1914158 3' similar to | 1 | GTCAAATAAGGTTGTTCTTTCCTTGAA GGACAGCACCCATGCCACAGCAC |

TABLE 8-continued

| SEQ ID | Origin | Unigene | Locus | GI | Nominal Description | Strand | Probe Sequence |
|---|---|---|---|---|---|---|---|
| 8106 | HUVEC cDNA | Hs.172922 | AI06204 | 3230540 | gb:700361 60S RIBOSOMAL PROTEIN (HUM ot83f03.s1 cDNA, 3' end/ clone = IMAGE:1823389/clone_end = 3' | 1 | CTGGAAAAACATCACATGGTTGAGTC AAGGATGAAAAGTCAAACTACCT |
| 8107 | HUVEC cDNA | Hs.96457 | AI081571 | 3418383 | ox59h10.s1 cDNA, 3' end/ clone = IMAGE:1660675/clone_end = 3' | 1 | ATCCATCCAATAAACACAGCAACACC CTATGCTACTGACCAAGCAAAGCT |
| 8108 | HUVEC cDNA | NA | AI082318 | 3419110 | ox72c08.x1 Soares_NhHMPu_S1 cDNA clone IMAGE:1661870 3' similar to gb:X63527 60S RIBOSOMAL PROTEIN | 1 | TAGTTAGAGTCCAAGACATGGTTCCT CCCCCTTTGTCTGTACATCCTGGC |
| 8109 | HUVEC cDNA | Hs.145222 | AI187426 | 3738064 | qf31d08.x1 cDNA, 3' end/ clone = IMAGE:1751631/clone_end = 3' | 1 | CAGCCTGCCTGCTTGCCATTTTTCTT CCCCTTCCATTTTTCTAACCTCAG |
| 8110 | HUVEC cDNA | Hs.273194 | AI285483 | 3923716 | ty56b02.x1 cDNA, 3' end/ clone = IMAGE:2283051/clone_end = 3' | 1 | ACTTCCTCCCCCTCCCCCTAGCATTA CTTATATGATATGTTTCCATACCC |
| 8111 | HUVEC cDNA | Hs.238797 | AI307808 | 4002412 | 602081661F1 cDNA, 5' end/ clone = IMAGE:4245999/clone_end = 3' | 1 | AAGGAATTTGTTTTCCCTATCCTAACT CAGTAACAGAGGGTTTACTCCGA |
| 8112 | HUVEC cDNA | Hs.135872 | AW028193 | 5886949 | wv61h08.x1 cDNA, 3' end/ clone = IMAGE:2534079/clone_end = 3' | 1 | TTTGCATCCCGAGTTTTGTATTCCAA GAAAATCAAAGGGGGCCAATTTGT |
| 8113 | HUVEC cDNA | Hs.244816 | AW078847 | 603399 | xb18g07.x1 cDNA, 3' end/ clone = IMAGE:2576700/clone_end = 3' | 1 | AAACAGGAAGGGGGTTTGGGCCCTT TGATCAACTGGAACCTTTGGATCAAG |
| 8114 | HUVEC cDNA | Hs.249863 | AW162315 | 6301348 | au66d07.x1 cDNA, 3' end/ clone = IMAGE:2781229/clone_end = 3' | 1 | AAAAACGGTTTATGGGGGTAGGGAAA CAGGCCGAAAAGAACGTGGAGAAA |
| 8115 | HUVEC cDNA | Hs.329930 | AW170757 | 6402282 | xj4207.x1 cDNA, 3' end/ clone = IMAGE:2658180/clone_end = 3' | 1 | GGGGACTCAGGCCCCCGCTGGGGGT CCCACATAGGGTTTTATCCAAAAA |
| 8116 | HUVEC cDNA | Hs.23349 | AW237511 | 6569900 | nab70e03.x1 cDNA, 3' end/ clone = IMAGE:3273292/clone_end = 3' | 1 | TGTTGTTGGATACGTACTTAACTGGT ATGCATCCCATGTCTTTGGGTACT |
| 8117 | HUVEC cDNA | NA | BE672733 | 10033274 | 7b75g07.x1 NCI_CGAP_Lu24 cDNA clone IMAGE:3234108 3' similar to TR:O99231 O99231 CYTOCHROME OXIDASE | 1 | TGAGAGCACACCATAAATTCACAGCA GGAATAAACGAAGACACACGAGCA |
| 8118 | HUVEC cDNA | Hs.288443 | BF110312 | 10940002 | 7n36d08.x1 cDNA, 3' end clone = IMAGE:3566654/clone_end = 3' | 1 | ACCAGGGCTTAAAACCTCAATTTATG TTCATGACAGTGGGGATTTTCTT |
| 8119 | HUVEC cDNA | Hs.111301 | J03210 | 180670 | matrix metalloproteinase 2 (gelatinase A, 72 kD gelatinase, 72 kD type IV collagenase) (MMP2), mRNA/ cds = (289, 2271) | 1 | AGCCATAGAAGGTGTTCAGGTATTGC ACTGCCAACTCTTTGTCCGTTTTG |
| 8120 | HUVEC cDNA | Hs.82085 | M14083 | 189566 | serine (or cysteine) proteinase inhibitor, clade E (nexin, plasminogen activator inhibitor type 1), member 1 (SERPINE1), mRNA/cds = (75, 1283) | 1 | CCATGCCCTTGTCATCAATCTTGAAT CCCATAGCTGCTTGAATCTGCTGC |
| 8121 | HUVEC cDNA | Hs.80120 | Y10343 | 2292903 | UDP-N-acetyl-alpha-D-galactosamine:polypeptide N-acetylgalactosaminyltransferase 1 (FalNAc-T1) (GALNT1), mRNA/ cds = (31, 1710) | 1 | TTAAGAATGTGGCAGAAATGTATGCT GAGGTAGCCCAGTCAATCCTTATT |
| 8122 | HUVEC cDNA | Hs.10340 | AK000452 | 7020548 | hypothetical protein FLJ20445 (FLJ20445), mRNA/cds = (334, 1170) | 1 | ATCAGTAGCAAAACAAACCCAGCAAC TTCTGTCCAGCATCTGCTGTAGGG |
| 8123 | HUVEC cDNA | Hs.73742 | AK001313 | 7022490 | cDNA FLJ10451 fis, clone NT2RP1000959, highly similar to acidic ribosomal phosphoprotein PD mRNA/cds = UNKNOWN | 1 | CCCATCTAACTAGCACACGAACCTTC CACGAGGACGCCTGGCGAGAGAAG |
| 8124 | HUVEC cDNA | Hs.808 | AK001364 | 7022577 | heterogeneous nuclear ribonucleoprotein F (HNRPF), mRNA/ cds = (323, 1570) | 1 | GAACTTGGCAGTTGTAGCAGAGGCA GTTGAGGCTTGTTGACCATCACCAT |
| 8125 | HUVEC cDNA | Hs.15978 | AK002211 | 7023952 | cDNA FLJ11349 fis, clone PLACE4000650, weakly similar to TUBERIN/cds = UNKNOWN | 1 | CGCTCTCTCCTGCACAGCACCACCAC CAACAGTCTGGATGATTTTAGGCA |
| 8126 | HUVEC cDNA | Hs.29692 | AK021498 | 10432693 | cDNA FLJ11436 fis, clone HEMBA1001213/cds = UNKNOWN | 1 | TTTTGGGAAGAAAACCCTATGCATCT GAAATACAATTGGCAATGGAAGCT |
| 8127 | HUVEC cDNA | Hs.109672 | AK023900 | 10435975 | Homo sapiens. Similar to sialytransferase 7 ((alpha-N-acetylneuraminyl 2,3-betagalactosyl-1,3)-N-acetyl galactosaminide alpha-2,6-sialytransferase) F, clone MGC:14252 IMAGE:4128833, mRNA, | 1 | CTCTTTGTTGCTACTCATTTCTCTCCG GCGTCTGCTGAGGGGTAGGTGTC |

TABLE 8-continued

| SEQ ID | Origin | Unigene | Locus | GI | Nominal Description | Strand | Probe Sequence |
|---|---|---|---|---|---|---|---|
| 8128 | HUVEC cDNA | Hs.25835 | AK024039 | 10436304 | cDNA FLJ13977 fis, clone Y79AA1001603, weakly similar to POLYPEPTIDE N-ACETYLGALACTOSAMINYL-TRANSFERASE (EC 2.4.1.41)/cds = (418, 1791) complete cds/cds = (126, 1129) | 1 | CACCTTCCTCTTGGTTACCCAGAAGA ACAGCAGCACCGTGATCCAGAGCA |
| 8129 | HUVEC cDNA | Hs.288967 | AK024167 | 10436481 | cDNA FLJ14105 fis, clone MAMMA1001202/cds = UNKNOWN | 1 | CTGTACATCTGCATCCCAGCAAAGAG CAGCAGGGACAGGAGGGAGGAGAG |
| 8130 | HUVEC cDNA | Hs.25001 | AK024230 | 10438557 | cDNA FLJ14168 fis, clone NT2RP2001440, highly similar to mRNA for 14-3-3gamma/ cds = UNKNOWN | 1 | CACAGACAGAAGGTTTCGTTCCTCAT TCGACAGTGGCTCATTCAGCTCTG |
| 8131 | HUVEC cDNA | Hs.6101 | AK025006 | 10437439 | hypothetical protein MGC3178 (MGC3178), mRNA/cds = (81, 1055) | 1 | TCAAGATTGGCAATTCACTGTGCCCA TTAAACCACTCAGTAGCTCAGCCT |
| 8132 | HUVEC cDNA | Hs.322680 | AK025200 | 10437664 | cDNA; FLJ21547 fis, clone COL08206/ cds = UNKNOWN | 1 | AGTTGTCCTGAGAGTTTTACACTTGT GAGAAAATACTGGCAGCTTTGATT |
| 8133 | HUVEC cDNA | Hs.288061 | AK025375 | 10437878 | actin, beta (ACTB), mRNA/ cds = (73, 1200) | 1 | CACATAGGAATCCTTCTGACCCATGC CCACCATACACGCCCTGGTGCCTGG |
| 8134 | HUVEC cDNA | Hs.288869 | AK025842 | 10438480 | nuclear receptor subfamily 2, group F, member 2 (NR2F2), mRNA/ cds = (342, 1586) | 1 | AACAGGAACCTTTATCTCTTTGTGAG GCGATTTGCATTCTCCACACAGGC |
| 8135 | HUVEC cDNA | Hs.251653 | AK026594 | 10439481 | tubulin, beta, 2 (TUBB2), mRNA/ cds = (0, 1337) | 1 | GTACTTGCCGCCGGTGGCCTCATTG AGTACACGTTGATGCGTTCCAGCT |
| 8136 | HUVEC cDNA | Hs.278242 | AK026632 | 10439528 | Homo sapiens, clone MGC:3214 IMAGE:3502620, mRNA, complete cds/cds = (2066, 3421) | 1 | ATAGTGGCTAGGGATTAGGAGGCGA AGGCGACAGGAGCAGACACCGGGTC |
| 8137 | HUVEC cDNA | Hs.181165 | AK026850 | 10439548 | eukaryotic translation elongation factor 1 alpha 1 (EEF1A1), mRNA/ cds = (53, 1441) | 1 | CATTTTGGCTTTTAGGGGTAGTTTTC ACGACACCTGTGTTCTGGCGGCAA |
| 8138 | HUVEC cDNA | Hs.108124 | AK026741 | 10439662 | cDNA; FLJ23088 fis, clone LNG07026/ cds = UNKNOWN | 1 | CCCTGGTTCAGGAATTAAGGGGACA GACTTGAATAAGAAACAAAACAAAA |
| 8139 | HUVEC cDNA | Hs.274368 | AK026775 | 10439706 | MSTP032 protein (MSTP032), mRNA/ cds = (88, 319) | 1 | ACAGTAGAGAATTTGAGTACACAGGG TATGGAGAGTAGGGCACAAAATGT |
| 8140 | HUVEC cDNA | Hs.241507 | AK027187 | 10440255 | cDNA; FLJ23534 fis, clone LNG06974, highly similar to HUMRPS6A ribosomal protein S6 mRNA/cds = UNKNOWN | 1 | GAACAGCCTCGTCTTTCCCCGAATGC CAGGCAGGATGACGATGAACGTGG |
| 8141 | HUVEC cDNA | Hs.334788 | BG392671 | 13286119 | hypothetical protein FLJ14639 (FLJ14639), mRNA/cds = (273, 689) | 1 | GACCTCCAGAATTTCCTCATCGCTGT CGGTGACCAAGTCCACAGACACTA |
| 8142 | HUVEC cDNA | NA | NC_002090 | 9507429 | many cloning vectors, kanamycin resistance, gene | 1 | TCTTGCCATCCTATGGAACTGCCTCG GTGAGTTTTCTCCTTCATTACAGA |
| 8143 | HUVEC cDNA | NA | U07360 | 476289 | Human DXS1178 locus dinucleotide repeat polymorphism sequence | 1 | TGTTACTCCTTCAAGCCCCTGAATCA CTATAGCCACGACTCTCCAACTGA |

TABLE 9

Viral genomes were used to design oligonucleotides for the microarrays. The accession numbers for the viral genomes used are given, along with the gene name and location of the region used for oligonucleotide design.

| Virus | Gene Name | Genome Location |
|---|---|---|
| Adenovirus, type 2 Accession #J01917 | E1a | 1226 . . . 1542 |
| | E1b_1 | 3270 . . . 3503 |
| | E2a_2 | complement(24089 . . . 25885) |
| | E3-1 | 27609 . . . 29792 |
| | E4 (last exon at 3'-end) | complement(33193 . . . 32802) |
| | IX | 3576 . . . 4034 |
| | Iva2 | complement(4081 . . . 5417) |
| | DNA Polymerase | complement(5187 . . . 5418) |
| Cytomegalovirus (CMV) Accession #X17403 | HCMVTRL2 (IRL2) | 1893 . . . 2240 |
| | HCMVTRL7 (IRL7) | complement(6595 . . . 6843) |
| | HCMVUL21 | complement(26497 . . . 27024) |
| | HCMVUL27 | complement(32831 . . . 34657) |
| | HCMVUL33 | 43251 . . . 44423 |
| | HCMVUL54 | complement(76903 . . . 80631) |
| | HCMVUL75 | complement(107901 . . . 110132) |
| | HCMVUL83 | complement(119352 . . . 121037) |
| | HCMVUL106 | complement(154947 . . . 155324) |
| | HCMVUL109 | complement(157514 . . . 157810) |
| | HCMVUL113 | 161503 . . . 162800 |
| | HCMVUL122 | complement(169364 . . . 170599) |
| | HCMVUL123 (last exon at 3'-end) | complement(171006 . . . 172225) |
| | HCMVUS28 | 219200 . . . 220171 |
| Epstein-Barr virus (EBV) Accession # NC_001345 | Exon in EBNA-1 RNA | 67477 . . . 67649 |
| | Exon in EBNA-1 RNA | 98364 . . . 98730 |
| | BRLF1 | complement(103366 . . . 105183) |
| | BZLF1 (first of 3 exons) | complement(102655 . . . 103155) |
| | BMLF1 | complement(82743 . . . 84059) |
| | BALF2 | complement(161384 . . . 164770) |
| Human Herpesvirus 6 (HHV6) | U16/U17 | complement(26259 . . . 27349) |
| | U89 | complement(133091 . . . 135610) |
| | U90 | complement(135664 . . . 135948) |

TABLE 9-continued

Viral genomes were used to design oligonucleotides for the microarrays. The accession numbers for the viral genomes used are given, along with the gene name and location of the region used for oligonucleotide design.

| Virus | Gene Name | Genome Location |
|---|---|---|
| Accession # NC_001664 | U86 | complement(125989 ... 128136) |
| | U83 | 123528 ... 123821 |
| | U22 | complement(33739 ... 34347) |
| | DR2 (DR2L) | 791 ... 2653 |
| | DR7 (DR7L) | 5629 ... 6720 |
| | U95 | 142941 ... 146306 |
| | U94 | complement(141394 ... 142866) |
| | U39 | complement(59588 ... 62080) |
| | U42 | complement(69054 ... 70598) |
| | U81 | complement(121810 ... 122577) |
| | U91 | 136485 ... 136829 |

TABLE 10A

Lupus gene expression markers

| Oligo/ SEQ ID | Source | Unigene | Acc | GI | SEQ ID (Acc) | Name | Strand | SAM FDR | CART |
|---|---|---|---|---|---|---|---|---|---|
| 41 | cDNA T-cells | Hs.166120 | NM_004031 | 4809287 | 8845 | interferon regulatory factor 7 (IRF7) | 1 | 1.1 | NA |
| 328 | Tabel 3A | NA | NA | NA | 8846 | 53G7 | 1 | NA | surrogate |
| 668 | Table 3A | Hs.169895 | NM_004223 | 4759281 | 8847 | ubiquitin-conjugating enzyme E2L 6 | 1 | 1.6 | NA |
| 855 | Table 3A | Hs.135187 | NM_030930 | 13569892 | 8848 | unc93 (C. elegans) homolog B | 1 | 1.1 | NA |
| 981 | Table 3A | Hs.17448 | AK023680 | 10435678 | 8849 | cDNA FLJ13618 fis | 1 | 1.6 | NA |
| 1001 | Table 3A | Hs.85155 | NM_004926 | 15812179 | 8850 | zinc finger protein 36, C3H type-like 1 | 1 | NA | Model II (5 gene) 3rd Splitter |
| 1003 | Table 3A | Hs.24115 | AK024240 | 10436567 | 8851 | cDNA FLJ14178 fis | 1 | NA | Model II (5 gene) Secondary Splitter |
| 1025 | Table 3A | Hs.12293 | NM_024556 | 13375720 | 8852 | hypothetical protein FLJ21103 | 1 | NA | Model II (3 gene) Secondary Splitter |
| 1035 | Table 3A | Hs.166254 | NM_030938 | 20070348 | 8853 | VMP1 ortholog of rat vacuole protein 1 | 1 | NA | surrogate |
| 1227 | Table 3A | Hs.322456 | NM_032039 | 14042969 | 8854 | hypothetical protein DKFZp761D0211 | 1 | NA | surrogate |
| 1341 | Table 3A | Hs.181165 | AV756188 | 10914036 | 8855 | eukaryotic translation elongation factor | 1 | 1.6 | NA |
| 1390 | Table 3A | Hs.238990 | NM_004064 | 17978497 | 8856 | EST IMAGE:3458141, Similar to p27, Kip1, | 1 | 1.1 | NA |
| 1436 | Table 3A | Hs.288061 | NM_001101 | 5016088 | 8857 | actin, beta (ACTB) | 1 | NA | Model I (3 gene) Secondary Splitter |
| 1535 | Table 3A | Hs.356755 | BE868389 | 10317165 | 8858 | tripartite motif protein 14 (TRIM14) | 1 | 1.6 | NA |
| 1750 | Table 3A | Hs.198253 | NM_002122 | 18426974 | 8859 | HLA-DQA1 | 1 | 1.1 | NA |
| 2102 | Table 3A | Hs.301921 | NM_001295 | 4502630 | 8860 | chemokine (C-C motif) receptor1 (CCR1) | 1 | 1.6 | NA |
| 2331 | Table 3A | Hs.172182 | NM_002568 | 4505574 | 8861 | poly(A)-binding protein, cytoplasmic 1 | 1 | 1.6 | NA |
| 2386 | Table 3A | Hs.63489 | NM_002831 | 18104988 | 8862 | protein tyrosine phosphatase, PTPN6 | 1 | 1.6 | NA |
| 2412 | Table 3A | Hs.79411 | NM_002946 | 4506584 | 8863 | replication protein A2 | 1 | 1.1 | Model I (2 gene) Primary Splitter |
| 2560 | literature | Hs.1524 | NM_003811 | 4507608 | 8864 | TNF (ligand) superfamily, member 9 (TNFSF9) | 1 | 1.6 | NA |
| 2648 | Table 3A | Hs.38125 | NM_080424 | 17986253 | 8865 | SP110 nuclear body protein | 1 | 1.6 | Model I (2 gene) Primary Splitter |
| 2895 | Table 3A | Hs.18420 | NM_006289 | 16753232 | 8866 | talin 1 (TLN1) | 1 | 1.1 | NA |
| 3249 | Table 3A | Hs.7104 | NM_015995 | 7706289 | 8867 | cDNA DKFZp761P06121 | 1 | NA | surrogate |
| 3305 | Table 3A | Hs.183125 | NM_016523 | 7705573 | 8868 | killer cell lectin-like receptor subfamily F | 1 | 1.6 | NA |
| 3541 | literature | Hs.170222 | R14692 | 768965 | 8869 | Na+/H+ exchanger NHE-1 isoform | 1 | 1.6 | NA |
| 3692 | Table 3A | Hs.173334 | W47229 | 1331869 | 8870 | ELL-RELATED RNA POLYMERASE II | 1 | 1.1 | NA |
| 3701 | Table 3A | Hs.1103 | NM_000660 | 10863872 | 8871 | transforming growth factor, | 1 | 1.6 | NA |

TABLE 10A-continued

Lupus gene expression markers

| Oligo/ SEQ ID | Source | Unigene | Acc | GI | SEQ ID (Acc) | Name | Strand | SAM FDR | CART |
|---|---|---|---|---|---|---|---|---|---|
| | | | | | | beta 1 (TGFB1) | | | |
| 3741 | Table 3A | Hs.198951 | NM_002229 | 4504808 | 8872 | jun B proto-oncogene (JUNB) | 1 | 1.1 | NA |
| 3825 | Table 3A | Hs.3416 | NM_001122 | 4557260 | 8873 | adipose differentiation-related protein (ADFP) | 1 | 1.1 | NA |
| 3827 | Table 3A | Hs.139262 | NM_017523 | 8923794 | 8874 | XIAP associated factor-1 (HSXIAPAF1) | 1 | 2.67 | NA |
| 3832 | Table 3A | Hs.172182 | NM_002568 | 4505574 | 8875 | poly(A)-binding protein, cytoplasmic 1 | 1 | 1.6 | NA |
| 4149 | Literature | Hs.74621 | NM_000311 | 4506112 | 8876 | prion protein (p27–30) (PRNP) | 1 | 1.6 | NA |
| 4400 | db mining | NA | AF073705 | 3335589 | 8877 | immunoglobulin lambda light chain variable region 4a | 1 | 1.1 | NA |
| 4601 | literature | Hs.149609 | NM_002205 | 4504750 | 8878 | Integrin, alpha 5 (fibronectin receptor) | 1 | 1.6 | NA |
| 4604 | db mining | Hs.169824 | NM_002258 | 4504878 | 8879 | killer cell lectin-like receptor subfamily B, member 1 | 1 | 1.1 | NA |
| 4631 | literature | Hs.73839 | NM_002935 | 4506550 | 8880 | ribonuclease, RNase A family, 3 | 1 | 1.1 | NA |
| 4637 | db mining | Hs.301698 | NM_003033 | 4506950 | 8881 | beta-galactoside alpha-2,3-sialyltransferase (SIAT4A) | 1 | NA | NA |
| 5067 | Table 3B | Hs.356291 | W16552 | 1290934 | 8882 | capicua protein (CIC) mRNA | 1 | 0 | Model II (1 gene) Primary Splitter |
| 5074 | db mining | NA | AA701193 | 2704358 | 8883 | EST Soares_fetal_liver_spleen IMAGE: 461188 3' | -1 | 1.6 | NA |
| 5468 | Table 3A | Hs.229990 | AI818777 | 5437856 | 8884 | EST IMAGE: 2424619 | -1 | 1.6 | NA |
| 5531 | Table 3A | Hs.77393 | AL567986 | 12921892 | 8885 | farnesyl diphosphate synthase | -1 | 1.6 | NA |
| 5607 | db mining | Hs.279105 | AW063509 | 8887446 | 8886 | TN1012 cDNA | -1 | 1.6 | NA |
| 6382 | Table 3A | Hs.179665 | NM_078467 | 17978494 | 8887 | cyclin-dependent kinase inhibitor 1A (p21, Cip1) | 1 | 1.6 | NA |
| 6956 | Table 3B | NA | BM852711 | 19209110 | 8888 | ESTT (Negative stand probe to Hs.17481) | 1 | 1.1 | NA |
| 7238 | db mining | Hs.56009 | NM_006187 | 5453823 | 8889 | 2'-5'-oligoadenylate synthetase 3 | 1 | 1.1 | NA |
| 7330 | db mining | Hs.226307 | NM_004900 | 4758159 | 8890 | phorbolin | 1 | 0.25 | NA |
| 7641 | db mining | Hs.100217 | NM_005892 | 5174400 | 8891 | formin-like (FMNL) | 1 | 1.6 | NA |
| 8015 | HUVEC cDNA | Hs.198281 | NM_002654 | 4505838 | 8892 | pyruvate kinase, muscle (PKM2) | 1 | 1.6 | NA |
| 8095 | HUVEC cDNA | Hs.251653 | NM_006088 | 20127490 | 8893 | tubulin, beta, 2 (TUBB2) | 1 | 1.6 | NA |

TABLE 10B

PCR Primers for lupus marker genes

| SEQ ID | PRIMER SET 1 | | Tm | SEQ ID | Primer Set 2 | Tm | SEQ ID |
|---|---|---|---|---|---|---|---|
| 41 | FORWARD | GAAGAGCCTGGTCCTGGTGA | 62.74 | 8894 | TGACGACATCGAGTGCTTCC | 62.41 | 8895 |
| | REVERSE | AGAGGCTGAGGCTGCTGCTA | 62.82 | 8896 | CAGCTCTAGGTGGGCTGCTC | 62.56 | 8897 |
| 328 | FORWARD | GCCCAAGGGTGAAAACTGTG | 62.77 | 8898 | TGGGTCTGCTGCTGTCTGTC | 62.67 | 8899 |
| | REVERSE | TCCGTCGTTGACTTGTGTCC | 62.15 | 8900 | AGGACGGGGATGGACGTATC | 63.32 | 8901 |
| 668 | FORWARD | TACATTCCCCAGAGCCAAGG | 62.28 | 8902 | GCCTGCTTGCAGGAAATGAA | 63.63 | 8903 |
| | REVERSE | GCCTGCAAGGTGACCTGTCT | 62.79 | 8904 | CTCCCACCCATATGCTCCAC | 62.63 | 8905 |
| 855 | FORWARD | TACATTCCCCAGAGCCAAGG | 62.28 | 8906 | GCCTGCTTGCAGGAAATGAA | 63.63 | 8907 |
| | REVERSE | GCCTGCAAGGTGACCTGTCT | 62.79 | 8908 | CTCCCACCCATATGCTCCAC | 62.63 | 8909 |
| 981 | FORWARD | CCGTAATCTTAAAGAGAAAATCTTTGGA | 62.24 | 8910 | CCCGTAATCTTAAAGAGAAAATCTTTGG | 63.41 | 8911 |
| | REVERSE | TCACTCAGAAATGGAACTTTTACCTG | 61.95 | 8912 | TCACTCAGAAATGGAACTTTTACCTGT | 62.55 | 8913 |
| 1001 | FORWARD | TGGATTCCAGGTCTGGAGTTTT | 62.09 | 8914 | CACGTGCCCATCTCAAGACA | 63.3 | 8915 |
| | REVERSE | CGACGGTAGTGACCAGCAAG | 61.84 | 8916 | ATGTGTGTGTGCCAGTTCTGTTT | 61.82 | 8917 |
| 1003 | FORWARD | GCCTCTCAACTGAGCAGTAAAGGT | 62.42 | 8918 | GCAGTAAAGGTAAGGAGAGCTCAATC | 62.1 | 8919 |
| | REVERSE | TGAAGTCTCAAGTGGGCATGA | 61.79 | 8920 | TGAAGTCTCAAGTGGGCATGA | 61.79 | 8921 |
| 1025 | FORWARD | AACCCACTCCCCAGGCTAGA | 63.2 | 8922 | GCCGCCTGTTCAAGTTCAAG | 63.16 | 8923 |
| | REVERSE | ATCCAGACCCCGAGTCCTTC | 62.71 | 8924 | CACATTGGTGTGCTGTGTGG | 62.16 | 8925 |
| 1035 | FORWARD | ATGGCAGCCTTGCCTAATCC | 63.58 | 8926 | TGCATGAGAGCCACTACCA | 61.95 | 8927 |
| | REVERSE | TATGCAGCAGCCCAGTTTCA | 62.83 | 8928 | AGGTAGGCCAATCCCAGAGG | 62.62 | 8929 |

TABLE 10B-continued

PCR Primers for lupus marker genes

| SEQ ID | PRIMER SET 1 | | Tm | SEQ ID | Primer Set 2 | Tm | SEQ ID |
|---|---|---|---|---|---|---|---|
| 1227 | FORWARD | ACCTCTGTGCCTTGCTGCTC | 63.06 | 8930 | ATCCCAAGGAACTGGCTGTG | 62.4 | 8931 |
| | REVERSE | ATCAGGCTGCTTTGGCTACG | 62.72 | 8932 | GCCTCTTCAGGGACAGAGCA | 63.01 | 8933 |
| 1341 | FORWARD | AAGGATTGATCGCCGTTTTG | 62.22 | 8934 | CTGAACCATCCAGGCCAAAT | 62.17 | 8935 |
| | REVERSE | TGGGCCTGACAAGAACCATT | 62.76 | 8936 | ACGGCGATCAATCCTTTCCT | 63.1 | 8937 |
| 1390 | FORWARD | TGGCATGTTTTGTGCATTTGT | 62.27 | 8938 | AAGCCAAAGTGGCATGTTTTG | 62.27 | 8939 |
| | REVERSE | CTTGGCTCAGTATGCAACCTTTT | 61.81 | 8940 | GGCTCAGTATGCAACCTTTTAAGC | 62.48 | 8941 |
| 1436 | FORWARD | GCCGAGGACTTTGATTGCAC | 63.04 | 8942 | GAACGGTGAAGGTGACAGCA | 62.29 | 8943 |
| | REVERSE | GAAGTGGGGTGGCTTTTAGGA | 62.55 | 8944 | AATCAAAGTCCTCGGCCACA | 62.89 | 8945 |
| 1535 | FORWARD | TCCACACCATGGGCAGAAC | 63.02 | 8946 | CAGGGCCTGGGTTTGAATAA | 62.08 | 8947 |
| | REVERSE | GGCCCTGCAATTATTCAAACC | 62.69 | 8948 | TTGATTGCTGAATGGGAGAGG | 62.41 | 8949 |
| 1750 | FORWARD | CCCTTGGTGTCTGGAAGCAC | 63.01 | 8950 | TTAGGTAGCTGGGCGGCTTA | 62.06 | 8951 |
| | REVERSE | GTCTGTGCCTTGGGGTTGTC | 62.89 | 8952 | GGTGCTTCCAGACACCAAGG | 63.01 | 8953 |
| 2102 | FORWARD | AGGAAGCAGGGTTGGTTTCC | 62.63 | 8954 | CCCAGAGCCAATCAGTAGCC | 62.07 | 8955 |
| | REVERSE | CCAAGATGGCAGTCGGAACT | 62.53 | 8956 | TGTTCCCCAGGATTCCAAGA | 62.71 | 8957 |
| 2331 | FORWARD | GGCTGCCCAGAAAGCAGTTA | 62.7 | 8958 | AAAGAGGCTGCCCAGAAAGC | 63.13 | 8959 |
| | REVERSE | TTCTTCGGTGAAGCACAAGTTTC | 62.83 | 8960 | TGAAGCACAAGTTTCTTTTCATGG | 62.63 | 8961 |
| 2386 | FORWARD | AAGTGAGCGGTGCTGTCCTC | 62.92 | 8962 | AGCGGTCAGCAGACAAGGAG | 63.04 | 8963 |
| | REVERSE | TGGGGCACTCCTAGGTTCAG | 62.51 | 8964 | AATGCTTCCACAGGGTCAGG | 62.4 | 8965 |
| 2412 | FORWARD | TGGCCTCTGCCTGTTTTCAT | 63.02 | 8966 | AGGACCAGGGCGTTATAGGC | 62.56 | 8967 |
| | REVERSE | CGTCATGGCAAGTGTGTCAA | 61.78 | 8968 | ATGCCACACAACCAAAGTCG | 61.81 | 8969 |
| 2560 | FORWARD | GGGTCCCTGCTGCTTTCTCT | 63.11 | 8970 | GGCGTCCATCTTCACACTGA | 62.27 | 8971 |
| | REVERSE | TCCAACTTGGGGAAGGAGTG | 62.36 | 8972 | ACCCGGAAGAGTCCCAAGAC | 62.72 | 8973 |
| 2648 | FORWARD | AGCATCCCCACCTCAGGATT | 63.08 | 8974 | TTACGGTGAGCCCTTTCAGG | 62.43 | 8975 |
| | REVERSE | GTGTCTGGGTTTGGGTCCTG | 62.74 | 8976 | GCATGTCTCGCACAAACCAT | 62.09 | 8977 |
| 2895 | FORWARD | CCAAGTGCCTTCATGCCCTA | 63.37 | 8978 | TCTGCCTTCAGAGCTTCGAGA | 62.79 | 8979 |
| | REVERSE | CGGCAGATTCAGATCGAGGT | 62.65 | 8980 | CAGCCCAGAAGGCTTTGGTA | 62.56 | 8981 |
| 3249 | FORWARD | CTGGCAGGACTGCAACAAGA | 62.55 | 8982 | GCTCCCTCAGCGACTACAGC | 62.58 | 8983 |
| | REVERSE | CAGATGGGGCAGCTGAACTT | 62.66 | 8984 | AGGAAAGGCCAGGGACTCAC | 62.85 | 8985 |
| 3305 | FORWARD | TCCCTCCATCATCGACACTG | 62.09 | 8986 | GTCTAGCCTCAGAGTAACCCCTGTT | 62.42 | 8987 |
| | REVERSE | TTGGCATAAAATAAGCGACGAA | 61.72 | 8988 | TTGGCATAAAATAAGCGACGAA | 61.72 | 8989 |
| 3541 | FORWARD | CTGCTGACCCACCAAGGTCT | 62.64 | 8990 | GAGCAGGGGTGGTTTCTACG | 61.96 | 8991 |
| | REVERSE | CCCGCAGCTCTGAGTAAGGA | 62.9 | 8992 | TCCTTCCCCTAGCAGCTTCC | 62.98 | 8993 |
| 3692 | FORWARD | TGGTTGCCTTAAGGTGTTTGC | 62.27 | 8994 | ACATTAAATCCGCCCTGCAA | 62.58 | 8995 |
| | REVERSE | GCCACAGTATGCTTCCCATTG | 62.7 | 8996 | TGCTCTAATCAAGTGGGAAGCAG | 62.93 | 8997 |
| 3701 | FORWARD | TTGACTTCCGCAAGGACCTC | 62.65 | 8998 | GCCTTTCCTGCTTCTCATGG | 62.19 | 8999 |
| | REVERSE | TCCAGGCTCCAAATGTAGGG | 62.28 | 9000 | CTCCGTGGAGCTGAAGCAAT | 62.79 | 9001 |
| 3741 | FORWARD | TCCACCTCGACGTTACAAGC | 62.48 | 9002 | CCTGCCCCTTTACGGACAC | 62.76 | 9003 |
| | REVERSE | CCCTCTTCCCCTCCCTGTTA | 62.59 | 9004 | GCCGGAGTCCAGTGTGGT | 62.21 | 9005 |
| 3825 | FORWARD | ACCCTCCTGTCCAACATCCA | 62.73 | 9006 | TGTTAACAACACGCCCCTCA | 62.45 | 9007 |
| | REVERSE | CAGCATTGCGGAACACTGAG | 62.95 | 9008 | TGTCCATCTCTGCACCTTGG | 62.26 | 9009 |
| 3827 | FORWARD | TTTTGATGTCAGAGCCCAAGC | 62.57 | 9010 | TCAGTGTGGCATCCTGCTTC | 62.41 | 9011 |
| | REVERSE | GAAGCAGGATGCCACACTGA | 62.41 | 9012 | TGAAGCTAACCACCGGCATT | 62.81 | 9013 |
| 3832 | FORWARD | TGGCATGTTGTTGGAGATTGA | 62.43 | 9014 | GGCTGCCCAGAAAGCAGTTA | 62.7 | 9015 |
| | REVERSE | TGGGCAGCCTCTTTAGCTTG | 62.81 | 9016 | TTCTTCGGTGAAGCACAAGTTTC | 62.83 | 9017 |
| 4149 | FORWARD | AAACCCTTTTGCGTGGTCCT | 63 | 9018 | TTAATATGTGGGAAACCCTTTTGC | 62.25 | 9019 |
| | REVERSE | CCTGTTAATGGTGTCCACTTTGG | 62.7 | 9020 | CCTGTTAATGGTGTCCACTTTGG | 62.7 | 9021 |
| 4400 | FORWARD | ACATCATCGCATGGCATCAG | 63.06 | 9022 | ACAACAAGGGGAGCGGAGTT | 63.23 | 9023 |
| | REVERSE | AACTCCGCTCCCCTTGTTGT | 63.23 | 9024 | TCAGCCTCATCCTCAAACTGG | 62.65 | 9025 |
| 4601 | FORWARD | CAGCTCCAAGGGGAATCAGA | 62.61 | 9026 | AGCCAGGAATTTCCCAGGAC | 62.62 | 9027 |
| | REVERSE | CTGGATCTGCCTGGATTGGT | 62.38 | 9028 | ACAGTGGGCTCCCCTTTCTC | 62.85 | 9029 |

TABLE 10B-continued

PCR Primers for lupus marker genes

| SEQ ID | PRIMER SET 1 | | Tm | SEQ ID | Primer Set 2 | Tm | SEQ ID |
|---|---|---|---|---|---|---|---|
| 4604 | FORWARD | GGCAGCAACTCCGAGAGAAA | 62.91 | 9030 | TGCAGTGTGGACATTCAACAGA | 62.71 | 9031 |
|  | REVERSE | GCAGGCTGGATTCTTTGGTG | 63.02 | 9032 | TCTCGGAGTTGCTGCCAATA | 61.85 | 9033 |
| 4631 | FORWARD | CTCACAGGAGCCACAGCTCA | 62.79 | 9034 | CCACGGTATCCTGTGGTTCC | 62.51 | 9035 |
|  | REVERSE | CACCCATAAGCCCCAACAGA | 63.12 | 9036 | TGATTGAGGAGCTTGGCAGA | 62.03 | 9037 |
| 4637 | FORWARD | ATGCTGCCCTTCTTTTGCAC | 62.59 | 9038 | GGCAAGCTTGGGAATGAATG | 62.78 | 9039 |
|  | REVERSE | GGAGCCTCTGGTGGCTCATA | 62.65 | 9040 | TGCTGGAGGTAATCGCCACT | 63.04 | 9041 |
| 5067 | FORWARD | TCGACATGGTGAGGTAGAGCA | 61.81 | 9042 | TTTGGTGACAGTGAGCTTGAGG | 62.69 | 9043 |
|  | REVERSE | TGTTCTGGCAGCACCTCAAG | 62.55 | 9044 | TGGATGGCCGTTTAGAGAGAA | 61.99 | 9045 |
| 5074 | FORWARD | GGCTTAACCCAGGCATCCTC | 63.1 | 9046 | TGTCTGGAAGCCACAACTGG | 62.27 | 9047 |
|  | REVERSE | GAGGCCTGCTTCCAGTTGTG | 63.27 | 9048 | GGGTTTTCTGTGGCCCTCTT | 62.63 | 9049 |
| 5468 | FORWARD | CCCACTTCCCCATGTTTGTC | 62.5 | 9050 | TAAAACAGCCCAGCGCTCAC | 63.65 | 9051 |
|  | REVERSE | CGGCAGATCCCTGAAATGAC | 62.88 | 9052 | GCTGGAAACCTGGCAGTGAT | 62.55 | 9053 |
| 5531 | FORWARD | CCATGGGTCTTGCCCTAC | 62.62 | 9054 | TGCTCCTTCTCGCCATCAAT | 63.14 | 9055 |
|  | REVERSE | AGGCTGGACCATCAGTCAGG | 62.62 | 9056 | AGGAAGCAGCCAGGAAGATG | 61.82 | 9057 |
| 5607 | FORWARD | AAACTCGGCATGTCCTCCAG | 62.53 | 9058 | CGGTCAGATCGTTGCGTAGA | 62.33 | 9059 |
|  | REVERSE | CAAGGATGAGGACGGTGCTT | 62.53 | 9060 | TGGGCTTAGCCTTGATCCAC | 62.43 | 9061 |
| 6382 | FORWARD | TGGGGCTGGGAGTAGTTGTC | 62.4 | 9062 | CATCCCTCCCCAGTTCATTG | 62.6 | 9063 |
|  | REVERSE | GGAAGGTGTTTGGGGTCAGA | 62.25 | 9064 | GTGGCATGCCCTGTCCATA | 62.91 | 9065 |
| 6956 | FORWARD | TCTTGGAGATTCGAGCAGCA | 62.17 | 9066 | AGGCAGCAGTGCAAGTGACA | 63.23 | 9067 |
|  | REVERSE | CTGCGACCAGAGTCAGTGGA | 62.65 | 9068 | TGGCTATTGCTGGCCTCCTA | 63.03 | 9069 |
| 7238 | FORWARD | CTCTGCCAAGTTGTCCAGCA | 62.55 | 9070 | GGACCCCAAACTCCACCTCT | 62.59 | 9071 |
|  | REVERSE | AGGTACCCAACTGCGACCTG | 62.43 | 9072 | TGGACAACTTGGCAGAGCAG | 62.55 | 9073 |
| 7330 | FORWARD | CCTGGGTTGAGCAGCAGAAT | 62.66 | 9074 | CAGCCCTGGGATGGACTAGA | 62.5 | 9075 |
|  | REVERSE | AGCACATTGCTTTGCTGGTG | 62.36 | 9076 | AGGCCCATCCTTCAGTTTCC | 62.62 | 9077 |
| 7641 | FORWARD | CAGGCTGAGGCTCAAGGAAG | 62.53 | 9078 | CCTCCGACCTCTCGCTGTAG | 62.41 | 9079 |
|  | REVERSE | CCAAGAGGAGGATGCACCAG | 63.11 | 9080 | GCTGAGGACCACCTTCCTTG | 62.15 | 9081 |
| 8015 | FORWARD | CCCTGGCCCTTACTTGCTTC | 63.22 | 9082 | GCAAGAGGGTGACAGCTTCC | 62.3 | 9083 |
|  | REVERSE | GGTGGAGGGTGGAGTGTTTG | 62.74 | 9084 | GCTGTTTCTTGACCCCAAGC | 62.09 | 9085 |

TABLE 10 C

Surrogates for lupus gene expression markers

| SEQ (Oligo) ID | Acc | Name | CART Surrogates | Hierarchical Clustering Surrogates |
|---|---|---|---|---|
| 41 | NM_004031 | interferon regulatory factor 7 (IRF7) | | |
| 328 | unknown | 53G7 | | |
| 668 | AF061736 | ubiquitin-conjugating enzyme E2L 6 | | |
| 855 | AJ271326 | unc93 (*C. elegans*) homolog B | | 171 |
| 981 | AK023680 | cDNA FLJ13618 fis | | |
| 1001 | NM_004926 | zinc finger protein 36, C3H type-like 1 | 1015, 1019, 1036, 1037, 1013, | 2401, 209, 8004, 578 |
| 1003 | AK024240 | cDNA FLJ14178 fis | 10, 100, 1005, 1004, 1001 | 6074 |
| 1025 | AK024756 | hypothetical protein FLJ21103 | 103, 1041, 1042, 1046, 1003 | |
| 1035 | NM_030938 | VMP1 ortholog of rat vacuole protein 1 | | |
| 1227 | NM_032039 | hypothetical protein DKFZp761D0211 | | |
| 1341 | AV756188 | eukaryotic translation elongation factor | | |
| 1390 | AY004255 | EST IMAGE:3458141, Similar to p27, Kip1, | | |
| 1436 | NM_001101 | actin, beta (ACTB) | 5067, 7330, 3692, | 1052 |
| 1635 | BE868389 | tripartite motif protein 14 (TRIM14) | | |
| 1750 | M11124 | HLA-DQA1 | | 1770, 1769 |
| 2102 | NM_001295 | chemokine (C-C motif) receptor 1 (CCR1) | | |
| 2331 | NM_002568 | poly(A)-binding protein, cytoplasmic 1 | | 3832 |
| 2386 | NM_002831 | protein tyrosine phosphatase, PTPN6 | | |
| 2412 | NM_002946 | replication protein A2 | 855, 7330, 2331, 2895, | 3741, 3692 |
| 2560 | NM_003811 | TNF (ligand) superfamily, member 9 (TNFSF9) | | |
| 2648 | NM_080424 | SP110 nuclear body protein | 2412, 855, 7330, 2331, 2895, | 3328, 824, 2969, 371, 8016, 7238, 3827, 4 |

TABLE 10 C-continued

Surrogates for lupus gene expression markers

| SEQ (Oligo) ID | Acc | Name | CART Surogates | Hierarchical Clustering Surrogates |
|---|---|---|---|---|
| 2895 | NM_006289 | talin 1 (TLN1) | | 8095, 2386 |
| 3249 | NM_015995 | cDNA DKFZp761P06121 | | |
| 3305 | NM_016523 | killer cell lectin-like receptor subfamily F | | |
| 3541 | R14692 | Na+/H+ exchanger NHE-1 isoform | | |
| 3692 | W47229 | ELL-RELATED RNA POLYMERASE II | | |
| 3701 | X02812 | transforming growth factor, beta 1 (TGFB1) | | |
| 3741 | X51345 | jun B proto-oncogene (JUNB) | | |
| 3825 | X97324 | adipose differentiation-related protein (ADFP) | | |
| 3827 | X99699 | XIAP associated factor-1 (HSXIAPAF1) | | |
| 3832 | Y00345 | poly(A)-binding protein, cytoplasmic 1 | | 2331 |
| 4149 | NM_000311 | prion protein (p27–30) (PRNP) | | 4444 |
| 4400 | AF073705 | immunoglobulin lambda light chain variable region 4a | | |
| 4601 | NM_002205 | integrin, alpha 5 (fibronectin receptor) | | |
| 4604 | NM_002258 | killer cell lectin-like receptor subfamily B, member 1 | | 1991 |
| 4631 | NM_002935 | ribonuclease, RNase A family, 3 | | |
| 4637 | NM_003033 | beta-galactoside alpha-2,3-sialyltransferase (SIAT4A) | | |
| 5067 | W16552 | capicua protein (CIC) mRNA | 328, 2412, 1227, 3249, 2331, | 7242 |
| 5074 | AA701193 | EST Soares_fetal_liver_spleen IMAGE:461188 3' | | |
| 5468 | AI818777 | EST IMAGE:2424619 | | |
| 5531 | AL567986 | farnesyl diphosphate synthase | | |
| 5607 | AW063509 | TN1012 cDNA | | |
| 6382 | NM_078467 | cyclin-dependent kinase inhibitor 1A (p21, Cip1) | | |
| 6956 | BM852711 | ESTT (Negative stand probe to Hs.17481) | | 5278 |
| 7238 | NM_006187 | 2'-5'-oligoadenylate synthetase 3 | | 3328, 824, 2969, 371, 8016, 1785, 3827, 41 |
| 7330 | NM_004900 | phorbolin | | |
| 7641 | NM_005892 | formin-like (FMNL) | | |
| 8015 | M26252 | pyruvate kinase, muscle (PKM2) | | |
| 8095 | AK026594 | tubulin, beta, 2 (TUBB2) | | |

TABLE 11

Kits for discovery of, or application of diagnostic gene sets

A. Contents of kit for discovery of diagnostic gene sets using microarrays

1. Sterile, endotoxin and RNAse free blood collection tubes
2. Alcohol swabs, tourniquet, blood collection set
3. -PBS (phosphate buffer saline; needed when method of example 8 is used to derived mononuclear RNA)
4. Cell lysis buffer
5. RNA isolation kit
6. Substrates for labeling of RNA (may vary for various expression profiling techniques)
   For fluorescence microarray expression profiling:
   Reverse transcriptase and 10x RT buffer
   T7(dT)24 primer (primer with T7 promoter at 5' end)
   DTT
   Deoxynucleotides 100 mM each
   RNAse inhibitor
   2nd strand cDNA buffer
   DNA polymerase
   Rnase H
   T7 RNA polymerase
   Ribonucleotides
   In Vitro transcription buffer
   Cy3 and Cy5 labeled ribonucleotides
7. Microarrays containing candidate gene libraries
8. Cover slips for slides
9. Hybridization chambers
10. Software package for identification of diagnostic gene set from data
    Contains statistical methods.
    Allows alteration in desired sensitivity and specificity of gene set.
    Software facilitates access to and data analysis by centrally located database server.
11. Password and account number to access central database server.
12. Kit User Manual

TABLE 11-continued

Kits for discovery of, or application of diagnostic gene sets

B. Contents of kit for application of diagnostic gene sets using microarrays 1. Sterile, endotoxin and RNAse free blood collection tubes
2. Alcohol swabs, tourniquet, blood collection set
3. -PBS (phosphate buffer saline; needed when method of example 7 is used to derived mononuclear RNA)
4. Cell lysis buffer
5. RNA isolation kit
6. Substrates for labeling of RNA (may vary for various expression profiling techniques)
   For fluorescence microarray expression profiling:
   Reverse transcriptase and 10x RT buffer
   T7(dT)24 primer (primer with T7 promoter at 5' end)
   DTT
   Deoxynucleotides 100 mM each
   RNAse inhibitor
   2nd strand cDNA buffer
   DNA polymerase
   Rnase H
   T7 RNA polymerase
   Ribonucleotides
   In Vitro transcription buffer
   Cy3 and Cy5 labeled ribonucleotides
7. Microarrays containing candidate gene libraries
8. Cover slips for slides
9. Hybridization chambers
10. Software package for identification of diagnostic geng set from data
    Contains statistical methods.
    Allows alteration in desired sensitivity and specificity of gene set.
    Software facilitates access to and data analysis by centrally located database server.
11. Password and account number to access central database server.
12. Kit User Manual

TABLE 11-continued

Kits for discovery of, or application of diagnostic gene sets

C. Contents of kit for application of diagnostic gene sets using Real-time RT-PCR 1. Sterile, endotoxin and RNAse free blood collection tubes
2. Alcohol swabs, tourniquet, blood collection set
3. -PBS (phosphate buffer saline; needed when method of example 7 is used to derived mononuclear RNA)
4. Cell lysis buffer
5. RNA isolation kit
6. Substrates for real time RT-PCR (may vary for various real-time PCR techniques:
   - poly dT primers, random hexamer primers
   - Reverse Transcriptase and RT buffer
   - DTT
   - Deoxynucleotides 100 mM
   - RNase H
   - primer pairs for diagnostic and control gene set
   - 10x PCR reaction buffer
   - Taq DNA polymerase
   - Fluorescent probes for diagnostic and control gene set (alternatively, fluorescent dye that binds to only double stranded DNA)
   - reaction tubes with or without barcode for sample tracking
   - 96-well plates with barcode for sample identification, one barcode for entire set, or individual barcode per reaction tube in plate
7. Software package for identification of diagnostic gene set from data
   - Contains statistical methods.
   - Allows alteration in desired sensitivity and specificity of gene set.
   - Software facilitates access to and data analysis by centrally located database server
8. Password and account number to access central database server.
9. Kit User Manual

SEQUENCE LISTING (9090 sequences)

SEQ ID NO: 1 - DNA, 50 bp, Homo sapiens
agagcacttgcagagcctgggacaacctccttattgaagggaagagggac

SEQ ID NO: 2 - DNA, 50 bp, Homo sapiens
tggtctcaaagatttacatggcaacattcgaaagtccccagagaagtcct

SEQ ID NO: 3 - DNA, 50 bp, Homo sapiens
aggacttctctggggactttcgaatgttgccatgtaaatctttgagacca

SEQ ID NO: 4 - DNA, 50 bp, Homo sapiens
aggtgccagcaactgaataaatacctctcccagtgtaaatctggagccaa

SEQ ID NO: 5 - DNA, 50 bp, Homo sapiens
gggtgtctttaaatagcactagccaaatcacatatctccaacactcctta

SEQ ID NO: 6 - DNA, 50 bp, Homo sapiens
taaggagtgttggagatatgtgatttggctagtgctatttaaagacaccc

SEQ ID NO: 7 - DNA, 50 bp, Homo sapiens
cccacagtgcaattcagaatatgctcagggaatgccagccaccttgtaaa

SEQ ID NO: 8 - DNA, 50 bp, Homo sapiens
gccaagacaataagctaggctactgggtccagctactactttggtgggat

SEQ ID NO: 9 - DNA, 50 bp, Homo sapiens
atcccaccaaagtagtagctggacccagtagcctagcttattgtcttggc

SEQ ID NO: 10 - DNA, 50 bp, Homo sapiens
aatttataactcctaggggttatttctgtgccagacacattccacctctc

SEQ ID NO: 11 - DNA, 50 bp, Homo sapiens
actaattgcattggcagcattgtgtctttgaccttgtatactagcttgac

SEQ ID NO: 12 - DNA, 50 bp, Homo sapiens
aaaccaaaaataatcacaacagaaaccagctgccccaaaggaaccagagg

SEQ ID NO: 13 - DNA, 50 bp, Homo sapiens
tcccaccaggactttgctaacaataatgtttggaaataaagaagtgctct

SEQ ID NO: 14 - DNA, 50 bp, Homo sapiens
tgacactcatgccaacaagaacctgtgcccctccttcctaacctgaggcc

SEQ ID NO: 15 - DNA, 50 bp, Homo sapiens
acaaattttaccctaacagttttaccacctagcaacagtcatttctgaaa

SEQ ID NO: 16 - DNA, 50 bp, Homo sapiens
tttattggtacttcctaaagatagagactaaagtcatggtagtattggcc

SEQ ID NO: 17 - DNA, 50 bp, Homo sapiens
ggccaatactaccatgactttagtctctatctttaggaagtaccaataaa

SEQ ID NO: 18 - DNA, 50 bp, Homo sapiens
cctcccattttgttctcggaagattaaatgctacatgtgtaagtctgcct

SEQ ID NO: 19 - DNA, 50 bp, Homo sapiens
ccgtgcccggaaacaggccgtggctagagaagagcgagatcatctttacc

SEQ ID NO: 20 - DNA, 50 bp, Homo sapiens
ggtctaatttattcaaagggggcaagaagtagcagtgtctgtaaaagagc

SEQ ID NO: 21 - DNA, 50 bp, Homo sapiens
agatgggtgaatcagttgggttttgtaaatacttgtatgtggggaagaca

SEQ ID NO: 22 - DNA, 50 bp, Homo sapiens
tctctagttgtcactttcctcttccactttgataccattgggtcattgaa

SEQ ID NO: 23 - DNA, 50 bp, Homo sapiens
tcaaaagaaagccttctggatgctgttaagatgtacccttcaggtgaacc

SEQ ID NO: 24 - DNA, 50 bp, Homo sapiens
ccccctttccttctaatttttcagctccttcaatgcaaagtacatgtatt

SEQ ID NO: 25 - DNA, 50 bp, Homo sapiens
cctccaaccccggaaacttcctgtgcaacccagactatcacctttgaaag

SEQ ID NO: 26 - DNA, 50 bp, Homo sapiens
ggaaggtagtcttcatttgcaatcaggaaaacgaacgtaaaggcacaggt

SEQ ID NO: 27 - DNA, 50 bp, Homo sapiens
acctgtgcctttacgttcgttttcctgattgcaaatgaagactaccttcc

SEQ ID NO: 28 - DNA, 50 bp, Homo sapiens
tgttttcctcactacattgtacatgtgggaattacagataaacggaagcc

SEQ ID NO: 29 - DNA, 50 bp, Homo sapiens
cagagcaagaccctgaagacccccaaccacggcctaaaagcctctttgtg

SEQ ID NO: 30 - DNA, 50 bp, Homo sapiens
gcttcatatgtatggctgttgctttgcttcatgtgtatggctatttgtat

SEQ ID NO: 31 - DNA, 50 bp, Homo sapiens
cagatgggttcagcagtctggtcagtgagaaagggccgagggtagacagg

SEQ ID NO: 32 - DNA, 50 bp, Homo sapiens
tccagggcaatcaatgttcacgcaacttgaaattatatctgtggtcttca

SEQ ID NO: 33 - DNA, 50 bp, Homo sapiens
tcatcccgagaacattggcttccacatcacagtatctacccttacatggt

SEQ ID NO: 34 - DNA, 50 bp, Homo sapiens
cgctctcgatattcctgtgcagaaacctggaccacgtctacaaccggctc

SEQ ID NO: 35 - DNA, 50 bp, Homo sapiens
cctgctcagctctgcataagtaattcaagaaatgggaggcttcaccttaa

SEQ ID NO: 36 - DNA, 50 bp, Homo sapiens
ggaggacccacactgctacacttctgatcccctttggttttactacccaa

SEQ ID NO: 37 - DNA, 50 bp, Homo sapiens
gaagaacagcagatggcggtgatcagcagagagattgaactttgaggagg

SEQ ID NO: 38 - DNA, 50 bp, Homo sapiens
ggaatttcctatcttgcagcatcctgtaaataaacattcaagtccaccct

SEQ ID NO: 39 - DNA, 50 bp, Homo sapiens
cctcaaagtgctaccgataaacctttctaattgtaagtgcccttactaag

SEQ ID NO: 40 - DNA, 50 bp, Homo sapiens
agtgggtcccagattggctcacactgagaatgtaagaactacaaacaaaa

SEQ ID NO: 41 - DNA, 50 bp, Homo sapiens
ctgtccagcgccaacagcctctatgacgacatcgagtgcttccttatgga

SEQ ID NO: 42 - DNA, 50 bp, Homo sapiens
aaattctggtaagtatgtgcttttctgtgggggtgggatttggaaggggg

SEQ ID NO: 43 - DNA, 50 bp, Homo sapiens
atgggtgaagagaaccgagcaaagatcaaaataaaaagtgacacagcagc

SEQ ID NO: 44 - DNA, 50 bp, Homo sapiens
gctgtgtccatctttgtcactgagtgaaatctctgttttctattctctga

SEQ ID NO: 45 - DNA, 50 bp, Homo sapiens
atgtgctgtcaaaacaagtttttctgtcaagaagatgatcagaccttgga

SEQ ID NO: 46 - DNA, 50 bp, Homo sapiens
cagtgatcagggtcctgcaagcagtggggaagggggccaaggtattggag

SEQ ID NO: 47 - DNA, 50 bp, Homo sapiens
tggacacacggatcaagaccaggaagaattgaacttgtcaaggtgaaggg

SEQ ID NO: 48 - DNA, 50 bp, Homo sapiens
aacagaccccctctagaaatttttcagatgcttctgggagacaccaaagg

SEQ ID NO: 49 - DNA, 50 bp, Homo sapiens
gtcagtaggtgcggtgtctagggtagtgaatcctgtaagttcaaatttat

SEQ ID NO: 50 - DNA, 60 bp, Homo sapiens
agttgtgtggtcagtaggtgcggtgtctagggtagtgaatcctgtaagttcaaatttatg

SEQ ID NO: 51 - DNA, 70 bp, Homo sapiens
tttaagttgtgtggtcagtaggtgcggtgtctagggtagtgaatcctgtaagttcaaatttatgattagg

SEQ ID NO: 52 - DNA, 50 bp, Homo sapiens
gtttgagatggacacactggtgtggattaacctgccagggagacagagct

SEQ ID NO: 53 - DNA, 50 bp, Homo sapiens
ttgtgactctgaatcccatgttctcaaactacgctgccttccgaagtctg

SEQ ID NO: 54 - DNA, 50 bp, Homo sapiens
tttaagtactaagtcatcatttgccttgaaagtttcctctgcattgggtt

SEQ ID NO: 55 - DNA, 50 bp, Homo sapiens
aacccaatgcagaggaaactttcaaggcaaatgatgacttagtacttaaa

SEQ ID NO: 56 - DNA, 50 bp, Homo sapiens
tacctgggcattcttgtttcattcaattccacctgcaatcaagtcctaca

SEQ ID NO: 57 - DNA, 60 bp, Homo sapiens
ccattaaacttacctgggcattcttgtttcattcaattccacctgcaatcaagtcctaca

SEQ ID NO: 58 - DNA, 70 bp, Homo sapiens
cacctgcaatcaagtcctacaagctaaaattagatgaactcaactttgacaaccatgagaccactgttat

SEQ ID NO: 59 - DNA, 50 bp, Homo sapiens
aatgcgtacgtttcctgagaagtgtctaaaaacaccaaaaagggatccgt

SEQ ID NO: 60 - DNA, 60 bp, Homo sapiens
acgtttcctgagaagtgtctaaaaacaccaaaaagggatccgtacattcaatgtttatgc

SEQ ID NO: 61 - DNA, 70 bp, Homo sapiens
caaatcaatgcgtacgtttcctgagaagtgtctaaaaacaccaaaaagggatccgtacattcaatgttta

SEQ ID NO: 62 - DNA, 50 bp, Homo sapiens
ctccgggagaggggacggtcaatcctgtgggtgaagacagagggaaacac

SEQ ID NO: 63 - DNA, 50 bp, Homo sapiens
ggctgggaaactgttggtggccagtgggtaataaagacctttcagtatcc

SEQ ID NO: 64 - DNA, 50 bp, Homo sapiens
tgctagaggggcttagagaactacaaggcctgcagaatttcccagagaag

SEQ ID NO: 65 - DNA, 50 bp, Homo sapiens
ctgactcaggatgacagacaggtggaactgccagtgtagagggaattcta

SEQ ID NO: 66 - DNA, 50 bp, Homo sapiens
gtaaaggctatacttgtcttgttcaccttgggatgacgccgcatgatatg

SEQ ID NO: 67 - DNA, 50 bp, Homo sapiens
caagcaggaagcacaaactcccccaagctgactcatcctaactaacagtc

SEQ ID NO: 68 - DNA, 50 bp, Homo sapiens
tcttcaacagaccccctctagaaatttttcagatgcttctgggagacacc

SEQ ID NO: 69 - DNA, 50 bp, Homo sapiens
gtcctccacgccatttccttttccttcaagcctagcccttctctcattat

SEQ ID NO: 70 - DNA, 50 bp, Homo sapiens
ggcccttcatgtacatccatggtgtgctggcttaaaatgtaattaatctt

SEQ ID NO: 71 - DNA, 50 bp, Homo sapiens
aagatgcccaaccctgtgatcagaacctccaaatactgccatgagaaact

SEQ ID NO: 72 - DNA, 50 bp, Homo sapiens
caggagtttgtgtgtcttttataaaaagtttgccctggatgtcatattgg

SEQ ID NO: 73 - DNA, 50 bp, Homo sapiens
ccctgagtgacagtcacgacagaacaaaaccacaagaccagaccacattt

SEQ ID NO: 74 - DNA, 50 bp, Homo sapiens
cctttacatccagataggttaccagtaacggaacatatccagtactcctg

SEQ ID NO: 75 - DNA, 50 bp, Homo sapiens
tgcatcgtaaaaccttcagaaggaaaggagaatgttttgtggaccacttt

SEQ ID NO: 76 - DNA, 50 bp, Homo sapiens
ggccactgaatgggtaggagcaaccactgactggtcttaagctgttcttg

SEQ ID NO: 77 - DNA, 50 bp, Homo sapiens
tgtagggtaaatgtgactggaatacacctttggaacggaattctttatca

SEQ ID NO: 78 - DNA, 50 bp, Homo sapiens
aggctggacatcggcccgctccccacaatgaaataaagttattttctcat

SEQ ID NO: 79 - DNA, 50 bp, Homo sapiens; identical to SEQ ID NO: 77

SEQ ID NO: 80 - DNA, 50 bp, Homo sapiens
gttgccatggtgatggtgtagccctcccactttgctgttccttactttac

SEQ ID NO: 81 - DNA, 50 bp, Homo sapiens
ccacccacccctcaattaaggcaacaatgaagttaatggataccctctgc

SEQ ID NO: 82 - DNA, 50 bp, Homo sapiens; identical to SEQ ID NO: 80

SEQ ID NO: 83 - DNA, 50 bp, Homo sapiens; identical to SEQ ID NO: 81

SEQ ID NO: 84 - DNA, 50 bp, Homo sapiens
gctcacctatttgggttaagcatgccaatttaaagagaccaagtgtatgt

SEQ ID NO: 85 - DNA, 50 bp, Homo sapiens
tccaccttttgtatttaattttaaagtcagtgtactgcaaggaagctgga

SEQ ID NO: 86 - DNA, 50 bp, Homo sapiens
ccctatcccgcaaaatgggcttcctgcctgggtttttctcttctcacatt

SEQ ID NO: 87 - DNA, 50 bp, Homo sapiens; identical to SEQ ID NO: 85

SEQ ID NO: 88 - DNA, 50 bp, Homo sapiens
agatcttcaagtgaacatctcttgccatcacctagctgcctgcacctgcc

SEQ ID NO: 89 - DNA, 50 bp, Homo sapiens
gctaattttaagcatgttcagtggcagctcccctccagtttcagtgtcac

SEQ ID NO: 90 - DNA, 50 bp, Homo sapiens
cctgtgatcaggctcccaagtctggttcccatgaggtgagatgcaacctg

SEQ ID NO: 91 - DNA, 50 bp, Homo sapiens
acatggtttgactcccgaacatcaccgacgtgtctcctgtttttctgggt

SEQ ID NO: 92 - DNA, 50 bp, Homo sapiens
tcagagctgaagaagcgagctggatggcaaggcctgtgcgacagataatg

SEQ ID NO: 93 - DNA, 50 bp, Homo sapiens
tcagccattttgggcatatgtatctttataatcagactggaaacgggact

SEQ ID NO: 94 - DNA, 50 bp, Homo sapiens
atcctggcaaccttacaattcctctcggcatttgtcacttccatctcagc

SEQ ID NO: 95 - DNA, 50 bp, Homo sapiens
agcttactacagtgaaagaatgggattggcaagtaacttctgacttactg

SEQ ID NO: 96 - DNA, 50 bp, Homo sapiens
attataacatcttcaacacagaacacactttgtggtcgaaaggctcagcc

SEQ ID NO: 97 - DNA, 50 bp, Homo sapiens
tgtcagagattgcctgtggctctaatatgcacctcaagattttaaggaga

SEQ ID NO: 98 - DNA, 50 bp, Homo sapiens
tgtctggcagggactgaatgacctgatgtcagatttagattcttcctggg

SEQ ID NO: 99 - DNA, 50 bp, Homo sapiens
gggaggaacactgcactcttaagcttccgccgtctcaacccctcacagga

SEQ ID NO: 100 - DNA, 50 bp, Homo sapiens
atgaagaagggtgtgaaggctgaacaatcatggatttttctgatcaattg

SEQ ID NO: 101 - DNA, 50 bp, Homo sapiens
gcctctgctccccagggagttgtgtctgtaatcggcctactattcagtgg

SEQ ID NO: 102 - DNA, 50 bp, Homo sapiens
ggatgctactgatgggaatgattaagggagctgctgtttaggtggtgctg

SEQ ID NO: 103 - DNA, 50 bp, Homo sapiens
tcaggaacaacatctactgcatggcccagctgctggacaactcagacacg

SEQ ID NO: 104 - DNA, 50 bp, Homo sapiens
cttacatcaggtactttgtcagcttcatcatccagttccagttccacgag

SEQ ID NO: 105 - DNA, 50 bp, Homo sapiens
catccaggagctgttcaagcgcatctccgagcagttcacggccatgttcc

SEQ ID NO: 106 - DNA, 50 bp, Homo sapiens
acctcccactttgtctgtacatactggcctctgtgattacatagatcagc

SEQ ID NO: 107 - DNA, 50 bp, Homo sapiens
gtctttgagaatatgatgtcagacattttcggatgggctgtttagatgtt

SEQ ID NO: 108 - DNA, 50 bp, Homo sapiens
ggtcacccaggaggatggcaaagagagtcgcatctcagtgcaggagagac

SEQ ID NO: 109 - DNA, 50 bp, Homo sapiens
agacccttatctggaggaggaagagaagcaggagagagaaagccacagcc

SEQ ID NO: 110 - DNA, 50 bp, Homo sapiens
ggctgtgtcctaaggcccatttgagaagctgaggctagttccaaaaacct

SEQ ID NO: 111 - DNA, 50 bp, Homo sapiens
gtgctcctgtaagtcaaatgtgtgctttgtactgctgttgttgaaattga

SEQ ID NO: 112 - DNA, 50 bp, Homo sapiens
cagagacataaagagaagatgccaaggccccctcctccacccaccgctaa

SEQ ID NO: 113 - DNA, 50 bp, Homo sapiens
atgggagtaataagagcagtggcagcagcatctctgaacatttctctgga

SEQ ID NO: 114 - DNA, 50 bp, Homo sapiens
ccactaatcctgatgaggctgacaaagttggggctgagaacacaatcacc

SEQ ID NO: 115 - DNA, 50 bp, Homo sapiens
tgttggggtttcctttaccttttctataagttgtaccaaaacatccactt

SEQ ID NO: 116 - DNA, 50 bp, Homo sapiens
cagagtaggcatctgggcaccaagaccttccctcaacagaggacactgag

SEQ ID NO: 117 - DNA, 50 bp, Homo sapiens
ctttgcctaaaccctatggcctcctgtgcatctgtactcaccctgtacca

SEQ ID NO: 118 - DNA, 50 bp, Homo sapiens; identical to SEQ ID NO: 76

SEQ ID NO: 119 - DNA, 50 bp, Homo sapiens
tgattctgcacttggggtctgtctgtacagttactcatgtcattgtaatg

SEQ ID NO: 120 - DNA, 50 bp, Homo sapiens
tgtgtaataggccttttcatgctttatgtgtagctttttacctgtaacct

SEQ ID NO: 121 - DNA, 50 bp, Homo sapiens
aagttatcatgtccatccgcaccaagctgcagaacaaggagcatgtgatt

SEQ ID NO: 122 - DNA, 50 bp, Homo sapiens; identical to SEQ ID NO: 121

SEQ ID NO: 123 - DNA, 50 bp, Homo sapiens
tggtggatgttaaaccaatattcctttcaactgctgcctgctagggaaaa

SEQ ID NO: 124 - DNA, 50 bp, Homo sapiens
tgaacttgctgaatgtaaggcaggctactatgcgttataatctaatcaca

SEQ ID NO: 125 - DNA, 50 bp, Homo sapiens
atttgaccagagcaaagctgaaaaatgaataactaaccccctttccctgc

SEQ ID NO: 126 - DNA, 60 bp, Homo sapiens
gcaattggagaactggatttgctgtttatgtctctgagaaatgcctgcatttgaccagag

SEQ ID NO: 127 - DNA, 70 bp, Homo sapiens
tttgaccagagcaaagctgaaaaatgaataactaaccccctttccctgctagaaataacaattagatgcc

SEQ ID NO: 128 - DNA, 50 bp, Homo sapiens
ccctttttgtcccccaacttgagatgtatgaaggcttttggtctccctgg

SEQ ID NO: 129 - DNA, 50 bp, Homo sapiens
attagaccagaccagtgtatttctaaagaaaatcctgacatgcacaccca

SEQ ID NO: 130 - DNA, 50 bp, Homo sapiens
gaccctactgctgatgataccagtgctgctgtaactgaagaaatgccacc

SEQ ID NO: 131 - DNA, 50 bp, Homo sapiens
acaggcaaagtgacaggggaaaaggaattagtctaagagtaaggggatga

SEQ ID NO: 132 - DNA, 50 bp, Homo sapiens
ctttcctcttgctgctggggcctaggtcttcttgctgctgcttccttttc

SEQ ID NO: 133 - DNA, 50 bp, Homo sapiens
agagtttttgttggtagactggagctgggatgttgaatcaacctcaggca

SEQ ID NO: 134 - DNA, 50 bp, Homo sapiens
tgcctgaggttgattcaacatcccagctccagtctaccaacaaaaactct

SEQ ID NO: 135 - DNA, 50 bp, Homo sapiens
ctgacgatcagcttggaacagccaaacagaattaacgcaactaataacct

SEQ ID NO: 136 - DNA, 50 bp, Homo sapiens
tccttttatgcattggaggaaaaacatgttggcttttctcttgacgtggg

SEQ ID NO: 137 - DNA, 50 bp, Homo sapiens
cccacgtcaagagaaaagccaacatgtttttcctccaatgcataaaagga

SEQ ID NO: 138 - DNA, 50 bp, Homo sapiens
ctcaggaaacccgacagaagaaacatgtaacacagaactcacgtccacta

SEQ ID NO: 139 - DNA, 50 bp, Homo sapiens
actcgagacgtaaattatggctgaatcatccgctaccttcacgccaatgg

SEQ ID NO: 140 - DNA, 50 bp, Homo sapiens
tgctgttttcattctgcatttgtgtagtttggtgctttgttccaagttaa

SEQ ID NO: 141 - DNA, 50 bp, Homo sapiens
aaaaatgacaaaagttatcaccaaaaccccctttcccatcttgcactgtt

SEQ ID NO: 142 - DNA, 50 bp, Homo sapiens
agcttttaatgctccaaatgctgacccatgcaatatttcctcatgtgatc

SEQ ID NO: 143 - DNA, 50 bp, Homo sapiens
aaaagaaatgcaggtttattatccagcactgagagagttaacaaggactg

SEQ ID NO: 144 - DNA, 50 bp, Homo sapiens
agagagacttctcattggctgtgaaggtagagcttttggggaaattcctg

SEQ ID NO: 145 - DNA, 50 bp, Homo sapiens
caggaatttccccaaaagctctaccttcacagccaatgagaagtctctct

SEQ ID NO: 146 - DNA, 50 bp, Homo sapiens; identical to SEQ ID NO: 144

SEQ ID NO: 147 - DNA, 50 bp, Homo sapiens
catctcagccctgcctttctctggagcattctgaaaacagatattctggc

SEQ ID NO: 148 - DNA, 50 bp, Homo sapiens
tcatgataacctgcagacctgatcaagcctctgtgcctcagtttctctct

SEQ ID NO: 149 - DNA, 50 bp, Homo sapiens
atgggggtaataagagcagtagcagcagcatctctgaacatttctctgga

SEQ ID NO: 150 - DNA, 50 bp, Homo sapiens
gaaattgcttttcctcttgaaccacagttctacccctgggatgttttgag

SEQ ID NO: 151 - DNA, 50 bp, Homo sapiens
aattcctcaggaagtaaaaccgaagaagatggcccagctccccaagaaag

SEQ ID NO: 152 - DNA, 50 bp, Homo sapiens
aacatccaaggagaaacagagacaggcccaagagatgaagagtgagaggg

SEQ ID NO: 153 - DNA, 50 bp, Homo sapiens
tcgtgtgaatcagactaagtgggatttcatttttacaactctgctctact

SEQ ID NO: 154 - DNA, 50 bp, Homo sapiens
gcatatacaagttggaagactaaagaggtgcaatgtgatctgagcctcca

SEQ ID NO: 155 - DNA, 50 bp, Homo sapiens
tgagtgtgtttgtgtgcatgaaagagaaagactgattacctcctgtgtgg

SEQ ID NO: 156 - DNA, 50 bp, Homo sapiens
agctgttcccaaattttctaacgagtggaccattatcactttaaagccct

SEQ ID NO: 157 - DNA, 50 bp, Homo sapiens
atcaacagaccaacatttttctcttcctcaagcaacactcctagggcctg

SEQ ID NO: 158 - DNA, 50 bp, Homo sapiens
tatgactgatgatcctccaacaacaaaaccacttactgctcgtaaattca

SEQ ID NO: 159 - DNA, 50 bp, Homo sapiens
aaaatactgatgttcctagtgaaagaggcagcttgaaactgagatgtgaa

SEQ ID NO: 160 - DNA, 50 bp, Homo sapiens
ggaagactttaaaccacctagttctcccactggggcatcggtctaaagct

SEQ ID NO: 161 - DNA, 50 bp, Homo sapiens
ccctgttccacaaacccatatgtatcctttcctcaacctcctcctttccc

SEQ ID NO: 162 - DNA, 50 bp, Homo sapiens
gtgtgtgagtgtgagtgtgagcgagagggtgagtgtggtcagagtaaagc

SEQ ID NO: 163 - DNA, 50 bp, Homo sapiens
tctggtcattcaaggatcccctcccaaggctatgcttttctataactttt

SEQ ID NO: 164 - DNA, 50 bp, Homo sapiens
ggcagctcaggaccactccaatgacccacctaacaagatgaatgaagtta

SEQ ID NO: 165 - DNA, 50 bp, Homo sapiens
tgttcttcatctaagccttctggttttatgggtcagagttccgactgcca

SEQ ID NO: 166 - DNA, 50 bp, Homo sapiens
gccttcatgcacctgtcctttctaacacgtcgccttcaactgtaatcaca

SEQ ID NO: 167 - DNA, 50 bp, Homo sapiens
ccctctcctctcttcctccctggaatcttgtaaaggtcctggcaaagatg

SEQ ID NO: 168 - DNA, 50 bp, Homo sapiens
ctgggctgggacgtgacctgtgctgagggctgtgagaatgtgaaacaaca

SEQ ID NO: 169 - DNA, 50 bp, Homo sapiens
gggatgaacgaaagccccctcttcaactcctctcactttttaaagcattg

SEQ ID NO: 170 - DNA, 50 bp, Homo sapiens
acaatgttgagttcagcatgtgtctgccatttcatttgtacgcttgttca

SEQ ID NO: 171 - DNA, 50 bp, Homo sapiens
tttcagtcccagaacctacagataccctgctacttgcttcacgtggatgc

SEQ ID NO: 172 - DNA, 50 bp, Homo sapiens
aattcagttagctccattcagaaccaaatgcagtccaagggaggttatgg

SEQ ID NO: 173 - DNA, 50 bp, Homo sapiens
cccatcttacagaagttgaggccaagggagaatggtaggcacagaagaaa

SEQ ID NO: 174 - DNA, 50 bp, Homo sapiens
tgtgttaagtgcaggagacattggtattctgggcaccttcctaatatgct

SEQ ID NO: 175 - DNA, 50 bp, Homo sapiens
tgtgttaagtgcaggagacattggtattctgggcagcttcctaatatgct

SEQ ID NO: 176 - DNA, 50 bp, Homo sapiens
agctgtgttggtagtgctgtgttgaattacggaataatgagttagaacta

SEQ ID NO: 177 - DNA, 50 bp, Homo sapiens; identical to SEQ ID NO: 115

SEQ ID NO: 178 - DNA, 60 bp, Homo sapiens
tgcatgttggggtttcctttaccttttctataagttgtaccaaaacatccacttaagttc

SEQ ID NO: 179 - DNA, 70 bp, Homo sapiens
tgttggggtttcctttaccttttctataagttgtaccaaaacatccacttaagttctttgatttgtacca

SEQ ID NO: 180 - DNA, 50 bp, Homo sapiens
tctacctgcagtctccattgtttccagagtgaacttgtaattatcttgtt

SEQ ID NO: 181 - DNA, 50 bp, Homo sapiens
gtgtgcgtgtgtgtgtgcctgtccagtgtatattgtgtcttagcttccat

SEQ ID NO: 182 - DNA, 50 bp, Homo sapiens
ctgaagggaagagagccttgaatagactgaagcgaagacggttctgcaag

SEQ ID NO: 183 - DNA, 50 bp, Homo sapiens
ttctctgcatctaggccatcatactgccaggctggttatgactcagaaga

SEQ ID NO: 184 - DNA, 50 bp, Homo sapiens
cttcctgtacctcctccccacagcttgcttttgttgtaccgtctttcaat

SEQ ID NO: 185 - DNA, 50 bp, Homo sapiens
aacctgcacaagcatgtaataaaagagcacacttaaaaacattctgacca

SEQ ID NO: 186 - DNA, 50 bp, Homo sapiens
tggtcagaatgtttttaagtgtgctcttttattacatgcttgtgcaggtt

SEQ ID NO: 187 - DNA, 50 bp, Homo sapiens
ccttctgaaggtgtatagatacagcttgtcttgaaatgtctttctccaca

SEQ ID NO: 188 - DNA, 50 bp, Homo sapiens
tgtggagaaagacatttcaagacaagctgtatctatacaccttcagaagg

SEQ ID NO: 189 - DNA, 50 bp, Homo sapiens
tgctaggtcacagaggatctgcttggtcttgataagctatgttgttgcac

SEQ ID NO: 190 - DNA, 50 bp, Homo sapiens
ctagaggaccattcatgcaatgactatttctaaagcacctgctacacagc

SEQ ID NO: 191 - DNA, 50 bp, Homo sapiens
gggagtttctgagggtctgctttgtttacctttcgtgcggtggattcttt

SEQ ID NO: 192 - DNA, 50 bp, Homo sapiens
tcggaggagtcggacgaggatatgggatttggtctctttgactaatcacc

SEQ ID NO: 193 - DNA, 50 bp, Homo sapiens
ttccttcctcggtggtgttaatcatttcgtttttaccctttaccttcgga

SEQ ID NO: 194 - DNA, 50 bp, Homo sapiens
gtctacatcaactattacgacatgaacgcggccaatgtgggctggaacaa

SEQ ID NO: 195 - DNA, 50 bp, Homo sapiens
cagaagggtcaaaaagctccagcccagaaagcacctgctccaaaggcatc

SEQ ID NO: 196 - DNA, 50 bp, Homo sapiens
gaccttcctgccaccagtcactgtccctcaaatgacccaaagaccaatat

SEQ ID NO: 197 - DNA, 50 bp, Homo sapiens
gagatggggagggctaccacagagttatccactttacaacggagacacag

SEQ ID NO: 198 - DNA, 50 bp, Homo sapiens
atgggtttggcttgaggctggtagcttctatgtaattcgcaatgattcca

SEQ ID NO: 199 - DNA, 50 bp, Homo sapiens
catccctccatgtactctgggtatcagcaactgtcctcatcagtctccat

SEQ ID NO: 200 - DNA, 50 bp, Homo sapiens
accttacaggagatcatcaaaactttgaacagcctcacagagcagaagac

SEQ ID NO: 201 - DNA, 50 bp, Homo sapiens
gagaagacagtggcgaccaagacgattttctgccttagagcaagggattc

SEQ ID NO: 202 - DNA, 50 bp, Homo sapiens
caggggatcagtgaaggaagagaaggccagcagatcagtgagagtgcaac

SEQ ID NO: 203 - DNA, 50 bp, Homo sapiens
cccattccctctctactcttgacagcaggattggatgttgtgtattgtgg

SEQ ID NO: 204 - DNA, 50 bp, Homo sapiens
acttaatatgtgggaaacccttttgcgtggtccttaggcttacaatgtgc

SEQ ID NO: 205 - DNA, 50 bp, Homo sapiens
aaaatacaagggctgttggtgagagcagacttgaggtgatgatagttggc

SEQ ID NO: 206 - DNA, 50 bp, Homo sapiens
ccagattttccccaaacttgcttctgttgagatttttccctcaccttgcc

SEQ ID NO: 207 - DNA, 50 bp, Homo sapiens
accttgggttgagtaatgctcgtctgtgtgttttagtttcatcacctgtt

SEQ ID NO: 208 - DNA, 50 bp, Homo sapiens
aaactcccctttcttgaggttgtctgagtcttgggtctatgccttgaaaa

SEQ ID NO: 209 - DNA, 50 bp, Homo sapiens
ctcagtgttggtgtggtgatgtttgttgcttttatgatttcatattgtgc

SEQ ID NO: 210 - DNA, 50 bp, Homo sapiens
ctgtatctttgacaattctgggtgcgagtgtgagagtgtgagcagggctt

SEQ ID NO: 211 - DNA, 50 bp, Homo sapiens
gataagtgtcctatggggatggtccactgtcactgtttctctgctgttgc

SEQ ID NO: 212 - DNA, 60 bp, Homo sapiens
tttagccaaaggataagtgtcctatggggatggtccactgtcactgtttctctgctgttg

SEQ ID NO: 213 - DNA, 70 bp, Homo sapiens
atttatattagtttagccaaaggataagtgtcctatggggatggtccactgtcactgtttctctgctgtt

SEQ ID NO: 214 - DNA, 50 bp, Homo sapiens
gaaggaagaagtggggtggaagaagtggggtgggacgacagtgaaatcta

SEQ ID NO: 215 - DNA, 50 bp, Homo sapiens
ccatcaatgaggtatcttctttagtggtggtatgtaatggaacttagcca

SEQ ID NO: 216 - DNA, 50 bp, Homo sapiens
aaagacgtgcactcaaccttctaccaggccactctcaggctcaccttaaa

SEQ ID NO: 217 - DNA, 50 bp, Homo sapiens
ccaagctgcttgtcctgggcctgcccctgtgtattcaccaccaataaatc

SEQ ID NO: 218 - DNA, 50 bp, Homo sapiens
cactggggacgagacaggtgctaaagttgaacgagctgatggatatgaac

SEQ ID NO: 219 - DNA, 50 bp, Homo sapiens
cgttgctgaagtggtaattgaggaaaacagttccccagattgttaagagt

SEQ ID NO: 220 - DNA, 50 bp, Homo sapiens
ctccccgtgagcactgcgtacaaacatccaaaagttcaacaacaccagaa

SEQ ID NO: 221 - DNA, 50 bp, Homo sapiens
agtgcctttcaggatctatttttggaggtttattacgtatgtctggttct

SEQ ID NO: 222 - DNA, 50 bp, Homo sapiens
agaacaaactaagccaggtatgcaaatatcgctgaatagaaacagatgga

SEQ ID NO: 223 - DNA, 50 bp, Homo sapiens; identical to SEQ ID NO: 222

SEQ ID NO: 224 - DNA, 50 bp, Homo sapiens
gcaattcctcaggctaagctgccggttcttaaatccatcctgctaagtta

SEQ ID NO: 225 - DNA, 50 bp, Homo sapiens
tcctggtggctctttgtggaggaaactaaacattcccttgatggtctcaa

SEQ ID NO: 226 - DNA, 50 bp, Homo sapiens
ctttgggttggagctgttccattgggtcctcttggtgtcgtttccctccc

SEQ ID NO: 227 - DNA, 50 bp, Homo sapiens
agaaaaagcttgggttaactcagtagttagatcaaagcaaatgtggactg

SEQ ID NO: 228 - DNA, 50 bp, Homo sapiens
acagatgtagcaacatgagaaacgcttatgttacaggttacatgagagca

SEQ ID NO: 229 - DNA, 50 bp, Homo sapiens
tgtttaatggtagttttacagtgtttctggcttagaacaaaggggcttaa

SEQ ID NO: 230 - DNA, 50 bp, Homo sapiens
tgccagcatatactgaagtcttttctgtcaccaaatttgtacctctaagt

SEQ ID NO: 231 - DNA, 50 bp, Homo sapiens
gctgcatatgagtaaagttaccccaaccacagtgaggaggaagatgttca

SEQ ID NO: 232 - DNA, 50 bp, Homo sapiens
aaacctccagtactttggttgacccttgtatgtcacagctctgctctatt

SEQ ID NO: 233 - DNA, 50 bp, Homo sapiens
acctgatcaatgacagagccttctgaggacattccaagacagtatacagt

SEQ ID NO: 234 - DNA, 50 bp, Homo sapiens
gcccttcccttcttggtttccaaaggcatttattgctgagttatatgttc

SEQ ID NO: 235 - DNA, 50 bp, Homo sapiens
ctgattgtagcagcctcgttagtgtcaccccctcctccctgatctgtcag

SEQ ID NO: 236 - DNA, 50 bp, Homo sapiens
accaaaaagaatagggaaaaacaagaatttcatgactctacctgtggtct

SEQ ID NO: 237 - DNA, 50 bp, Homo sapiens
gacttttccaaccctcatcaccaacgtctgtgccattttgtattttacta

SEQ ID NO: 238 - DNA, 50 bp, Homo sapiens
gctcgctaccagaaatcctaccgataagcccatcgtgactcaaaactcac

SEQ ID NO: 239 - DNA, 50 bp, Homo sapiens
acctgagtcccacaacaattgaaactgcaatgaagtctccttattctgct

SEQ ID NO: 240 - DNA, 50 bp, Homo sapiens
aattgatgaggatgctcctgggagggatgcgtgactatgtggtgttgcac

SEQ ID NO: 241 - DNA, 50 bp, Homo sapiens
tgaaatatgggaaagttgctgctattgattcagggtctgtcttggaggca

SEQ ID NO: 242 - DNA, 50 bp, Homo sapiens
caactgatagccacgctgaagaatggaaggaaaatttgcttggacctgca

SEQ ID NO: 243 - DNA, 50 bp, Homo sapiens
tgtgtaaatacataagcggcgtaagtttaaaggatgttggtgttccacgt

SEQ ID NO: 244 - DNA, 50 bp, Homo sapiens
aaccctcctccaatggaaattcccgtgttgcttcaaactgagacagatgg

SEQ ID NO: 245 - DNA, 60 bp, Homo sapiens
cctccaatggaaattcccgtgttgcttcaaactgagacagatgggacttaacaggcaatg

SEQ ID NO: 246 - DNA, 70 bp, Homo sapiens
ccaaccctcctccaatggaaattcccgtgttgcttcaaactgagacagatgggacttaacaggcaatggg

SEQ ID NO: 247 - DNA, 50 bp, Homo sapiens
aatcatcatctggatttaggaattgctcttgtcatacccccaagtttcta

SEQ ID NO: 248 - DNA, 50 bp, Homo sapiens
gcaagacatagaatagtgttggaaaatgtgcaatatgtgatgtggcaaat

SEQ ID NO: 249 - DNA, 50 bp, Homo sapiens
tctccatcttggtataaatacacttccacagtcagcacggggatcacaga

SEQ ID NO: 250 - DNA, 50 bp, Homo sapiens
tctccttactgggatagtcaggtaaacagttggtcaagactttgtaaaga

SEQ ID NO: 251 - DNA, 50 bp, Homo sapiens
acccatgatgagctcctcttcctggcttcttactgaaaggttaccctgta

SEQ ID NO: 252 - DNA, 50 bp, Homo sapiens
tgacatcatattctttcagagaagtgtcccaggacatgataataagatgc

SEQ ID NO: 253 - DNA, 50 bp, Homo sapiens
atcagaaaccgaagattaactacacagctccagaagactcagacctcaaa

SEQ ID NO: 254 - DNA, 50 bp, Homo sapiens
caggttcttaagggattctccgttttggttccattttgtacacgtttgga

SEQ ID NO: 255 - DNA, 50 bp, Homo sapiens
ctagaagatccacatcctctacaggtcggggaccaaaggctgattcttgg

SEQ ID NO: 256 - DNA, 50 bp, Homo sapiens
cttcttttgccatgtttccattctgccatcttgaattgtcttgtcagcca

SEQ ID NO: 257 - DNA, 50 bp, Homo sapiens
catggagacttgaggagggcttgaggttggtgaggttaggtgcgtgtttc

SEQ ID NO: 258 - DNA, 50 bp, Homo sapiens
cccatgtaagcaccccttcatttggcattccccacttgagaattaccctt

SEQ ID NO: 259 - DNA, 50 bp, Homo sapiens
cttgggccagactgtcagggttcaaggagggcatcaggagcagacggaga

SEQ ID NO: 260 - DNA, 50 bp, Homo sapiens
cctccgctcaactagcagatacagggatgaggcagacctgactctcttaa

SEQ ID NO: 261 - DNA, 50 bp, Homo sapiens
cagcggaacccttagcacccacatggaccaacagttcttccaaacttgac

SEQ ID NO: 262 - DNA, 50 bp, Homo sapiens
atgcctggtgcttccaaatattgttgacaactgtgactgtacccaaatgg

SEQ ID NO: 263 - DNA, 50 bp, Homo sapiens
cctctctccaaacccgttttccaacatttgttaatagttacgtctctcct

SEQ ID NO: 264 - DNA, 50 bp, Homo sapiens
tcatttgttgtgtgactgagtaaagaatttttggatcaagcggaaagagt

SEQ ID NO: 265 - DNA, 50 bp, Homo sapiens
tgaggatgtagagagaacaggtgggctgtattcacgccattggttggaag

SEQ ID NO: 266 - DNA, 50 bp, Homo sapiens
gaaattaaatgggttccaggtcttaaagaaagtgcagaagagatggtcaa

SEQ ID NO: 267 - DNA, 50 bp, Homo sapiens
aaccactatcatctacggcacaaacttgcaaaagctgtccacaccatttt

SEQ ID NO: 268 - DNA, 50 bp, Homo sapiens
cccgttttggggacgtgaacgttttaataatttttgctgaattctttaca

SEQ ID NO: 269 - DNA, 50 bp, Homo sapiens
tcagttttcaggagtgggttgatttcagcacctacagtgtacagtcttgt

SEQ ID NO: 270 - DNA, 50 bp, Homo sapiens
agcctatctgcttaagagactctggagtttcttatgtgccctggtggaca

SEQ ID NO: 271 - DNA, 50 bp, Homo sapiens
gagtagaaggacaacagggcagcaacttggagggagttctctggggatgg

SEQ ID NO: 272 - DNA, 50 bp, Homo sapiens
gttctggaactaaagggatctgaaacaacattcatgtgtgaatatgcaga

SEQ ID NO: 273 - DNA, 60 bp, Homo sapiens
tggaactaaagggatctgaaacaacattcatgtgtgaatatgcagatgagacagcaacca

SEQ ID NO: 274 - DNA, 70 bp, Homo sapiens
cagggacttaatcagcaatatcaacgtaatagttctggaactaaagggatctgaaacaacattcatgtgt

SEQ ID NO: 275 - DNA, 50 bp, Homo sapiens
acccattccatttatctttctacagggctgacattgtggcacattcttag

SEQ ID NO: 276 - DNA, 50 bp, Homo sapiens
tgaacctccaacagggaaggctctgtccagaaaggattgaatgtgaaacg

SEQ ID NO: 277 - DNA, 50 bp, Homo sapiens
tgaaggagatgatgagaatcttattccagggaccaacattaacacaacca

SEQ ID NO: 278 - DNA, 50 bp, Homo sapiens
ctctctggaggtactgagacagggtgctgatgggaaggaggggagccttt

SEQ ID NO: 279 - DNA, 50 bp, Homo sapiens
ctcttcggcaaatgtagcatgggcacctcagattgttgttgttaatgggc

SEQ ID NO: 280 - DNA, 50 bp, Homo sapiens
ttccagaaagaaaagatgagagggatgagaggcaagatatgaagatgaaa

SEQ ID NO: 281 - DNA, 50 bp, Homo sapiens
ggccagcctggacccaatcatgaggaagatgcagactcttatgagaacat

SEQ ID NO: 282 - DNA, 50 bp, Homo sapiens
aatgtttgcccagaataaagaaaataagctttgcacacactctcaattct

SEQ ID NO: 283 - DNA, 50 bp, Homo sapiens
gggaaagaaataccaaccctgcaataagtgtactaaactctacgctctgg

SEQ ID NO: 284 - DNA, 50 bp, Homo sapiens
caccagcgccttggctttgtgttagcatttcctcctgaagtgttctgttg

SEQ ID NO: 285 - DNA, 50 bp, Homo sapiens
acatcgtgattctccagctcaacgggtcggccaccatcaacgccaacgtg

SEQ ID NO: 286 - DNA, 50 bp, Homo sapiens
agctacgtatccatcgtgatggcatctacatggtacacatccaggtgacg

SEQ ID NO: 287 - DNA, 50 bp, Homo sapiens
ccacactgaatctcccctcctcacagttgccatgtagaccccttgaagag

SEQ ID NO: 288 - DNA, 60 bp, Homo sapiens
cagtcccccaccacactgaatctcccctcctcacagttgccatgtagaccccttgaagag

SEQ ID NO: 289 - DNA, 70 bp, Homo sapiens
ccatgtagaccccttgaagaggggaggggcctagggagccgcaccttgtcatgtaccatcaataaagtac

SEQ ID NO: 290 - DNA, 50 bp, Homo sapiens
ctcttcaaggggtctacatggcaactgtgaggaggggagattcagtgtgg

SEQ ID NO: 291 - DNA, 60 bp, Homo sapiens
ctcttcaaggggtctacatggcaactgtgaggaggggagattcagtgtggtgggggactg

SEQ ID NO: 292 - DNA, 70 bp, Homo sapiens
gtactttattgatggtacatgacaaggtgcggctccctaggcccctcccctcttcaaggggtctacatgg

SEQ ID NO: 293 - DNA, 50 bp, Homo sapiens
tttccttgttccctcccatgcctagctggattgcagagttaagtttatga

SEQ ID NO: 294 - DNA, 60 bp, Homo sapiens
tttccttgttccctcccatgcctagctggattgcagagttaagtttatgattatgaaata

SEQ ID NO: 295 - DNA, 70 bp, Homo sapiens
gttccatgttttccttgttccctcccatgcctagctggattgcagagttaagtttatgattatgaaataa

SEQ ID NO: 296 - DNA, 50 bp, Homo sapiens
tcataaacttaactctgcaatccagctaggcatgggagggaacaaggaaa

SEQ ID NO: 297 - DNA, 60 bp, Homo sapiens
tatttcataatcataaacttaactctgcaatccagctaggcatgggagggaacaaggaaa

SEQ ID NO: 298 - DNA, 70 bp, Homo sapiens
ttatttcataatcataaacttaactctgcaatccagctaggcatgggagggaacaaggaaaacatggaac

SEQ ID NO: 299 - DNA, 50 bp, Homo sapiens
gtcatccacctggccctcaaggagagaggcgggaggaagaagtagacaag

SEQ ID NO: 300 - DNA, 50 bp, Homo sapiens
tgactgaggaggagaagaatatcaaatggggttgagtgtgcagatctctg

SEQ ID NO: 301 - DNA, 50 bp, Homo sapiens
tggttttccaaaatgcacactgcgggttattgatttgttctttacaacta

SEQ ID NO: 302 - DNA, 50 bp, Homo sapiens
actgtcagcatgttgttgttgaagtgtggagttgtaactctgcgtggact

SEQ ID NO: 303 - DNA, 50 bp, Homo sapiens
tgagtcacatcctgggatccagtgtataaatccaatatcatgtcttgtgc

SEQ ID NO: 304 - DNA, 50 bp, Homo sapiens
gttctgctactgcgaattgatgacatcgtttcaggccacaaaaagaaagg

SEQ ID NO: 305 - DNA, 50 bp, Homo sapiens
acattcccttggatgtagtctgaggccccttaactcatctgttatcctgc

SEQ ID NO: 306 - DNA, 50 bp, Homo sapiens
actggcttccatcagtggtaactgctttggtctcttctttcatctgggga

SEQ ID NO: 307 - DNA, 50 bp, Arabidopsis thaliana
ccattggagaacttggcaactcacttggcggatccatggcacaacaacat

SEQ ID NO: 308 - DNA, 50 bp, Arabidopsis thaliana
ttttctcctttgtgtaattgtggattggatcttgtcctcttttgttccct

SEQ ID NO: 309 - DNA, 50 bp, Arabidopsis thaliana
tattctttcgtgtcagggcttgaaccaagtatccccgcttcttctacccc

SEQ ID NO: 310 - DNA, 50 bp, Arabidopsis thaliana
catcaagtgaagtggggaataacgacatcatttgcctgaagagtatggtt

SEQ ID NO: 311 - DNA, 50 bp, Arabidopsis thaliana
aatgagggcattggtttgctagttgctaattgatcagtgatgtattgtca

SEQ ID NO: 312 - DNA, 50 bp, Arabidopsis thaliana
tggaatcaacaagatggcttctttccccaccaaaactaagtgatcatcag

SEQ ID NO: 313 - DNA, 50 bp, Arabidopsis thaliana
tggaccgtaatgaatgaatgtacacgccataaacgccctttgttcaagca

SEQ ID NO: 314 - DNA, 50 bp, Arabidopsis thaliana
cctcactcttgtacccacggtagattcatgtaaaataccacttatgacgc

SEQ ID NO: 315 - DNA, 50 bp, Arabidopsis thaliana
ggttagcgaccttgttgttgttgttgtgttcttacatcttcttcttgaac

SEQ ID NO: 316 - DNA, 50 bp, Arabidopsis thaliana
ggcgaaaaggacggtcttgcttgtttgtaatttgtgtggagataaaaaga

SEQ ID NO: 317 - DNA, 50 bp, Homo sapiens; identical to SEQ ID NO: 128

SEQ ID NO: 318 - DNA, 50 bp, Homo sapiens
tgaaatatcagactagtgacaagctcctggtcttgagatgtcttctcgtt

SEQ ID NO: 319 - DNA, 60 bp, Homo sapiens
ggttgagttacttcctatcaagccagtaccgtgctaacaggctcaatattcctgaatgaa

SEQ ID NO: 320 - DNA, 70 bp, Homo sapiens
gttgagttacttcctatcaagccagtaccgtgctaacaggctcaatattcctgaatgaaatatcagacta

SEQ ID NO: 321 - DNA, 50 bp, Homo sapiens
aacgagaagacatctcaagaccaggagcttgtcactagtctgatatttca

SEQ ID NO: 322 - DNA, 60 bp, Homo sapiens
ttcattcaggaatattgagcctgttagcacggtactggcttgataggaagtaactcaacc

SEQ ID NO: 323 - DNA, 70 bp, Homo sapiens
tagtctgatatttcattcaggaatattgagcctgttagcacggtactggcttgataggaagtaactcaac

SEQ ID NO: 324 - DNA, 50 bp, Homo sapiens
tttcaagacagaaagtgacgcagagaacctccccggcccagtctcgacgc

SEQ ID NO: 325 - DNA, 50 bp, Homo sapiens
gcgtcgagactgggccggggaggttctctgcgtcactttctgtcttgaaa

SEQ ID NO: 326 - DNA, 50 bp, Homo sapiens
cctagacacctgcatcagtcaaggtcatggatattgggaagacagacagc

SEQ ID NO: 327 - DNA, 50 bp, Homo sapiens
gctgtctgtcttcccaatatccatgaccttgactgatgcaggtgtctagg

SEQ ID NO: 328 - DNA, 50 bp, Homo sapiens
aaataagaagaggaaagagagaggcctgccctaacccactgttgtgctga

SEQ ID NO: 329 - DNA, 50 bp, Homo sapiens
tcagcacaacagtgggttagggcaggcctctctctttcctcttcttattt

SEQ ID NO: 330 - DNA, 50 bp, Homo sapiens
ctcatgcctgcagtgctgctcatgttgcccccttggaattacttgttcaa

SEQ ID NO: 331 - DNA, 50 bp, Homo sapiens
ttgaacaagtaattccaagggggcaacatgagcagcactgcaggcatgag

SEQ ID NO: 332 - DNA, 50 bp, Homo sapiens
ccaatttctataattattgaacagcttttcgtggggccagcacaaagtct

SEQ ID NO: 333 - DNA, 50 bp, Homo sapiens
agactttgtgctggccccacgaaaagctgttcaataattatagaaattgg

SEQ ID NO: 334 - DNA, 50 bp, Homo sapiens
tggctacaaatagagtagagaacagactccagtcctcaaagactttcagt

SEQ ID NO: 335 - DNA, 50 bp, Homo sapiens
actgaaagtctttgaggactggagtctgttctctactctatttgtagcca

SEQ ID NO: 336 - DNA, 50 bp, Homo sapiens
agttaagatggaagaatatagagaccttctgaagagcactgtagcttgga

SEQ ID NO: 337 - DNA, 50 bp, Homo sapiens
tccaagctacagtgctcttcagaaggtctctatattcttccatcttaact

SEQ ID NO: 338 - DNA, 50 bp, Homo sapiens
cactcctatggcatgtggaagcaggtctgagcagtgtgcatagaagaaaa

SEQ ID NO: 339 - DNA, 50 bp, Homo sapiens
ttttcttctatgcacactgctcagacctgcttccacatgccataggagtg

SEQ ID NO: 340 - DNA, 50 bp, Homo sapiens
gctctccgttgacaatggccaaagaatagaagctctagaccttccttatt

SEQ ID NO: 341 - DNA, 50 bp, Homo sapiens
aataaggaaggtctagagcttctattctttggccattgtcaacggagagc

SEQ ID NO: 342 - DNA, 50 bp, Homo sapiens
ggcaaaacgcacctggcacaacagaacgaataatacagaagctggatgac

SEQ ID NO: 343 - DNA, 50 bp, Homo sapiens
gtcatccagcttctgtattattcgttctgttgtgccaggtgcgttttgcc

SEQ ID NO: 344 - DNA, 50 bp, Homo sapiens
tagccatttcttcctgattgtgcctagtatatcccagacagtttgtttct

SEQ ID NO: 345 - DNA, 50 bp, Homo sapiens
agaaacaaactgtctgggatatactaggcacaatcaggaagaaatggcta

SEQ ID NO: 346 - DNA, 50 bp, Homo sapiens
ggttggaatggtgatcgggatgcagtgagatactcttgtgagagggcaaa

SEQ ID NO: 347 - DNA, 50 bp, Homo sapiens
tttgccctctcacaagagtatctcactgcatcccgatcaccattccaacc

SEQ ID NO: 348 - DNA, 50 bp, Homo sapiens
gccatgagattcaacagtcaacatcagtctgataagctacccgacaaagt

SEQ ID NO: 349 - DNA, 50 bp, Homo sapiens
actttgtcgggtagcttatcagactgatgttgactgttgaatctcatggc

SEQ ID NO: 350 - DNA, 50 bp, Homo sapiens
aagaggacaagtttgagaggcaacacttaaacactagggctactgtggca

SEQ ID NO: 351 - DNA, 50 bp, Homo sapiens
tgccacagtagccctagtgtttaagtgttgcctctcaaacttgtcctctt

SEQ ID NO: 352 - DNA, 50 bp, Homo sapiens
atttgctttaaattgagtttccttgccattgcacactcctatctttctga

SEQ ID NO: 353 - DNA, 50 bp, Homo sapiens
tcagaaagataggagtgtgcaatggcaaggaaactcaatttaaagcaaat

SEQ ID NO: 354 - DNA, 50 bp, Homo sapiens
aaaagtcactaccaggctggcagggaatggggcaatctattcatactgat

SEQ ID NO: 355 - DNA, 50 bp, Homo sapiens
atcagtatgaatagattgccccattccctgccagcctggtagtgactttt

SEQ ID NO: 356 - DNA, 50 bp, Homo sapiens
atattgatttggatacggtgaataagctggacaagatgttgaggagaggg

SEQ ID NO: 357 - DNA, 50 bp, Homo sapiens
ccctctcctcaacatcttgtccagcttattcaccgtatccaaatcaatat

SEQ ID NO: 358 - DNA, 50 bp, Homo sapiens
aatgtgcaaggtgaaatgcttttggataaacgtaagcctattttctgacg

SEQ ID NO: 359 - DNA, 50 bp, Homo sapiens
cgtcagaaaataggcttacgtttatccaaaagcatttcaccttgcacatt

SEQ ID NO: 360 - DNA, 50 bp, Homo sapiens
ttcatctctaaggcacacttgctacccctctttgctgaccccagattgtg

SEQ ID NO: 361 - DNA, 50 bp, Homo sapiens
cacaatctggggtcagcaaagaggggtagcaagtgtgccttagagatgaa

SEQ ID NO: 362 - DNA, 50 bp, Homo sapiens
ttctggcaagctcttgtcatggtgttcgacacttccttctgtcttcttgg

SEQ ID NO: 363 - DNA, 50 bp, Homo sapiens
ccaagaagacagaaggaagtgtcgaacaccatgacaagagcttgccagaa

SEQ ID NO: 364 - DNA, 50 bp, Homo sapiens
ggtcaatgtagccaattatttgtttcaacagttgcagaacagatatttca

SEQ ID NO: 365 - DNA, 50 bp, Homo sapiens
tgaaatatctgttctgcaactgttgaaacaaataattggctacattgacc

SEQ ID NO: 366 - DNA, 50 bp, Homo sapiens
tgaaaagacagctaatttggtccaacaaacatgactgggtctagggcacc

SEQ ID NO: 367 - DNA, 50 bp, Homo sapiens
ggtgccctagacccagtcatgtttgttggaccaaattagctgtcttttca

SEQ ID NO: 368 - DNA, 50 bp, Homo sapiens
tggatcattgcccaaagttgcacgcactgactccttacctgtgaggaatg

SEQ ID NO: 369 - DNA, 50 bp, Homo sapiens
cattcctcacaggtaaggagtcagtgcgtgcaactttgggcaatgatcca

SEQ ID NO: 370 - DNA, 50 bp, Homo sapiens
ttaaaacattaaaagattgactccactttgtgccaagctctgcgggtagg

SEQ ID NO: 371 - DNA, 50 bp, Homo sapiens
cctacccgcagagcttggcacaaagtggagtcaatcttttaatgttttaa

SEQ ID NO: 372 - DNA, 50 bp, Homo sapiens
tgaatttggagtccctggcacataaatctaccttcaaatcagaggtcctt

SEQ ID NO: 373 - DNA, 50 bp, Homo sapiens
aaggacctctgatttgaaggtagatttatgtgccagggactccaaattca

SEQ ID NO: 374 - DNA, 50 bp, Homo sapiens
tgggtcagagacgaaaagggctattattaggtcaaacattacagaaatca

SEQ ID NO: 375 - DNA, 50 bp, Homo sapiens
tgatttctgtaatgtttgacctaataatagcccttttcgtctctgaccca

SEQ ID NO: 376 - DNA, 50 bp, Homo sapiens
ctgatttaacaggtggttctgcgggcgtccaggtcaacatctttttgtcc

SEQ ID NO: 377 - DNA, 50 bp, Homo sapiens
ggacaaaaagatgttgacctggacgcccgcagaaccacctgttaaatcag

SEQ ID NO: 378 - DNA, 50 bp, Homo sapiens
gtcactttagcgagcgggaaaacaatggcggaaagggaaaacctggaaag

SEQ ID NO: 379 - DNA, 50 bp, Homo sapiens
ctttccaggttttccctttccgccattgttttcccgctcgctaaagtgac

SEQ ID NO: 380 - DNA, 50 bp, Homo sapiens
taattaatagagctcacttaagattgcccatcaagaaacaggagggtggt

SEQ ID NO: 381 - DNA, 50 bp, Homo sapiens
accaccctcctgtttcttgatgggcaatcttaagtgagctctattaatta

SEQ ID NO: 382 - DNA, 50 bp, Homo sapiens
agtcctgctgaatcattggtttatagaagactatctggagggcctgatag

SEQ ID NO: 383 - DNA, 50 bp, Homo sapiens
ctatcaggccctccagatagtcttctataaaccaatgattcagcaggact

SEQ ID NO: 384 - DNA, 50 bp, Homo sapiens
atgtgattccatgataatcaaatagtgaatacattataaagtcagcaact

SEQ ID NO: 385 - DNA, 50 bp, Homo sapiens
atatatgggggctgggcctcgggactctcgctctaataaaggactgtagg

SEQ ID NO: 386 - DNA, 50 bp, Homo sapiens
ttttgacccagatgatggttcctttacagaacaataaaatggctgaacat

SEQ ID NO: 387 - DNA, 50 bp, Homo sapiens
tgagcactggaaacagtttcatggagtttaagttgagtgaacatcggcca

SEQ ID NO: 388 - DNA, 50 bp, Homo sapiens
atgcatttagtttttggcaccgtagtttaagggtgggattgccagttttt

SEQ ID NO: 389 - DNA, 50 bp, Homo sapiens
ggttgtgtctctggtttccccttttccccgtggttttaatttttaagaac

SEQ ID NO: 390 - DNA, 50 bp, Homo sapiens
ggaggacacccctgtgtgttgctgctgccttccgtgctgtctactgtatc

SEQ ID NO: 391 - DNA, 50 bp, Homo sapiens
gcatcagagagaatatggaaggacatcgaccctaacttcatccagtgagg

SEQ ID NO: 392 - DNA, 50 bp, Homo sapiens
accatagcagacagggtcagatggaatattagcggtttaggtgaagaacc

SEQ ID NO: 393 - DNA, 50 bp, Homo sapiens
agacagaagacaaggccaaatgggtgtctctggaatgatagacttagaaa

SEQ ID NO: 394 - DNA, 50 bp, Homo sapiens
atccacattcttacctttggtagtcaggtttggctactttgcagctcgcc

SEQ ID NO: 395 - DNA, 50 bp, Homo sapiens
atagcagtggattaccaacaccttgacttcttgtacagtgctaacatctt

SEQ ID NO: 396 - DNA, 50 bp, Homo sapiens
tagtaaaagtgaaagagaaagggtttttcctgccacaggatataactttt

SEQ ID NO: 397 - DNA, 50 bp, Homo sapiens
aaagcggtcgtttccccacaaggtgtccaactttgcggtactcacactta

SEQ ID NO: 398 - DNA, 50 bp, Homo sapiens
ctaggcccgcccaccccaaccttctggtggggagaaataaacggtttaga

SEQ ID NO: 399 - DNA, 50 bp, Homo sapiens
tgcactaaacagttgccccaaaagacatatcttgttttaaggcccagacc

SEQ ID NO: 400 - DNA, 50 bp, Homo sapiens
ttggatgaagctgaaaagacactaagaccttctgtgcctcagatccctga

SEQ ID NO: 401 - DNA, 50 bp, Homo sapiens
gtgtggcctaaggaacacctcttgtggggagtaagagccagcccttctcc

SEQ ID NO: 402 - DNA, 50 bp, Homo sapiens
aaggatgaaggactgatggagggcagaggaactggaggcagcaggcacaa

SEQ ID NO: 403 - DNA, 50 bp, Homo sapiens
agatgtctgtataaacaacctttgggtagcaggtggtcagttaggcagga

SEQ ID NO: 404 - DNA, 50 bp, Homo sapiens
tgcttgtcttttaaacaccttcacagatatcatttgcaccttgccaaagg

SEQ ID NO: 405 - DNA, 50 bp, Homo sapiens
gggtaggcagcttgcacccagttctcctttatctcaacttattttcctgg

SEQ ID NO: 406 - DNA, 50 bp, Homo sapiens
ccggtgtccctgagtgagggcaaagttgtaataacacttgttctctcctt

SEQ ID NO: 407 - DNA, 50 bp, Homo sapiens
acggcgttctgaaatttagcacactgggaagtccacatggttcatctgaa

SEQ ID NO: 408 - DNA, 50 bp, Homo sapiens
aatgagatcacagatggtgacactgagcggaaggatgcagtacctcggag

SEQ ID NO: 409 - DNA, 50 bp, Homo sapiens
tccttgcaaaacatttggctagtggtgttcagagaaataccaaaacgtgt

SEQ ID NO: 410 - DNA, 50 bp, Homo sapiens
ggcaaaggggaaggatgatgccatgtagatcctgtttgacatttttatgg

SEQ ID NO: 411 - DNA, 50 bp, Homo sapiens
actgttaaccaaattttgagcaaggagtctcaaaggtaattctgaaccag

SEQ ID NO: 412 - DNA, 50 bp, Homo sapiens
actagcagattgaatcgatattcattaagttaggaatggttggtggtcct

SEQ ID NO: 413 - DNA, 50 bp, Homo sapiens
aattgtgctttgtatcagtcagtgctggagaaatcttgaatagcttatgt

SEQ ID NO: 414 - DNA, 50 bp, Homo sapiens
aggaaaccaagccctcacaggaaagaaagcctgaatcaagaaaacaaagt

SEQ ID NO: 415 - DNA, 50 bp, Homo sapiens
actgagcaggacaactgacctgtctccttcacatagtccatatcaccaca

SEQ ID NO: 416 - DNA, 50 bp, Homo sapiens
gcgtaaaacgccagggccatcttcttacttaagccacatcctgaaccagg

SEQ ID NO: 417 - DNA, 50 bp, Homo sapiens
agcgacaagaaggaatctggtgaattttagtcatcccagctttttagtct

SEQ ID NO: 418 - DNA, 50 bp, Homo sapiens
gctggggctgagagagggtctgggttatctccttctgatcttcaaaacaa

SEQ ID NO: 419 - DNA, 50 bp, Homo sapiens
tcatggacacaaactttggagtataagcgacatcccttaagcaacaggct

SEQ ID NO: 420 - DNA, 50 bp, Homo sapiens
attcaagtcagggcctctctgcccttttccctccagaaacaaaaccaaga

SEQ ID NO: 421 - DNA, 50 bp, Homo sapiens
tgtttgtaccactagcattcttatgtctgtacttgaacgtgtagttagca

SEQ ID NO: 422 - DNA, 50 bp, Homo sapiens
aatatagctccactaaaggaccatagggaagagccagccttgccttttct

SEQ ID NO: 423 - DNA, 50 bp, Homo sapiens
gacagtccattaagttgatttccagtggtgaagggtcagacacgcctccc

SEQ ID NO: 424 - DNA, 50 bp, Homo sapiens
cctgggttgccttgtaatgaaaagggagatcgagccattgtaccacctta

SEQ ID NO: 425 - DNA, 50 bp, Homo sapiens
gttcactgtttaacagccagaagccagagcctgcgtactagaagtggatg

SEQ ID NO: 426 - DNA, 50 bp, Homo sapiens
ttgtcaagtggatctgccccaaagtttgctttgaggaaacgggcctccct

SEQ ID NO: 427 - DNA, 50 bp, Homo sapiens
cttgtatggaaaacagatgctgacagaattgtagactaccatgccacaca

SEQ ID NO: 428 - DNA, 50 bp, Homo sapiens
aaatctaagacacccaaacccctctttgtccctaagtagccctagcctgg

SEQ ID NO: 429 - DNA, 50 bp, Homo sapiens
agctgtttaattgaattggaatcgttccacttggaacccaagtttggaaa

SEQ ID NO: 430 - DNA, 50 bp, Homo sapiens
tttttctacgttatctcatctccttgttttcagtgtgcttcaataatgca

SEQ ID NO: 431 - DNA, 50 bp, Homo sapiens
ctcccatctgcacacctggatcaaggtagcctctctgcacaagggcaggt

SEQ ID NO: 432 - DNA, 50 bp, Homo sapiens
tgtttttgcttcctcagaaactttttattgcatctgccatccttcattgg

SEQ ID NO: 433 - DNA, 50 bp, Homo sapiens
acagccaactggaaagatataaaagtttgggtctgtctcctctccttcag

SEQ ID NO: 434 - DNA, 50 bp, Homo sapiens
actcctgctttagagagaagccaccatgaaaagtcctcatcatcagggga

SEQ ID NO: 435 - DNA, 50 bp, Homo sapiens
tccgtactgtatgtgatatagtgccattttcagtaactgctgtacacaca

SEQ ID NO: 436 - DNA, 50 bp, Homo sapiens
acttgccattacttttccttcccactctctccaacatcacattcacttta

SEQ ID NO: 437 - DNA, 50 bp, Homo sapiens
gtgagtgtgagcgagagggtgagtgtggtcagagtaaagctgctccaccc

SEQ ID NO: 438 - DNA, 50 bp, Homo sapiens
taatatgctggctttgcagcagaatgaaaaggatgagttggtgtagcctt

SEQ ID NO: 439 - DNA, 50 bp, Homo sapiens
ttccttccctggaggaactctttggttgcagggctaaacttagaggctgc

SEQ ID NO: 440 - DNA, 50 bp, Homo sapiens
tctgacggttgggagtggtggaaattggaaggataccaggaggtatttgg

SEQ ID NO: 441 - DNA, 50 bp, Homo sapiens
tgattacaaaaggcgtattctttcatggtttctgcaatgagaggaagtgt

SEQ ID NO: 442 - DNA, 50 bp, Homo sapiens
tcatgcattggattgctcagaataaagtgtctgttagacttcgttttggt

SEQ ID NO: 443 - DNA, 50 bp, Homo sapiens
tgacgttaacaccaggaatctccatgtttattatttttcgtggaaactcc

SEQ ID NO: 444 - DNA, 50 bp, Homo sapiens
ttgcaaagactcacgtttttgttgttttctcatcattccattgtgatact

SEQ ID NO: 445 - DNA, 50 bp, Homo sapiens
agctgtacatataacccttttctcctaaagaggagtcagtcagtgctcct

SEQ ID NO: 446 - DNA, 50 bp, Homo sapiens
agttcaggagatctctaagtgtagctgtaaattttggggttaatttggct

SEQ ID NO: 447 - DNA, 50 bp, Homo sapiens
tgtttggttgaggggtgcttttagttgtgtggcatttgtattcattgatc

SEQ ID NO: 448 - DNA, 50 bp, Homo sapiens
tcagcctgagtgagttcagcctgtaaaaaggatgttaagctgtgggtaaa

SEQ ID NO: 449 - DNA, 50 bp, Homo sapiens
aggggaaaagaggggagaaaaacaggagtgatgtcatttctttttcatgt

SEQ ID NO: 450 - DNA, 50 bp, Homo sapiens
actttctgcttgtagttgcttaaaattatgtattttgtcttgggctgcaa

SEQ ID NO: 451 - DNA, 50 bp, Homo sapiens
aagcaactgaatcttcagcatgttctcatcggcggagccttcttgtgtaa

SEQ ID NO: 452 - DNA, 50 bp, Homo sapiens
tgattggagcactgaggaacaagggaatgaaaaggcagactctctgaacg

SEQ ID NO: 453 - DNA, 50 bp, Homo sapiens
ttgtccaaacgaagcagccgtggtagtagctgtctatgattcttgctcag

SEQ ID NO: 454 - DNA, 50 bp, Homo sapiens
tggtgcaatagaagctgcaaagatgtgccactttatctatgaaatggagt

SEQ ID NO: 455 - DNA, 50 bp, Homo sapiens
ggcttccatgtccagaatcctgcttaaggttttagggtaccttcagtact

SEQ ID NO: 456 - DNA, 50 bp, Homo sapiens
ttttggccagcttttctagataaggttgtattgctactgcaactaacaaa

SEQ ID NO: 457 - DNA, 50 bp, Homo sapiens
cacacatcctggtacccttggtcttcaaaggccatttccagcagaccctc

SEQ ID NO: 458 - DNA, 50 bp, Homo sapiens
aaacatgtctttttctcgcctcaactttatccacatgaaatgtgtgccca

SEQ ID NO: 459 - DNA, 50 bp, Homo sapiens
taagcataaaacctgacacgttaaaatccctgccctttggtgagcccact

SEQ ID NO: 460 - DNA, 50 bp, Homo sapiens
aacttgcattttagcagtgcatgtttctaattgacttactgggaaactga

SEQ ID NO: 461 - DNA, 50 bp, Homo sapiens
aggcctcaggccacctccaggaacagaacacagttttaagtttgattttt

SEQ ID NO: 462 - DNA, 50 bp, Homo sapiens
tgagtcttagcaatatgggagcaggttttcactgaattctgagggtgcct

SEQ ID NO: 463 - DNA, 50 bp, Homo sapiens
gttgtcctggcacacaaggaggcgaggctatgcgttcgaggccaacctag

SEQ ID NO: 464 - DNA, 50 bp, Homo sapiens
tgggaacacatagaactgatggaggcttttcctaaggccaaggataatgt

SEQ ID NO: 465 - DNA, 50 bp, Homo sapiens
ggattgaacagttcagttgtatctatgccccacagtgaccagtaaagtcc

SEQ ID NO: 466 - DNA, 50 bp, Homo sapiens
cgatgactcattacccaatccccatgaacttgtttcagatttgctctgtt

SEQ ID NO: 467 - DNA, 50 bp, Homo sapiens
gtcgcaaaggggataatctgggaaagacaccaaatcatgggctcacttta

SEQ ID NO: 468 - DNA, 50 bp, Homo sapiens
actcaagctcacacctgtacctgatgggaatgaacataatgtgaagaaac

SEQ ID NO: 469 - DNA, 50 bp, Homo sapiens
caccaaaatagttatgttggcactgtgttcacacgcatggtccccacacc

SEQ ID NO: 470 - DNA, 50 bp, Homo sapiens
gtgcgctttcttttacaacaagcctctagaaacagatagtttctgagaat

SEQ ID NO: 471 - DNA, 50 bp, Homo sapiens
gtgtgtataatgtaaagtagttttgcatattcttgtgctgcacatgggct

SEQ ID NO: 472 - DNA, 50 bp, Homo sapiens
aggaatccttttctacatttgagcaaatactgaggttcatgttgtaccaa

SEQ ID NO: 473 - DNA, 50 bp, Homo sapiens
cgccttggctttgtgttagcatttcctcctgaagtgttctgttggcaata

SEQ ID NO: 474 - DNA, 50 bp, Homo sapiens
agagattttctattgctgggaaggtgtgtttctcccacaatttgtttgtg

SEQ ID NO: 475 - DNA, 50 bp, Homo sapiens
tgcaaccaaattggctttaccatcttggctttagtaggtatagaagacaa

SEQ ID NO: 476 - DNA, 50 bp, Homo sapiens
tgtcaaataaaagagaacgaacaggtagtttggtggagctgagctagtgt

SEQ ID NO: 477 - DNA, 50 bp, Homo sapiens
tcctgtagaaaacgaactgtaaaagaccatgcaagaggcaaaataaaact

SEQ ID NO: 478 - DNA, 50 bp, Homo sapiens
acagtagctttgtagtgggttttctgtgctgtgctttttaatttcatgta

SEQ ID NO: 479 - DNA, 50 bp, Homo sapiens
gattcctgtcatgaaggaaagcaagacagctcacagaccagcggcatctg

SEQ ID NO: 480 - DNA, 50 bp, Homo sapiens
ttttctgtacctttctaaacctctcttccctctgtgatggttttgtgttt

SEQ ID NO: 481 - DNA, 50 bp, Homo sapiens
aaatcttattcctcctcttctcccctcacttttccctacttcctctgcaa

SEQ ID NO: 482 - DNA, 50 bp, Homo sapiens
tggaatcagacatcttccagatggtttggaccctgtccatgtgtaggtca

SEQ ID NO: 483 - DNA, 50 bp, Homo sapiens
aatttagcacctcaggaataacttattggtttaggtcagttcttggcggg

SEQ ID NO: 484 - DNA, 50 bp, Homo sapiens
aaccatgtaactccattgaacatttttcaacttaaggtctgcatagcaga

SEQ ID NO: 485 - DNA, 50 bp, Homo sapiens
aaaccaggttaatggctaagaatgggtaacatgactcttgttggattgtt

SEQ ID NO: 486 - DNA, 50 bp, Homo sapiens
ctcttggctgagcttctacagggctgagagctgcgctttggggacttcag

SEQ ID NO: 487 - DNA, 50 bp, Homo sapiens
tttcctttggggcatgatgttttaacctttgctttagaagcacaagctgt

SEQ ID NO: 488 - DNA, 50 bp, Homo sapiens
atagaatgagcttggttaagcacctctcctttgcccttcaccctgactcc

SEQ ID NO: 489 - DNA, 50 bp, Homo sapiens
ttgagtagaactctgattttccctagaggccaaattctttttatctgggt

SEQ ID NO: 490 - DNA, 50 bp, Homo sapiens
ttctaaacacattcttgatcaccaaacaacttcagaaagacagtgactgt

SEQ ID NO: 491 - DNA, 50 bp, Homo sapiens
tggagttgcttccagctgccaaggcctgtgacagaattcgctgttaagag

SEQ ID NO: 492 - DNA, 50 bp, Homo sapiens
aatgatgcaaagttttattcttgaacttggacactgatgccatcaaacaa

SEQ ID NO: 493 - DNA, 50 bp, Homo sapiens
ggccagtaaattccatgtttttggctatatctcatccaaactgagcagtt

SEQ ID NO: 494 - DNA, 50 bp, Homo sapiens
ttcccattgtcctcctactcaactaaaattcatagttggctttaagccca

SEQ ID NO: 495 - DNA, 50 bp, Homo sapiens
gcatgtcctaatgcttgctgctgatttaaacacattaaaggtactttgca

SEQ ID NO: 496 - DNA, 50 bp, Homo sapiens
acaatggcataaaagtaactttctctgaagatgtgatgttcaggctgtga

SEQ ID NO: 497 - DNA, 50 bp, Homo sapiens
aatggaaggcaggtgaagatataaaaccctagaatgcttaaatgtgctgt

SEQ ID NO: 498 - DNA, 50 bp, Homo sapiens
ttaatgccagtcctcatgtaacctcaggtatcttcagcttgtggagaata

SEQ ID NO: 499 - DNA, 50 bp, Homo sapiens
tggagtatatgcctgaaaaggttttggattcagaaagaaaaaggatggtt

SEQ ID NO: 500 - DNA, 50 bp, Homo sapiens
aaagtaaggcatggttgtggttaatctggtttatttttgttccacaagtt

SEQ ID NO: 501 - DNA, 50 bp, Homo sapiens
ggtgtgtgtgtccagagtgagcaaggattatgtttttggattgtcaaaga

SEQ ID NO: 502 - DNA, 50 bp, Homo sapiens
aaccatttgcctctggctgtgtcacagggtgagccccaaaattggggttc

SEQ ID NO: 503 - DNA, 50 bp, Homo sapiens
gaaagtggagaggacctaacatatgtctctacctagaaaggatggtttca

SEQ ID NO: 504 - DNA, 50 bp, Homo sapiens
accaactataaacccagttctaaagttgtgtatgatggtgaacctttggg

SEQ ID NO: 505 - DNA, 50 bp, Homo sapiens
ggacctgagacactgtggctgtctaatgtaatcctttaaaaattctctgc

SEQ ID NO: 506 - DNA, 50 bp, Homo sapiens
tttggtgttcagttactgagtttcaaaaatgttttggtggcatgaggaca

SEQ ID NO: 507 - DNA, 50 bp, Homo sapiens
cctgtttaagaaagtgaaatgttatggtctcccctcttccaatgagctta

SEQ ID NO: 508 - DNA, 50 bp, Homo sapiens
acggaccaggccattcattattcctcaagtgttaatatactgacttatgc

SEQ ID NO: 509 - DNA, 50 bp, Homo sapiens
acagttttgtcaaaaagtgtatcttgaccccaccatcagtactccattct

SEQ ID NO: 510 - DNA, 50 bp, Homo sapiens
tttggttcatccgtgtgctgttcttttgggttctgagagggttttgccat

SEQ ID NO: 511 - DNA, 50 bp, Homo sapiens
ggcagtaatgcaagagtccttttgtgaagagtgtttctatgtagagatgt

SEQ ID NO: 512 - DNA, 50 bp, Homo sapiens
aaatgcagagcagaatggaccagtggatggacaaggagacaacccaggcc

SEQ ID NO: 513 - DNA, 50 bp, Homo sapiens
agtgttcctgctgccagttctttcctctttaggcgtggttgagaaaaagc

SEQ ID NO: 514 - DNA, 50 bp, Homo sapiens
cagtctctgccacttgtgctagtttttgtgtggtgtttagaaacatgggc

SEQ ID NO: 515 - DNA, 50 bp, Homo sapiens
ttccacttaggtttggcattttggcagataagctaatcttgtataaagca

SEQ ID NO: 516 - DNA, 50 bp, Homo sapiens
gtaaatgccctacatggtgtgatgctgcattatatataaaactgtgtgca

SEQ ID NO: 517 - DNA, 50 bp, Homo sapiens
agctcctgtgctgaccttcaagttacgttttggaactgtaatactaaagg

SEQ ID NO: 518 - DNA, 50 bp, Homo sapiens
acactagggaagaaccttaattctaaatttggttcatgtgtggcaaagtt

SEQ ID NO: 519 - DNA, 50 bp, Homo sapiens
taactggaatcactgccctgctgtaattaaacattctgtaccacatctgt

SEQ ID NO: 520 - DNA, 50 bp, Homo sapiens
cccccagtgctttgtagtctctcctatgtcataataaagctacattttct

SEQ ID NO: 521 - DNA, 50 bp, Homo sapiens
gacagacttggacacaaaaccgatccatagaagggcttcccaaaccttgt

SEQ ID NO: 522 - DNA, 50 bp, Homo sapiens
ccatatgtaacttgttttgaagagaagtgtttccgttgtgtgtcttgatg

SEQ ID NO: 523 - DNA, 50 bp, Homo sapiens
gtatcatctgccaagaccagggcctgcttcaccacagccacaataaagtc

SEQ ID NO: 524 - DNA, 50 bp, Homo sapiens
aatgaaccatttacagttcggttttggactctgagtcaaaggattttcct

SEQ ID NO: 525 - DNA, 50 bp, Homo sapiens
gccgagtcagcacatgggtagagatgatgtaaaagcagccaatctggaaa

SEQ ID NO: 526 - DNA, 50 bp, Homo sapiens
accttctgggaggagggtcggattcaatctgaacttagaactttcaactc

SEQ ID NO: 527 - DNA, 50 bp, Homo sapiens
gcaccatgtagaattttcactttgtactggcaggctcgttttacctcatt

SEQ ID NO: 528 - DNA, 50 bp, Homo sapiens
tctccagtcctgattactgtacacagtagctttagatggcgtggacgtga

SEQ ID NO: 529 - DNA, 50 bp, Homo sapiens
ttcctgttactggcatgtgcacgactatgttattagaagccactttatca

SEQ ID NO: 530 - DNA, 50 bp, Homo sapiens
gccagcttggaggatggacatttctggatacacatacacatacaaaacag

SEQ ID NO: 531 - DNA, 50 bp, Homo sapiens
tcagctccttgatctaagcctcccagagagacccctagaatgtttccctc

SEQ ID NO: 532 - DNA, 50 bp, Homo sapiens
ccggcggcaggaactatcagtagacagctgctgcttccatgaaacggaaa

SEQ ID NO: 533 - DNA, 50 bp, Homo sapiens
tgttgccttgaatataacagtacaatttgtcaattactctgcaccaggct

SEQ ID NO: 534 - DNA, 50 bp, Homo sapiens
aaaagtaacaccctccctttttcctgacagttctttcagctttacagaac

SEQ ID NO: 535 - DNA, 50 bp, Homo sapiens
aatgaaatgtagttgggttcttcctgtaatgcgctattatgtcttgggct

SEQ ID NO: 536 - DNA, 50 bp, Homo sapiens
aacctccttgtgtctgtttctctgttcctctgtggctgactcaataaact

SEQ ID NO: 537 - DNA, 50 bp, Homo sapiens
gtgggagggtgagatgtgaagatgtgggatgaacctggaatgaacgaatt

SEQ ID NO: 538 - DNA, 50 bp, Homo sapiens
ggcctaaagaaagctggggttaatcctgaagctaaaagtaaatgtttctt

SEQ ID NO: 539 - DNA, 50 bp, Homo sapiens
tcccatcctttccatcaagaccttcattagcttatgatatttgctgccga

SEQ ID NO: 540 - DNA, 50 bp, Homo sapiens
ggaggtctcttccagattgctcttctgccgaattatttgtatctattccg

SEQ ID NO: 541 - DNA, 50 bp, Homo sapiens
gcacacctcgtcagaggaccataaccgtgtggggacaataaccgcagggg

SEQ ID NO: 542 - DNA, 50 bp, Homo sapiens
acaatggatttgtgaagagcagattccatgagtaactctgacaggtattt

SEQ ID NO: 543 - DNA, 50 bp, Homo sapiens
tgagagacattgttaattttgggggaattggcattgcgaaagacttgaaa

SEQ ID NO: 544 - DNA, 50 bp, Homo sapiens
tgctagacatttctatactctgttgtaacactgaggtatctcatttgccc

SEQ ID NO: 545 - DNA, 50 bp, Homo sapiens
gtgggggatgggggttaaaaagtagagaacctcctttctgttcaactaat

SEQ ID NO: 546 - DNA, 50 bp, Homo sapiens
caggtgagtagttgccgcgtaatatcattggagtacattctttatactgt

SEQ ID NO: 547 - DNA, 50 bp, Homo sapiens
ccccaaccttattctgtgtgtagacattgtattccacaattttgaatggc

SEQ ID NO: 548 - DNA, 50 bp, Homo sapiens
cgaatggcttaaactaatttgctatgatcctctaacaccgaaatttccca

SEQ ID NO: 549 - DNA, 50 bp, Homo sapiens
agagggaatcagaaaaatgccaagccttttctctttgaatgtgctatttt

SEQ ID NO: 550 - DNA, 50 bp, Homo sapiens
cacccttctctgttaaccttgtgcctgtctcctgtatgatcacatcacca

SEQ ID NO: 551 - DNA, 50 bp, Homo sapiens
tgtgtctctgtcgcgtctgctgtgaagcacatgatgctctatttattgta

SEQ ID NO: 552 - DNA, 50 bp, Homo sapiens
tgagagtaagcacatgacagcgtctgcttgcgttgtgtctgttttatgtt

SEQ ID NO: 553 - DNA, 50 bp, Homo sapiens; identical to SEQ ID NO: 153

SEQ ID NO: 554 - DNA, 50 bp, Homo sapiens
tgcaacgaatatggataccacatagtactttggtgttacctgcttttgaa

SEQ ID NO: 555 - DNA, 50 bp, Homo sapiens
agaactgaatcagtcggaggaacctgaggcaggcgagagtagtactggag

SEQ ID NO: 556 - DNA, 50 bp, Homo sapiens
ttgccatgagataacacagtgtaaacagtagacacccagaaatcgtgact

SEQ ID NO: 557 - DNA, 50 bp, Homo sapiens
gctgttaggctaagagggtgcagggctagacacgaagcttaaactattca

SEQ ID NO: 558 - DNA, 50 bp, Homo sapiens
ccagtgtggaggtagcaaagcatctatctattctgaatcatgtttggaaa

SEQ ID NO: 559 - DNA, 50 bp, Homo sapiens
gccagtatgccacagaatgtcctaaacccttgctgcctcttatcaaaacc

SEQ ID NO: 560 - DNA, 50 bp, Homo sapiens
tttgtactgttgaaaccacttcattggacatgttgcaatagcaaaacccc

SEQ ID NO: 561 - DNA, 50 bp, Homo sapiens
agggggaacattgtaaagaaacaaaaaggtccagatgaatgtatgctaga

SEQ ID NO: 562 - DNA, 50 bp, Homo sapiens
ggtgctgaatatgtccttgtaggctctgttttaagaaaacaatatgtggg

SEQ ID NO: 563 - DNA, 50 bp, Homo sapiens
acattggcttgcttttgttaaagtgcaagtgttacatatggctttgtaca

SEQ ID NO: 564 - DNA, 50 bp, Homo sapiens
ttggtagtgtcagcgggcaccttttacaccttctagtagctcaagctagt

SEQ ID NO: 565 - DNA, 50 bp, Homo sapiens
tcctggaatcgtttaatctaaagcagtttcccctgttttggagattttgt

SEQ ID NO: 566 - DNA, 50 bp, Homo sapiens; identical to SEQ ID NO: 565

SEQ ID NO: 567 - DNA, 50 bp, Homo sapiens
tgagaaagtcctgtgcagtcctgagatgattactcttatttggtgtgctg

SEQ ID NO: 568 - DNA, 50 bp, Homo sapiens
tcgtcttttgcgaatggcttaattctgacactacctttctgggaaatgtt

SEQ ID NO: 569 - DNA, 50 bp, Homo sapiens
tttgattgtgtctgatgggaactgagttgttggcctttgtgaaatgaaat

SEQ ID NO: 570 - DNA, 50 bp, Homo sapiens
ttgacaaagcccaacaatgatctcaggaattacattttccaacagaccaa

SEQ ID NO: 571 - DNA, 50 bp, Homo sapiens
acctgtcacgcttctagttgcttcaaccattttataaccatttttgtaca

SEQ ID NO: 572 - DNA, 50 bp, Homo sapiens
tccttaaggtgcacagtaaatgtacagatagttataggccactgttttgt

SEQ ID NO: 573 - DNA, 50 bp, Homo sapiens
agctcatatgaacactgctctgaactcctctgacttagcattcaacttaa

SEQ ID NO: 574 - DNA, 50 bp, Homo sapiens
catgacaaacattactagcatgttcaactgcaccatgttctggcactgta

SEQ ID NO: 575 - DNA, 50 bp, Homo sapiens
acctctttcctaccaatttcacattttgcagaaacttgttcacatttcca

SEQ ID NO: 576 - DNA, 50 bp, Homo sapiens
gggttgtgtattaaatagccattcattctggaactcaaggacaggactgt

SEQ ID NO: 577 - DNA, 50 bp, Homo sapiens
gccttgcaggtgaccagcagtgtcattgtatttatatacagagcttatga

SEQ ID NO: 578 - DNA, 50 bp, Homo sapiens
ctggacgggcgtgggttctgggtcagcttcttttacctcaattttgtttg

SEQ ID NO: 579 - DNA, 50 bp, Homo sapiens
aaagtctgaggtgtggaacagttatttaagcattagtcaaccctggtcct

SEQ ID NO: 580 - DNA, 50 bp, Homo sapiens
tgggcaagacatgattaatgaatcagaatcctgtttcattggtgacttgg

SEQ ID NO: 581 - DNA, 50 bp, Homo sapiens
cctgtgtaaaagaagaaatacaagagactcaaacacctacacattcacgg

SEQ ID NO: 582 - DNA, 50 bp, Homo sapiens
tggcttgttcatcctccagatgtagctattgatgtacacttcgcaacgga

SEQ ID NO: 583 - DNA, 50 bp, Homo sapiens
aactatcagcttggatggtcacttgaatagaagatggttatacacagtgt

SEQ ID NO: 584 - DNA, 50 bp, Homo sapiens
ccacggtggaccctgtttgttttaaatattctgttcccatgtcaatcagt

SEQ ID NO: 585 - DNA, 50 bp, Homo sapiens
ttgtgtaggaaacttttgcagtttgacactaagataacttctgtgtgcat

SEQ ID NO: 586 - DNA, 50 bp, Homo sapiens
actcaaatcagttagcttcaaacaaaaacgaaagttagaccaagggaacg

SEQ ID NO: 587 - DNA, 50 bp, Homo sapiens; identical to SEQ ID NO: 586

SEQ ID NO: 588 - DNA, 50 bp, Homo sapiens
ttgtgtgctgtgcttcaaagccttaactgtcaaatcttgcattatcttgt

SEQ ID NO: 589 - DNA, 50 bp, Homo sapiens
acattatcatggcatgacttaagggaacattggtttgtgaaggaaaaaca

SEQ ID NO: 590 - DNA, 50 bp, Homo sapiens
tgtgtgactttcatgcttctggggttggagcttaaagatccaaactgaga

SEQ ID NO: 591 - DNA, 50 bp, Homo sapiens
tgctggtattctcactgccacatttttggaaacctgtattacaccttaaa

SEQ ID NO: 592 - DNA, 50 bp, Homo sapiens
ttgagtgtctgcagcagccctggacttccagacttctatcacatgagaaa

SEQ ID NO: 593 - DNA, 50 bp, Homo sapiens
tggtgctgatgcttagttgtctcatgccattaaattgtaaaagtgagttg

SEQ ID NO: 594 - DNA, 50 bp, Homo sapiens
ggaggtcagttgatttccccaggtacattcatggtgtgacagacacatgg

SEQ ID NO: 595 - DNA, 50 bp, Homo sapiens
agatcctttcagtccctagacctccattcactctgtttctcttctgctgg

SEQ ID NO: 596 - DNA, 50 bp, Homo sapiens
gatccgatcatggtgatgtacggggtgaattctcttgccgtgttgcaaat

SEQ ID NO: 597 - DNA, 50 bp, Homo sapiens
atggtttcaaaattcaaggtccccaaatggcagcattttatgttctgacc

SEQ ID NO: 598 - DNA, 50 bp, Homo sapiens
caagtatgtatgcaactttgcacaccaacaactgttaatctgtagctagt

SEQ ID NO: 599 - DNA, 50 bp, Homo sapiens
tggtgattctccaggccatttaataccctgcaatgtaattgtccctctgt

SEQ ID NO: 600 - DNA, 50 bp, Homo sapiens
ttctgcctcaatgtttactgtgcctttgtttttgctagtttgtgttgttg

SEQ ID NO: 601 - DNA, 50 bp, Homo sapiens
actactgtcacgtagctgtgtacaaagagatgtgaaatactttcaggcaa

SEQ ID NO: 602 - DNA, 50 bp, Homo sapiens
tgttgaacggttaaactgtgcatttctcattttgatgtgtcatgtatgtt

SEQ ID NO: 603 - DNA, 50 bp, Homo sapiens
aatggtcaaggttcagcatattctatatgaagatcacaaggtggtatcgt

SEQ ID NO: 604 - DNA, 50 bp, Homo sapiens
tgtgaacttgtgcgcaaatgtgcagattcaatgttcttgttacagattga

SEQ ID NO: 605 - DNA, 50 bp, Homo sapiens
ccccttgggctcagcacgaaagggctttcaatgaattaagtgaaaacttt

SEQ ID NO: 606 - DNA, 50 bp, Homo sapiens
aatgagttgtgttgaagcctccgtctcccatccttgcctgtagcccgtag

SEQ ID NO: 607 - DNA, 50 bp, Homo sapiens
agcctaaacatgtatactgtgcattttatgggtgactttgaaagatctgt

SEQ ID NO: 608 - DNA, 50 bp, Homo sapiens
accaggttttagcaaaatgcacacttttggctctttttggtatatgttct

SEQ ID NO: 609 - DNA, 50 bp, Homo sapiens
cctgactcctccttgcaaacaaaatgatagttgacactttatcctgattt

SEQ ID NO: 610 - DNA, 50 bp, Homo sapiens
ttgtattggcataatcagtgacttgtacattcagcaatagcatttgagca

SEQ ID NO: 611 - DNA, 50 bp, Homo sapiens
ttgttaagttgcaattactgcaatgacagaccaataaacaattgctgcca

SEQ ID NO: 612 - DNA, 50 bp, Homo sapiens
acagcaaactttggcatttatgtggagcatttctcattgttggaatctga

SEQ ID NO: 613 - DNA, 50 bp, Homo sapiens
tggtcattctgctgtgttcattaggtgccaatgtgaagtctggattttaa

SEQ ID NO: 614 - DNA, 50 bp, Homo sapiens
ggcatgaaatgagggacaaagaaagcatctcgtaggtgtgtctactgggt

SEQ ID NO: 615 - DNA, 50 bp, Homo sapiens
aatcttgacacatgcaattgtaaataaaagtcaccacttttgccaagctt

SEQ ID NO: 616 - DNA, 50 bp, Homo sapiens
tgatgccttcatctgttcagtcatctccaaaaacagtaaaaataaccact

SEQ ID NO: 617 - DNA, 50 bp, Homo sapiens
ggccaagctgaatgccatgaatatcagtgagacgcgttataaggaatcct

SEQ ID NO: 618 - DNA, 50 bp, Homo sapiens
cctgccagtgtcagaaaatcctatttatgaatcctgtcggtattccttgg

SEQ ID NO: 619 - DNA, 50 bp, Homo sapiens
tcaagaatttgggtgggagaaaagaaagtgggttatcaagggtgatttga

SEQ ID NO: 620 - DNA, 50 bp, Homo sapiens
caaactggtgcagaaattctataaactctttgctgtttttgatacctgct

SEQ ID NO: 621 - DNA, 50 bp, Homo sapiens
gctacttgtttacattgtacactgcgaccaccttgccgcttttcatcaca

SEQ ID NO: 622 - DNA, 50 bp, Homo sapiens
actggatgctacagacttataacagcatagtgaatggtaagactagtgca

SEQ ID NO: 623 - DNA, 50 bp, Homo sapiens
cctcccctatgcctcagccccatctctgctcctgtttgaattttgttatt

SEQ ID NO: 624 - DNA, 50 bp, Homo sapiens
ccagtgtgactagggatcctgagttttctgggacaattccagctttaatc

SEQ ID NO: 625 - DNA, 50 bp, Homo sapiens
tgacccttctttaagttatgtgtgtggggagaaatagaatggtgctctta

SEQ ID NO: 626 - DNA, 50 bp, Homo sapiens
gtgtgagtcctctgtttgcactggacatattccctacctgtcttatttca

SEQ ID NO: 627 - DNA, 50 bp, Homo sapiens
aggggaaggggtgcctggcgggtacttttctatcttttatttccagattt

SEQ ID NO: 628 - DNA, 50 bp, Homo sapiens
tcatgcttctgccctgtcaaaggtccctatttgaaatgtgttataataca

SEQ ID NO: 629 - DNA, 50 bp, Homo sapiens
agctagcagatcgtagctagtttgtattgtcttgtcaattgtacagactt

SEQ ID NO: 630 - DNA, 50 bp, Homo sapiens
agcccagaattcccaaaggcattaggtttcccaactgctttgtgctgata

SEQ ID NO: 631 - DNA, 50 bp, Homo sapiens
gtgtctatacatttctaagccttgtttgcagaataaacagggcatttagc

SEQ ID NO: 632 - DNA, 50 bp, Homo sapiens
tagaggtgtacagatgctatattatatccgctcccggtgtactgcagccc

SEQ ID NO: 633 - DNA, 50 bp, Homo sapiens
ttttacaaggaaggggtagtaattggcccactctcttcttactggaggct

SEQ ID NO: 634 - DNA, 50 bp, Homo sapiens
acacggtgaactggctgtgtccatctttgtcactgagtgaaatctctgtt

SEQ ID NO: 635 - DNA, 50 bp, Homo sapiens
tgaggacttggggcaggaaaggaatgctgctgaacttgaatttcccttta

SEQ ID NO: 636 - DNA, 50 bp, Homo sapiens
tcagaccttggatcagatgaactcttagaaatgaaggcagaaaaatgtca

SEQ ID NO: 637 - DNA, 50 bp, Homo sapiens
ccacgttcttgttccgatactctgagaagtgcctgatgttgatgtactta

SEQ ID NO: 638 - DNA, 50 bp, Homo sapiens
gcctgggtcagatttttattgtggggtgggatgagtaggacaacatattt

SEQ ID NO: 639 - DNA, 50 bp, Homo sapiens
gggtgcccacctgcatgtgaaggggaggcagttctcaatttatttcaata

SEQ ID NO: 640 - DNA, 50 bp, Homo sapiens
cagtcactgggtctatattaaacagcaaccagagcaacaaatggcaaaca

SEQ ID NO: 641 - DNA, 50 bp, Homo sapiens
tgacatggtagcagaaataggcccttttatgtgttgcttctattttacct

SEQ ID NO: 642 - DNA, 50 bp, Homo sapiens
agcaaagaacagtttggtggtcttttctcttccactgatttttctgtaat

SEQ ID NO: 643 - DNA, 50 bp, Homo sapiens
agccctgctaaactatgtacagaggaaactgttcaagtattggatttgaa

SEQ ID NO: 644 - DNA, 50 bp, Homo sapiens
tgtcaacgatgtttccagtagtgtttagatttggtgtcttcaaaggtagt

SEQ ID NO: 645 - DNA, 50 bp, Homo sapiens
ggctttttgcccatcaagaataaaaagaaataaaaccaaagggttaccgg

SEQ ID NO: 646 - DNA, 50 bp, Homo sapiens
tgcctgttgcacatcttgtaaaattggacaatggctctttagagagttat

SEQ ID NO: 647 - DNA, 50 bp, Homo sapiens
tgcggctagttcagagagatttttagagctgtggtggacttcatagatga

SEQ ID NO: 648 - DNA, 50 bp, Homo sapiens
aatggaaggattagtatggcctatttttaaagctgctttgttaggttcct

SEQ ID NO: 649 - DNA, 50 bp, Homo sapiens
ccatgtgggctactcatgatgggcttgattctttgggaataataaaatga

SEQ ID NO: 650 - DNA, 50 bp, Homo sapiens
aacgaggccagtggggaacccttacctaagtatgtgattgacaaatcatg

SEQ ID NO: 651 - DNA, 50 bp, Homo sapiens
cctctcaggacgtgccgggtttatcattgctttgttatttgtaaggactg

SEQ ID NO: 652 - DNA, 50 bp, Homo sapiens
ccactgcctgaaaggtttgtacagatgcatgccacagtagatgtccacat

SEQ ID NO: 653 - DNA, 50 bp, Homo sapiens
ttttgggataaattttactggttgctgttgtggagaaggtggcgtttcca

SEQ ID NO: 654 - DNA, 50 bp, Homo sapiens
tgaagtataagcctctactgggtctatattgtgaatcatcctgcctttca

SEQ ID NO: 655 - DNA, 50 bp, Homo sapiens
ctcgtctattggcccctgtagaaagttaacctttgttgttttccttttat

SEQ ID NO: 656 - DNA, 50 bp, Homo sapiens
tccccttctgtcccctagtaagcccagttgctgtatctgaacagtttgag

SEQ ID NO: 657 - DNA, 50 bp, Homo sapiens
aaacctatttcccttgcctcataggcttctgggatgtcatcacctccagt

SEQ ID NO: 658 - DNA, 50 bp, Homo sapiens
gaatttggtggtgtcaattgcttatttgttttcccacggttgtccagcaa

SEQ ID NO: 659 - DNA, 50 bp, Homo sapiens
ctattttgggtcatttttatgtacctttgggttcaggcattatttggggg

SEQ ID NO: 660 - DNA, 50 bp, Homo sapiens
taattgttgaacaggtgtttttccacaagtgccgcaaattgtaccttttt

SEQ ID NO: 661 - DNA, 50 bp, Homo sapiens
ccccctcagaagaatcatgaatttgcaacagacctaatttttggttactt

SEQ ID NO: 662 - DNA, 50 bp, Homo sapiens
ggcctttccattccatttattcacactgagtgtcctacaataaacttccg

SEQ ID NO: 663 - DNA, 50 bp, Homo sapiens
tggtgtctcaaaggagtaactgcagcttggtttgaaatttgtactgtttc

SEQ ID NO: 664 - DNA, 50 bp, Homo sapiens
tgccagtagtgaccaagaacacagtgattatatacactatactggaggga

SEQ ID NO: 665 - DNA, 50 bp, Homo sapiens
aggacacatctgacatcctgtgtttggttaaaatatacagcacattgtga

SEQ ID NO: 666 - DNA, 50 bp, Homo sapiens
tgggggttgtaaattggcatggaaatttaaagcaggttcttgttagtgca

SEQ ID NO: 667 - DNA, 50 bp, Homo sapiens
tgtgaaagaaacttgcttgcagctttaacaaaatgagaaacttcccaaat

SEQ ID NO: 668 - DNA, 50 bp, Homo sapiens
gtatatatcctccagcattcagtccagggggagccacggaaaccatgttc

SEQ ID NO: 669 - DNA, 50 bp, Homo sapiens
tgtgatgctaggaacatgagcaaactgaaaattactatgcacttgtcaga

SEQ ID NO: 670 - DNA, 50 bp, Homo sapiens
aacccagtatatctgtgttatctgatgggacggttgacagtggtcaggga

SEQ ID NO: 671 - DNA, 50 bp, Homo sapiens
atccagtggcctaggaattaaagtgttgttgtttttgctgttaaattgga

SEQ ID NO: 672 - DNA, 50 bp, Homo sapiens
gcattggcagcattgtgtctttgaccttgtatactagcttgacatagtgc

SEQ ID NO: 673 - DNA, 50 bp, Homo sapiens
tttcatggtgtgaaggaaggagcgtggtgcattggacatgggtctgacac

SEQ ID NO: 674 - DNA, 50 bp, Homo sapiens
agactgcacaaccaagaagttactcaaagctctgtgggagcccctgcctg

SEQ ID NO: 675 - DNA, 50 bp, Homo sapiens
cagtgctcacctaaatccatctgactacttgttcctgtgccctcttgttt

SEQ ID NO: 676 - DNA, 50 bp, Homo sapiens
gtgacgacgacctgaaggagacgggcttccaccttaccaccacgaaccag

SEQ ID NO: 677 - DNA, 50 bp, Homo sapiens
aacaggataaagctcgccgggaatgggaaagacagaagagaagggaaatg

SEQ ID NO: 678 - DNA, 50 bp, Homo sapiens
cctcacccccaccctcactttcaatccgtttgataccatttggctccttt

SEQ ID NO: 679 - DNA, 50 bp, Homo sapiens
atggaaagatgtggtctgagatgggtgctgcaaagatcataataaagtca

SEQ ID NO: 680 - DNA, 50 bp, Homo sapiens
ccatgacttcacagacatggtctagaatctgtacccttacccacatatga

SEQ ID NO: 681 - DNA, 50 bp, Homo sapiens
ctgtgaatgtttgcagtctcctaccgtctcaactacagctgcagttgcta

SEQ ID NO: 682 - DNA, 50 bp, Homo sapiens
cagcctgaattgcctctgggaagaggggtgggaatgacttttcaatgtac

SEQ ID NO: 683 - DNA, 50 bp, Homo sapiens
aatggcctagaatttgtggtagttgccaaagaggttctcctaggtggtct

SEQ ID NO: 684 - DNA, 50 bp, Homo sapiens
cagtgaaaagtttgtgagtgaagaatgctgagaagattgtaatgctttgt

SEQ ID NO: 685 - DNA, 50 bp, Homo sapiens
ttgtctcaaagctaccaagtttgtgcaataagtggaagggatgtcatcct

SEQ ID NO: 686 - DNA, 50 bp, Homo sapiens
acatcgaaggtgtgcatatatgttgaatgacattttagggacatggtgtt

SEQ ID NO: 687 - DNA, 50 bp, Homo sapiens
ggctatctcaggcaatatggccagcacctgggtctttatgcatgaagata

SEQ ID NO: 688 - DNA, 50 bp, Homo sapiens
gctgtcacggagcgactgtcgagatcgcctagtatgttctgtgaacacaa

SEQ ID NO: 689 - DNA, 50 bp, Homo sapiens
agctgctgacttgactgtcatcctgttcttgttagccattgtgaataaga

SEQ ID NO: 690 - DNA, 50 bp, Homo sapiens
ctcacaggtggactgagaaatcagttacatcttaagtgacctacagggta

SEQ ID NO: 691 - DNA, 50 bp, Homo sapiens
gtgcattgtatttagtctgtattgatcatggatgccctccttaatagcca

SEQ ID NO: 692 - DNA, 50 bp, Homo sapiens
cctgtacaattgcatcacgggtggggataaaaagaggaatattctggttt

SEQ ID NO: 693 - DNA, 50 bp, Homo sapiens
aaacagagctgtcttcagcaacattattagtagacaaagaggatgtggat

SEQ ID NO: 694 - DNA, 50 bp, Homo sapiens
actcaagttttcagtttgtaccgcctggtatgtctgtgtaagaagccaat

SEQ ID NO: 695 - DNA, 50 bp, Homo sapiens
tgactcctgccaagaaatcctttcttagaaggttgtttgattagttttgc

SEQ ID NO: 696 - DNA, 50 bp, Homo sapiens
ttgtattatctgctttgctgatgtagacaagagttaactgagtagcatgc

SEQ ID NO: 697 - DNA, 50 bp, Homo sapiens
aaagattgttggttaggccagattgacacctatttataaaccatatgcgt

SEQ ID NO: 698 - DNA, 50 bp, Homo sapiens
tggtaactgttccaggattgctccaggtttgagatggtattgctaaattt

SEQ ID NO: 699 - DNA, 50 bp, Homo sapiens
tgcaccttgtagtggattctgcatatcatctttcccacctaaaaatgtct

SEQ ID NO: 700 - DNA, 50 bp, Homo sapiens
cactagcacttgtgatgcaatagaacacttcgcctgtactgaaagggcca

SEQ ID NO: 701 - DNA, 50 bp, Homo sapiens
acgcaggctttcctatttctacaactgattgtacttatgcattttgtacc

SEQ ID NO: 702 - DNA, 50 bp, Homo sapiens
caggagctactttgagtttggtgttactaggatcagggtcagtctttggc

SEQ ID NO: 703 - DNA, 50 bp, Homo sapiens
tagagagaggcccgtggcctgaggtagtgcagaggaggatagtagagcag

SEQ ID NO: 704 - DNA, 50 bp, Homo sapiens
ttttggaagattttcagtctagttgccaaatctggctcctttacaaaaga

SEQ ID NO: 705 - DNA, 50 bp, Homo sapiens
aagttaattgaggcaatgtcatctgctcaaagttgagtggtttattcaca

SEQ ID NO: 706 - DNA, 50 bp, Homo sapiens
ttgcagtgtattactgtcagcagtatggtagctcaccgtggacgttcggc

SEQ ID NO: 707 - DNA, 50 bp, Homo sapiens
tattctgtgttaatggctaacctgttacactgggctgggttgggtagggt

SEQ ID NO: 708 - DNA, 50 bp, Homo sapiens
aaactgaatgagagaaaattgtataaccatcctgctgttcctttagtgca

SEQ ID NO: 709 - DNA, 50 bp, Homo sapiens
tgacactggtcttgcagtacaactggaagccaaaacaaggtggaagatgt

SEQ ID NO: 710 - DNA, 50 bp, Homo sapiens
ggtcaagtatatttggacctattatcctcggcaagccaagatgcaaacat

SEQ ID NO: 711 - DNA, 50 bp, Homo sapiens
agttcacaatatggttcaaatgtaacagtgcagaattgaatatggaggca

SEQ ID NO: 712 - DNA, 50 bp, Homo sapiens
ttgcatctttccaggagagcctcacattcttcttccaggttgtatcaccc

SEQ ID NO: 713 - DNA, 50 bp, Homo sapiens
gtgagtcaggagcaggagcgtgcggaccaaaaatcctcagcccttacgac

SEQ ID NO: 714 - DNA, 50 bp, Homo sapiens
tcaccttatgcaatgtgaattatcactacagaactccatcttactccaga

SEQ ID NO: 715 - DNA, 50 bp, Homo sapiens
tttgatgtaatataacctaacgttgtgctggtacctgttttaccatgtgt

SEQ ID NO: 716 - DNA, 50 bp, Homo sapiens
ctccatccctggccccctccctggatgacattaaagaagggttgagctgg

SEQ ID NO: 717 - DNA, 50 bp, Homo sapiens; identical to SEQ ID NO: 716

SEQ ID NO: 718 - DNA, 50 bp, Homo sapiens
ggcttagctgccagtctcccatttgtgacctatgccatccatctataatg

SEQ ID NO: 719 - DNA, 50 bp, Homo sapiens
ggccccaatgccaactcttaagtcttttgtaattctggctttctctaata

SEQ ID NO: 720 - DNA, 50 bp, Homo sapiens
tgtcaggtttgggtcttgggttcaagtgtatatattcctgtaagtttctt

SEQ ID NO: 721 - DNA, 50 bp, Homo sapiens; identical to SEQ ID NO: 75

SEQ ID NO: 722 - DNA, 50 bp, Homo sapiens
ttgacattctgcgaaagcaacaagcaaactgaagaccaactcctatgaga

SEQ ID NO: 723 - DNA, 50 bp, Homo sapiens
cgcctcttcaggttcttaagggattctccgttttggttccattttgtaca

SEQ ID NO: 724 - DNA, 50 bp, Homo sapiens
ccttgttggacagggggacaggctgcctactggaatgtaaatatgtgata

SEQ ID NO: 725 - DNA, 50 bp, Homo sapiens
tttctgaatgcctacctggcggtgtataccaggcagtgtcccagtttaaa

SEQ ID NO: 726 - DNA, 50 bp, Homo sapiens
tgtgcaaggggagcacatattggatgtatatgttaccatatgttaggaaa

SEQ ID NO: 727 - DNA, 50 bp, Homo sapiens
tcaagtgaacatctcttgccatcacctagctgcctgcacctgcccttcag

SEQ ID NO: 728 - DNA, 50 bp, Homo sapiens
ccgaggagaagcgcgagggctacgagcgtctcctgaagatgcaaaaccag

SEQ ID NO: 729 - DNA, 50 bp, Homo sapiens
gcagctgtttgaagtttgtatattttccgtactgcagagcttacacaaaa

SEQ ID NO: 730 - DNA, 50 bp, Homo sapiens
gcctgtgaaatagtactgcacttacataaagtgagacattgtgaaaaggc

SEQ ID NO: 731 - DNA, 50 bp, Homo sapiens
gctctgattgtacaagaattacctgtgctagtcaagttgttgtttttcct

SEQ ID NO: 732 - DNA, 50 bp, Homo sapiens
ctgtcttttgtagctctggactggaggggtagatggggagtcaattaccc

SEQ ID NO: 733 - DNA, 50 bp, Homo sapiens
ggtacaaccttcaactatttcttccatgcggaccccctcctgccaaaaga

SEQ ID NO: 734 - DNA, 50 bp, Homo sapiens
gcaattctccctgcgtcatggatttcaaggtcttttaatcaccttcggtt

SEQ ID NO: 735 - DNA, 50 bp, Homo sapiens
ccttcgctttaacataggtctaatttatttgccgtgccattttccataca

SEQ ID NO: 736 - DNA, 50 bp, Homo sapiens
tggttggaagtgggtggggttatgaaattgtagatgtttttagaaaaact

SEQ ID NO: 737 - DNA, 50 bp, Homo sapiens
accttcctccaggaaaagccattcaagcctgattatttttctaagtaact

SEQ ID NO: 738 - DNA, 50 bp, Homo sapiens
ctgtatagctttccccacctcccacaaaatcacccagttaatgtgtgtgt

SEQ ID NO: 739 - DNA, 50 bp, Homo sapiens
ggggtacctgtgttgagttgataaacatttccatcttcattaaaactgct

SEQ ID NO: 740 - DNA, 50 bp, Homo sapiens
tgtccacctttgcagcctgtttctgtcatgtagtttcaacaagtgctacc

SEQ ID NO: 741 - DNA, 50 bp, Homo sapiens
atgctacctcaaagtgctaccgataaacctttctaattgtaagtgccctt

SEQ ID NO: 742 - DNA, 50 bp, Homo sapiens
agcacccattccgaccatagtataatcatatcaaagggtgagaatcattt

SEQ ID NO: 743 - DNA, 50 bp, Homo sapiens
tgtggtttaagctgtactgaactaaatctgtggaatgcattgtgaactgt

SEQ ID NO: 744 - DNA, 50 bp, Homo sapiens
attacgaagatgaaccagtaaacgaggacatggagtgactatcggggcgg

SEQ ID NO: 745 - DNA, 50 bp, Homo sapiens
tcctccagctgacagaaaaatccaggatgagatcagaaggatactggtgt

SEQ ID NO: 746 - DNA, 50 bp, Homo sapiens
tttacacgccctgaagcagtcttctttgctagttgaattatgtggtgtgt

SEQ ID NO: 747 - DNA, 50 bp, Homo sapiens
gttcacggaaaagccagaacctgctgttttcagggtgggtgatgtaaata

SEQ ID NO: 748 - DNA, 50 bp, Homo sapiens
agtgctcttgctttggataactgtaaagggacccatgctgatagactgga

SEQ ID NO: 749 - DNA, 50 bp, Homo sapiens
tgccccagttgtcagtcagagccgttggtgtttttcattgtttaaaatgt

SEQ ID NO: 750 - DNA, 50 bp, Homo sapiens
aaaccaatggacaaacttcttgcttcaaggaacaaactcttaggttggca

SEQ ID NO: 751 - DNA, 50 bp, Homo sapiens
aaacatcatgagagtggaggcctgccacccagaaaggcacatactagtgc

SEQ ID NO: 752 - DNA, 50 bp, Homo sapiens
agtggattaacccctgcttctcttcttgttccctgttatcattcctcccc

SEQ ID NO: 753 - DNA, 50 bp, Homo sapiens
gtctgcttattcgtgtctcttactaggttcaatttcttggaggccgtgat

SEQ ID NO: 754 - DNA, 50 bp, Homo sapiens
tggcctgactgacatgcagttccataaatgcagatgtttgtctcattacc

SEQ ID NO: 755 - DNA, 50 bp, Homo sapiens
gccagacttgaaagagggctccagaaaaagtagatgcgtatctgtacaaa

SEQ ID NO: 756 - DNA, 50 bp, Homo sapiens
cgtcttaatgttcaccgtccacagctttggaataaaccatcctgggaagt

SEQ ID NO: 757 - DNA, 50 bp, Homo sapiens
ttaatgttcaccgtccacagctttggaataaaccatcctgggaagttgct

SEQ ID NO: 758 - DNA, 50 bp, Homo sapiens
tctagcccagcattgatctagaagcagaggaatcccagcgccttttaaaa

SEQ ID NO: 759 - DNA, 50 bp, Homo sapiens
ttgctcagcatgccagcctttaagattgaattagattgtgttgttgtggt

SEQ ID NO: 760 - DNA, 50 bp, Homo sapiens
aaaaggtatagaaatgctggttggaatgcttatttgaaaaagactggcca

SEQ ID NO: 761 - DNA, 50 bp, Homo sapiens
ctgcttcacgcctgtgtctccgcagcacttcatcgacctcttcaagtttt

SEQ ID NO: 762 - DNA, 50 bp, Homo sapiens
agagcagcttgtgtatgtaaacgcttcagtgaacttgctaatgatccaat

SEQ ID NO: 763 - DNA, 50 bp, Homo sapiens
tcaaacctactaatccagcgacaatttgaatcggttttgtaggtagagga

SEQ ID NO: 764 - DNA, 50 bp, Homo sapiens
tcaacctccgtcatgttttagaaaccttttatcttttccttcctcatgct

SEQ ID NO: 765 - DNA, 50 bp, Homo sapiens
tttccatctgtgtcccagattgtgaccctagactttcaattgacaagtaa

SEQ ID NO: 766 - DNA, 50 bp, Homo sapiens
catgtcgttagatggaacatggaagccattgtctaatcaactctatcatt

SEQ ID NO: 767 - DNA, 50 bp, Homo sapiens
atgtaatcctgtaggttggtacttcccccaaactgattataggtaacagt

SEQ ID NO: 768 - DNA, 50 bp, Homo sapiens
tgaatgatcagaactgacatttaattcatgtttgtctcgccatgcttctt

SEQ ID NO: 769 - DNA, 50 bp, Homo sapiens
tttgcacattttacatatgctatgtggttgcctttgggttttctgtacag

SEQ ID NO: 770 - DNA, 50 bp, Homo sapiens
tggtcatgttccaggtgctagtacatcattcatgatcaccttaatgctca

SEQ ID NO: 771 - DNA, 50 bp, Homo sapiens
agcataaagagttgtggatcagtagccattttagttactgggggtggggg

SEQ ID NO: 772 - DNA, 50 bp, Homo sapiens
tcaacactttgctttatttgacacaaccagactttctcagttcctgttct

SEQ ID NO: 773 - DNA, 50 bp, Homo sapiens
atgaagaaaatcattgagactgttgcagaaggagggggagaacttggagt

SEQ ID NO: 774 - DNA, 50 bp, Homo sapiens
actgaaagacttttgcttaaagtggcattattgactgctgatgtgatgct

SEQ ID NO: 775 - DNA, 50 bp, Homo sapiens
ttggttggtaactctgtaattcctaactatcactggtttggttctggact

SEQ ID NO: 776 - DNA, 50 bp, Homo sapiens
ccaccatatatactagctgttaatcctatggaatggggtattgggagtgc

SEQ ID NO: 777 - DNA, 50 bp, Homo sapiens
agaggaatctgaaagtgcagggtgttggttaaagttgtacctcccaagta

SEQ ID NO: 778 - DNA, 50 bp, Homo sapiens
tttttctccatcctgtttctagcacaaaaatttgcctgctgtgttacaaa

SEQ ID NO: 779 - DNA, 50 bp, Homo sapiens
cagattgatttgaaaggtgtgcagcctgatttaaaaccaaaccctgaacc

SEQ ID NO: 780 - DNA, 50 bp, Homo sapiens
gcaactaataagccaaggaatcgacatatattaggtgcgtgtactgtttc

SEQ ID NO: 781 - DNA, 50 bp, Homo sapiens
tgtccagtgataaatgtgattgatcttgccttttgtacatggaggtcacc

SEQ ID NO: 782 - DNA, 50 bp, Homo sapiens; identical to SEQ ID NO: 758

SEQ ID NO: 783 - DNA, 50 bp, Homo sapiens
agggaacagtgtggagatgtttttgtcttgtccaaataaaagattcacca

SEQ ID NO: 784 - DNA, 50 bp, Homo sapiens
acccattggtatacacagaatattcctgtgcccacacttaatgtcaatct

SEQ ID NO: 785 - DNA, 50 bp, Homo sapiens
ttgatgataccaccagtaaaaataggatgtttaccccaaaacaagtgtca

SEQ ID NO: 786 - DNA, 50 bp, Homo sapiens
tttcaaccgaaagggcagatccaatagaagacccgctccttaaataaaca

SEQ ID NO: 787 - DNA, 50 bp, Homo sapiens
acagaggcaaagttaagcttgatgatggttaaaatcggtttgatagcacc

SEQ ID NO: 788 - DNA, 50 bp, Homo sapiens
tggttgatttccctcattgtgtaaacattgacaggtatgtgacaaatggg

SEQ ID NO: 789 - DNA, 50 bp, Homo sapiens
cacaaactagattctggacaccagtgtgcggaaatgcttctgctacattt

SEQ ID NO: 790 - DNA, 50 bp, Homo sapiens
ggccctctttcctgtctgtgtaaattgttccgtgaagccgcgctctgttt

SEQ ID NO: 791 - DNA, 50 bp, Homo sapiens
cactgtcctttctccaggccctcagatggcacattagggtgggcgtgctg

SEQ ID NO: 792 - DNA, 50 bp, Homo sapiens
aggagctatgattagacttctgttagacttcctcactctatcacccacat

SEQ ID NO: 793 - DNA, 50 bp, Homo sapiens
acccactttctccttggtaaagcgtttacttaacaaaataatacccgaga

SEQ ID NO: 794 - DNA, 50 bp, Homo sapiens
gtcacacatgacacaagatgtacataatatcatgctcacgcctggagtgt

SEQ ID NO: 795 - DNA, 50 bp, Homo sapiens
atgtgcatgtgaatggcctagagaacctatttttgtgtctaaagtttaca

SEQ ID NO: 796 - DNA, 50 bp, Homo sapiens
agatcctgtcctcctttagcctcactaatcaagttgggtcctatcttccc

SEQ ID NO: 797 - DNA, 50 bp, Homo sapiens
agttgttagttgccctgctacctagtttgttagtgcatttgagcacacat

SEQ ID NO: 798 - DNA, 50 bp, Homo sapiens
aatcctttaactctgcggatagcatttggtaggtagtgattaactgtgaa

SEQ ID NO: 799 - DNA, 50 bp, Homo sapiens
ggaggaggagcttatttcttggtgtacttgaatcagaaggtccctgcaag

SEQ ID NO: 800 - DNA, 50 bp, Homo sapiens; identical to SEQ ID NO: 799

SEQ ID NO: 801 - DNA, 50 bp, Homo sapiens
aagtggaagtgggtgaattctactttttatgttggagtggaccaatgtct

SEQ ID NO: 802 - DNA, 50 bp, Homo sapiens
tgggattcattggcccataggtacattggaaaatgtatatctctccagct

SEQ ID NO: 803 - DNA, 50 bp, Homo sapiens
gggacccccaggaggctgaggatgggagacagagaccagactgtgacttg

SEQ ID NO: 804 - DNA, 50 bp, Homo sapiens
tgtttgtagcacacttgagtttgtgtattccattgacatcaaatgtgaca

SEQ ID NO: 805 - DNA, 50 bp, Homo sapiens
cgatctgtgtttgctctgacgaatggaatttatcctcacaaattggtgtt

SEQ ID NO: 806 - DNA, 50 bp, Homo sapiens
ccaggagcgtggttttctgattgtgatctgaggttctgccccaactgcac

SEQ ID NO: 807 - DNA, 50 bp, Homo sapiens
acattacctaatattctcactagctatgttctccaatccacactgccttt

SEQ ID NO: 808 - DNA, 50 bp, Homo sapiens
agacagccctgccaaagccataccaaagacactcaaagacagccaataaa

SEQ ID NO: 809 - DNA, 50 bp, Homo sapiens
agagatagcacagatggaccaaaggttatgcacaggtgggagtcttttgt

SEQ ID NO: 810 - DNA, 50 bp, Homo sapiens; identical to SEQ ID NO: 809

SEQ ID NO: 811 - DNA, 50 bp, Homo sapiens
gcctttcttcctctcccaacataacaatcgtggtaacagaatgcgactgc

SEQ ID NO: 812 - DNA, 50 bp, Homo sapiens
accgtgtaaagtggggatggggtaaaagtggttaacgtactgttggatca

SEQ ID NO: 813 - DNA, 50 bp, Homo sapiens
gcccagtgcttaaaaacgccttcttgcatgaggggattgaactatacaat

SEQ ID NO: 814 - DNA, 50 bp, Homo sapiens
gcgggaaggcatgtaaccacctaaaccatctccgagaacatcagaggatc

SEQ ID NO: 815 - DNA, 50 bp, Homo sapiens
tgtcaggctggcttggttaggttttactggggcagaggatagggaatctc

SEQ ID NO: 816 - DNA, 50 bp, Homo sapiens
ggtggattccaaatgaacccctgcgttagttacaaaggaaaccaatgcca

SEQ ID NO: 817 - DNA, 50 bp, Homo sapiens
atttatcgtaaacatccacgagtgctgttgcactaccatctatttgttgt

SEQ ID NO: 818 - DNA, 50 bp, Homo sapiens
tgggggttgtaaattggcatggaaatttaaagcaggttcttgttggtgca

SEQ ID NO: 819 - DNA, 50 bp, Homo sapiens
gataggggcggcccggagccagccaggcagttttattgaaatctttttaa

SEQ ID NO: 820 - DNA, 50 bp, Homo sapiens
catttgtaccctaggcccacgaacccacgagaatgtcctctgacttccag

SEQ ID NO: 821 - DNA, 50 bp, Homo sapiens
agtgggattttatgccagttgttaaaatgagcattgatgtacccattttt

SEQ ID NO: 822 - DNA, 50 bp, Homo sapiens
ctttcctttgctccctcccatgtttctggtggactaaattgtgtatctgg

SEQ ID NO: 823 - DNA, 50 bp, Homo sapiens
agttttctagattgtcacatgctttgtgactaatgcaagaaagcaagtcc

SEQ ID NO: 824 - DNA, 50 bp, Homo sapiens
gaaacactttcaggaccttccttcctcttgcagttgttctttaatctcct

SEQ ID NO: 825 - DNA, 50 bp, Homo sapiens
ctcgaggggccaattacaggagcacaggaaggttctgattacacacctct

SEQ ID NO: 826 - DNA, 50 bp, Homo sapiens
ttgagttaagttgcatttctttgggctatgaaggagtcctcttaagtttg

SEQ ID NO: 827 - DNA, 50 bp, Homo sapiens
agggattgtttctggaccagtttgtctaagtcctggctcttattggttca

SEQ ID NO: 828 - DNA, 50 bp, Homo sapiens
tgaactgctgctacatccagacactgtgcaaataaattatttctgctacc

SEQ ID NO: 829 - DNA, 50 bp, Homo sapiens
actatgcagtttttcttgaaggaactaaaagcaactagctccctaatggt

SEQ ID NO: 830 - DNA, 50 bp, Homo sapiens
gtctttccagcatccactctcccttgtcctcctgggggcatatctcagtc

SEQ ID NO: 831 - DNA, 50 bp, Homo sapiens
gcagtaggtaggctcacttctctttcccttcaaaatgcttttcataggct

SEQ ID NO: 832 - DNA, 50 bp, Homo sapiens
tctgctgttgggctggtgtgtggacagaaggaatggaaagccaaattaat

SEQ ID NO: 833 - DNA, 50 bp, Homo sapiens
ccacttggaataggaatatcacccctatcttggaagaccaggtggaggct

SEQ ID NO: 834 - DNA, 50 bp, Homo sapiens
gccctatggcgttgttaaacacgagcgtatgctagtaagtatcattcata

SEQ ID NO: 835 - DNA, 50 bp, Homo sapiens
gtgggtgcatggggctgtggagtgggtgtcagtatggatgtgtctgaatg

SEQ ID NO: 836 - DNA, 50 bp, Homo sapiens
cattcgtctgtatgcccagtcccatccgtgtcctgctgtaactacataga

SEQ ID NO: 837 - DNA, 50 bp, Homo sapiens
tgtctgcttcttccattttctcgtctctctcccctcttcccccattatcc

SEQ ID NO: 838 - DNA, 50 bp, Homo sapiens; identical to SEQ ID NO: 580

SEQ ID NO: 839 - DNA, 50 bp, Homo sapiens
ccagattagggtggctgtccatccctggatagctatttgcacgaatcatg

SEQ ID NO: 840 - DNA, 50 bp, Homo sapiens
cggagctctggctctgctgtaggaagcccggtacgtccttcatgacagca

SEQ ID NO: 841 - DNA, 50 bp, Homo sapiens
gcactgaatatcgaacaagcactcaaattgaagtatcagtcatgttttgt

SEQ ID NO: 842 - DNA, 50 bp, Homo sapiens
agctcgaggtgtcctgcacttttcttataaggctactgaagttacatgtt

SEQ ID NO: 843 - DNA, 50 bp, Homo sapiens
tgccattggaatgtttctacacgatcctattaagaataatgtgatgccct

SEQ ID NO: 844 - DNA, 50 bp, Homo sapiens
ggataacaagtaaatgtctgaaagcatgaggggctttatttgcctttacc

SEQ ID NO: 845 - DNA, 50 bp, Homo sapiens; identical to SEQ ID NO: 28

SEQ ID NO: 846 - DNA, 50 bp, Homo sapiens
aaaactcatctcagaagaggatctgaatggggccgcacatcaccatcatc

SEQ ID NO: 847 - DNA, 50 bp, Homo sapiens
aaacccctttaaatgagggccagtattatctctgctttcagaagtagaca

SEQ ID NO: 848 - DNA, 50 bp, Homo sapiens
gacctgactccactcttaaacctgggtcttctccttggcggtgctgtcag

SEQ ID NO: 849 - DNA, 50 bp, Homo sapiens
cttttatagcagtttatggggagcacttgaaagagcgtgtgtacatgtat

SEQ ID NO: 850 - DNA, 50 bp, Homo sapiens
agatcctgaaagtagctgcctgtgacccagtgaagccatatcaaaagtgg

SEQ ID NO: 851 - DNA, 50 bp, Homo sapiens
tactgctaagtgcttggttggggtggtgagatgatgattagatcaggggt

SEQ ID NO: 852 - DNA, 50 bp, Homo sapiens
ttgtacccagagactatgatttatattgattgcacttgcctgccatgatt

SEQ ID NO: 853 - DNA, 50 bp, Homo sapiens
tttcagatgcttctgggagacaccaaagggtgaagctatttatctgtagt

SEQ ID NO: 854 - DNA, 50 bp, Homo sapiens
ttgtggtaatatgatgtgcctttccttgcctaaatcccttcctggtgtgt

SEQ ID NO: 855 - DNA, 50 bp, Homo sapiens
cacaaggtgcgcggttaccgctacttggaggaggacaactcggacgagag

SEQ ID NO: 856 - DNA, 50 bp, Homo sapiens
tagactcacgaacaaatccacctgagatcagcagagccaccctagatcag

SEQ ID NO: 857 - DNA, 50 bp, Homo sapiens
cctcagaggcttactctaacccatcccagaataaatggagacttcatgtg

SEQ ID NO: 858 - DNA, 50 bp, Homo sapiens
aggctgttgatgcttattctctgtaactaagaattttaccttttggggga

SEQ ID NO: 859 - DNA, 50 bp, Homo sapiens
gtaaacgtatcctctgtattcagtaaacaggctgcctctccagggagggc

SEQ ID NO: 860 - DNA, 50 bp, Homo sapiens
aactaaccccctttccctgctagaaataacaattagatgccccaaagcga

SEQ ID NO: 861 - DNA, 50 bp, Homo sapiens
gcctcgacacatcctcatccccagcatgggacacctcaagatgaataata

SEQ ID NO: 862 - DNA, 48 bp, Homo sapiens
gcacagtcacattccctccttaggaatcttccccttccaccctttaca

SEQ ID NO: 863 - DNA, 50 bp, Homo sapiens
tttgaggttctttggttttgttagtaaaagccagttctgtggtgatgacc

SEQ ID NO: 864 - DNA, 50 bp, Homo sapiens
catctgaagtgtggagccttacccatttcatcacctacaacggaagtagt

SEQ ID NO: 865 - DNA, 50 bp, Homo sapiens
ttttggcagttgtctgcattaacctgttcatacacccattttgtcccttt

SEQ ID NO: 866 - DNA, 50 bp, Homo sapiens
tggtgtttatgtactactctatagaactcttggcttgcacttctacagct

SEQ ID NO: 867 - DNA, 50 bp, Homo sapiens; identical to SEQ ID NO: 131

SEQ ID NO: 868 - DNA, 50 bp, Homo sapiens
tggtctccttggaaatccgtctagttaacatttcaagggcaataccgtgt

SEQ ID NO: 869 - DNA, 50 bp, Homo sapiens
gtctaccaggcgaaaaccacagattctccttctagttagtatagcggact

SEQ ID NO: 870 - DNA, 50 bp, Homo sapiens
acttctcttgatgtagaaagagatgacgttgttaccctgagtgacagtca

SEQ ID NO: 871 - DNA, 50 bp, Homo sapiens
tgagctaagtgtcatgcatatttgtgaagaaacacccttgtttggtccct

SEQ ID NO: 872 - DNA, 50 bp, Homo sapiens
ctgagcaaggcagatgacctaatcacctcacgacagcaatacagcagtga

SEQ ID NO: 873 - DNA, 50 bp, Homo sapiens
tttgtactattgctagaccctcttctgtaatgggtaatgcgtttgattgt

SEQ ID NO: 874 - DNA, 50 bp, Homo sapiens
tgctatgctaatgtctagaaaggcatacgatgctactattatgctctgtt

SEQ ID NO: 875 - DNA, 50 bp, Homo sapiens
actgctctttctcaggcccaaggtaaaaaggtttttggtctcatgttgac

SEQ ID NO: 876 - DNA, 50 bp, Homo sapiens
tcaccagctgatgacacttccaaagagattagctcacctttctcctaggc

SEQ ID NO: 877 - DNA, 50 bp, Homo sapiens; identical to SEQ ID NO: 116

SEQ ID NO: 878 - DNA, 50 bp, Homo sapiens
tgcatgaagcactgtttttaaacccaagtaaagactgcttgaaacctgtt

SEQ ID NO: 879 - DNA, 50 bp, Homo sapiens
tgattttgcaacttaggatgtttttgagtcccatggttcattttgattgt

SEQ ID NO: 880 - DNA, 50 bp, Homo sapiens
tttgagcgatctctcacatgatggggttctttagtacatggtaacagcca

SEQ ID NO: 881 - DNA, 50 bp, Homo sapiens
cccggcctgggactcagcatttctgatatgccttaagaattcattctgtt

SEQ ID NO: 882 - DNA, 50 bp, Homo sapiens
agttttgctgaagactggccttattaatggacagctttcctaacaagaga

SEQ ID NO: 883 - DNA, 50 bp, Homo sapiens
gggtcaatagtttcccaatttcaggatatttcgatgtcagaaataacgca

SEQ ID NO: 884 - DNA, 50 bp, Homo sapiens
tgagagctgaaatgagaccatttactttgtttaaaatgctgtactgtgca

SEQ ID NO: 885 - DNA, 50 bp, Homo sapiens
ttgagctaagaccttaggaaattcactttctgcatgataaaatgacccaa

SEQ ID NO: 886 - DNA, 50 bp, Homo sapiens
tgtcattgtacactttatttccctcacactgtgttatgctctgatgtgct

SEQ ID NO: 887 - DNA, 50 bp, Homo sapiens
ggtctctttgactaatcaccaaaaagcaaccaacttagccagttttattt

SEQ ID NO: 888 - DNA, 50 bp, Homo sapiens
aggttcttcctgtacatacgtgtatatatgtgaacagtgagatggccgtt

SEQ ID NO: 889 - DNA, 50 bp, Homo sapiens
acttggatgctgccgctactgaatgtttacaaattgcttgcctgctaaag

SEQ ID NO: 890 - DNA, 50 bp, Homo sapiens
gggaggcgtggctgagaccaactggtttgcctataatttattaactattt

SEQ ID NO: 891 - DNA, 50 bp, Homo sapiens
tctcccagaatgtacttatcttacctcggcatgtactgtagtcactcagt

SEQ ID NO: 892 - DNA, 50 bp, Homo sapiens
tgtgcactgttgtaaaccattcagaattttcctgctaggcccttgatgct

SEQ ID NO: 893 - DNA, 50 bp, Homo sapiens
catcggccagacagagttgaatgcaagcaatccagaagaagtgttacagc

SEQ ID NO: 894 - DNA, 50 bp, Homo sapiens
tgctctagccatcaggttctttcaaatgcatctttacactcttgcacaaa

SEQ ID NO: 895 - DNA, 50 bp, Homo sapiens
tgagcatgaaatgggatcctgcatcacttgttttaactatttattttgcc

SEQ ID NO: 896 - DNA, 50 bp, Homo sapiens
tttgcggctagttggctattcaagaaacctcgcccctctgaatgtcatac

SEQ ID NO: 897 - DNA, 50 bp, Homo sapiens
gtttacgtggaagaaacgctaagggtttgctcccaggaaaggagaggaag

SEQ ID NO: 898 - DNA, 50 bp, Homo sapiens
tgctcaaatcaggacttaaatcataggcaccacatttttcatgtcagact

SEQ ID NO: 899 - DNA, 50 bp, Homo sapiens
tgaaattctacccatcttgagggaggaccgttcctcagttaaggacttgt

SEQ ID NO: 900 - DNA, 50 bp, Homo sapiens
atgagtgtgtcggaatcccgtgcttaaaatacgctcttaaattattttct

SEQ ID NO: 901 - DNA, 50 bp, Homo sapiens
aaatcagaactgaggtagcttagagatgtagcgatgtaagtgtcgatgtt

SEQ ID NO: 902 - DNA, 50 bp, Homo sapiens
aggctttagcaaagatggatatattggtgactgagacagaagaactggca

SEQ ID NO: 903 - DNA, 50 bp, Homo sapiens
agtgggcctaactcatgtgagcttgataactgatgaactcattgggagca

SEQ ID NO: 904 - DNA, 50 bp, Homo sapiens
aacactaacctctcccctcctggctcaagaattactccgaagtcagtctg

SEQ ID NO: 905 - DNA, 50 bp, Homo sapiens
tctgtcaggaaatgtaactttggttttatttttggcttattccaaggggt

SEQ ID NO: 906 - DNA, 50 bp, Homo sapiens
aaattgtgccggacttacctttcattgaacatgctgccataacttagatt

SEQ ID NO: 907 - DNA, 50 bp, Homo sapiens
tggcagggagctgggacctggagagacaactcctgtaaataaaacacttt

SEQ ID NO: 908 - DNA, 50 bp, Homo sapiens
agggagataatggagtccactttaatttggaattctgtgtgagctatgat

SEQ ID NO: 909 - DNA, 50 bp, Homo sapiens
agatcagtgatactggtgttagtgttgtaatcaggttaaacccacttcca

SEQ ID NO: 910 - DNA, 50 bp, Homo sapiens
ccatttgacagtaaaggctcttggcttctgttggaggcatgggaaattgt

SEQ ID NO: 911 - DNA, 50 bp, Homo sapiens
tttaacagcctgtcctcccggcatcaggagtcattgaacaatcatggatt

SEQ ID NO: 912 - DNA, 50 bp, Homo sapiens
aatacttattgtttggcaggtcatccacacacttctgcccccactgcatt

SEQ ID NO: 913 - DNA, 50 bp, Homo sapiens
ttatcagatgggatactggggactataaacaatggaaataaagccactgt

SEQ ID NO: 914 - DNA, 50 bp, Homo sapiens
ccctgtgcctttcctttgagagtgaaggtgggtggagttgaccagagaaa

SEQ ID NO: 915 - DNA, 50 bp, Homo sapiens
tgtgtgcgtagaatattacgtatgcatgttcatgtctaaagaatggctgt

SEQ ID NO: 916 - DNA, 50 bp, Homo sapiens
tctacatgtgactggctttcttgccctcgtctcttgaatgtttagactct

SEQ ID NO: 917 - DNA, 50 bp, Homo sapiens
tggtacccaaactcaccatttggtcctctttaatctttgagggtttcaat

SEQ ID NO: 918 - DNA, 50 bp, Homo sapiens
ttccatttattcatgtacattggccagttcctggtccttgtctgacttct

SEQ ID NO: 919 - DNA, 50 bp, Homo sapiens
aaccatctggagtcagtacagatcatcaatccttccacatatacaagttc

SEQ ID NO: 920 - DNA, 50 bp, Homo sapiens
ggccacctgctgactatttgtggtttaaaataaaaggtttacttgtctgc

SEQ ID NO: 921 - DNA, 50 bp, Homo sapiens
tctttgtaaagcacgatgatacaaatctggtgccagtgttatattttgca

SEQ ID NO: 922 - DNA, 50 bp, Homo sapiens
catggatatcatgtatccttcctggtgctcacacacctgtcaccttgtaa

SEQ ID NO: 923 - DNA, 50 bp, Homo sapiens
ataaggtgcataaaacccttaaattcatctagtagctgttcccccgaaca

SEQ ID NO: 924 - DNA, 50 bp, Homo sapiens
tggaccggagtctgctgagtttataaggttccaaaaatatggtaaaatct

SEQ ID NO: 925 - DNA, 50 bp, Homo sapiens
actcgaccttggtaaacggaaatgttgggggtgaagagaaacaatcacta

SEQ ID NO: 926 - DNA, 50 bp, Homo sapiens
ttcaaggttctgcgaaattaattgggcaggttaattgtgtacctgaaact

SEQ ID NO: 927 - DNA, 50 bp, Homo sapiens
tccccaggatggggcctcatacaacccttcatctgcactcaacatttaat

SEQ ID NO: 928 - DNA, 50 bp, Homo sapiens
ttttagacatggagtgcaggtggacactgtgtgaactgtttttggtcagt

SEQ ID NO: 929 - DNA, 50 bp, Homo sapiens
caagaaacttggtctgcagtctggaagcttgtctgctctatagaaatgaa

SEQ ID NO: 930 - DNA, 50 bp, Homo sapiens; identical to SEQ ID NO: 929

SEQ ID NO: 931 - DNA, 50 bp, Homo sapiens; identical to SEQ ID NO: 602

SEQ ID NO: 932 - DNA, 50 bp, Homo sapiens
ccccttcaactgagggtcattttaccagagtcaataaaggccaacccttc

SEQ ID NO: 933 - DNA, 50 bp, Homo sapiens
attctgagggtgactgaggctacagctgctatcacatgccgaactttctt

SEQ ID NO: 934 - DNA, 50 bp, Homo sapiens
tggtatcaggagttgggatttctcagcactgctaatgaagatcccctctt

SEQ ID NO: 935 - DNA, 50 bp, Homo sapiens
cgcagagaggagaaaaggagacagcaagacgccaataaagaaacacaact

SEQ ID NO: 936 - DNA, 50 bp, Homo sapiens
cccgcacgggcagctgaaggccgctgttttctaatatttgtattctaatt

SEQ ID NO: 937 - DNA, 50 bp, Homo sapiens
cccctgggagatgtagcaaattgagtgtgggttttggagtctgagcctca

SEQ ID NO: 938 - DNA, 50 bp, Homo sapiens
gcagagggagggttgccatgaaggaacttgggattttcaatggaataaat

SEQ ID NO: 939 - DNA, 50 bp, Homo sapiens
cctttcacgtctggacgaattaccaaatgccatgaattgccactgtgtgt

SEQ ID NO: 940 - DNA, 50 bp, Homo sapiens
aggaagatggcgctgttatcagcggggaaatgtactatttaagatcagct

SEQ ID NO: 941 - DNA, 50 bp, Homo sapiens
atccaagtctgaaactctgcgctctagtactgctgttaagatacacaact

SEQ ID NO: 942 - DNA, 50 bp, Homo sapiens
tggatagccatttctgctcaaccacacattctctaagaaacagcttgaaa

SEQ ID NO: 943 - DNA, 50 bp, Homo sapiens
tgttgtatgtggatggggaagttttgtttctcctcttagcatttgtttct

SEQ ID NO: 944 - DNA, 50 bp, Homo sapiens
tctgaatgatcctactcctttggagtaaaactagtgcttaccagtttcca

SEQ ID NO: 945 - DNA, 50 bp, Homo sapiens
tccttttgtagccactttgagtctgcagttgtcagtaagcctttttaaag

SEQ ID NO: 946 - DNA, 50 bp, Homo sapiens
gggggaaattaccagtagaatgccttggtctgaatatttgatagaaccaa

SEQ ID NO: 947 - DNA, 50 bp, Homo sapiens
ctggtactttacagttttgcaccaactctgccaagccactggatcttaca

SEQ ID NO: 948 - DNA, 50 bp, Homo sapiens
atccagtcactcatcaagtgtaatctgtctcctaaatatctctggaacct

SEQ ID NO: 949 - DNA, 50 bp, Homo sapiens
agcttttggggtcagatctctggaacatcatgtgatgaagctgacatttt

SEQ ID NO: 950 - DNA, 50 bp, Homo sapiens
agcagttaggcttgactttgaggagaggctgtgatgtttatgatccctga

SEQ ID NO: 951 - DNA, 50 bp, Homo sapiens
gctgtccacagaaaacgcccttaagtagccctaccttactccttagagct

SEQ ID NO: 952 - DNA, 50 bp, Homo sapiens
catgggtattaatagtctttgctgctggtaatactgaaagaacctgcttt

SEQ ID NO: 953 - DNA, 50 bp, Homo sapiens
aggatttgatttcttgaaaccctctaggtctctagaacactgaggacagt

SEQ ID NO: 954 - DNA, 50 bp, Homo sapiens
ggactcaggagctaatactgtctacagtggagcttggtgcaattagaagc

SEQ ID NO: 955 - DNA, 50 bp, Homo sapiens
accaggaggacagagtttgctttcatattttccctgtaagtaagagggct

SEQ ID NO: 956 - DNA, 50 bp, Homo sapiens
ccatgaagaagcaagacgaaaacacacaggagggaaaatcctgggattct

SEQ ID NO: 957 - DNA, 50 bp, Homo sapiens
ttggaatttgtgttgcatgtaaggcaatctttcctgttgtaaatcttcct

SEQ ID NO: 958 - DNA, 50 bp, Homo sapiens
aggaaactgagtagactcctgtgtaaccctgtttggaactttgccttctt

SEQ ID NO: 959 - DNA, 50 bp, Homo sapiens
tttacaaggcagaatggggtgtaacagttgaattaaactagcaatcacgt

SEQ ID NO: 960 - DNA, 50 bp, Homo sapiens
tagtaggaatgaagtggaagtccaggcttggattgcctaactacactgct

SEQ ID NO: 961 - DNA, 50 bp, Homo sapiens
agtgtttagtctcatgttgggaacacatgaatgtgatgaacatagtgaat

SEQ ID NO: 962 - DNA, 50 bp, Homo sapiens
accctttgagagttccacaagtggtagtagagtggtttaacgtctttcct

SEQ ID NO: 963 - DNA, 50 bp, Homo sapiens
ttgccccttttctgtaagtctcttgggatcctgtgtagaagctgttctca

SEQ ID NO: 964 - DNA, 50 bp, Homo sapiens
actcatcaattgaaaagtcctccaaaaagagaactattgggaaaccatgg

SEQ ID NO: 965 - DNA, 50 bp, Homo sapiens; identical to SEQ ID NO: 21

SEQ ID NO: 966 - DNA, 50 bp, Homo sapiens
tcagacctggttgattttgtactttggaactgtaccttggatggttttgt

SEQ ID NO: 967 - DNA, 50 bp, Homo sapiens
gtatctcatggcctcttgatgtggaaagaagttgacagagggttgcaggg

SEQ ID NO: 968 - DNA, 50 bp, Homo sapiens
agttcagtgagaagaaaccagaacacttgttcctagtgttgtgttgtttt

SEQ ID NO: 969 - DNA, 50 bp, Homo sapiens
gcagatggctatgtgctagagggcaaagagttggagttctatcttaggaa

SEQ ID NO: 970 - DNA, 50 bp, Homo sapiens
ttggtgtcaatgatctggtgacaataggattacattggagccaattgaat

SEQ ID NO: 971 - DNA, 50 bp, Homo sapiens
aactagaagatgtacttcgacagcatccattttacttcaaggcagcaaga

SEQ ID NO: 972 - DNA, 50 bp, Homo sapiens
atacacttttccaaatttgtcccaacagccctgtaagccagctttcttct

SEQ ID NO: 973 - DNA, 50 bp, Homo sapiens
gcattttcttcacttgcaggcaaacttggctctcaataaacttttaccac

SEQ ID NO: 974 - DNA, 50 bp, Homo sapiens; identical to SEQ ID NO: 129

SEQ ID NO: 975 - DNA, 50 bp, Homo sapiens
agccaaatgtgtcatacatcaaatcttcagcagcttttgcataatccagg

SEQ ID NO: 976 - DNA, 50 bp, Homo sapiens
tcctcaaaggggaaaactatgaaggggaagaagacaaacctaagatacca

SEQ ID NO: 977 - DNA, 50 bp, Homo sapiens
agatggactggagctttttctttgtgaatagaaactggatgccacagtga

SEQ ID NO: 978 - DNA, 50 bp, Homo sapiens
agttgtcagaagactcctgggtgtacagagcaaatcaagctgcatcagta

SEQ ID NO: 979 - DNA, 50 bp, Homo sapiens
agtggcttcatagctactgacaaatgtctgaactattgtcgtgcccttca

SEQ ID NO: 980 - DNA, 50 bp, Homo sapiens
gcctgtacaaacattcaagttagttggcagtctataaatgtgagttgggt

SEQ ID NO: 981 - DNA, 50 bp, Homo sapiens
aaggaaggtaaagttaggggactagaagactctaaattggcttctacaga

SEQ ID NO: 982 - DNA, 50 bp, Homo sapiens
agaactaattgcccatgtttaattatagcagacacgccattctaacaggt

SEQ ID NO: 983 - DNA, 50 bp, Homo sapiens
aacttggtattgttgtagtttatgtagtaagtgacttggcacccatcaga

SEQ ID NO: 984 - DNA, 50 bp, Homo sapiens
agtttaacttttcctcacccctgtatagaaaatgccttgcctctcaagag

SEQ ID NO: 985 - DNA, 50 bp, Homo sapiens
gtcttgggctggatgggttatagagctgagcggctgtgatggttctgttt

SEQ ID NO: 986 - DNA, 50 bp, Homo sapiens
gacacatctagaatgtttttctttcaccgtacctccaaaagaggcaattt

SEQ ID NO: 987 - DNA, 50 bp, Homo sapiens
accagggatgctctctaacgtaatcaagggaaggttcagtaagacaaagt

SEQ ID NO: 988 - DNA, 50 bp, Homo sapiens
acacagttcagtttttgagggaactagttttgtcataatactacacccct

SEQ ID NO: 989 - DNA, 50 bp, Homo sapiens
tgcagtgggaattcttgagtgaggtcttacctcttctttaaacctcttca

SEQ ID NO: 990 - DNA, 50 bp, Homo sapiens
aaggcagaatagaatgctgagattggttaagtttgcaatgaccatcttga

SEQ ID NO: 991 - DNA, 50 bp, Homo sapiens
tgccctaatcttgagttgaggaaatatatgcacaggagtcaaagagatgt

SEQ ID NO: 992 - DNA, 50 bp, Homo sapiens
gctagattgtgaagtacatgggatttcatgagccagaggaggcatttgga

SEQ ID NO: 993 - DNA, 50 bp, Homo sapiens
gcctcaaagaaaacccagagtgccctgttctaaaacgtagttctgaatcc

SEQ ID NO: 994 - DNA, 50 bp, Homo sapiens
aatcccagggcttggttaagtgctgtgtgataacttgtttggatgagact

SEQ ID NO: 995 - DNA, 50 bp, Homo sapiens
aggtttcttacccaacacaaatggacagtggatttgactttctaaagact

SEQ ID NO: 996 - DNA, 50 bp, Homo sapiens
cctggtgatgggaagggtcttgtgttttaatgccaataaatgtgccagct

SEQ ID NO: 997 - DNA, 50 bp, Homo sapiens
aaaatattgagccaggccctggggaagtgggaagtgagagccagagcggc

SEQ ID NO: 998 - DNA, 50 bp, Homo sapiens
agcacacaaggaatcccagaaaatgttggctgaaggaataaatggatgga

SEQ ID NO: 999 - DNA, 50 bp, Homo sapiens
cactgcctaccgccattcatgattaaaccatccagaaataccatccctgt

SEQ ID NO: 1000 - DNA, 50 bp, Homo sapiens
aaatgagatggcctctgcggacacatgaaagggtacttcagcttaccaaa

SEQ ID NO: 1001 - DNA, 50 bp, Homo sapiens
tggactaggagagacttgattttggtgctaaagttccccagttcatatgt

SEQ ID NO: 1002 - DNA, 50 bp, Homo sapiens
ctcacagccagcacgacccccagaaagaggcgtcccacaataaacacgtc

SEQ ID NO: 1003 - DNA, 50 bp, Homo sapiens
acagaacattgagatgtgcctagttccgtatttacagtttggtctggctg

SEQ ID NO: 1004 - DNA, 50 bp, Homo sapiens
tgaatttcagatgggtgatttaagtgagtcacaagtcacaaaactttgct

SEQ ID NO: 1005 - DNA, 50 bp, Homo sapiens
tgtacttaagtgctgatgactgttagccagtttacaactttttaccatcg

SEQ ID NO: 1006 - DNA, 50 bp, Homo sapiens
ttctgaacattttagtcaagctacaacaggtttggaaaacctctgtgggg

SEQ ID NO: 1007 - DNA, 50 bp, Homo sapiens
tgtcaagggcattaaaagcctcctgaagcataatcttatcaaagggatac

SEQ ID NO: 1008 - DNA, 50 bp, Homo sapiens
tcagtccatctcaagacctgtgcctgtcagatttcacaattatggagatt

SEQ ID NO: 1009 - DNA, 50 bp, Homo sapiens
ggtaggagtgaaatctctctctcaaactctaggaaagcccgagtcatact

SEQ ID NO: 1010 - DNA, 50 bp, Homo sapiens
acagcaggtgtcatgggtcaagcataaatcatatatagcattttcaggca

SEQ ID NO: 1011 - DNA, 50 bp, Homo sapiens; identical to SEQ ID NO: 1010

SEQ ID NO: 1012 - DNA, 50 bp, Homo sapiens
tgtgggtccctatgagtgtagagcccatatccccatagagtctacctaga

SEQ ID NO: 1013 - DNA, 50 bp, Homo sapiens
tgttttcatttcagaacattgtgctgtctgtcagcatatgtatatcagct

SEQ ID NO: 1014 - DNA, 50 bp, Homo sapiens
tggctactgcaaaaccagttttgacaggtcagattttcatatgtataggt

SEQ ID NO: 1015 - DNA, 50 bp, Homo sapiens
agaggttctgaaaggtctgtgtcttgtcaaaacaagtaaacggtggaact

SEQ ID NO: 1016 - DNA, 50 bp, Homo sapiens
atgcgtcctggttttcaatcgctgctgaacaaacctatcaaaaatgtagc

SEQ ID NO: 1017 - DNA, 50 bp, Homo sapiens
agtatgatccctcaaaacctcactaactggaaggatgattttgtctcagt

SEQ ID NO: 1018 - DNA, 50 bp, Homo sapiens
gagggttcctcactgaggttgagaggtgtgttggataggactgatcccac

SEQ ID NO: 1019 - DNA, 50 bp, Homo sapiens
aagtgtggttcctgaaggctgtctttgtaactttttgtagttctttgtgt

SEQ ID NO: 1020 - DNA, 50 bp, Homo sapiens; identical to SEQ ID NO: 798

SEQ ID NO: 1021 - DNA, 50 bp, Homo sapiens
ctggaaagggggctaagatcagggccttcattctggatcaggcgaaattt

SEQ ID NO: 1022 - DNA, 50 bp, Homo sapiens
gttcctcttcgggaagcttttgataaggaattctcagaccgatagggtgt

SEQ ID NO: 1023 - DNA, 50 bp, Homo sapiens
agttttgtacttttcacatagcttgttgccccgtaaaagggttaacagca

SEQ ID NO: 1024 - DNA, 50 bp, Homo sapiens
ttggatctggttctgaggaggacacacctggcatcggatgacctttataa

SEQ ID NO: 1025 - DNA, 50 bp, Homo sapiens
tagacatgcttgtgtccacacagcacaccaatgtgatacttccactgacc

SEQ ID NO: 1026 - DNA, 50 bp, Homo sapiens
atgggatgcggtgggttgcccaataaacggctgtggagtggaaattcctc

SEQ ID NO: 1027 - DNA, 50 bp, Homo sapiens
tttgtacgtagctgttacatgtagggcaatctgtctttaagtagggataa

SEQ ID NO: 1028 - DNA, 50 bp, Homo sapiens; identical to SEQ ID NO: 38

SEQ ID NO: 1029 - DNA, 50 bp, Homo sapiens
gagatgagttttgttattttggggttttcaagcattggaaccaaaggcca

SEQ ID NO: 1030 - DNA, 50 bp, Homo sapiens
tcacttagacccctgtaacaggttaaatcttcatggtgttctgtttccta

SEQ ID NO: 1031 - DNA, 50 bp, Homo sapiens
gctctccagactgttacagtgcatgagtgataataaaaatgagtcagtca

SEQ ID NO: 1032 - DNA, 50 bp, Homo sapiens
ggaggtaaacattggagatgtttgtgaaaatattactcttgctgtgaggt

SEQ ID NO: 1033 - DNA, 50 bp, Homo sapiens
ggcccctttctttcttctgaggattgcagaggatatagttatcaatctct

SEQ ID NO: 1034 - DNA, 50 bp, Homo sapiens
tcaacagcacttaaactgaagtttgggttgctcatacaataaacagattg

SEQ ID NO: 1035 - DNA, 50 bp, Homo sapiens
gggccattttatgatgcattgcacaccctctggggaaattgatctttaaa

SEQ ID NO: 1036 - DNA, 50 bp, Homo sapiens
ttttccacaggggacctacccctattgcggtcctccagctcatctttcac

SEQ ID NO: 1037 - DNA, 50 bp, Homo sapiens
gggtgagaacacttgcaacagtttattaatgaggtgactttcaccttagg

SEQ ID NO: 1038 - DNA, 50 bp, Homo sapiens
aatgtaccatcaataaaattggctgcttgggcagttttagttaccacctt

SEQ ID NO: 1039 - DNA, 50 bp, Homo sapiens
ttttcagaggcttcctaattaatcttgccctcctccatttcagtccattt

SEQ ID NO: 1040 - DNA, 50 bp, Homo sapiens
agctccaaccttacgatggagaattaaacttgcttgtatttccactttgt

SEQ ID NO: 1041 - DNA, 50 bp, Homo sapiens
agcttcctcttcctcaggacagcttctactttagatgatccaataatgat

SEQ ID NO: 1042 - DNA, 50 bp, Homo sapiens
cactgacttctattccatgagctttttcaaggcgcttattttatggcagc

SEQ ID NO: 1043 - DNA, 50 bp, Homo sapiens
tgtttcgtaaattaaataggtctggcccagaagacccactcaattgcctt

SEQ ID NO: 1044 - DNA, 50 bp, Homo sapiens
ggaagacccaaggaaatccggaatttcgcaccagaggacccaccacgtcc

SEQ ID NO: 1045 - DNA, 50 bp, Homo sapiens
tcttgttacttccaaggagaaccaagaatggctctgtcacactcgaagcc

SEQ ID NO: 1046 - DNA, 50 bp, Homo sapiens
tctttctctaaagcttgtttgatgaaactggttggtcctttcagtgaaca

SEQ ID NO: 1047 - DNA, 50 bp, Homo sapiens
gctgtgtgacttagtagataaaatactgccttctgcctttgggaccatga

SEQ ID NO: 1048 - DNA, 50 bp, Homo sapiens
tctgtaattggacagctctctcgaagagatcttacagactgtatcagtct

SEQ ID NO: 1049 - DNA, 50 bp, Homo sapiens
ggtcgtggacgtggtcagccacctcagtaaaattggagaggattcttttg

SEQ ID NO: 1050 - DNA, 50 bp, Homo sapiens
aaagtgaaaccaagagtacaagagacaggtgaaattaaagagccccttga

SEQ ID NO: 1051 - DNA, 50 bp, Homo sapiens
gtccaggatgcagagctaaaggccctcctccagagttctacaagtcgaaa

SEQ ID NO: 1052 - DNA, 50 bp, Homo sapiens
ccaacttgagatgtatgaaggcttttggtctccctgggagtgggtggagg

SEQ ID NO: 1053 - DNA, 50 bp, Homo sapiens
ttcctcatcccatttacagtttttctaactccagggtagtgtttagtgtt

SEQ ID NO: 1054 - DNA, 50 bp, Homo sapiens
catgccaaagactcaactgctttcaaagataatgtgggtgctagatgcag

SEQ ID NO: 1055 - DNA, 50 bp, Homo sapiens
tccccttctcccctgcactgtaaaatgtgggattatgggtcacaggaaaa

SEQ ID NO: 1056 - DNA, 50 bp, Homo sapiens
accatgcatagagtcaatcaaatccttgtgatgttttgtatggactttga

SEQ ID NO: 1057 - DNA, 50 bp, Homo sapiens
tgtgctgcctcaagactgctggagtcaggacattttatagagccttttcc

SEQ ID NO: 1058 - DNA, 50 bp, Homo sapiens
gtgcagtctcttagcagacttcaggcccaaactgtattcttcactcaggc

SEQ ID NO: 1059 - DNA, 50 bp, Homo sapiens
gttagtgaaagctgtttactgtaacggggaaaaccagattctttgcatct

SEQ ID NO: 1060 - DNA, 50 bp, Homo sapiens
gcttctgtaaatgccatcccaatgtggtttggttttgttgaacagaaacc

SEQ ID NO: 1061 - DNA, 50 bp, Homo sapiens
ttgcctcgataagtttccaagtcactgaaatctgctgaaggttttactgt

SEQ ID NO: 1062 - DNA, 50 bp, Homo sapiens
acttctgaactgaggaatttgctgttgacagccaaagtatagtgtacaag

SEQ ID NO: 1063 - DNA, 50 bp, Homo sapiens
agagccatctggtgtgaagaactctatatttgtatgttgagagggcatgg

SEQ ID NO: 1064 - DNA, 50 bp, Homo sapiens
agaacaagtttgccttgattttgtttaaaatgacttctgctaagcaccca

SEQ ID NO: 1065 - DNA, 50 bp, Homo sapiens
cctgccaaagcaagaagaaggcttggtccccagaaacaaacagtagtcat

SEQ ID NO: 1066 - DNA, 50 bp, Homo sapiens
ggagtctcaggccaaggatgtcattgaagagtatttcaaatgcaagaaat

SEQ ID NO: 1067 - DNA, 50 bp, Homo sapiens; identical to SEQ ID NO: 1066

SEQ ID NO: 1068 - DNA, 50 bp, Homo sapiens
tttcatctgaatccagaggtgcatcaaattaaatgacagctccacttggc

SEQ ID NO: 1069 - DNA, 50 bp, Homo sapiens
ttgacacgttccacttcctttgcaattattgtatttagttgtgcactagt

SEQ ID NO: 1070 - DNA, 50 bp, Homo sapiens
ccaaatcaactgtgtgaactgtttctgcactgcttgctaatggtttcatc

SEQ ID NO: 1071 - DNA, 50 bp, Homo sapiens
attgagacgggaaaaactcgctgtaaaataatgccaacctagataatgct

SEQ ID NO: 1072 - DNA, 50 bp, Homo sapiens
tgttcttgcattgcatttaatgatcccttttctccccacctccacacact

SEQ ID NO: 1073 - DNA, 50 bp, Homo sapiens
tgcagattcctagtagcatgccttacctacagcactatgtgcatttgctg

SEQ ID NO: 1074 - DNA, 50 bp, Homo sapiens
gcaagaccgtttgtccacttcattttgtataatcacagttgtgttcctga

SEQ ID NO: 1075 - DNA, 50 bp, Homo sapiens
aatttaacttttgggtgccaggaaatgggttttctcaaagtccattgccg

SEQ ID NO: 1076 - DNA, 50 bp, Homo sapiens
tcgtggaagggagagccatcagcagaaagagaccctgagatcttcgcctg

SEQ ID NO: 1077 - DNA, 50 bp, Homo sapiens
aaacacaccagggagacaccataaaacagaccaagactaacttaaaaaca

SEQ ID NO: 1078 - DNA, 50 bp, Homo sapiens
aaccacaatcaaacatataaataagcctggaaaaccaactacaaccagca

SEQ ID NO: 1079 - DNA, 50 bp, Homo sapiens
tttcctgattatttgatgctagctggaattcaagaaatggcattgacctt

SEQ ID NO: 1080 - DNA, 50 bp, Homo sapiens
tcaccccaagtagcatgactgatctgcaatttaaaattcctgtgatctgt

SEQ ID NO: 1081 - DNA, 50 bp, Homo sapiens
tgagaagtgcggaataggttgcttctaccacctgttcttaatgtaacagt

SEQ ID NO: 1082 - DNA, 50 bp, Homo sapiens
tcgaatgagtggtcaggtagtcttaaagagcctcatgttaaatagacaca

SEQ ID NO: 1083 - DNA, 50 bp, Homo sapiens
tgaagtgcaaataaaagcactgctactataagacattctggaatggttgt

SEQ ID NO: 1084 - DNA, 50 bp, Homo sapiens
gcagtccccagatccagaacatgggaagttagggaaaatgtgtgattttg

SEQ ID NO: 1085 - DNA, 50 bp, Homo sapiens
aggtatgacaggaactgtcttcatgtccttacccaagcaagtcatccatg

SEQ ID NO: 1086 - DNA, 50 bp, Homo sapiens
aattttgaatttctccttgccacgttaataaagccaaaagcagcgggtgc

SEQ ID NO: 1087 - DNA, 50 bp, Homo sapiens
tgactctgtgctggcaaaaatgcttgaaacctctatatttctttcgttca

SEQ ID NO: 1088 - DNA, 50 bp, Homo sapiens
gctctcccacagaaacctttgtccttgcaactttatcctttgtcccgatt

SEQ ID NO: 1089 - DNA, 50 bp, Homo sapiens
ttgccttagccagtgtacctcctacctcagtctatgtgagaggaagagaa

SEQ ID NO: 1090 - DNA, 50 bp, Homo sapiens
actgtattgggattgtaaagaacatctctgcactcagacagtttacagaa

SEQ ID NO: 1091 - DNA, 50 bp, Homo sapiens
gtgtgtgtgcatgtgtgtgttagcagaggtattttactcagaaaataggt

SEQ ID NO: 1092 - DNA, 50 bp, Homo sapiens
gccagtcaaaaagtaaaatgaagagaggcacgccaaccactccaaaattt

SEQ ID NO: 1093 - DNA, 50 bp, Homo sapiens
cactttgtggtcgaaaggctcagcctctctacatgaagtctgtggacatg

SEQ ID NO: 1094 - DNA, 50 bp, Homo sapiens
aggctttcttgtctcagcaactttcccatcttgtctctcttggatgatgt

SEQ ID NO: 1095 - DNA, 50 bp, Homo sapiens
tttttctttttgaagcatggaaaacaaatcttttatgccactccagccat

SEQ ID NO: 1096 - DNA, 50 bp, Homo sapiens
ccatgatataaggaagggccgtgcctcatggaaaagcaacaggtggcctc

SEQ ID NO: 1097 - DNA, 50 bp, Homo sapiens
taaaggcgagcaccgtcaggagcgcagagatcggccctactagatgcaga

SEQ ID NO: 1098 - DNA, 50 bp, Homo sapiens
tgagcctgacacctgtgtttcagcatttggagacatccccatgttattct

SEQ ID NO: 1099 - DNA, 50 bp, Homo sapiens
ctgagccacatccaagcctggtttgctgcactctattgccaaagactgac

SEQ ID NO: 1100 - DNA, 50 bp, Homo sapiens
acttgcctcattctcatcatccaaactgaacatttgtatcccaagcagaa

SEQ ID NO: 1101 - DNA, 50 bp, Homo sapiens
gtatgaagaaggaagcccagcagagcaggaggcagcagcaacaatgagag

SEQ ID NO: 1102 - DNA, 50 bp, Homo sapiens
ctgtgtgtgtccatgtctgcaagcagttcttcaataaatggcctgcctcc

SEQ ID NO: 1103 - DNA, 50 bp, Homo sapiens
tcaaagcagagcacagagttatttggtgtttgctgaagacagcctttgtg

SEQ ID NO: 1104 - DNA, 50 bp, Homo sapiens
acttccatctcagctaatgcacccaccagctcaaacacaccaataaagct

SEQ ID NO: 1105 - DNA, 50 bp, Homo sapiens
tgcaatccacaatctgacattctcaggaagcccccaagttgatatttcta

SEQ ID NO: 1106 - DNA, 50 bp, Homo sapiens
cagaaaccaatactgctgtgcactgagaataaaaactcatgcccccttgt

SEQ ID NO: 1107 - DNA, 50 bp, Homo sapiens
caccagtgaggattactgatgtggacagttgatggggtttgtttctgtat

SEQ ID NO: 1108 - DNA, 50 bp, Homo sapiens; identical to SEQ ID NO: 500

SEQ ID NO: 1109 - DNA, 50 bp, Homo sapiens
taaggggtagacaagataccgaataatctccacaagtttatttgtggtct

SEQ ID NO: 1110 - DNA, 50 bp, Homo sapiens
acatcaacagtggtgctgtggaatgcccagccagttaagcacaaaggaaa

SEQ ID NO: 1111 - DNA, 50 bp, Homo sapiens
acaaacaatgcaaccaactatccaagtgttataccaactaaaacccccaa

SEQ ID NO: 1112 - DNA, 50 bp, Homo sapiens
ttcacctacaaaatttcacctgcaaaccttaaacctgcaaaattttcctt

SEQ ID NO: 1113 - DNA, 50 bp, Homo sapiens
gggtacttctccataaggcatctcagtcaaatccccatcactgtcataaa

SEQ ID NO: 1114 - DNA, 50 bp, Homo sapiens
cttgctgttttccctgtccacatccatgctgtacagacaccaccattgaa

SEQ ID NO: 1115 - DNA, 50 bp, Homo sapiens
aagtcaattcctggaatttgaaagagcaaataaagacctgagaaccttcc

SEQ ID NO: 1116 - DNA, 50 bp, Homo sapiens
aagctactgtgtgtgtgaatgaacactcttgctttattccagaatgctgt

SEQ ID NO: 1117 - DNA, 50 bp, Homo sapiens
tgtcatgctcccagaatttcagcttcagcttaactgacagatgttaaagc

SEQ ID NO: 1118 - DNA, 50 bp, Homo sapiens
aggtggtactcaagccatgctgcctccttacatcctttttggaacagagc

SEQ ID NO: 1119 - DNA, 50 bp, Homo sapiens; identical to SEQ ID NO: 75

SEQ ID NO: 1120 - DNA, 50 bp, Homo sapiens
tgtggttaggaagcaatttcccaatgtacctataagaaatgtgcatcaag

SEQ ID NO: 1121 - DNA, 50 bp, Homo sapiens
gcctgcgttgccacttgtcttaactctgaatatttcatttcaaaggtgct

SEQ ID NO: 1122 - DNA, 50 bp, Homo sapiens
agctaatattgctgcaatggctggcaggaaacaggtgatcaagagtgtca

SEQ ID NO: 1123 - DNA, 50 bp, Homo sapiens
tcgaccccagaggtgaatgtattgttattattgttttgttgttgttgtga

SEQ ID NO: 1124 - DNA, 50 bp, Homo sapiens
tccttggcagctgtattctggagtctggatgttgctctctaaagaccttt

SEQ ID NO: 1125 - DNA, 50 bp, Homo sapiens
tttgccatgtccagtacagaataatttgtacttagtatttgcagcagggt

SEQ ID NO: 1126 - DNA, 50 bp, Homo sapiens
tagagaacctatagcatcttctcattcccatgtggaacaggatgcccaca

SEQ ID NO: 1127 - DNA, 50 bp, Homo sapiens
aactcatgtgcaggtttgataaacaccagaacagaagacagtgatgctgt

SEQ ID NO: 1128 - DNA, 50 bp, Homo sapiens
tggccctgacagtattcattatttcagataattccctgtgataggacaac

SEQ ID NO: 1129 - DNA, 50 bp, Homo sapiens
acctggagagagaaggtattgaaacatctcctttatgtgtgactttccca

SEQ ID NO: 1130 - DNA, 50 bp, Homo sapiens
agaaatacccactaacaaagaacaagcattagttttggctgtcatcaact

SEQ ID NO: 1131 - DNA, 50 bp, Homo sapiens
atgggcaaattcttaggtaagacaaaaacacagccccaagggcaggtagt

SEQ ID NO: 1132 - DNA, 50 bp, Homo sapiens
gctgatgccactacccgatttgtttatttgcaatttgagccatttaaaga

SEQ ID NO: 1133 - DNA, 50 bp, Homo sapiens
cctgttcccttcagccaacccgtttctgcagtaaaattaagcctgtcaaa

SEQ ID NO: 1134 - DNA, 50 bp, Homo sapiens
tggcttaaaccagtgttcagtctggtgccaaacttcgaatggaatacaaa

SEQ ID NO: 1135 - DNA, 50 bp, Homo sapiens
tgtgagttgtgaccatgtaacatgagaggttttgctagggcctattattt

SEQ ID NO: 1136 - DNA, 50 bp, Homo sapiens
agctgagtaattctaatctcttctgtgttttccttgccttaaccacaaat

SEQ ID NO: 1137 - DNA, 50 bp, Homo sapiens
aatttgctagaatccagtaaatcattttggtagctctggctgtgctatca

SEQ ID NO: 1138 - DNA, 50 bp, Homo sapiens
tggctcgaagtttctctagtgttttctgtggaaggaataaaaatttgagt

SEQ ID NO: 1139 - DNA, 50 bp, Homo sapiens
actcttgggagtgctgcagtctttaatcatgctgtttaaactgttgtggc

SEQ ID NO: 1140 - DNA, 50 bp, Homo sapiens
tttacatgattggaccctcagattctgttaaccaaaattgcagaatgggg

SEQ ID NO: 1141 - DNA, 50 bp, Homo sapiens
tgaaatcaaagcacggtgcagaacttgtaccaagtacaaaaggtccatgt

SEQ ID NO: 1142 - DNA, 50 bp, Homo sapiens
ccttactctgtccttgatggaggggagaagggagggcaaagaagttaaat

SEQ ID NO: 1143 - DNA, 50 bp, Homo sapiens
caccgccatgcaactccatgcctatttactggaaacctgttatgccaaac

SEQ ID NO: 1144 - DNA, 50 bp, Homo sapiens
caagagaatgaaggaggctaaggagaagcgccaggaacaaattgcgaaga

SEQ ID NO: 1145 - DNA, 50 bp, Homo sapiens
agtctcgggtatgctgttgtgaaattgaaactgtaaaagtagatggttga

SEQ ID NO: 1146 - DNA, 50 bp, Homo sapiens
actaaactacccgaaggacttaggtgctttgtgtacttaaccccaggacc

SEQ ID NO: 1147 - DNA, 50 bp, Homo sapiens
gccaccactgtctgtttgagactccttcatgagcaaagattgatgtatgg

SEQ ID NO: 1148 - DNA, 50 bp, Homo sapiens
atgaatttgaagacatggtggctgaaaagcggctcatcccagatggttgt

SEQ ID NO: 1149 - DNA, 50 bp, Homo sapiens
agcttcagtctctactggattagccctactctttcctttcccctccatta

SEQ ID NO: 1150 - DNA, 50 bp, Homo sapiens
agatgtggttatcacaagtctcgagggggaaactactgcataaaataact

SEQ ID NO: 1151 - DNA, 50 bp, Homo sapiens
tcagtaaaaatgcctgttgtgagatgaacctcctgtaacttctatctgtt

SEQ ID NO: 1152 - DNA, 50 bp, Homo sapiens
agttaactgcggagccaagagttggactataattaaattaccttccttgt

SEQ ID NO: 1153 - DNA, 50 bp, Homo sapiens
ccggtttgggttgttaatggttgaaaacttagaggaacatagtgaggcct

SEQ ID NO: 1154 - DNA, 50 bp, Homo sapiens; identical to SEQ ID NO: 1153

SEQ ID NO: 1155 - DNA, 50 bp, Homo sapiens
ccagtgatttgattaactcagggcaaggctgaatatcagagtgtatcgca

SEQ ID NO: 1156 - DNA, 50 bp, Homo sapiens; identical to SEQ ID NO: 386

SEQ ID NO: 1157 - DNA, 50 bp, Homo sapiens
actggacatcgccctacgcaacctcctcgccatgactgataagttccttt

SEQ ID NO: 1158 - DNA, 50 bp, Homo sapiens
actgctggtagcatttatctgacttggaaagttggagaagaggcattcct

SEQ ID NO: 1159 - DNA, 50 bp, Homo sapiens
cttccgaagagaagaggctggggctgtaactggaaaggggaagcgcacag

SEQ ID NO: 1160 - DNA, 50 bp, Homo sapiens
cctgaccttgagctctagtctcccctttaaatcttaccttggcagtaaca

SEQ ID NO: 1161 - DNA, 50 bp, Homo sapiens
ttggtcccacagtttttatgtgtcctacttgaaattatgtttgctcccgt

SEQ ID NO: 1162 - DNA, 50 bp, Homo sapiens
tggaggatttttgttaagtcaagtgtcaatcgaagttaaaaagcaagggt

SEQ ID NO: 1163 - DNA, 50 bp, Homo sapiens
atggctcttttcctattagagcaacttgtgtttccctgataatgtgtaca

SEQ ID NO: 1164 - DNA, 50 bp, Homo sapiens
gtcgtgactgacttggtgtgttgctattgtgtttctatatactccgtcca

SEQ ID NO: 1165 - DNA, 50 bp, Homo sapiens
tttagtccagtggtttccacagctggctaagccaggagtcacttggaggc

SEQ ID NO: 1166 - DNA, 50 bp, Homo sapiens
tggaagacagtaaagaacagccctctgtagtcagtaaagtttcaccttct

SEQ ID NO: 1167 - DNA, 50 bp, Homo sapiens
tgggtggagtattatgtttaactggagttgtcaagtatgagtccctcagg

SEQ ID NO: 1168 - DNA, 50 bp, Homo sapiens
aaagtagtaaatcgggctgtcttaatagtgcgcctgttactaatggaatt

SEQ ID NO: 1169 - DNA, 50 bp, Homo sapiens
atgtcaagctttgggtctctggagtataactttttgtaacattagccatt

SEQ ID NO: 1170 - DNA, 50 bp, Homo sapiens
atctaggacacctccatcaaacctcctcttgcactttccctctggcttcc

SEQ ID NO: 1171 - DNA, 50 bp, Homo sapiens
tgtgatgggaacagtgtcttagggagatgcagcttggacttgaggtaaat

SEQ ID NO: 1172 - DNA, 50 bp, Homo sapiens
agaatgggaggccaaccttctatcagagttaaacttttgacaagggaaca

SEQ ID NO: 1173 - DNA, 50 bp, Homo sapiens
aaaaatgtgaaactgccctgcctcccctttttgctgacaacactgtgtac

SEQ ID NO: 1174 - DNA, 50 bp, Homo sapiens
ggccccattacaaaactccttaggaacctcgccctctctctgctgtaagg

SEQ ID NO: 1175 - DNA, 50 bp, Homo sapiens
gctgctgtctagatttatgtgtgctctgacaagaaatgttttgtgtaaca

SEQ ID NO: 1176 - DNA, 50 bp, Homo sapiens
ccaggctgcggtgagaatgccaagaaggcactacctcccacccacatcac

SEQ ID NO: 1177 - DNA, 50 bp, Homo sapiens
ccagttgtcttgaacagcctgactcctgccagccctatggaagttccttt

SEQ ID NO: 1178 - DNA, 50 bp, Homo sapiens; identical to SEQ ID NO: 1177

SEQ ID NO: 1179 - DNA, 50 bp, Homo sapiens
tctttaagaagaccaccacatagaataccccttcctatcagctcgctctg

SEQ ID NO: 1180 - DNA, 50 bp, Homo sapiens
tttgactttcaggatgtcatactacttctgtacctagcattttcagtcct

SEQ ID NO: 1181 - DNA, 50 bp, Homo sapiens
tgcttagatttgttcctgttgtcaaaactgttacccccaaaattggtgtg

SEQ ID NO: 1182 - DNA, 50 bp, Homo sapiens
aacaaggtacatgcattatgtgtcacattactgggcaaactgttcaagta

SEQ ID NO: 1183 - DNA, 50 bp, Homo sapiens
agcacaagcagtgtctgtcactttccatgcataaagtttagtgagatgtt

SEQ ID NO: 1184 - DNA, 50 bp, Homo sapiens
agtgactaaatactgggaacctattttctcaatcttcctccatgttgtgt

SEQ ID NO: 1185 - DNA, 50 bp, Homo sapiens
cttcaggactgtatgagccgagcagttacaagacacaaagaagttaaaaa

SEQ ID NO: 1186 - DNA, 50 bp, Homo sapiens
agggccagatttcatgttgaccctggggatgctgtgaatttctcctgcag

SEQ ID NO: 1187 - DNA, 50 bp, Homo sapiens
aaatgcaggtttattatccagcactgagagagttaacaaggactggaaaa

SEQ ID NO: 1188 - DNA, 50 bp, Homo sapiens; identical to SEQ ID NO: 1187

SEQ ID NO: 1189 - DNA, 50 bp, Homo sapiens
ccctccttaatcaacttcaaggagcaccttcattagtacagcttgcatat

SEQ ID NO: 1190 - DNA, 50 bp, Homo sapiens
aaaccagtgactcctaatctttttcaagttaagacaccttaccattgctt

SEQ ID NO: 1191 - DNA, 50 bp, Homo sapiens
aagggaacacaaaactgtggtcctgacaatactaattctacccgttttca

SEQ ID NO: 1192 - DNA, 50 bp, Homo sapiens
tttttgtacgatcagccttactgctaataaaagcacttccacagggaaaa

SEQ ID NO: 1193 - DNA, 50 bp, Homo sapiens
aaattctacaaaggagaggttgggcgttacaaaggcattgtgaatctaat

SEQ ID NO: 1194 - DNA, 50 bp, Homo sapiens; identical to SEQ ID NO: 1193

SEQ ID NO: 1195 - DNA, 50 bp, Homo sapiens
ttcaccgaggacatgaaactccaccttgcggggataaagagagaaaaaca

SEQ ID NO: 1196 - DNA, 50 bp, Homo sapiens
tgtgctcttcagtagaggattttctgtgatcctacaatgaagggaaagct

SEQ ID NO: 1197 - DNA, 50 bp, Homo sapiens
tttgtgtaaaaccaccttttgaagcagcaactatcaagtctgaaaagcaa

SEQ ID NO: 1198 - DNA, 50 bp, Homo sapiens
agtgggtgaatcacagtaatttccctgtaaaatgtggtacctgaagtcat

SEQ ID NO: 1199 - DNA, 50 bp, Homo sapiens
taggctcatagccttgtatttcgttttagattgtaagctcaatggcaggg

SEQ ID NO: 1200 - DNA, 50 bp, Homo sapiens
gctcaagcaaatgtttggtaatgcagacatgaatacatttcccaccttca

SEQ ID NO: 1201 - DNA, 50 bp, Homo sapiens
aagtcatcatttgccttgaaagtttcctctgcattgggtttgaagtagtt

SEQ ID NO: 1202 - DNA, 50 bp, Homo sapiens
gagcaggggtgggagtggctgtaacttcacaatcctaatacagtaaatgt

SEQ ID NO: 1203 - DNA, 50 bp, Homo sapiens
ttcttaaggagtcttaactcggtacttgggttaacgccagaaattacttt

SEQ ID NO: 1204 - DNA, 50 bp, Homo sapiens
ttggtgagttgccaaagaagcaatacagcatatctgcttttgccttctgt

SEQ ID NO: 1205 - DNA, 50 bp, Homo sapiens
aggccttgtttttcagcttcatctgcagttctatgtgaagattgataaat

SEQ ID NO: 1206 - DNA, 50 bp, Homo sapiens
tgcaacttagaaaccagctacagtatggcccacttaataaaacacctgaa

SEQ ID NO: 1207 - DNA, 50 bp, Homo sapiens
agtttattgttagccaggttgcttgaaaggttgagagtggagtggtttgg

SEQ ID NO: 1208 - DNA, 50 bp, Homo sapiens
gcataactgctctagcttcttgtttaccatagtactgtggcttcagattt

SEQ ID NO: 1209 - DNA, 50 bp, Homo sapiens
tgtatcttttcctgttaaacacacagacccctccccaatctggacattga

SEQ ID NO: 1210 - DNA, 50 bp, Homo sapiens
gccttgccagcctgtgtgcttgtgggaacaccttgtacctgagcttacag

SEQ ID NO: 1211 - DNA, 50 bp, Homo sapiens
gcatgaatgggcaatattttcatctgtttacttgtagtgccatagaggcc

SEQ ID NO: 1212 - DNA, 50 bp, Homo sapiens
ggccttctatgtgcttagccataacaattccattaagcaagaaggtaagc

SEQ ID NO: 1213 - DNA, 50 bp, Homo sapiens
aattgaacaataaccattggtgactggagcaggtaattatagcctgcaga

SEQ ID NO: 1214 - DNA, 50 bp, Homo sapiens
aggggtcccaagagcctgtcctcttttgttcaaaatacatcttgaaacgt

SEQ ID NO: 1215 - DNA, 50 bp, Homo sapiens
cctgctgggactccctgacttactttggttggttcctagtgctacttgtt

SEQ ID NO: 1216 - DNA, 50 bp, Homo sapiens
ggaaagctcgtcagtttagtaggctccgaaatagaatagcagttgtcact

SEQ ID NO: 1217 - DNA, 50 bp, Homo sapiens
agaaggtaactttatagaagtaacaccaatatcctagtctgcttgccccg

SEQ ID NO: 1218 - DNA, 50 bp, Homo sapiens
gctgctccctggttccactctggagagtaatctgggacatcttagtgttt

SEQ ID NO: 1219 - DNA, 50 bp, Homo sapiens
ctctcctcttcccacctctgtatcccacacaggcatctggtgatgttctc

SEQ ID NO: 1220 - DNA, 50 bp, Homo sapiens
acacctgttctttgtaattgggttgtggtgcattttgcactacctggagt

SEQ ID NO: 1221 - DNA, 50 bp, Homo sapiens
agcctaggtgaaaatctatttataaatggaccacaactctggggtgtcgt

SEQ ID NO: 1222 - DNA, 50 bp, Homo sapiens
catgaagctctcaagtcctgcatcctgaggatccagatggatgacaagga

SEQ ID NO: 1223 - DNA, 50 bp, Homo sapiens
ggtggtgtttcctagaccttccctgatgcgattttacctttgttgaattt

SEQ ID NO: 1224 - DNA, 50 bp, Homo sapiens
acgatgctgtttgctctggaatgttcatcttttagacaggttttggctca

SEQ ID NO: 1225 - DNA, 50 bp, Homo sapiens
tccgagggatgagattaaggcagaggcaaaagtttcacacaaagtttctg

SEQ ID NO: 1226 - DNA, 50 bp, Homo sapiens
gccacaactcccatagatgccaatgttttgatagcctcagtttctcaacg

SEQ ID NO: 1227 - DNA, 50 bp, Homo sapiens
tgacccacccaccaaggaagaaagcagaataaacatttttgcactgcctg

SEQ ID NO: 1228 - DNA, 50 bp, Homo sapiens
catgctctcccatgacatctccatgctggtttctccatagcataaatgaa

SEQ ID NO: 1229 - DNA, 50 bp, Homo sapiens
ggtgccgtgcatcaccaaatgaaagtttgtatttaacgaggaggtgcttt

SEQ ID NO: 1230 - DNA, 50 bp, Homo sapiens
aaatcctctctgctgttcacattatcctttgtttaacgtatgaaccaggt

SEQ ID NO: 1231 - DNA, 50 bp, Homo sapiens
gtgtagaattcccggagcgtccgtggttcagagtaaacttgaagcagatc

SEQ ID NO: 1232 - DNA, 50 bp, Homo sapiens
tgggtaggttaagctgccatacgtgttcagtgtgaatagtgtttaagttg

SEQ ID NO: 1233 - DNA, 50 bp, Homo sapiens
tgatgcaagagtggacgtaatgctagttggcagtattttattgtaagaaa

SEQ ID NO: 1234 - DNA, 50 bp, Homo sapiens; identical to SEQ ID NO: 1151

SEQ ID NO: 1235 - DNA, 50 bp, Homo sapiens; identical to SEQ ID NO: 1035

SEQ ID NO: 1236 - DNA, 50 bp, Homo sapiens
aaaatgctgctggcttttctgaagacaggtgcttgaacttgtcagtttgt

SEQ ID NO: 1237 - DNA, 50 bp, Homo sapiens
ccgcccaaaagtctgttctgatggcactgagttttcattgttctggatgt

SEQ ID NO: 1238 - DNA, 50 bp, Homo sapiens
tggttgtgctaaattcatagcaggtgccttattctttgcttttagtcaaa

SEQ ID NO: 1239 - DNA, 50 bp, Homo sapiens
tttgccagggtaatcttcagttggccctgattcaattaaatggccttaat

SEQ ID NO: 1240 - DNA, 50 bp, Homo sapiens
acactccttaagttccaaatgttttccgctaatagtctgtcctaaagcct

SEQ ID NO: 1241 - DNA, 50 bp, Homo sapiens
aggactcttgaacatctgagcagttttgtgctttgagccactttttgaca

SEQ ID NO: 1242 - DNA, 50 bp, Homo sapiens
cgcctatatgaacctggacatatggactaccacagcgaataggaatgcaa

SEQ ID NO: 1243 - DNA, 50 bp, Homo sapiens; identical to SEQ ID NO: 1242

SEQ ID NO: 1244 - DNA, 50 bp, Homo sapiens
tttcctattttgctccagactatgttttcagcataccttgggtctgaaca

SEQ ID NO: 1245 - DNA, 50 bp, Homo sapiens
ttgtgctttctgtatttaaaactttggctgtactaagcaaatgcaaggtt

SEQ ID NO: 1246 - DNA, 50 bp, Homo sapiens
ggtcatcatagttgaggtatgtgtctgctatttgcaaagaagttggtcgt

SEQ ID NO: 1247 - DNA, 50 bp, Homo sapiens
ttcaggaccctagaggagagctttatacaattaccgatgtgaatttctct

SEQ ID NO: 1248 - DNA, 50 bp, Homo sapiens
tgttttgcttaatgtggacaatttacacacccaacacatactgtttccaa

SEQ ID NO: 1249 - DNA, 50 bp, Homo sapiens
gagatcaacgggatgaggtgttacagctgcctccctcttcatgcaatctg

SEQ ID NO: 1250 - DNA, 50 bp, Homo sapiens
aggtagggtttaatccccagtaaaattgccatattgcacatgtcttaatg

SEQ ID NO: 1251 - DNA, 50 bp, Homo sapiens
agggggtgatttttgctcttgtcctgagaaataacagtgctgttttaaaa

SEQ ID NO: 1252 - DNA, 50 bp, Homo sapiens
acttgagtggggttttccttttcccccaattctaagagaatataatgtgt

SEQ ID NO: 1253 - DNA, 50 bp, Homo sapiens
gcgtctgttgttagcaaagaatagattcacacagtctaaggtttccttcc

SEQ ID NO: 1254 - DNA, 50 bp, Homo sapiens
ccctcttagcctatccatcttaagccccaagctgagtgtggttctggtaa

SEQ ID NO: 1255 - DNA, 50 bp, Homo sapiens
taaggagaattagactcccaagtagacaccagagtcactgtttggttggt

SEQ ID NO: 1256 - DNA, 50 bp, Homo sapiens
acgtgtttttgggatatgtttccaatctttaaatgaccttgccctgtcca

SEQ ID NO: 1257 - DNA, 50 bp, Homo sapiens
aaccatttgttaactgtactgaaggtgtgtcctcaagaagaaagtgttca

SEQ ID NO: 1258 - DNA, 50 bp, Homo sapiens
aaacaaactgtgtaactgcccaaagcagcacttataaatcagcctaacat

SEQ ID NO: 1259 - DNA, 50 bp, Homo sapiens
aaactgatcacactgactggatctgtccacgacatggaaaataaactgga

SEQ ID NO: 1260 - DNA, 50 bp, Homo sapiens
ttgcattgatgaattttgtatctgcttccattaaaagcataacagccaca

SEQ ID NO: 1261 - DNA, 50 bp, Homo sapiens
atctctccttcagtctgctctgtttaattctgctgtctgctcttctctaa

SEQ ID NO: 1262 - DNA, 50 bp, Homo sapiens
ttgaagttttaagggacgtcagtgtttatgccatttttccagttccaaaa

SEQ ID NO: 1263 - DNA, 50 bp, Homo sapiens
ggtcggctcttatagagtggccatagtgttctgtcaaaacacttgcttcc

SEQ ID NO: 1264 - DNA, 50 bp, Homo sapiens
ttctccttcacagctaagatgccatgtgcaggtggattccatgccgcaga

SEQ ID NO: 1265 - DNA, 50 bp, Homo sapiens
catgattccaaggatcagcctggatgcctagaggactagatcaccttagt

SEQ ID NO: 1266 - DNA, 50 bp, Homo sapiens
agtgaagatctggctgaaccagttccacaaggttactgtatacatagcct

SEQ ID NO: 1267 - DNA, 50 bp, Homo sapiens
aggccatcattctatacctcatttaagccattgttatcaagggtttaccc

SEQ ID NO: 1268 - DNA, 50 bp, Homo sapiens
agagtacatggaaagttaggtgttcaaattcacatctaatttccctggga

SEQ ID NO: 1269 - DNA, 50 bp, Homo sapiens
gttttcagttttcccctttacagtcttctcccctcacctccaggaccctc

SEQ ID NO: 1270 - DNA, 50 bp, Homo sapiens
atccttcagaatgtgttggtttaccagtgacaccccatattcatcacaaa

SEQ ID NO: 1271 - DNA, 50 bp, Homo sapiens
gtctggccttggcttgctcggataaaactttgtatgtattttgtatggca

SEQ ID NO: 1272 - DNA, 50 bp, Homo sapiens
tgctgagcatggggaatgtggctgctgcagagacgttatgaaacacttct

SEQ ID NO: 1273 - DNA, 50 bp, Homo sapiens
tctccatccttgtgaatgtcctcgtctgtttcaaatacagtgcagtcagt

SEQ ID NO: 1274 - DNA, 51 bp, Homo sapiens
tggttcttctgatgagcaagggaacaacactgagaatgaggaggaaggagt

SEQ ID NO: 1275 - DNA, 50 bp, Homo sapiens
tgaagttaaggattacttggctgccatagcataacaatgaagtgactgaa

SEQ ID NO: 1276 - DNA, 50 bp, Homo sapiens
ggctttcttgttttggtgtcttggagtgctgggtaaggttcagtggatat

SEQ ID NO: 1277 - DNA, 50 bp, Homo sapiens
ctatctacaccatcatgcgctggttccggagacacaaggtgcgggctcac

SEQ ID NO: 1278 - DNA, 50 bp, Homo sapiens
gaagcggctggcaactgaaggctggaacacttgctactggataatcgtag

SEQ ID NO: 1279 - DNA, 50 bp, Homo sapiens
aagcaagagattgtaaaccgggtacagaatccaagagatgagagaggacc

SEQ ID NO: 1280 - DNA, 50 bp, Homo sapiens
agacgaatgcttgtcagttgtagctttccaggattctgctccaatgagga

SEQ ID NO: 1281 - DNA, 50 bp, Homo sapiens
caaactgattgcggggcagggacttgagtatggggagaggctgcaaaaga

SEQ ID NO: 1282 - DNA, 50 bp, Homo sapiens
gaacatcaggagaggagtccagagcccacgtctactgcggaaaagtcagg

SEQ ID NO: 1283 - DNA, 50 bp, Homo sapiens
agttggagagttactcgaacctcaggtgacagttgtaaggcagacatagt

SEQ ID NO: 1284 - DNA, 50 bp, Homo sapiens
ctcctccaggcctctcggatgcctctgttgggacagctaagttcctcttc

SEQ ID NO: 1285 - DNA, 50 bp, Homo sapiens
tcctccatatatccaaacaacaaagcataatatttcgcccactaagccaa

SEQ ID NO: 1286 - DNA, 50 bp, Homo sapiens
tgctgttgcaaaagaagaagacatctctgcctgagttttaattttgtcca

SEQ ID NO: 1287 - DNA, 50 bp, Homo sapiens
tttctgctggagtcccctgtgtcctcagccatcccaagaagggtttgctg

SEQ ID NO: 1288 - DNA, 50 bp, Homo sapiens
ctggttggatctgcatctcacgcccactgcacaccgttcctctccatctg

SEQ ID NO: 1289 - DNA, 50 bp, Homo sapiens
acctcgactccctggtgctctttgcagagttgggcagtgaaattaccttt

SEQ ID NO: 1290 - DNA, 50 bp, Homo sapiens
atacacagcacgacgtatccttgtaccgacttctcccggttcttgtttga

SEQ ID NO: 1291 - DNA, 50 bp, Homo sapiens
gtacttaggaagacacagctagatggacaacagcattgggaggcttagcc

SEQ ID NO: 1292 - DNA, 50 bp, Homo sapiens
catctctggttgtgtctgtgccgactcggtgttgaatcaaatcaggtgtg

SEQ ID NO: 1293 - DNA, 50 bp, Homo sapiens
caacaataggaggtggaatgctgcaaggggctgcaaatgagggcaatgca

SEQ ID NO: 1294 - DNA, 50 bp, Homo sapiens
atatttcactttacatccaaacatcactttggcttcgaagccgccgcctg

SEQ ID NO: 1295 - DNA, 50 bp, Homo sapiens
tggcaaattctgcgagtgtgataatttcaactgtgatagatccaatggct

SEQ ID NO: 1296 - DNA, 50 bp, Homo sapiens
tctcacatgtccatttgaaccacccaaaccaaaaacaaagcataagctgg

SEQ ID NO: 1297 - DNA, 50 bp, Homo sapiens
tccaggatgtctacaaaattggtggtattggtactgttcctgttggccga

SEQ ID NO: 1298 - DNA, 50 bp, Homo sapiens
tggacatagcagcacatactacttcagagttcatgatgtagatgtctggt

SEQ ID NO: 1299 - DNA, 50 bp, Homo sapiens
aacagaagacgaggacacagagcgagaataagcacaactcagacaacaca

SEQ ID NO: 1300 - DNA, 50 bp, Homo sapiens
tgaccacttatgcactttctgaatttgctttccatgctcagagttctgct

SEQ ID NO: 1301 - DNA, 50 bp, Homo sapiens
ctttgaccccaccttgtggaaacccagctgtctactggcagacattggtg

SEQ ID NO: 1302 - DNA, 50 bp, Homo sapiens
aaacaccagtttgcaggaagaaaggaagagaatggaaattgcttctggaa

SEQ ID NO: 1303 - DNA, 50 bp, Homo sapiens
ccctaccatgagccctacaaacaactaacctgccactaatagttatgtca

SEQ ID NO: 1304 - DNA, 50 bp, Homo sapiens
agtcgtattagagccttggcgtaatcatggtcatagctgtttcctgtgtg

SEQ ID NO: 1305 - DNA, 50 bp, Homo sapiens
ttgctgcctgatctgacatacatgatccatcgggttttgttacaaggaac

SEQ ID NO: 1306 - DNA, 50 bp, Homo sapiens
catgttcataggtaatctttgtactctgtgtgcagcagtatttggtttgc

SEQ ID NO: 1307 - DNA, 50 bp, Homo sapiens
aattcgccctatagtgagtcgattaccaatcactgcccgcgtttacaacg

SEQ ID NO: 1308 - DNA, 50 bp, Homo sapiens
acaggtaactgaagatcaaagtaaagcaacagaggaatgtacatctacct

SEQ ID NO: 1309 - DNA, 50 bp, Homo sapiens
aacagttgggcaccctgaatggcaaatggcaaatttggagcgctaataat

SEQ ID NO: 1310 - DNA, 50 bp, Homo sapiens
gccaatcactttattgactcctagccgcagacctcctcattctaacctga

SEQ ID NO: 1311 - DNA, 50 bp, Homo sapiens
atgtgggaggggcatggcagctatgaaggacctcctacctctggtttctg

SEQ ID NO: 1312 - DNA, 50 bp, Homo sapiens
catgggacggggagaaaaagcaaaccctggcacttgggaatacttatacc

SEQ ID NO: 1313 - DNA, 50 bp, Homo sapiens
ttgtgcccttgactgggtatttcttgaagcccttggatctacctttggtc

SEQ ID NO: 1314 - DNA, 50 bp, Homo sapiens
acataatacggttgtgcgagcagagaatctacctttccacttctaagcct

SEQ ID NO: 1315 - DNA, 50 bp, Homo sapiens
ccagcctttgcctcttccttcaatgtggtttccatgggaatttgcttcag

SEQ ID NO: 1316 - DNA, 50 bp, Homo sapiens
aaaacctcgagtcatggtgaatgagtgtctcggagttgctcgtgtgtgta

SEQ ID NO: 1317 - DNA, 50 bp, Homo sapiens
gtgagcacggacatgcggcatcatcgagtgagactggtgttccaagattc

SEQ ID NO: 1318 - DNA, 50 bp, Homo sapiens
caccacagtctcagtgcagggctgggaagtgaaagacgattcaccagacc

SEQ ID NO: 1319 - DNA, 50 bp, Homo sapiens
tttgtgggtgggtgattagtcgttgctgatgagatattttgagggtgggg

SEQ ID NO: 1320 - DNA, 50 bp, Homo sapiens
accttgtaagtgcctaagaaatgagactacaagctccatttcagcaggac

SEQ ID NO: 1321 - DNA, 50 bp, Homo sapiens
gccgagatctgctcagactacatggcttccactatagggttctacagtgt

SEQ ID NO: 1322 - DNA, 50 bp, Homo sapiens
aaatcagaattcatttagctcaccacatctcttgaatgtgattgacctac

SEQ ID NO: 1323 - DNA, 50 bp, Homo sapiens
aggtgtttaacagtgttattttgccactggtaatgtgtaaactgtgagtg

SEQ ID NO: 1324 - DNA, 50 bp, Homo sapiens
tggagtttccaggagaaaaataatcacctttgaaggtttttagagcatgt

SEQ ID NO: 1325 - DNA, 50 bp, Homo sapiens
ggtaacaacatccgtctgaaagggtcggacctcgtccaaaggagataggc

SEQ ID NO: 1326 - DNA, 50 bp, Homo sapiens
acattttgatttcttctctctgtggggtggcaagttgagggagcattctt

SEQ ID NO: 1327 - DNA, 50 bp, Homo sapiens
cgtaaaccaatgtggtacactagttggcccgaacttggtataaaccgcct

SEQ ID NO: 1328 - DNA, 50 bp, Homo sapiens
tctttaagtctgtcaaaccagaactctttgaagcactttgaacaatgccc

SEQ ID NO: 1329 - DNA, 50 bp, Homo sapiens
agctggcgtaatagcgaagaggcccgcaccgatcgcctttccaacaagtg

SEQ ID NO: 1330 - DNA, 50 bp, Homo sapiens
agatgcattttaaatgtctataaatggtgtcataactagagcacgggcgt

SEQ ID NO: 1331 - DNA, 50 bp, Homo sapiens
attaaaacgcttggaagaaaatccccttttggcaggtgggggaaaaagca

SEQ ID NO: 1332 - DNA, 50 bp, Homo sapiens
attcaaccaatagcccttgccgtaccgcctacccgtaacattactggagg

SEQ ID NO: 1333 - DNA, 50 bp, Homo sapiens
cgcctatagcactcgaataattcttctcaccctaacaggtcaacctcgct

SEQ ID NO: 1334 - DNA, 50 bp, Homo sapiens
gttgtgcatgattccccacgtgtctctgtttatccagataagaaaagata

SEQ ID NO: 1335 - DNA, 50 bp, Homo sapiens
tcttttaggatttgtcttttagaatctccagtcctcacaggaaaaccccc

SEQ ID NO: 1336 - DNA, 50 bp, Homo sapiens; identical to SEQ ID NO: 1167

SEQ ID NO: 1337 - DNA, 50 bp, Homo sapiens
acctcattctgacacctgcatatagtgtgggaaattgctctgcatttgac

SEQ ID NO: 1338 - DNA, 50 bp, Homo sapiens
gttctggaggacaggaagggtgacccacagaggattataccaccggggtg

SEQ ID NO: 1339 - DNA, 50 bp, Homo sapiens
gccgcagacctcctcattctaacctgaatcgaaggacaaccagtaagcta

SEQ ID NO: 1340 - DNA, 50 bp, Homo sapiens
tgagtcgtattacaattcactggccgtcgttttacaacgtcgtgactggg

SEQ ID NO: 1341 - DNA, 50 bp, Homo sapiens
taagattatcaaccttggggtcgttttgttgttcgcggattgagcacgga

SEQ ID NO: 1342 - DNA, 50 bp, Homo sapiens
ctgggctgaagcctattcctatggggctctggaatgtttgtgactgaatg

SEQ ID NO: 1343 - DNA, 50 bp, Homo sapiens
ttgtccatttggaacagagtcactataaagaacgggctcaactgggcacc

SEQ ID NO: 1344 - DNA, 50 bp, Homo sapiens
gcagacataggcgaagaaaacatggcattgagtgtgctgagtccagacaa

SEQ ID NO: 1345 - DNA, 50 bp, Homo sapiens
cttttcccaccccctccccctccatgtgaagatttgggtgcttaacatat

SEQ ID NO: 1346 - DNA, 50 bp, Homo sapiens
ggcactgcctccttacctgtgaggaatgcaaaataaagcatggattaagt

SEQ ID NO: 1347 - DNA, 50 bp, Homo sapiens
aaaccacaccaggaactccttgcatggcaaaagctgaacagtacaaatcc

SEQ ID NO: 1348 - DNA, 50 bp, Homo sapiens
acacagtcatccccatgcagaaacctcagaaaacaccaatgtattacaca

SEQ ID NO: 1349 - DNA, 50 bp, Homo sapiens
gtctgaacgagactcaattcctctccgaggctccccaaacaaattgtagc

SEQ ID NO: 1350 - DNA, 50 bp, Homo sapiens
gtgcagtccatcagatccaagcctgtctcttgaggaacaaccgcgcagac

SEQ ID NO: 1351 - DNA, 50 bp, Homo sapiens
gacccaggctatggatgaggctgactattactgtcaggcgtgggacagca

SEQ ID NO: 1352 - DNA, 50 bp, Homo sapiens
tggtggcaaatctgatttttggaaacgagtattggaggactataaaacaa

SEQ ID NO: 1353 - DNA, 50 bp, Homo sapiens
acatttcttgttggcactacagcaaccacatacagtacagacaacctcca

SEQ ID NO: 1354 - DNA, 50 bp, Homo sapiens
tgggataaaggtgtgtcggtttagcacctctggaagacctatctagagct

SEQ ID NO: 1355 - DNA, 50 bp, Homo sapiens
cctggcacatgttgtctggagtctggcacactggttatcaatagcacatt

SEQ ID NO: 1356 - DNA, 50 bp, Homo sapiens
gcatgttctcaccgtgaaggagagtgatgcagggagatactactgtgcag

SEQ ID NO: 1357 - DNA, 50 bp, Homo sapiens
aaagtgggtggaagacttcctggtgcaggaggctcactccgatttaaggt

SEQ ID NO: 1358 - DNA, 50 bp, Homo sapiens
ctgtggtctgttatatgagagagatcctttaactagagcaaagagggagt

SEQ ID NO: 1359 - DNA, 50 bp, Homo sapiens
gcttgctgttccttagaattttgccttgtaagttctagctcaagttgggg

SEQ ID NO: 1360 - DNA, 50 bp, Homo sapiens
tttctcagagctggaggttgctgggcacctaaatgatgtttcatgatagc

SEQ ID NO: 1361 - DNA, 50 bp, Homo sapiens
ctttttgtaagttacaacattccactggatccttatattgcctgtagtgg

SEQ ID NO: 1362 - DNA, 50 bp, Homo sapiens
ctcatctatgtcttctaaagcttttctgcattcttccacctgggattcaa

SEQ ID NO: 1363 - DNA, 50 bp, Homo sapiens
ctgtctttggaaggagacacaagaacctgataacattggttgtcttcggg

SEQ ID NO: 1364 - DNA, 50 bp, Homo sapiens
aaacaagaacccacttaaacacagcatcaaactctaccatgaaatgaaga

SEQ ID NO: 1365 - DNA, 50 bp, Homo sapiens
ttcttcctggtcatattcctcttttgattttctaagaacttccctcagga

SEQ ID NO: 1366 - DNA, 50 bp, Homo sapiens
acacaagatactgccactttctctacacaaagacccacccaaacaccagc

SEQ ID NO: 1367 - DNA, 50 bp, Homo sapiens
ctttctcaggaagtggctctgccaggcaggactatgtgggaaagggtttt

SEQ ID NO: 1368 - DNA, 50 bp, Homo sapiens
attacatgctaactcaaacttacaaaatcaagctctctgtgatcctggtt

SEQ ID NO: 1369 - DNA, 50 bp, Homo sapiens
gattaaaggcttccatcgattgggtagtgtccttcaagtgggtggcgaag

SEQ ID NO: 1370 - DNA, 50 bp, Homo sapiens
tgtattaacaggcttattgctatgcagggaaatagaaggggcattacaaa

SEQ ID NO: 1371 - DNA, 50 bp, Homo sapiens
tggtggatggatggaaacacatacctcctaattaacctgttggtggaaac

SEQ ID NO: 1372 - DNA, 50 bp, Homo sapiens
gccttggagtgtgacatttctgcgagaatgcttaaataccgatttcccgc

SEQ ID NO: 1373 - DNA, 50 bp, Homo sapiens
agggagtcgttttaccaattcactggcccgtgttttacaaacgtctgact

SEQ ID NO: 1374 - DNA, 50 bp, Homo sapiens
tggagagcttgggacaaggtcagaatgaaaacataccagtcaatcctgct

SEQ ID NO: 1375 - DNA, 50 bp, Homo sapiens
acctgtgctctttggatacctaatgcgacatttaagttgtatttgacagt

SEQ ID NO: 1376 - DNA, 50 bp, Homo sapiens
aggctgggcacaaaggagaaaggaggacatggaaaatccgacaattcgaa

SEQ ID NO: 1377 - DNA, 51 bp, Homo sapiens
atctcaaatccttgagcactcagtctagtgaagatgttgtcattatgtaca

SEQ ID NO: 1378 - DNA, 50 bp, Homo sapiens
gggtcataggttcatgggtttgttgagaattgtggctcctggtttctggt

SEQ ID NO: 1379 - DNA, 50 bp, Homo sapiens
gccttctttctgctgactgggggctttcatttaaaaggagtctttttaat

SEQ ID NO: 1380 - DNA, 50 bp, Homo sapiens
tgtaaacagtggcaggagcgtggacttaaaacaaggcttgcttatttggt

SEQ ID NO: 1381 - DNA, 50 bp, Homo sapiens
gccctttgggttaagcctttacattcatgaagacccctccagggtagaat

SEQ ID NO: 1382 - DNA, 50 bp, Homo sapiens
aaaaggaaaacgaaaaaggaaaaggtggccaatgtggaaaaagtttcaat

SEQ ID NO: 1383 - DNA, 50 bp, Homo sapiens
actctcaggagccatgaaagctgcacagttactttatataccacgaggca

SEQ ID NO: 1384 - DNA, 50 bp, Homo sapiens
ttatgtcaccagaatgtttgccaacaccccgaaaaggaaccagaggactt

SEQ ID NO: 1385 - DNA, 50 bp, Homo sapiens
aggttatttgagcacagtgaaagcagagtactatggttgtccaacacagg

SEQ ID NO: 1386 - DNA, 50 bp, Homo sapiens
ggcctgccatccgagggactgtgttgtagattgtgatcaaggttgattgg

SEQ ID NO: 1387 - DNA, 50 bp, Homo sapiens
acaggtagttgaataattgtttcaagagctcaacagatgacaagcttctt

SEQ ID NO: 1388 - DNA, 50 bp, Homo sapiens
aatacactttgtgccaagggaagaacactgcatgccctgggtcttcagtc

SEQ ID NO: 1389 - DNA, 50 bp, Homo sapiens
gggaactggaggtgagaagcattataatagcctctctgcctttatctaca

SEQ ID NO: 1390 - DNA, 50 bp, Homo sapiens
acaagccaaagtggcatgttttgtgcatttgtaaatgctgtgttgggtag

SEQ ID NO: 1391 - DNA, 50 bp, Homo sapiens
aacagactgtcgtagaaaactgtctttgcttccaaatcagcagaggacca

SEQ ID NO: 1392 - DNA, 50 bp, Homo sapiens
gcccctcagaagagccaaactttgagttttatgtctgtttgtcattgata

SEQ ID NO: 1393 - DNA, 50 bp, Homo sapiens
ccttgtgtccaacgggaataggaagaattagttactgacttcacctgaga

SEQ ID NO: 1394 - DNA, 50 bp, Homo sapiens
cccacaattggactgatagggggagaaaatccaaagagacggagcaactg

SEQ ID NO: 1395 - DNA, 50 bp, Homo sapiens
aacggcaactgggagatttgtgagtgaacactgtttcatcttaatatgct

SEQ ID NO: 1396 - DNA, 50 bp, Homo sapiens
acatctgagaaaccctgaatcctgcaatcaagtagaagtcaacttcatct

SEQ ID NO: 1397 - DNA, 50 bp, Homo sapiens
gccataggaaggtttaccagtagaatccttgctaggttgatgtgggccat

SEQ ID NO: 1398 - DNA, 50 bp, Homo sapiens
tcatctcaacttagtattatacccacacccacccaagaacagggtttgtt

SEQ ID NO: 1399 - DNA, 50 bp, Homo sapiens
gactgaaagatttagccataatgtaaactgcctcaaattggactttgggc

SEQ ID NO: 1400 - DNA, 50 bp, Homo sapiens
ggcactgtctgtgtccttccttgaactgtctaccctgttgcttttcacaa

SEQ ID NO: 1401 - DNA, 50 bp, Homo sapiens
ggccagccgaggctacaaaaactaaccctggatcctactctcttattaaa

SEQ ID NO: 1402 - DNA, 50 bp, Homo sapiens
actaggttgcaatatgtgaaatcagaggaccaaagtacagatggaaacca

SEQ ID NO: 1403 - DNA, 50 bp, Homo sapiens
ccctgtctgactacaacatccagaaagagtccactctgcacttggtcctg

SEQ ID NO: 1404 - DNA, 50 bp, Homo sapiens
ggcatcgcccatgctcctcacctgtattttgtaatcagaaataaattgct

SEQ ID NO: 1405 - DNA, 50 bp, Homo sapiens
aaagcaacgaaaggaacgcaagaacagaatgaagaaagtcagggggactg

SEQ ID NO: 1406 - DNA, 50 bp, Homo sapiens
tcccactttgtctgtacatactggcctctgtgattacatagatcagccat

SEQ ID NO: 1407 - DNA, 50 bp, Homo sapiens; identical to SEQ ID NO: 1278

SEQ ID NO: 1408 - DNA, 50 bp, Homo sapiens
cagtcacgtcagttatgtagatactgcatggcaggagagctttacgctaa

SEQ ID NO: 1409 - DNA, 50 bp, Homo sapiens
gccacccctcacacagccaaaccccagatcatctgaaactactaactttg

SEQ ID NO: 1410 - DNA, 50 bp, Homo sapiens
gcaggtgaccattggcacacgctagaagtttatggcagagctttacaaat

SEQ ID NO: 1411 - DNA, 50 bp, Homo sapiens
tgccatgctgctaggaaattgtcctttttctttctagctgttaacctact

SEQ ID NO: 1412 - DNA, 50 bp, Homo sapiens
aacttattccagtgttgatcgcaagctgttgatgcacaggcgtcttgtgg

SEQ ID NO: 1413 - DNA, 50 bp, Homo sapiens
tgaaaaggattaaagctggtattctagaacatgcccttcactggttgtgt

SEQ ID NO: 1414 - DNA, 50 bp, Homo sapiens
ggtaaggtttctaggaggtctgttaggtgtacatcctgcagcttattggc

SEQ ID NO: 1415 - DNA, 50 bp, Homo sapiens
tgattctgtaaagctgtggaatgaagctgcagatttagagaacattggct

SEQ ID NO: 1416 - DNA, 50 bp, Homo sapiens
cgattttacacggctgggtagaatttgtagaaaagatccacagggcaagc

SEQ ID NO: 1417 - DNA, 50 bp, Homo sapiens
gctactacttcattgcaacctttattactgaccacatcagacatcatgct

SEQ ID NO: 1418 - DNA, 50 bp, Homo sapiens
gggctgaagtacctaagtgtgaatgtctctcccgttaaactgagtgtaga

SEQ ID NO: 1419 - DNA, 50 bp, Homo sapiens
aggaaaacggttcaccagtgtttagttttatattgaggtgctcaggttgg

SEQ ID NO: 1420 - DNA, 50 bp, Homo sapiens
ccgggccttgcatataaataacggagcatacagtgagcacatctagctga

SEQ ID NO: 1421 - DNA, 50 bp, Homo sapiens
ataatgaaagctaagcctcgggctaatttccccatagccgtggggtgact

SEQ ID NO: 1422 - DNA, 50 bp, Homo sapiens; identical to SEQ ID NO: 75

SEQ ID NO: 1423 - DNA, 50 bp, Homo sapiens
tgctctgttctggtttctgttttcaaatcaaatgcctgtttgggaggaga

SEQ ID NO: 1424 - DNA, 50 bp, Homo sapiens
caaaatcccaaaaccagggccaaggagtggacgcttctcttgtgagccag

SEQ ID NO: 1425 - DNA, 50 bp, Homo sapiens
acaaatttcttggctggatttgaagcttaaactcctgtggattcacatca

SEQ ID NO: 1426 - DNA, 50 bp, Homo sapiens
tccacggttgtgccttattgttccattaaaattgtatcttcgatccatca

SEQ ID NO: 1427 - DNA, 50 bp, Homo sapiens
ggtctgagagtctgtgaagatggcccagtcttctatcccccacctaaaaa

SEQ ID NO: 1428 - DNA, 50 bp, Homo sapiens
acacacaggagggaaaatcctgggattctttttctagggatgtaatacat

SEQ ID NO: 1429 - DNA, 50 bp, Homo sapiens
ctgtttgaactgttgagtttccgttgctggctgagtgcgttttgtccttc

SEQ ID NO: 1430 - DNA, 50 bp, Homo sapiens; identical to SEQ ID NO: 1427

SEQ ID NO: 1431 - DNA, 50 bp, Homo sapiens
ggtacagagaagccagcttgtttacatgcttattccatgactgcttgccc

SEQ ID NO: 1432 - DNA, 50 bp, Homo sapiens; identical to SEQ ID NO: 1431

SEQ ID NO: 1433 - DNA, 50 bp, Homo sapiens
gggagaatgaatgtgcaacgtggctgaaatctattttgtgtaataaaagg

SEQ ID NO: 1434 - DNA, 50 bp, Homo sapiens
ccccaccaccccattaccacagctgcctttgtgtgtttgtgtcaataaaa

SEQ ID NO: 1435 - DNA, 50 bp, Homo sapiens
ccagcaagataatgtcctgtcttctaagatgtgcatcaagcctggtacat

SEQ ID NO: 1436 - DNA, 50 bp, Homo sapiens; identical to SEQ ID NO: 1052

SEQ ID NO: 1437 - DNA, 50 bp, Homo sapiens
gctactagagagcaaggggctttcttaccaccagtgctgaggagaaaagt

SEQ ID NO: 1438 - DNA, 50 bp, Homo sapiens
accaagaaaccagcccctgaaaagaagcctgcagagaagaaacctactac

SEQ ID NO: 1439 - DNA, 50 bp, Homo sapiens
tttcctcatctatgaattgtcattcacacacctacttttctgcttcgttt

SEQ ID NO: 1440 - DNA, 50 bp, Homo sapiens; identical to SEQ ID NO: 1439

SEQ ID NO: 1441 - DNA, 50 bp, Homo sapiens
aataatgacaaatgccctgcacctacccacatgcactcgtgtgagacaag

SEQ ID NO: 1442 - DNA, 50 bp, Homo sapiens
gtgcccctgtgggtcccagggaggtcttaaacaaggtatttttcaactta

SEQ ID NO: 1443 - DNA, 50 bp, Homo sapiens
cagtgaagacgtcaggggcaaggtctcgggggtccggaagggtgatcatc

SEQ ID NO: 1444 - DNA, 50 bp, Homo sapiens
tgcaagggagacatatcctagatcactttgctttttctttaaggagctga

SEQ ID NO: 1445 - DNA, 50 bp, Homo sapiens; identical to SEQ ID NO: 75

SEQ ID NO: 1446 - DNA, 50 bp, Homo sapiens
ttgggggaggttagggacttatcctgtgcttgtaaataaataaggtcatg

SEQ ID NO: 1447 - DNA, 50 bp, Homo sapiens
acttggctgccatagcataacaatgaagtgactgaaaaatccagaatttc

SEQ ID NO: 1448 - DNA, 50 bp, Homo sapiens
aaaatattaaacacaaactaccacctacctccctcaccaaagcccataaa

SEQ ID NO: 1449 - DNA, 50 bp, Homo sapiens
agctgtttggtaaccatagtttcacttgttcaaagctgtgtaatcgtggg

SEQ ID NO: 1450 - DNA, 50 bp, Homo sapiens; identical to SEQ ID NO: 1449

SEQ ID NO: 1451 - DNA, 50 bp, Homo sapiens
tgtcgccttttagaaggagaaacttaagtgtggaatgcattatatgggca

SEQ ID NO: 1452 - DNA, 50 bp, Homo sapiens; identical to SEQ ID NO: 1124

SEQ ID NO: 1453 - DNA, 50 bp, Homo sapiens
tttggagtggaggcattgtttttaagaaaaacatgtcatgtaggttgtct

SEQ ID NO: 1454 - DNA, 50 bp, Homo sapiens
tggctgggacgctagaagggtcatgtgttaactataatcacatttatggt

SEQ ID NO: 1455 - DNA, 50 bp, Homo sapiens
attctggttaaccgctcacatgcataacaataatgctagaaattcaggaa

SEQ ID NO: 1456 - DNA, 50 bp, Homo sapiens
tgctgatttctagtgtatactctgtagtctcagttcgtgtttgattccat

SEQ ID NO: 1457 - DNA, 50 bp, Homo sapiens
aaatgaatctttcaaaggtttcccaaaccactccttatgatccagtgata

SEQ ID NO: 1458 - DNA, 50 bp, Homo sapiens; identical to SEQ ID NO: 1124

SEQ ID NO: 1459 - DNA, 50 bp, Homo sapiens
tgcgtgtgcctcagtttcctcctccacaactgaatatttatagtggctga

SEQ ID NO: 1460 - DNA, 50 bp, Homo sapiens
gggatgtggaggatttttgttaagtgtcaatcgaagttaaaaagcaaggg

SEQ ID NO: 1461 - DNA, 50 bp, Homo sapiens
agctctctgcacccttacccctttccaccttttgtatttaattttaaagt

SEQ ID NO: 1462 - DNA, 50 bp, Homo sapiens
ccctccagccaataggcagctttcttaactatcctaacaagccttggacc

SEQ ID NO: 1463 - DNA, 50 bp, Homo sapiens
cgtggttgtgggaggggaaagaggaaacagagctagtcagatgtgaattg

SEQ ID NO: 1464 - DNA, 50 bp, Homo sapiens
acaatgtgttagcagaaaccagtgggttataatgtagaatgatgtgcttt

SEQ ID NO: 1465 - DNA, 50 bp, Homo sapiens
gctagatccccggtggttttgtgctcaaaataaaaagcctcagtgaccca

SEQ ID NO: 1466 - DNA, 50 bp, Homo sapiens; identical to SEQ ID NO: 1425

SEQ ID NO: 1467 - DNA, 50 bp, Homo sapiens
gctgtggttggttgcattacatgacacagaaaactgtcctctacctcacg

SEQ ID NO: 1468 - DNA, 50 bp, Homo sapiens
gccctggtaggctcctttagaaggaccatttctgttcctagagcttaact

SEQ ID NO: 1469 - DNA, 50 bp, Homo sapiens; identical to SEQ ID NO: 1404

SEQ ID NO: 1470 - DNA, 50 bp, Homo sapiens
tttccctctcctgtccttgtgttgaaggcagtaaactaagggtgtcaagc

SEQ ID NO: 1471 - DNA, 50 bp, Homo sapiens
agactggaaatggggatgagggtgtaaattgtattgaaaaagatcgcgaa

SEQ ID NO: 1472 - DNA, 50 bp, Homo sapiens
ccatgagttgtttggttttccagaagctgccagtgggttcccgtgaattg

SEQ ID NO: 1473 - DNA, 50 bp, Homo sapiens
gatacgatgagatccgccgtcactggggtggcaatgtcctgggtcctaag

SEQ ID NO: 1474 - DNA, 50 bp, Homo sapiens
agtctttctggtttctggagataacccatcaataaagctgcttcctctgg

SEQ ID NO: 1475 - DNA, 50 bp, Homo sapiens
cgatgatggttacccttcatggacgtcttaatcttccacacacatcccct

SEQ ID NO: 1476 - DNA, 50 bp, Homo sapiens
ggcccctggacatgtacctgcagaataataaagtcatcaatacctaaaaa

SEQ ID NO: 1477 - DNA, 50 bp, Homo sapiens
gcaaacctgcagattcccaagatgttcacgagcttgtgctttctaaagaa

SEQ ID NO: 1478 - DNA, 50 bp, Homo sapiens
tccccattgtgccgcctttatcaattgcctgttttgttttgtttgttttt

SEQ ID NO: 1479 - DNA, 50 bp, Homo sapiens
ctttagctgctgttgcctcccttctcaggctggtgctggatccttcctag

SEQ ID NO: 1480 - DNA, 50 bp, Homo sapiens
ctgcttatggcacaatttgcctcaaaatccattccaagttgtatatttgt

SEQ ID NO: 1481 - DNA, 50 bp, Homo sapiens
ctgcttctgggtgcatggtagactttgtggcatttgatacaacttggaca

SEQ ID NO: 1482 - DNA, 50 bp, Homo sapiens
cttatagtatttatccacccaaaccccagactgagatactgctcccaggg

SEQ ID NO: 1483 - DNA, 50 bp, Homo sapiens
gagagaccagcctttcttcctttggtaggaatggcctgagttggcgttgt

SEQ ID NO: 1484 - DNA, 50 bp, Homo sapiens
cagaggtgggagtaactgctggtagtgccttctttggttgtgttgctcag

SEQ ID NO: 1485 - DNA, 50 bp, Homo sapiens
ctgtgtgccccagctgcatcagccagcttctaggtggctccattgttttc

SEQ ID NO: 1486 - DNA, 50 bp, Homo sapiens
agagcagaatagcaatataagagcacagacgaacatagacacgacagcga

SEQ ID NO: 1487 - DNA, 50 bp, Homo sapiens
ctattaggacccagtgattatgctaccttggcacggttagggtactgcgg

SEQ ID NO: 1488 - DNA, 50 bp, Homo sapiens
aaagaagcatgcacacttatcacaaacaactctctcaggtggccagtctg

SEQ ID NO: 1489 - DNA, 50 bp, Homo sapiens
tgctgcctatatgaagtctttgagaaagcccctcttggagtctgtgcctt

SEQ ID NO: 1490 - DNA, 50 bp, Homo sapiens
gatatacgaggacaaaacccatctaccaggcagctaacaaaccgccgcca

SEQ ID NO: 1491 - DNA, 50 bp, Homo sapiens
gccactttattagtaatggtcgatagtccgaatcgatggctagggtgact

SEQ ID NO: 1492 - DNA, 50 bp, Homo sapiens
taatctggcgggttatacccccgtgttctccggattatatttcgggacac

SEQ ID NO: 1493 - DNA, 50 bp, Homo sapiens
gctggatttgtgggtatgggggcggtttttgggcgaaggttggttgttac

SEQ ID NO: 1494 - DNA, 50 bp, Homo sapiens
ccacatcatcgggggcgaaatagaagcccagagagaggctaggtgtagga

SEQ ID NO: 1495 - DNA, 50 bp, Homo sapiens
agggagactctcagccttcagcttcctaaattctgtgtctgtgactttcg

SEQ ID NO: 1496 - DNA, 50 bp, Homo sapiens
ttgtcaagctgctgctgtcttcaagatctacctggtcagaatctcctgct

SEQ ID NO: 1497 - DNA, 50 bp, Homo sapiens
ggccagtctctatgtgtcttaatcccttgtccttcattaaaagcaaaact

SEQ ID NO: 1498 - DNA, 50 bp, Homo sapiens
tctctcacattctgtctttcccctcctccttcaccttccctccgtccctc

SEQ ID NO: 1499 - DNA, 50 bp, Homo sapiens
acacgagactatagagaatgcagcacacagatgagagcagagcaaataga

SEQ ID NO: 1500 - DNA, 50 bp, Homo sapiens
gcatccagatggtggtttactctgcaacagtctaatgttcttcacttcca

SEQ ID NO: 1501 - DNA, 50 bp, Homo sapiens
ggggttttcaccctacctaaagatgctttaattgctgttttccaaattgt

SEQ ID NO: 1502 - DNA, 50 bp, Homo sapiens
atgcctaacaagcaacatgatcctataaatccaccccaagccaatctggt

SEQ ID NO: 1503 - DNA, 50 bp, Homo sapiens
ccaccatctggtacgtttttacttcctcacccgcgtgtactccgattacc

SEQ ID NO: 1504 - DNA, 50 bp, Homo sapiens
gagtatattcccccagttatttgctcttccccacacagggtggtagtacc

SEQ ID NO: 1505 - DNA, 50 bp, Homo sapiens
caaaggaaggggcgtgaaggggtgagaaaaatatgggacccaaattgtgg

SEQ ID NO: 1506 - DNA, 50 bp, Homo sapiens
tttccttacaggcggtaacaccggtccacacagttcttgccaaaacaaag

SEQ ID NO: 1507 - DNA, 50 bp, Homo sapiens
aattttctctcacctcatcactcgggacctccccagtgataataacccgg

SEQ ID NO: 1508 - DNA, 50 bp, Homo sapiens
gcgggtgtaaggggatatcttgataaactggagcccaggaagattacaaa

SEQ ID NO: 1509 - DNA, 50 bp, Homo sapiens
acgccgacaatcaagaaaatgtgagttataacggacaaggttgtattatg

SEQ ID NO: 1510 - DNA, 50 bp, Homo sapiens
gatattggtagtaaaggggttacctgtgaacttccaaaattccttggggc

SEQ ID NO: 1511 - DNA, 50 bp, Homo sapiens
taaagatgtccgggtacacttcgccaagggttagcgtctttgggcatttc

SEQ ID NO: 1512 - DNA, 50 bp, Homo sapiens
tcctaatttcttctgtgaaccttctcaaatcccccagcatgcgtgtagtg

SEQ ID NO: 1513 - DNA, 50 bp, Homo sapiens
ctgcatgatgtcatcaacctgctgtagtgcggaaacgaccacaacacaca

SEQ ID NO: 1514 - DNA, 50 bp, Homo sapiens
aaagacgaacgagacacgaaagcaacgaacgaacacagagcacgccgcac

SEQ ID NO: 1515 - DNA, 50 bp, Homo sapiens
tttcaacacgcatcccttatgggcgaactgtcctcaaacaacaacaagtg

SEQ ID NO: 1516 - DNA, 50 bp, Homo sapiens
taggacgagaaacgaagaaggacagagcgagaacaagtaagcagggacac

SEQ ID NO: 1517 - DNA, 50 bp, Homo sapiens
ggtggagaatcaaaacgaccccgcaaataaacatggcgatttggcttggg

SEQ ID NO: 1518 - DNA, 50 bp, Homo sapiens
tggccttttaaataactgggcttctcacaaccatagtgaacagaaacagc

SEQ ID NO: 1519 - DNA, 50 bp, Homo sapiens
attgtgacatggtgatgcctcattgctgatatggtcctgtggttatgtgc

SEQ ID NO: 1520 - DNA, 50 bp, Homo sapiens
ggaagagataacaccacaacgaaagagcaggcaagagagaccaaagcaca

SEQ ID NO: 1521 - DNA, 50 bp, Homo sapiens
ggtaaaaggcgttactctccgccctcttcaaggaacggccaagagtataa

SEQ ID NO: 1522 - DNA, 50 bp, Homo sapiens
acccaagggtctcgccagtggggttaagtcacaatattactacacaaggg

SEQ ID NO: 1523 - DNA, 50 bp, Homo sapiens
acagtacacaatcacctgcaagggacatagcacacaaaccgctaaagagg

SEQ ID NO: 1524 - DNA, 50 bp, Homo sapiens
tctcacagcgagaggaggagacgggatgaccgagaggtagacgattatac

SEQ ID NO: 1525 - DNA, 50 bp, Homo sapiens
cgctggtgttgtccccaagtgatttattctactggagtgcctggtgtctt

SEQ ID NO: 1526 - DNA, 50 bp, Homo sapiens
ttccggcttttaacaaacacacaccacactaacacaacaacacaaacaaa

SEQ ID NO: 1527 - DNA, 50 bp, Homo sapiens
aagacttgcctctttaaaattgctttgttttctgcagtactatctgtggt

SEQ ID NO: 1528 - DNA, 50 bp, Homo sapiens
gaactcgtccactcttctcgggccactattctggttcagggaatcttggg

SEQ ID NO: 1529 - DNA, 50 bp, Homo sapiens
agcaataaaccgaagcagctagacagcgaagaagtacagcaaagagacga

SEQ ID NO: 1530 - DNA, 50 bp, Homo sapiens
cgcccatactagagaagtttgccctctattgtctctcacaccacaatgag

SEQ ID NO: 1531 - DNA, 50 bp, Homo sapiens
cacagacatccacggacacaaaaggcggggaccaccaccacaatgaacac

SEQ ID NO: 1532 - DNA, 50 bp, Homo sapiens
gcgtcgattgatatcagacagcatcgtctctgcgagcacaaagatctgtt

SEQ ID NO: 1533 - DNA, 50 bp, Homo sapiens
ggaacagggttaatggccaggccctttgccgccccttttaaagggaatcc

SEQ ID NO: 1534 - DNA, 50 bp, Homo sapiens
acagagtaacatgggatatgggtatgagtgggatgtgctgagaaggaact

SEQ ID NO: 1535 - DNA, 50 bp, Homo sapiens
gggggcaaagaaagtacattgggtgaaaatttaaaaaggtatggagcatt

SEQ ID NO: 1536 - DNA, 50 bp, Homo sapiens
caaacgaacagcgaagacaacaactcacgatgctgcacaacgcgaccaac

SEQ ID NO: 1537 - DNA, 50 bp, Homo sapiens
acattttataaggcatttgtgttagccactcagtcatctttgggtgctgc

SEQ ID NO: 1538 - DNA, 50 bp, Homo sapiens
gtcacagcaacgtgtcgctccccagatcatttattagcgtcgattgttgt

SEQ ID NO: 1539 - DNA, 50 bp, Homo sapiens
attccaaacgggatctgctgagacctcacagaggtgggccgcgattataa

SEQ ID NO: 1540 - DNA, 50 bp, Homo sapiens
cctagggtgaaacacgtgacagaagaataaagactattgaatagtcctct

SEQ ID NO: 1541 - DNA, 50 bp, Homo sapiens; identical to SEQ ID NO: 1315

SEQ ID NO: 1542 - DNA, 50 bp, Homo sapiens
ccccttgtttactctgtctgtatgtatgtcaaaagcgtggcaaaacctct

SEQ ID NO: 1543 - DNA, 50 bp, Homo sapiens
catgatctcagaggaaactgtcgctgaccctggacatgggtacgtttgac

SEQ ID NO: 1544 - DNA, 50 bp, Homo sapiens
cctctacctgcacgacaatacataatgacccaccaatcacatgcctatca

SEQ ID NO: 1545 - DNA, 50 bp, Homo sapiens
atttggaagcgccaccctagcaaatatacaaaccattaaaccttccctct

SEQ ID NO: 1546 - DNA, 50 bp, Homo sapiens
tttaccaatgattttcaggtgacctgggctaagtcatttaaactgggtct

SEQ ID NO: 1547 - DNA, 50 bp, Homo sapiens
agtttacatatcgacagcatatccactgatttctaaatgggctggtccca

SEQ ID NO: 1548 - DNA, 50 bp, Homo sapiens
atctggagtgggacccttcaaaccatgtctgtgcttatgcgggaaacaat

SEQ ID NO: 1549 - DNA, 50 bp, Homo sapiens
gcggagagaagaagaggtagatatgagaacagtgtgtggtatatgatagt

SEQ ID NO: 1550 - DNA, 50 bp, Homo sapiens
gaaatcccaccggcaagttaaggtcacggagcaagtgaataaacgcggag

SEQ ID NO: 1551 - DNA, 50 bp, Homo sapiens
gtgatcaaacaaattcacagcacagacaccgcgcaacaacgcaacttctc

SEQ ID NO: 1552 - DNA, 50 bp, Homo sapiens
ggtatttgtgttgttgagtattgtgtctgggtgtgggtatttgattcttt

SEQ ID NO: 1553 - DNA, 50 bp, Homo sapiens
gggttcgtccagggctgcgctaaattattctcaatgatttgtctctttgc

SEQ ID NO: 1554 - DNA, 50 bp, Homo sapiens
caatgacgcagtcggaccctcggatccaagtcctgctttgggtgtggacc

SEQ ID NO: 1555 - DNA, 50 bp, Homo sapiens
gggttataatagatggacgggtctttcacggtggtgacagcaccctttcc

SEQ ID NO: 1556 - DNA, 50 bp, Homo sapiens
tccgctgcaatttgagtttagctttacagattgtgccgggtgtttaacct

SEQ ID NO: 1557 - DNA, 50 bp, Homo sapiens
ctccttcccaaagacttgagtggaacttccctttcatgtgcgtatcggtc

SEQ ID NO: 1558 - DNA, 50 bp, Homo sapiens
aaattagtcgccttcgtcgagagtgcccttctgatgaatgtggtgctggg

SEQ ID NO: 1559 - DNA, 50 bp, Homo sapiens
gacagtactcctaagacccctgtgtgtgtcccgatgagatcatgactggg

SEQ ID NO: 1560 - DNA, 50 bp, Homo sapiens
catgcccatcgtcctagaattaattcccctaaaaatctttgaaatagggc

SEQ ID NO: 1561 - DNA, 50 bp, Homo sapiens
ggcgtatcatcaactggtgagcccgaagggatattatttctaaggcctct

SEQ ID NO: 1562 - DNA, 50 bp, Homo sapiens
ccagaatcgtaagggggctgacggaggatgagagggggcacccagagatc

SEQ ID NO: 1563 - DNA, 50 bp, Homo sapiens
cggtgttttctgatcggtttttgttttctgcttacatatgatgtacttgt

SEQ ID NO: 1564 - DNA, 50 bp, Homo sapiens
acagaatgcagcggtgcaacaccggcaaggttccacacgccacaaagaaa

SEQ ID NO: 1565 - DNA, 50 bp, Homo sapiens
tggaagtgaagtctatgatgtgaaacactttgcctcctgtgtactgtgtc

SEQ ID NO: 1566 - DNA, 50 bp, Homo sapiens
ccaaaaagcttcatttttctatataggctgcacaagagccttgattgaag

SEQ ID NO: 1567 - DNA, 50 bp, Homo sapiens
tcacaagacagtcatcagaaccagtaaatatccgtctgccagttcgatca

SEQ ID NO: 1568 - DNA, 50 bp, Homo sapiens; identical to SEQ ID NO: 1567

SEQ ID NO: 1569 - DNA, 50 bp, Homo sapiens
gctgtcatttgtacatttaaagcagctgttttggggtctgtgagagtaca

SEQ ID NO: 1570 - DNA, 50 bp, Homo sapiens
tatcctgagtcccttaatcttatggggccggaaggaatgtcagggccagg

SEQ ID NO: 1571 - DNA, 50 bp, Homo sapiens
ctctgccttcggagggaaattgtaaatcctgtgtttcattacttgaatgt

SEQ ID NO: 1572 - DNA, 50 bp, Homo sapiens
aaactcctgcttaaggtgttctaattttctgtgagcacactaaaagcgaa

SEQ ID NO: 1573 - DNA, 50 bp, Homo sapiens
gggtgcacgttcctcctggttccttcgcttgtgtttctgtacttaccaaa

SEQ ID NO: 1574 - DNA, 50 bp, Homo sapiens
ggggttgggaggaagtgtctactaggagggtgggtgagatctgtgttgat

SEQ ID NO: 1575 - DNA, 50 bp, Homo sapiens
atctaccctccgattgttcctgaaccgatgagaaataaagtttctgttga

SEQ ID NO: 1576 - DNA, 50 bp, Homo sapiens
aagtcttatgccaaattcagtgctactcctcgttacatgacatacaactg

SEQ ID NO: 1577 - DNA, 50 bp, Homo sapiens
cacacggaggcatctgcaccctcgatgaagcccaataaacctcttttctc

SEQ ID NO: 1578 - DNA, 50 bp, Homo sapiens
acaacgtcgtgactgggaaaaccctggcgttacccaacttaatcgccttg

SEQ ID NO: 1579 - DNA, 50 bp, Homo sapiens
ccaagcctccaagtgggaagaaagactgggatgatgaccaaaatgattga

SEQ ID NO: 1580 - DNA, 50 bp, Homo sapiens
caactacttgtggcatgcattggcactcggaataaagcgcactattgtca

SEQ ID NO: 1581 - DNA, 50 bp, Homo sapiens
gaaggggtagggtccaccatactggtaattggggtactctgtatatgtgt

SEQ ID NO: 1582 - DNA, 50 bp, Homo sapiens
gctcagttccatatttcatccgtgaaaaacttgcaatacgagcagtttca

SEQ ID NO: 1583 - DNA, 50 bp, Homo sapiens
aattgtcatttacctgggtatgaattccctgacacacattcatgtcaaca

SEQ ID NO: 1584 - DNA, 50 bp, Homo sapiens
gtgacttgactgtggaagatgatggttgcatgtttctagtttgtatatgt

SEQ ID NO: 1585 - DNA, 50 bp, Homo sapiens
cagtgctgtaatacagacggcaatgcaatagcctatttaaagaactacgt

SEQ ID NO: 1586 - DNA, 50 bp, Homo sapiens
agctggtggatggtgacttttgaagaacaaaaggctttggcaacagaaaa

SEQ ID NO: 1587 - DNA, 50 bp, Homo sapiens
tctgttgtcactaaagactaaatgagggtttgcagttgggaaagaggtca

SEQ ID NO: 1588 - DNA, 50 bp, Homo sapiens
gcggagttgaccaaaataatatctgaggatgattgcttttccctgctgcc

SEQ ID NO: 1589 - DNA, 50 bp, Homo sapiens
catcttgaacttggcctgagaacattttctgggaagaggtaagggtgaca

SEQ ID NO: 1590 - DNA, 50 bp, Homo sapiens
tctgtggaatctccttcattggcattgttatttaatcataaacggggcag

SEQ ID NO: 1591 - DNA, 50 bp, Homo sapiens
tgtactgttcatgctgacacagatatttcagtctgcatggtaaaagttct

SEQ ID NO: 1592 - DNA, 50 bp, Homo sapiens
taatggggtttatatggactttcttctcataaatggcctgccgtctccct

SEQ ID NO: 1593 - DNA, 50 bp, Homo sapiens; identical to SEQ ID NO: 1438

SEQ ID NO: 1594 - DNA, 50 bp, Homo sapiens
agtcctgtgtgcttccctctcttatgactgtgtccctggttgtcaataaa

SEQ ID NO: 1595 - DNA, 50 bp, Homo sapiens
acccaccacctcttgcactctcgcttttggagcaagttgcattaactatt

SEQ ID NO: 1596 - DNA, 50 bp, Homo sapiens
tgacagttgcagaattgtggagtgtttttacattgatcttttgctaatgc

SEQ ID NO: 1597 - DNA, 50 bp, Homo sapiens
atgacagacacacgtatctaacaaacaaacaaacagtgaccttctccatg

SEQ ID NO: 1598 - DNA, 50 bp, Homo sapiens
gcaagggataatacaaatcctatgatctctatgcccaatatgctgcctca

SEQ ID NO: 1599 - DNA, 50 bp, Homo sapiens
agtacttttcacagcgtggcctttcaccataattttatatttctccccct

SEQ ID NO: 1600 - DNA, 50 bp, Homo sapiens
tcttaagagccagagccatataagcatcttgggaaagcaagtttgaacca

SEQ ID NO: 1601 - DNA, 50 bp, Homo sapiens
aagccggtcatgagattatatgtggtaaagttaattgactaacaacccca

SEQ ID NO: 1602 - DNA, 50 bp, Homo sapiens
agggggctgtgtctgatcttggtgttcaaaacagaactgtatttttgcct

SEQ ID NO: 1603 - DNA, 50 bp, Homo sapiens
gttcatagcttcctgcaacttgacagagcctgagtttgcctcttagtggg

SEQ ID NO: 1604 - DNA, 50 bp, Homo sapiens
catatgggagaagggggagtaatgacttgtacaaacagtatttctggtgt

SEQ ID NO: 1605 - DNA, 50 bp, Homo sapiens
acatgtgatgtttgactgtaccattgactgttatggaagttcagcgttgt

SEQ ID NO: 1606 - DNA, 50 bp, Homo sapiens
tcttgcttttattcctttttgttgttggccttgtgctgcgtttgtttaca

SEQ ID NO: 1607 - DNA, 50 bp, Homo sapiens
agtgttgttttctcctctttaatattgctgtgaacagtggtgcccattgt

SEQ ID NO: 1608 - DNA, 50 bp, Homo sapiens
aattcttgtgtgctgctttccatttgacaccgcagttctgttcagccatc

SEQ ID NO: 1609 - DNA, 50 bp, Homo sapiens
gaggtgtctccatctctgcctcaacttcatggtgcactgagctgtaactt

SEQ ID NO: 1610 - DNA, 50 bp, Homo sapiens; identical to SEQ ID NO: 276

SEQ ID NO: 1611 - DNA, 50 bp, Homo sapiens
tattttcttccattcttgtcattggtcaataggggagggtagattagctg

SEQ ID NO: 1612 - DNA, 50 bp, Homo sapiens
tcccctgcttccactaaatccagttgtgacaaaatctaacgtgacatcag

SEQ ID NO: 1613 - DNA, 50 bp, Homo sapiens
acctggtcaacttagcttttaagcagacgatgctgtaaaaactaacggct

SEQ ID NO: 1614 - DNA, 50 bp, Homo sapiens
acctgggatgcccctgctctggacctctcatttctcttcattggtttatt

SEQ ID NO: 1615 - DNA, 50 bp, Homo sapiens
atctatccttgccagccttgggcatcacatttaccagtttaatagattgt

SEQ ID NO: 1616 - DNA, 50 bp, Homo sapiens
gccctgatctggagttacctgaggccatagctgccctattcacttctaag

SEQ ID NO: 1617 - DNA, 50 bp, Homo sapiens
cttgaccaaacccacagcctgtctcttctcttgtttagttacttacggca

SEQ ID NO: 1618 - DNA, 50 bp, Homo sapiens
ccttagaagaggaagcaaaggcagattcagggaccaaaaggattaatgat

SEQ ID NO: 1619 - DNA, 50 bp, Homo sapiens
atgtgtcaaccaccatttcagctattaaaaactcctgttatctccttgtt

SEQ ID NO: 1620 - DNA, 50 bp, Homo sapiens
agccaccagagccttcctctctttgtaccacagtttcttctgtaaatcca

SEQ ID NO: 1621 - DNA, 50 bp, Homo sapiens
acatgaaatatagttgcatatatggacaccgacttgggaggacaggtcct

SEQ ID NO: 1622 - DNA, 50 bp, Homo sapiens
ctttccagcctcctgctgggctctctcttcctaccctccttccacatgta

SEQ ID NO: 1623 - DNA, 50 bp, Homo sapiens
agatagccagcctagaggtatggctgtaactatctctgtgaagtgtgaga

SEQ ID NO: 1624 - DNA, 50 bp, Homo sapiens
tggcatcctcaggggttgtgatccagctccatatattgtttaccttcaaa

SEQ ID NO: 1625 - DNA, 50 bp, Homo sapiens
catgaggagagtgctagttcatgtgttctccattcttgtgagcatcctaa

SEQ ID NO: 1626 - DNA, 50 bp, Homo sapiens
cagcaaatccatctgaactgtggaggagaagctctctttactgagggtgc

SEQ ID NO: 1627 - DNA, 50 bp, Homo sapiens
tcagcataaactggaatgtagtgtcagaggatactgtggcttgttttgtt

SEQ ID NO: 1628 - DNA, 50 bp, Homo sapiens
tggtgaaacaaaaccagtcattagaaatggtctgtgcttttattttccca

SEQ ID NO: 1629 - DNA, 50 bp, Homo sapiens
actatgctttattggtcccatgttttgtgcaattttaaagagatggcttt

SEQ ID NO: 1630 - DNA, 50 bp, Homo sapiens
aaagatgaactatttggtctcattgaagccaacacagaacttgctgctgt

SEQ ID NO: 1631 - DNA, 50 bp, Homo sapiens
ggagcccctctttctcccatgctgcacttactccttttgctaataaaagt

SEQ ID NO: 1632 - DNA, 50 bp, Homo sapiens
ccttccatgtcccaccccactcccaccaaaaagtacaaaatcaggatgtt

SEQ ID NO: 1633 - DNA, 50 bp, Homo sapiens
tgatggtaaccataatggaagagattctggctagtgtctatcagaggtga

SEQ ID NO: 1634 - DNA, 50 bp, Homo sapiens
gtcctggtggtatcttcaatagccactaaccctgcctggtacagtatggg

SEQ ID NO: 1635 - DNA, 50 bp, Homo sapiens
cccagctctgctgcccttgttttgctgcatgttaaataaaaccattttca

SEQ ID NO: 1636 - DNA, 50 bp, Homo sapiens
cccacactgctacacttctgatcccctttggttttactacccaaatctaa

SEQ ID NO: 1637 - DNA, 50 bp, Homo sapiens
ctgtaatacctcctcctaaccaagccggatatggtatggcaagttaccaa

SEQ ID NO: 1638 - DNA, 50 bp, Homo sapiens
cccttgtaagggaattctggggcagctatggtttgagtatgcagtttgca

SEQ ID NO: 1639 - DNA, 50 bp, Homo sapiens
acaatctctgtccagcacctcttggttaaataatgtatgctgtgagacat

SEQ ID NO: 1640 - DNA, 50 bp, Homo sapiens
acagggcctcagcaagggagccatacatttttgtaacattttgatatgtt

SEQ ID NO: 1641 - DNA, 50 bp, Homo sapiens
ttgactgtcgatggattgtggtgtggtgtatctgaaggctattgaatgca

SEQ ID NO: 1642 - DNA, 50 bp, Homo sapiens
ttctgttccaaacaagtattctgtagatccaaatggattaccagtgtgct

SEQ ID NO: 1643 - DNA, 50 bp, Homo sapiens
atcttcagaatcagttaggttcctcactgcaagaaataaaatgtcaggca

SEQ ID NO: 1644 - DNA, 50 bp, Homo sapiens
tgaaccttactgcaaaaacttgtgatgtaagaaatttgtatggtgtggca

SEQ ID NO: 1645 - DNA, 50 bp, Homo sapiens
gctgtctcaagggtatccgtacctcaatgtcagttacattcagcagaaaa

SEQ ID NO: 1646 - DNA, 50 bp, Homo sapiens
ttggtcagatttagaagcattcatgctcacaagttttgggaaagtgaaaa

SEQ ID NO: 1647 - DNA, 50 bp, Homo sapiens
ccctaaaggcaagaagaaaaagtaaaagaccttggctcatagaaagtcac

SEQ ID NO: 1648 - DNA, 50 bp, Homo sapiens
gtgtgtgcatggaagatgcctgggctgtctttgctatatgtaaatagagc

SEQ ID NO: 1649 - DNA, 50 bp, Homo sapiens
gccttggctttatttgcaggctactaaagctgcttttactttgtaacttt

SEQ ID NO: 1650 - DNA, 50 bp, Homo sapiens
acagtttggttacaggacttctgtgcattgtaaacataaacagcatggaa

SEQ ID NO: 1651 - DNA, 50 bp, Homo sapiens
tgtgaaagtgtggaatggaagaaatgtcgatcctgttgtaactgattgtg

SEQ ID NO: 1652 - DNA, 50 bp, Homo sapiens
acaaccaaccagtttcttttctagccaatcatctctgaagagttgctgtt

SEQ ID NO: 1653 - DNA, 50 bp, Homo sapiens
gaactccctgattctataccctcttccttctttctgcaaggcagaggaat

SEQ ID NO: 1654 - DNA, 50 bp, Homo sapiens
caccctcagctccaccctcagcagatgataatatcaagacacctgccgag

SEQ ID NO: 1655 - DNA, 50 bp, Homo sapiens
ttggccctcaggtttactgtgtaaatctgcatttttggtggtaaatccct

SEQ ID NO: 1656 - DNA, 50 bp, Homo sapiens
gcatttccatagcactgaagtaccagtttccattcctgggctgagattgt

SEQ ID NO: 1657 - DNA, 50 bp, Homo sapiens
ctccttttaacgtgttattgacaaacctccccaaaagaatatgcaattgt

SEQ ID NO: 1658 - DNA, 50 bp, Homo sapiens
aacattcagttgagaccatatgcattttctgtgctgtttgtacttgaggt

SEQ ID NO: 1659 - DNA, 50 bp, Homo sapiens
ttaaccctcagagaactctgcattttagggtacttgaggctgacttaact

SEQ ID NO: 1660 - DNA, 50 bp, Homo sapiens
agcgacctcttctctagtccggtgttacgaacagaagttctgagttgtgc

SEQ ID NO: 1661 - DNA, 50 bp, Homo sapiens
taaatgtcggtccaggccctgtgcaccttaccccagagacagactctttt

SEQ ID NO: 1662 - DNA, 50 bp, Homo sapiens
ataaggctgtaaaatgagaattctgccccctcacctcttaccccagtact

SEQ ID NO: 1663 - DNA, 50 bp, Homo sapiens
aaaagtcggggatcggggcaagagaggctgagtacggatgggaaactatt

SEQ ID NO: 1664 - DNA, 50 bp, Homo sapiens
gagcacccagagggatttttcagtgggaagcattacactttgctaaatca

SEQ ID NO: 1665 - DNA, 50 bp, Homo sapiens
tgattaggtgacgagttgacattgagattgtccttttcccctgatcaaaa

SEQ ID NO: 1666 - DNA, 50 bp, Homo sapiens
tgtatgtatgggagtgaggagtttcagggccattgcaaacatagctgtgc

SEQ ID NO: 1667 - DNA, 50 bp, Homo sapiens
acagagttatccactttacaacggagacacagttctggaacattgaaact

SEQ ID NO: 1668 - DNA, 50 bp, Homo sapiens
atacgggacaataaaatctgccttttgctctggagggagatactacctct

SEQ ID NO: 1669 - DNA, 50 bp, Homo sapiens
gggcaaacaactttaggaatactagttactcacttaacatggagggcggg

SEQ ID NO: 1670 - DNA, 50 bp, Homo sapiens
aaaggccgcgcagattgtttaattctggaaagtcaatccccggatttagc

SEQ ID NO: 1671 - DNA, 50 bp, Homo sapiens
gggactccatgggaatatttgcccagtaatggtaaggaaatctttcgggt

SEQ ID NO: 1672 - DNA, 50 bp, Homo sapiens
ccagaaaggtgatgaatgaataggactgagagtcacagtgaatgtggcat

SEQ ID NO: 1673 - DNA, 50 bp, Homo sapiens
tcccaaggttgttagtgactgataagcttccaaactacagtacagttttt

SEQ ID NO: 1674 - DNA, 50 bp, Homo sapiens
gttttcttgtagttgcgggtccctcgcgaaagttcattcatggccccact

SEQ ID NO: 1675 - DNA, 50 bp, Homo sapiens
catggggctctcttgtgtacttattgtttaaggtttcctcaaactgtgat

SEQ ID NO: 1676 - DNA, 50 bp, Homo sapiens
acaaattgaaatgtctgtactgatcctcaaccaataaaatctcagccgaa

SEQ ID NO: 1677 - DNA, 50 bp, Homo sapiens
tgcaggagacattggtattctgggcagcttcctaatatgctttacaatct

SEQ ID NO: 1678 - DNA, 50 bp, Homo sapiens; identical to SEQ ID NO: 33

SEQ ID NO: 1679 - DNA, 50 bp, Homo sapiens
ggcattgttagtttagtgtgtgtgcagagtccatttcccacatctttcct

SEQ ID NO: 1680 - DNA, 50 bp, Homo sapiens
gactgcaatgctggtggggaaagacttaaaagtggattaaagacctgcgt

SEQ ID NO: 1681 - DNA, 50 bp, Homo sapiens
gctttccttctccaggaatactgaacatgggagctcttgaaatatgtagt

SEQ ID NO: 1682 - DNA, 50 bp, Homo sapiens
tgggaatcaagatttaatcctagagatttggtgtacaattcaggctttgg

SEQ ID NO: 1683 - DNA, 50 bp, Homo sapiens
gcagtagtgtggactagaacaacccaaatagcatctagaaagccatgagt

SEQ ID NO: 1684 - DNA, 50 bp, Homo sapiens
tgtgtaatgtacctgtcagtgcctcctttattaaggggttctttgagaat

SEQ ID NO: 1685 - DNA, 50 bp, Homo sapiens
ccactgtcactgtttctctgctgttgcaaatacatggataacacatttga

SEQ ID NO: 1686 - DNA, 50 bp, Homo sapiens
agtttgccctggatgtcatattggcagttggaggacacagtttctattgt

SEQ ID NO: 1687 - DNA, 50 bp, Homo sapiens
ccaagttccacattccttctagcgtgccttacatcaggtactttgtcagc

SEQ ID NO: 1688 - DNA, 50 bp, Homo sapiens
agctgtctcctgttttgtaagctttcagtgcaacatttcttggttccaat

SEQ ID NO: 1689 - DNA, 50 bp, Homo sapiens
tgcatgttggggtttcctttaccttttctataagttgtaccaaaacatcc

SEQ ID NO: 1690 - DNA, 50 bp, Homo sapiens
gggtttgtgctatacactgggatgtctaattgcagcaataaagcctttct

SEQ ID NO: 1691 - DNA, 50 bp, Homo sapiens
gccacacttattcttttcagtaacctgctagtgcacaggctgtactttag

SEQ ID NO: 1692 - DNA, 50 bp, Homo sapiens
cagtcgaaggctttaactttgcacacttgggatcacagttgcgtcattgt

SEQ ID NO: 1693 - DNA, 50 bp, Homo sapiens
ttccctttccccagcatcactccccaaggaagagccaatgttttccaccc

SEQ ID NO: 1694 - DNA, 50 bp, Homo sapiens
agccataatgtaaactgcctcaaattggactttgggcataaaagaacttt

SEQ ID NO: 1695 - DNA, 50 bp, Homo sapiens
ttgcttttactagtcttagctctacgatttaaatccatgtgtccaagggg

SEQ ID NO: 1696 - DNA, 50 bp, Homo sapiens
cacacctgcacactcacggctgaaatctccctaacccagggggaccttag

SEQ ID NO: 1697 - DNA, 50 bp, Homo sapiens
agctgtaacgttcgcgttaggaaagatggtgtttattccagtttgcattt

SEQ ID NO: 1698 - DNA, 50 bp, Homo sapiens
aggggttccactagtgtctgctttcctttattattgcactgtgtgaggtt

SEQ ID NO: 1699 - DNA, 50 bp, Homo sapiens
catcctcaggtggtcaggcgtagatcaccagaataaacccagcttccctc

SEQ ID NO: 1700 - DNA, 50 bp, Homo sapiens
acacacaacgtgaaaaataggaacaggaacaaaaagaagaccaatgactc

SEQ ID NO: 1701 - DNA, 50 bp, Homo sapiens
tttagagtcttccattttgttggaattagatcctccccttcaaatgctgt

SEQ ID NO: 1702 - DNA, 50 bp, Homo sapiens
ctaatttcagtgcttgtgcttggttgttcagggccatttcaggtttgggt

SEQ ID NO: 1703 - DNA, 50 bp, Homo sapiens; identical to SEQ ID NO: 206

SEQ ID NO: 1704 - DNA, 50 bp, Homo sapiens; identical to SEQ ID NO: 818

SEQ ID NO: 1705 - DNA, 50 bp, Homo sapiens
aggtggtgttcagtgtcagacctcttaatggccagtgaataacactcact

SEQ ID NO: 1706 - DNA, 50 bp, Homo sapiens
gggggtagtttgtggcaggacaagagaaggcattgagctttttctttcat

SEQ ID NO: 1707 - DNA, 50 bp, Homo sapiens
tcgttaagagagcaacattttacccacacacagataaagttttcccttga

SEQ ID NO: 1708 - DNA, 50 bp, Homo sapiens; identical to SEQ ID NO: 86

SEQ ID NO: 1709 - DNA, 50 bp, Homo sapiens
aaacaaggtaggaatgaggctagacctttaacttccctaaggcatacttt

SEQ ID NO: 1710 - DNA, 50 bp, Homo sapiens
ttccccatatccaagtaccaatgctgttgtaaacaacgtgtatagtgcct

SEQ ID NO: 1711 - DNA, 50 bp, Homo sapiens
tgagcctttcacacctgtgctggcgctggaaaattatttgtgctcagctg

SEQ ID NO: 1712 - DNA, 50 bp, Homo sapiens
tgggattgtactataccagtaagtgccacttctgtgtctttctaatggaa

SEQ ID NO: 1713 - DNA, 50 bp, Homo sapiens
tttttcctcacaggagcggaagaactagggggagcaggagctgcaatgcg

SEQ ID NO: 1714 - DNA, 50 bp, Homo sapiens
tctacccatttcctgaggcctgtggaaataaacctttatgtacttaaagt

SEQ ID NO: 1715 - DNA, 50 bp, Homo sapiens
gtgtccgttatgagtgccaaaaatctgtcttgaaggcagctacactttga

SEQ ID NO: 1716 - DNA, 50 bp, Homo sapiens
ctgtgcaatgctacatgtacgtggacttatatcagaccagtgtggatctt

SEQ ID NO: 1717 - DNA, 50 bp, Homo sapiens
agtcccctgtcctggtcatctatcaagataacaagcggccctcagggatc

SEQ ID NO: 1718 - DNA, 50 bp, Homo sapiens
gggtctatgtgaaaatgcccccaacagagccagaatgtgaaaagcaattt

SEQ ID NO: 1719 - DNA, 50 bp, Homo sapiens
cttgccttaagctaccagattgcttttgccaccattggccatactgtgtg

SEQ ID NO: 1720 - DNA, 50 bp, Homo sapiens
cccctgccagagggagttcttcttttgtgagagacactgtaaacgacaca

SEQ ID NO: 1721 - DNA, 50 bp, Homo sapiens
tgcagccactattgttagtctcttgattcataatgacttaagcacacttg

SEQ ID NO: 1722 - DNA, 50 bp, Homo sapiens
tgactattactgtcaggcgtgggacaccaacactgcggtattcggcggag

SEQ ID NO: 1723 - DNA, 50 bp, Homo sapiens
tttgagacgcaataccaatacttaggattttggtcttggtgtttgtatga

SEQ ID NO: 1724 - DNA, 50 bp, Homo sapiens
tccttccagggcttctttgtgtctgtgttctactgtttcctcaatagtga

SEQ ID NO: 1725 - DNA, 50 bp, Homo sapiens
ccatgtccatccccacctccccaacccgtgtcagctttcacagcatcaag

SEQ ID NO: 1726 - DNA, 50 bp, Homo sapiens
tgccctcaagtaaaagaaaagccgaaagggttaatcatatttgaaaacca

SEQ ID NO: 1727 - DNA, 50 bp, Homo sapiens
atgctacttgggagaaaactctcactaactgtctcaccgggtttcaaagc

SEQ ID NO: 1728 - DNA, 50 bp, Homo sapiens
ggactttgcgaatatcagagacctcagactcttcacagggtcaggactca

SEQ ID NO: 1729 - DNA, 50 bp, Homo sapiens
agctccctgcaagtcacatttcccagtgaaacactgaacttatcagaaaa

SEQ ID NO: 1730 - DNA, 50 bp, Homo sapiens
ttccttcaggatgatctagagcagcatggagctgttggtagaatattagt

SEQ ID NO: 1731 - DNA, 50 bp, Homo sapiens
ggggaggaaggaaggacattaaattctttccctggtaatgaaaagagccc

SEQ ID NO: 1732 - DNA, 50 bp, Homo sapiens
gccttgtacataatactattccatccacacagtttccaccctcacctgcc

SEQ ID NO: 1733 - DNA, 50 bp, Homo sapiens
agcaagatagccaaatgtgacatcaagctccattgtttcggaaatccagg

SEQ ID NO: 1734 - DNA, 50 bp, Homo sapiens
gccgagtgaggtaaccaggtggcatctaccccatgttttataaggaattt

SEQ ID NO: 1735 - DNA, 50 bp, Homo sapiens
ttctttccatttgctatcatgtcagtgaacgccaggagtgctttctttgc

SEQ ID NO: 1736 - DNA, 50 bp, Homo sapiens
tgaatttacttcctcccaagagtttggactgcccgtcagattgtttctgc

SEQ ID NO: 1737 - DNA, 50 bp, Homo sapiens
accctcatttccagggggagcctcaggccccgagataaatgtgctccatg

SEQ ID NO: 1738 - DNA, 50 bp, Homo sapiens
ttctctgagggctgggggttgggggagtcagcatgattatattttaatgt

SEQ ID NO: 1739 - DNA, 50 bp, Homo sapiens
acttggctgtaatcagttatgccgtataggatgtcagacaataccactgg

SEQ ID NO: 1740 - DNA, 50 bp, Homo sapiens
tggagctcagtaacataactgcttcttggagctttggaatattttatcct

SEQ ID NO: 1741 - DNA, 50 bp, Homo sapiens
aaatttcacaagcaatactttggaccactggggttcaggccccaagaaat

SEQ ID NO: 1742 - DNA, 50 bp, Homo sapiens
acacacaaaacagcaaacttcaggtaactattttggattgcaaacaggat

SEQ ID NO: 1743 - DNA, 50 bp, Homo sapiens
tcttgccttaattaacattccctgtgacctagttggtgcagtggcttgaa

SEQ ID NO: 1744 - DNA, 50 bp, Homo sapiens
acttgcagttgtgtggaaaactgttttgtaatgaaagatcttcattgggg

SEQ ID NO: 1745 - DNA, 50 bp, Homo sapiens
tgtgatctctactactgttgattttgccctcggagcaaactgaataaagc

SEQ ID NO: 1746 - DNA, 50 bp, Homo sapiens
taggaaatgtttgacatctgaagctctcttcacactcccgtggcactcct

SEQ ID NO: 1747 - DNA, 50 bp, Homo sapiens
cgtcccctctccccttggttctgcactgttgccaataaaaagctcttaaa

SEQ ID NO: 1748 - DNA, 50 bp, Homo sapiens
gggagtgttgtgactgaaatgcttgaaaccaaagcttcagataaacttgc

SEQ ID NO: 1749 - DNA, 50 bp, Homo sapiens
aggggacagaaatcaggtattggcagtttttccattttcatttgtgtgtg

SEQ ID NO: 1750 - DNA, 50 bp, Homo sapiens
agccgcccagctacctaattcctcagtaacatcgatctaaaatctccatg

SEQ ID NO: 1751 - DNA, 50 bp, Homo sapiens
acatgcaagtacatgtttttaatgttgtctgtcttctgtgctgttcctgt

SEQ ID NO: 1752 - DNA, 50 bp, Homo sapiens
cctgtgtgggactgagatgcaggatttcttcacacctctcctttgtgact

SEQ ID NO: 1753 - DNA, 50 bp, Homo sapiens
ggcatctgaatgtgtctgcgttcctgttagcataatgtgaggaggtggag

SEQ ID NO: 1754 - DNA, 50 bp, Homo sapiens
ctgagagcccaaactgctgtcccaaacatgcacttccttgcttaaggtat

SEQ ID NO: 1755 - DNA, 50 bp, Homo sapiens
aagctccctggagccctgttggcagctctagcttttgcagtcgtgtaatg

SEQ ID NO: 1756 - DNA, 50 bp, Homo sapiens
agccctctttctctccacccaatgctgctttctcctgttcatcctgatgg

SEQ ID NO: 1757 - DNA, 50 bp, Homo sapiens
tccacaggggtggtgtcaaatgctattgaaattgtgttgaattgtatgct

SEQ ID NO: 1758 - DNA, 50 bp, Homo sapiens; identical to SEQ ID NO: 1465

SEQ ID NO: 1759 - DNA, 50 bp, Homo sapiens
gacttccacagcagcagaacaagtgcctcctggactgttcacggcagacc

SEQ ID NO: 1760 - DNA, 50 bp, Homo sapiens
tatccccagctcaggtggtgagtcctcctgtccagcctgcatcaataaaa

SEQ ID NO: 1761 - DNA, 50 bp, Homo sapiens
ctgggttttgtggtcatctattctagcagggaacactaaaggtggaaata

SEQ ID NO: 1762 - DNA, 50 bp, Homo sapiens
agctatggaatcaattcaatttggactggtgtgctctctttaaatcaagt

SEQ ID NO: 1763 - DNA, 50 bp, Homo sapiens
tggctcaagtagaaaagcagtcccattcatattaagacagtgtacaaaac

SEQ ID NO: 1764 - DNA, 50 bp, Homo sapiens
agctcttgaaagcagctttgagttagaagtatgtgtgttacaccctcaca

SEQ ID NO: 1765 - DNA, 50 bp, Homo sapiens
aaccggatatatacatagcatgacatttctttgtgctttggcttacttgt

SEQ ID NO: 1766 - DNA, 50 bp, Homo sapiens; identical to SEQ ID NO: 270

SEQ ID NO: 1767 - DNA, 50 bp, Homo sapiens
aaagttgatactgtgggatttttgtgaacagcctgatgtttgggaccttt

SEQ ID NO: 1768 - DNA, 50 bp, Homo sapiens
cttccttagctcctgttcttggcctgaagcctcacagctttgatggcagt

SEQ ID NO: 1769 - DNA, 50 bp, Homo sapiens
tttgtgcttccctttacctaaactgtcctgcctcccatgcatctgtaccc

SEQ ID NO: 1770 - DNA, 50 bp, Homo sapiens; identical to SEQ ID NO: 1769

SEQ ID NO: 1771 - DNA, 50 bp, Homo sapiens
cttgtggcttcctcagctcctgcccttggcctgaagtcccagcattgatg

SEQ ID NO: 1772 - DNA, 50 bp, Homo sapiens
atttgtttgcatccctcccccacaccctggtgttttaaaatgaagaaaaa

SEQ ID NO: 1773 - DNA, 50 bp, Homo sapiens
catccgacataatcctacaggtgctgtgttattcatggggcagataaaca

SEQ ID NO: 1774 - DNA, 50 bp, Homo sapiens
agtggggtggggagcatgttcatttgtacctcgagttttaaactggttcc

SEQ ID NO: 1775 - DNA, 50 bp, Homo sapiens
cctaaaccgtatggcctcccgtgcatctgtattcaccctgtatgacaaac

SEQ ID NO: 1776 - DNA, 50 bp, Homo sapiens
tttcatctcaggcctccctcaaccccaccacttcttttataactagtcct

SEQ ID NO: 1777 - DNA, 50 bp, Homo sapiens
gcatggcttaacctggtgataaaagcagttattaaaagtctacgttttcc

SEQ ID NO: 1778 - DNA, 50 bp, Homo sapiens
agcttccgccgtctcaacccctcacaggagcttactggcaaacatgaaaa

SEQ ID NO: 1779 - DNA, 50 bp, Homo sapiens
tctcctccacctcaactccgtgcttaaccaaagaagctgtactccggggg

SEQ ID NO: 1780 - DNA, 50 bp, Homo sapiens
acccaagggacctggatttggtgtacaagcaggcctttaatttatattga

SEQ ID NO: 1781 - DNA, 50 bp, Homo sapiens
agctcctcttcctggcttcttactgaaaggttaccctgtaacatgcaatt

SEQ ID NO: 1782 - DNA, 50 bp, Homo sapiens; identical to SEQ ID NO: 194

SEQ ID NO: 1783 - DNA, 50 bp, Homo sapiens
ccaccccaaccttctggtggggagaaataaacggtttagagacagctctg

SEQ ID NO: 1784 - DNA, 50 bp, Homo sapiens
gccaagggccaagagaatatccgaactttaatttcaggaattgaatgggt

SEQ ID NO: 1785 - DNA, 50 bp, Homo sapiens; identical to SEQ ID NO: 150

SEQ ID NO: 1786 - DNA, 50 bp, Homo sapiens
ccggttgttaaaactggtttagcacaatttatattttccctctcttgcct

SEQ ID NO: 1787 - DNA, 50 bp, Homo sapiens
attaaagcaccaaattcatgtacagcatgcatcacggatcaatagactgt

SEQ ID NO: 1788 - DNA, 50 bp, Homo sapiens
tagccgtactttgctaactgtgctcctcacttcctcttcttcattgcagt

SEQ ID NO: 1789 - DNA, 50 bp, Homo sapiens
aggctaagctgccggttcttaaatccatcctgctaagttaatgttgggta

SEQ ID NO: 1790 - DNA, 50 bp, Homo sapiens
aatatatgcatccctggtgaaggatcttgcctgcatgaaacatgttctca

SEQ ID NO: 1791 - DNA, 50 bp, Homo sapiens
acctgggcattcttgtttcattcaattccacctgcaatcaagtcctacaa

SEQ ID NO: 1792 - DNA, 50 bp, Homo sapiens
ctccctcacagcacagagaagacaaaattagcaaaaccccactacacagt

SEQ ID NO: 1793 - DNA, 50 bp, Homo sapiens
gttcagtggcactcaacatgagtcaagagcatcctgcttctaccatgtgg

SEQ ID NO: 1794 - DNA, 50 bp, Homo sapiens
cttgagctagaagtctccaaggaggtcgggatggggcttgtagcagaagg

SEQ ID NO: 1795 - DNA, 50 bp, Homo sapiens
ctcccaactcctccctatcctaaaggcccactggcattaaagtgctgtat

SEQ ID NO: 1796 - DNA, 50 bp, Homo sapiens
tcggtcctctttccagtggatcataagacaatggaccctttttgttatga

SEQ ID NO: 1797 - DNA, 50 bp, Homo sapiens
aacacacagtgtttatgttggaatcttttggaactcctttgatctcactg

SEQ ID NO: 1798 - DNA, 50 bp, Homo sapiens
ggggctctttccctcatgtatacttcaagtaagatcaagaatcttttgtg

SEQ ID NO: 1799 - DNA, 50 bp, Homo sapiens
tcatcctctgtgtggctcatgtttttgcttttcaacacacaaagcacaaa

SEQ ID NO: 1800 - DNA, 50 bp, Homo sapiens
tggatgattgggactttaaaacgaccctctttcaggtggattcagagacc

SEQ ID NO: 1801 - DNA, 50 bp, Homo sapiens
tgtagcttctgaaaggtgctttctccatttatttaaaaactacccatgca

SEQ ID NO: 1802 - DNA, 50 bp, Homo sapiens
tgtagcaacatgagaaacgcttatgttacaggttacatgagagcaatcat

SEQ ID NO: 1803 - DNA, 50 bp, Homo sapiens
ctgatggctgtgaccctgcttcctgcactgacccagagcctctgcctgtg

SEQ ID NO: 1804 - DNA, 50 bp, Homo sapiens
tgtgtgttgatcccaagacaatgaaagtttgcactgtatgctggacggca

SEQ ID NO: 1805 - DNA, 50 bp, Homo sapiens
ctctcctcagactgctcaagagaagcacatgaaaaccattacctgacttt

SEQ ID NO: 1806 - DNA, 50 bp, Homo sapiens
gccagtaagatcaatgtgacggcagggaaatgtatgtgtgtctattttgt

SEQ ID NO: 1807 - DNA, 50 bp, Homo sapiens
gcaacaatgaagttaatggataccctctgcctttggctcagaaatgttat

SEQ ID NO: 1808 - DNA, 50 bp, Homo sapiens
tgtctttcggttatcaagtgtttctgcatggtaatgtcatgtaaatgctg

SEQ ID NO: 1809 - DNA, 50 bp, Homo sapiens
tatcatggggagtaataggaccagagcggtatctctggcaccacactagc

SEQ ID NO: 1810 - DNA, 50 bp, Homo sapiens
tgatcttggctgtatttaatggcataggctgacttttgcagatggaggaa

SEQ ID NO: 1811 - DNA, 50 bp, Homo sapiens
agtactgagaaaaatcccttcagctctaagaacactgaaaaatccaccga

SEQ ID NO: 1812 - DNA, 50 bp, Homo sapiens
actttgcacacatttgcatccacatattagggaaggaataagtagctgca

SEQ ID NO: 1813 - DNA, 50 bp, Homo sapiens
atgcagtgtttccctctgtgttagagcagagaggtttcgatatttattga

SEQ ID NO: 1814 - DNA, 50 bp, Homo sapiens
tgctgaagtttcccttagacattttatgtcttgcttgtagggcataatgc

SEQ ID NO: 1815 - DNA, 50 bp, Homo sapiens
cactggaccattgtcacaaccctctgtttctctttgactaagtgccctgg

SEQ ID NO: 1816 - DNA, 50 bp, Homo sapiens
aagtgttactgtggcttcaaagaagctattgattctgaagtagtgggttt

SEQ ID NO: 1817 - DNA, 50 bp, Homo sapiens
gctgcttatatatttaataataaaagaagtgcacaagctgccgttgacgt

SEQ ID NO: 1818 - DNA, 50 bp, Homo sapiens
aacaaacatttggttttgttcagaccttatttccactctggtggataagt

SEQ ID NO: 1819 - DNA, 50 bp, Homo sapiens
gagagagggcacgagaacccaaaggaatagagattctccaggaatttcct

SEQ ID NO: 1820 - DNA, 50 bp, Homo sapiens
ttcccagcatcagccttagaacaagaaccttaccttcaaggagcaagtga

SEQ ID NO: 1821 - DNA, 50 bp, Homo sapiens
ctgtccagctccctctccccaagaaacaacatgaatgagcaacttcagag

SEQ ID NO: 1822 - DNA, 50 bp, Homo sapiens
ctgtaacgacgagagcggcgaggatgtcgaggttccctatgtccgataca

SEQ ID NO: 1823 - DNA, 50 bp, Homo sapiens
acctagtcatcaggacactgagccagggctgcaaccactccatgagtttg

SEQ ID NO: 1824 - DNA, 50 bp, Homo sapiens
ccccaaccctctgggctcttggatttcagagtgaaaacttgatggcattg

SEQ ID NO: 1825 - DNA, 50 bp, Homo sapiens
tcaattcctctgggaatgttacattgtttgtctgtcttcatagcagattt

SEQ ID NO: 1826 - DNA, 50 bp, Homo sapiens
accagtttctttcccttctagatcaccctgttctgaagccagcctctctc

SEQ ID NO: 1827 - DNA, 50 bp, Homo sapiens
ctacctgaacccctcttgccactgccttctaccttgtttgaaacctgaat

SEQ ID NO: 1828 - DNA, 50 bp, Homo sapiens
aactcgagaccttttcaacttggcttcctttcttggttcataaatgaatt

SEQ ID NO: 1829 - DNA, 50 bp, Homo sapiens
agctgctgctggatcacagctgctttctgttgtcattgctgttgtccctc

SEQ ID NO: 1830 - DNA, 50 bp, Homo sapiens; identical to SEQ ID NO: 110

SEQ ID NO: 1831 - DNA, 50 bp, Homo sapiens
atccagccccacccaatggccttttgtgcttgtttcctataacttcagta

SEQ ID NO: 1832 - DNA, 50 bp, Homo sapiens
ccttctttgtatataggcttctcaccgcgaccaataaacagctcccagtt

SEQ ID NO: 1833 - DNA, 50 bp, Homo sapiens
aaaacgatgaaggtatgctgtcatggtcctttctggaagtttctggtgcc

SEQ ID NO: 1834 - DNA, 50 bp, Homo sapiens
aatgcgaaattattggttggtgtgaagaaagccagacaacttctgtttct

SEQ ID NO: 1835 - DNA, 50 bp, Homo sapiens
ctgtggctcgtttgagggattggggtggacctggggtttattttcagtaa

SEQ ID NO: 1836 - DNA, 50 bp, Homo sapiens
gcttccccaccccagtttttgttgcttgaaaatattgttgtcccggattt

SEQ ID NO: 1837 - DNA, 50 bp, Homo sapiens
tggactgttttgttgggcagtgcctgataagcttcaaagctgctttattc

SEQ ID NO: 1838 - DNA, 50 bp, Homo sapiens
cctgccgtgcccacctaactgtccagatgaggtttatcagcttatgagaa

SEQ ID NO: 1839 - DNA, 50 bp, Homo sapiens
cgagctgagaagcggtcatgagcacctggggattttagtaagtgtgtctt

SEQ ID NO: 1840 - DNA, 50 bp, Homo sapiens
accatccaatcggacaagctttcagaaccttattgaaggatttgaagcac

SEQ ID NO: 1841 - DNA, 50 bp, Homo sapiens
tgctgatgaacctgcagaaaaggctgatgaaccaatggaacattaagtga

SEQ ID NO: 1842 - DNA, 50 bp, Homo sapiens
tcttatgcacacggtgatttcatgttatatatgcaaagtaggcaactgtt

SEQ ID NO: 1843 - DNA, 50 bp, Homo sapiens
aacataggagtggattcctgccccaaccaaaccgcattcgtgtggatttt

SEQ ID NO: 1844 - DNA, 50 bp, Homo sapiens
aataaatttgcaaaaccaagatcacagtacaccatatgcactctggtacc

SEQ ID NO: 1845 - DNA, 50 bp, Homo sapiens
aaatgacctcatgttgtggtttaaacagcaactgcacccactagcacagc

SEQ ID NO: 1846 - DNA, 50 bp, Homo sapiens
tgtgcagtagaaacaaaagtaggctacagtctgtgccatgttgatgtaca

SEQ ID NO: 1847 - DNA, 50 bp, Homo sapiens
ctgtttattctgggaaatgttttaatgccagggcctgctgagttgcttct

SEQ ID NO: 1848 - DNA, 50 bp, Homo sapiens
ccttaagaccagttcatagttaatacaggtttacagttcatgcctgtggt

SEQ ID NO: 1849 - DNA, 50 bp, Homo sapiens
tcatcactttggacaggagttaattaagagaatgaccaagctcagttcaa

SEQ ID NO: 1850 - DNA, 50 bp, Homo sapiens
agtctgcctaaataggtagcttaaacttatgtcaaaatgtctgcagcagt

SEQ ID NO: 1851 - DNA, 50 bp, Homo sapiens
ctggcctccagtgccttcccccgtggaataaacggtgtgtcctgagaaac

SEQ ID NO: 1852 - DNA, 50 bp, Homo sapiens
agctaattaagctgcagaacgtgggaaataaagttcgaaacaaaggttaa

SEQ ID NO: 1853 - DNA, 50 bp, Homo sapiens
ggacaggtgtgccgacagaaggaaccagcgtgtatatgagggtatcaaat

SEQ ID NO: 1854 - DNA, 50 bp, Homo sapiens
cccttcgtggggctacacattctcttcctcatattttcatgcacacaagt

SEQ ID NO: 1855 - DNA, 50 bp, Homo sapiens
ttctgcacaggtctctgtttagtaaatacatcactgtataccgatcagga

SEQ ID NO: 1856 - DNA, 50 bp, Homo sapiens
caccctccaccccttccttttgcgcggaccccattacaataaattttaaa

SEQ ID NO: 1857 - DNA, 50 bp, Homo sapiens
catgcagctatttcaaagtgtgttggattaattaggatcatccctttggt

SEQ ID NO: 1858 - DNA, 50 bp, Homo sapiens
tggagaattgtggaaggattgtaacatggaccatccaaatttatggccgt

SEQ ID NO: 1859 - DNA, 50 bp, Homo sapiens
ttcacgggatgcaccaaagtgtgtaccccgtaagcatgaaaccagtgttt

SEQ ID NO: 1860 - DNA, 50 bp, Homo sapiens
tctgtccatcagtgcatgacgtttaaggccacgtatagtcctagctgacg

SEQ ID NO: 1861 - DNA, 50 bp, Homo sapiens
tcctataattatttctgtagcactccacactgatctttggaaacttgccc

SEQ ID NO: 1862 - DNA, 50 bp, Homo sapiens
gggacactggaggctggagctacagttgaaagcactgcatgttaagaggg

SEQ ID NO: 1863 - DNA, 50 bp, Homo sapiens
tgctaccacaactatattatcatgcaaatgctgtattcttctttggtgga

SEQ ID NO: 1864 - DNA, 50 bp, Homo sapiens
gcaacttacgcttggcatcttcagaatgcttttctagcattaagagatgt

SEQ ID NO: 1865 - DNA, 50 bp, Homo sapiens
tttacaagaattgtccatgtgcttccctaggctgagctggcattggtctg

SEQ ID NO: 1866 - DNA, 50 bp, Homo sapiens
aaaacttcccaccctacttttccaagagtgccagttggattctgaatctg

SEQ ID NO: 1867 - DNA, 50 bp, Homo sapiens
tagaccaattctctgatctcgagttgtttttgtttggatacagccctttt

SEQ ID NO: 1868 - DNA, 50 bp, Homo sapiens
aacattctacatagcacaggagcttaagagtggcattatcttctcgcctt

SEQ ID NO: 1869 - DNA, 50 bp, Homo sapiens
agatacgcagacattgtggcatctgggtagaagaatactgtattgtgtgt

SEQ ID NO: 1870 - DNA, 50 bp, Homo sapiens
tttgaccagaagcccttagtaagtacgtgcctgaaactgaaaccatgtgc

SEQ ID NO: 1871 - DNA, 50 bp, Homo sapiens
acacctggcttggagtcagatttagttaacaataatgagcctggagcagt

SEQ ID NO: 1872 - DNA, 50 bp, Homo sapiens
tctaatagcgggttactttcacatacagccctcccccagcagttgaatga

SEQ ID NO: 1873 - DNA, 50 bp, Homo sapiens
ctgaaaagtgctttgctggagtcctgttctctgagctccacagaagacac

SEQ ID NO: 1874 - DNA, 50 bp, Homo sapiens
aagcctaaagtgattcaatagcccaggagcacctgattcctttctgcctg

SEQ ID NO: 1875 - DNA, 50 bp, Homo sapiens
tgggcatggttgaatctgaaaccctccttctgtggcaacttgtactgaaa

SEQ ID NO: 1876 - DNA, 50 bp, Homo sapiens
ggggtggggtggggtgagagtgtgtggagtaaggacattcagaataaata

SEQ ID NO: 1877 - DNA, 50 bp, Homo sapiens
agaagttgtgcgcgtgctttctcagcagcatttttccttcaaaatcatct

SEQ ID NO: 1878 - DNA, 50 bp, Homo sapiens
cttgccagccaggagtgcggacaccatgttcccagctcagtgccaaagag

SEQ ID NO: 1879 - DNA, 50 bp, Homo sapiens
atttggggagagaaaacctttttaagcatggtggggcactcagataggag

SEQ ID NO: 1880 - DNA, 50 bp, Homo sapiens
accctctttcttgtttgtcagcatctgaccatctgtgactataaagctgt

SEQ ID NO: 1881 - DNA, 50 bp, Homo sapiens
tggtcatccaaactcaaacttgagaaaatatcttgctttcaaattgacac

SEQ ID NO: 1882 - DNA, 50 bp, Homo sapiens
accgaatttggcaagaatgaaatggtgtcataaagatgggaggggagggt

SEQ ID NO: 1883 - DNA, 50 bp, Homo sapiens
agcctgtgacattaagcattctcacaattagaaataagaataaaacccat

SEQ ID NO: 1884 - DNA, 50 bp, Homo sapiens
aaaaataaaaacaaatactgtgtttcagaagcgccacctattggggaaaa

SEQ ID NO: 1885 - DNA, 50 bp, Homo sapiens
ttatcacaagctctgttacctttatatacgctgcctcttcaatttggaaa

SEQ ID NO: 1886 - DNA, 50 bp, Homo sapiens
gcagaaaatatcctggcagggaatctggcttaaacatgaaatgctgtaat

SEQ ID NO: 1887 - DNA, 50 bp, Homo sapiens
tgtgtgcataatagctacagtgcatagttgtagacaaagtacattctggg

SEQ ID NO: 1888 - DNA, 50 bp, Homo sapiens
tctcagtgggtggtagcagagggatcaagcagttatttgatttgtgctct

SEQ ID NO: 1889 - DNA, 50 bp, Homo sapiens
gtctatttacggaactcaaatacgtgggcattcaaatgtattacagtggg

SEQ ID NO: 1890 - DNA, 50 bp, Homo sapiens
tgcacttttagaaatgcatatttgccacaaaacctgtattactgaataat

SEQ ID NO: 1891 - DNA, 50 bp, Homo sapiens
gggaggggattaaccaaaggccaccctgactttgtttttgtggacacaca

SEQ ID NO: 1892 - DNA, 50 bp, Homo sapiens
gcctgcccctgtgtattcaccaccaataaatcagaccatgaaacctgaaa

SEQ ID NO: 1893 - DNA, 50 bp, Homo sapiens
aggtgtatttatgttaccgttctgaataaacagaatggaccattgaacca

SEQ ID NO: 1894 - DNA, 50 bp, Homo sapiens
tgtaatgaatttgtcgcaaagacgtaataaaattaactggtggcacggtc

SEQ ID NO: 1895 - DNA, 50 bp, Homo sapiens
tgtcaatggaagttggctgcacttgatgtttgtttgcatgatgtctacct

SEQ ID NO: 1896 - DNA, 50 bp, Homo sapiens
tcgagcacctgtaaacaattttctcaacctatttgatgttcaaataaaga

SEQ ID NO: 1897 - DNA, 50 bp, Homo sapiens
aactttactaagtaatctcacagcatttgccaagtctcccaatatccaat

SEQ ID NO: 1898 - DNA, 50 bp, Homo sapiens
taagatctttaaactgctttatacactgtcacgtggcttcatcagctgtg

SEQ ID NO: 1899 - DNA, 50 bp, Homo sapiens
aaaaccactaccctcagagagagccaaaaatacagaagaggcggagagcg

SEQ ID NO: 1900 - DNA, 50 bp, Homo sapiens
cgagcaagcctgggaactcaggaaaattcacaggacttgggagattctaa

SEQ ID NO: 1901 - DNA, 50 bp, Homo sapiens
ggcttagctacagtgaagttttgcattgcttttgaagacaagaaaagtgc

SEQ ID NO: 1902 - DNA, 50 bp, Homo sapiens
acttcaaaattaccttttcatatccatgatcttgagtccatttgggggat

SEQ ID NO: 1903 - DNA, 50 bp, Homo sapiens
caaacacttttgggccaggatttgagtctctgcatgacatatacttgatt

SEQ ID NO: 1904 - DNA, 50 bp, Homo sapiens
cagactccaccaagcctggtcagcccaaaccaccagaagcccagaataaa

SEQ ID NO: 1905 - DNA, 50 bp, Homo sapiens
agtgcagaatctcataggttgccaataatacactaattcctttctatcct

SEQ ID NO: 1906 - DNA, 50 bp, Homo sapiens
agactgactacattggaagctttgagttgacttctgaccaaaggtggtaa

SEQ ID NO: 1907 - DNA, 50 bp, Homo sapiens; identical to SEQ ID NO: 1761

SEQ ID NO: 1908 - DNA, 50 bp, Homo sapiens
gtggtgagggcagttctgcacccagccaaacacataacaataaaaaccaa

SEQ ID NO: 1909 - DNA, 50 bp, Homo sapiens
tctgtgtcctaaagatgtgttctctataaaatacaaaccaacgtgcctaa

SEQ ID NO: 1910 - DNA, 50 bp, Homo sapiens
ctagtcatagaaatacctcattcgcctgtgggaagagaagggaagcctct

SEQ ID NO: 1911 - DNA, 50 bp, Homo sapiens
agcagcggctggatgtgatatgtctagtttaaccagtccccttgatcttt

SEQ ID NO: 1912 - DNA, 50 bp, Homo sapiens
tattggaggactccctcccagctttggaagggtcatccgcgtgtgtgtgt

SEQ ID NO: 1913 - DNA, 50 bp, Homo sapiens
atacaaagcaaacaaactcaagttatgtcatacctttggatacgaagacc

SEQ ID NO: 1914 - DNA, 50 bp, Homo sapiens; identical to SEQ ID NO: 1575

SEQ ID NO: 1915 - DNA, 50 bp, Homo sapiens; identical to SEQ ID NO: 257

SEQ ID NO: 1916 - DNA, 50 bp, Homo sapiens
gcccaaagaagcaaggaaccaaatttaagactctcgcatcttcccaaccc

SEQ ID NO: 1917 - DNA, 50 bp, Homo sapiens
ccggagtctgggattcatcccgtcatttctttcaataaataattattgga

SEQ ID NO: 1918 - DNA, 50 bp, Homo sapiens
gcaatggcagccttggcaaacgctaaatgaaaatcgtgacaacacttgtg

SEQ ID NO: 1919 - DNA, 50 bp, Homo sapiens
agtgttggtagcacttaagacttatacttgccttctgatagtattccttt

SEQ ID NO: 1920 - DNA, 50 bp, Homo sapiens
aactgaggactgtttgcaattgacataggcaataataagtgatgtgctga

SEQ ID NO: 1921 - DNA, 50 bp, Homo sapiens
gggctcagttctgccttatctaaatcaccagagaccaaacaaggactaat

SEQ ID NO: 1922 - DNA, 50 bp, Homo sapiens; identical to SEQ ID NO: 614

SEQ ID NO: 1923 - DNA, 50 bp, Homo sapiens
tcttggaaacttccattaagtgtgtagattgagcaggtagtaattgcatg

SEQ ID NO: 1924 - DNA, 50 bp, Homo sapiens
actactcagcatggaaacaagatgaaattccatttgtaggtagtgagaca

SEQ ID NO: 1925 - DNA, 50 bp, Homo sapiens
cactaatgatcctgctaccctcttgaagaccagcccggtacctctctccc

SEQ ID NO: 1926 - DNA, 50 bp, Homo sapiens
gtgacctcacttctggcactgtgactactatggctgtttagaactactga

SEQ ID NO: 1927 - DNA, 50 bp, Homo sapiens
aagccttattcttcaactaaaagatgaggattaagagcaagaagttgggg

SEQ ID NO: 1928 - DNA, 50 bp, Homo sapiens
gcactgaatcgtttcatgtaagaatccaaagtggacaccattaacaggtc

SEQ ID NO: 1929 - DNA, 50 bp, Homo sapiens
ggtgctcacattccttaaattaaggagaaatgctggcatagagcagcact

SEQ ID NO: 1930 - DNA, 50 bp, Homo sapiens
cttttgttctctccgtgaaacttacctttccctttttctttctctttttt

SEQ ID NO: 1931 - DNA, 50 bp, Homo sapiens
tggtatgtagagcttagatttccctattgtgacagagccatggtgtgttt

SEQ ID NO: 1932 - DNA, 50 bp, Homo sapiens
tggagataatctagaacacaggcaaaatccttgcttatgacatcacttgt

SEQ ID NO: 1933 - DNA, 50 bp, Homo sapiens
gtgcctctgtgctgtgtatgtgaaccacccatgtgagggaataaacctag

SEQ ID NO: 1934 - DNA, 50 bp, Homo sapiens
tgcaaacggttttgtaagttaacactacactactcacaatggtaggggaa

SEQ ID NO: 1935 - DNA, 50 bp, Homo sapiens
cctgtgcccagcaggaaggaagtcaaataaaccacactgactacctgtgc

SEQ ID NO: 1936 - DNA, 50 bp, Homo sapiens
cccaacaatcccaaggccctttttatacaaaaattctcagttctcttcac

SEQ ID NO: 1937 - DNA, 50 bp, Homo sapiens
tgtctgttttaatcatgtatctggaatagggtcgggaagggtttgtgcta

SEQ ID NO: 1938 - DNA, 50 bp, Homo sapiens
cacgatggtggaaacagtggggaactactgctggaaaaagccctaatagc

SEQ ID NO: 1939 - DNA, 50 bp, Homo sapiens
ccctggaggcactgaagtgcttagtgtacttggagtattggggtctgacc

SEQ ID NO: 1940 - DNA, 50 bp, Homo sapiens
acaagtttacatgataaaaagaaatgtgatttgtcttcccttctttgcac

SEQ ID NO: 1941 - DNA, 50 bp, Homo sapiens
ttgtatgtgaataattctagcgggggacctgggagataattctacgggga

SEQ ID NO: 1942 - DNA, 50 bp, Homo sapiens
atctattctaacgcaaaaccactaactgaagttcagatataatggatggt

SEQ ID NO: 1943 - DNA, 50 bp, Homo sapiens
gtaacggaacatatccagtactcctggttcctaggtgagcaggtgatgcc

SEQ ID NO: 1944 - DNA, 50 bp, Homo sapiens
actaatttgatgtttacaggtggacacacaaggtgcaaatcaatgcgtac

SEQ ID NO: 1945 - DNA, 50 bp, Homo sapiens
tgtgtgttttagtttcatcacctgttatctgtgtttgctgaggagagtgg

SEQ ID NO: 1946 - DNA, 50 bp, Homo sapiens
ttggagctgttccattgggtcctcttggtgtcgtttccctcccaacagag

SEQ ID NO: 1947 - DNA, 50 bp, Homo sapiens
atttgttgctctcagactgtgtaaaacaaaatttattcatgttttctgca

SEQ ID NO: 1948 - DNA, 50 bp, Homo sapiens
ctgaaccattactgtaattggctcttaaggcttgaagtaaccttataggt

SEQ ID NO: 1949 - DNA, 50 bp, Homo sapiens
gctaagctgccggttcttaaatccatcctgctaagttaatgttgggtaga

SEQ ID NO: 1950 - DNA, 50 bp, Homo sapiens
tgtaaccaataaatctgtagtgaccttacctgtattccctgtgctatcct

SEQ ID NO: 1951 - DNA, 50 bp, Homo sapiens; identical to SEQ ID NO: 305

SEQ ID NO: 1952 - DNA, 50 bp, Homo sapiens
atttctcccttatctactgtgatgacttcagaagatacaatggtcccagg

SEQ ID NO: 1953 - DNA, 50 bp, Homo sapiens
tgtctggagggggtttgtgcctgataacgtaataacaccagtggagactt

SEQ ID NO: 1954 - DNA, 50 bp, Homo sapiens
acactgccttctcaactccaaactgactcttaagaagactgcattatatt

SEQ ID NO: 1955 - DNA, 50 bp, Homo sapiens
agatgttccaaatttagaaagcttaaggcggcctacagaaaaaggaaaaa

SEQ ID NO: 1956 - DNA, 50 bp, Homo sapiens
aagtccaactactaaactgggggatattatgaagggccttgagcatctgg

SEQ ID NO: 1957 - DNA, 50 bp, Homo sapiens
atccacctccctcccctagagctattctcctttgggtttcttgctgctgc

SEQ ID NO: 1958 - DNA, 50 bp, Homo sapiens
aaaaggccacagcaatctgtactacaatcaactttattttgaaatcatgt

SEQ ID NO: 1959 - DNA, 50 bp, Homo sapiens
gattagttaccattgaaattggttctgtcataaaacagcatgagtctggt

SEQ ID NO: 1960 - DNA, 50 bp, Homo sapiens
aaaaatacacatcacacccatttaaaagtgatcttgagaaccttttcaaa

SEQ ID NO: 1961 - DNA, 50 bp, Homo sapiens
acagcaacagctattaaatcagcaagttttggagcaaagacaacagcagt

SEQ ID NO: 1962 - DNA, 50 bp, Homo sapiens
tgaccagggcagtgaaaatgaaaccgcattttgggtgccattaaataggg

SEQ ID NO: 1963 - DNA, 50 bp, Homo sapiens
caatttctttattagagggccttattgatgtgttctaagtctttccagaa

SEQ ID NO: 1964 - DNA, 50 bp, Homo sapiens
agagctgaaatgtcaggaacaaaaagaagaacagctgcaggaaggggtgc

SEQ ID NO: 1965 - DNA, 50 bp, Homo sapiens
ggtaataagagcagtagcagcagcatctctgaacatttctctggatttgc

SEQ ID NO: 1966 - DNA, 50 bp, Homo sapiens
agagtttggaaaaagcctgtgaaaggtgtcttctttgacttaatgtcttt

SEQ ID NO: 1967 - DNA, 50 bp, Homo sapiens
gtatggtagattcaaatgaaccactgaaaaggcatttagtttcttgtccc

SEQ ID NO: 1968 - DNA, 50 bp, Homo sapiens; identical to SEQ ID NO: 1762

SEQ ID NO: 1969 - DNA, 50 bp, Homo sapiens
gctcttaagttgtggagagtgcaacagtagcataggaccctaccctctgg

SEQ ID NO: 1970 - DNA, 50 bp, Homo sapiens; identical to SEQ ID NO: 658

SEQ ID NO: 1971 - DNA, 50 bp, Homo sapiens
aaaacagccaaaactccacagtcaatattagtaatttcttgctggttgaa

SEQ ID NO: 1972 - DNA, 50 bp, Homo sapiens
tagcatttgtttaagggtgatagtcaaattatgtattggtggggctgggt

SEQ ID NO: 1973 - DNA, 50 bp, Homo sapiens
gcagatgagacagcaaccattgtagaatttctgaacagatggattacctt

SEQ ID NO: 1974 - DNA, 50 bp, Homo sapiens
tctaatttctgaaatgtgcagctcccatttggccttgtgcggttgtgttc

SEQ ID NO: 1975 - DNA, 50 bp, Homo sapiens
accagagtacgttggaaaacttcttggaaaggctaaagacgatcatgaga

SEQ ID NO: 1976 - DNA, 50 bp, Homo sapiens
tgaggacttttcgaccaattcaaccctttgccccacctttattaaaatct

SEQ ID NO: 1977 - DNA, 50 bp, Homo sapiens
gctggcccataaacaccctgtaggttcttgatatttataataaaattggt

SEQ ID NO: 1978 - DNA, 50 bp, Homo sapiens
cccagggagttgtgtctgtaatcggcctactattcagtggcgagaaataa

SEQ ID NO: 1979 - DNA, 50 bp, Homo sapiens; identical to SEQ ID NO: 1810

SEQ ID NO: 1980 - DNA, 50 bp, Homo sapiens
ttgttgacaactgtgactgtacccaaatggaaagtaactcatttgttaaa

SEQ ID NO: 1981 - DNA, 50 bp, Homo sapiens
gtcaagattgtgttttgaggtttccttcagacagattccaggcgatgtgc

SEQ ID NO: 1982 - DNA, 50 bp, Homo sapiens
tcaccagtccctccccaaatgctttccatgagttgcagttttttcctagt

SEQ ID NO: 1983 - DNA, 50 bp, Homo sapiens
tactttggggacttgtagggatgcctttctagtcctattctattgcagtt

SEQ ID NO: 1984 - DNA, 50 bp, Homo sapiens
ccatcggtgaaactaacagataagcaagagagatgttttggggactcatt

SEQ ID NO: 1985 - DNA, 50 bp, Homo sapiens; identical to SEQ ID NO: 1781

SEQ ID NO: 1986 - DNA, 50 bp, Homo sapiens
caccaggaacctgctttagtgggggatagtgaagaagacaataaaagata

SEQ ID NO: 1987 - DNA, 50 bp, Homo sapiens
ggctacagaaagaagatgccagatgacacttaagacctacttgtgatatt

SEQ ID NO: 1988 - DNA, 50 bp, Homo sapiens
gcatttccacaccaagcagcaacagcaaatcacgaccactgatagatgtc

SEQ ID NO: 1989 - DNA, 50 bp, Homo sapiens
tccccaaaccataaaaccctatacaagttgttctagtaacaatacatgag

SEQ ID NO: 1990 - DNA, 50 bp, Homo sapiens
gcttccggtccttagccttcccaggtgggactttaggcatgattaaaata

SEQ ID NO: 1991 - DNA, 50 bp, Homo sapiens
tgctattgccttcctattttgcataataaatgcttcagtgaaaatgcagc

SEQ ID NO: 1992 - DNA, 50 bp, Homo sapiens
ggaagaagagggagagatggagcaaagtgagggccgagtgagagcgtgct

SEQ ID NO: 1993 - DNA, 50 bp, Homo sapiens; identical to SEQ ID NO: 1831

SEQ ID NO: 1994 - DNA, 50 bp, Homo sapiens
ctcagctaaaaggccacccctttatcgcattgctgtccttgggtagaata

SEQ ID NO: 1995 - DNA, 50 bp, Homo sapiens
accttatgaactacagtggagctacactcattgaaatgtaatttcagttc

SEQ ID NO: 1996 - DNA, 50 bp, Homo sapiens; identical to SEQ ID NO: 32

SEQ ID NO: 1997 - DNA, 50 bp, Homo sapiens
gccagatttggggcatttggaaagaagttcattgaagataaagcaaaagt

SEQ ID NO: 1998 - DNA, 50 bp, Homo sapiens
ctgcacccttcccccagcaccatttatgagtctcaagttttattattgca

SEQ ID NO: 1999 - DNA, 50 bp, Homo sapiens
ttttgaagaagggaaattcacactgtgcgttttgagtatgcaagaagaat

SEQ ID NO: 2000 - DNA, 50 bp, Homo sapiens
tgttgtgactttttagccagtgactttttctgagcttttcatggaagtgg

SEQ ID NO: 2001 - DNA, 50 bp, Homo sapiens
acttcacacagacaagtggctaagtgtccattatttaccttgaacaatca

SEQ ID NO: 2002 - DNA, 50 bp, Homo sapiens; identical to SEQ ID NO: 433

SEQ ID NO: 2003 - DNA, 50 bp, Homo sapiens; identical to SEQ ID NO: 1787

SEQ ID NO: 2004 - DNA, 50 bp, Homo sapiens
atggaaattgtatttgccttctccactttgggaggctcccacttcttggg

SEQ ID NO: 2005 - DNA, 50 bp, Homo sapiens
tcagagggaaagtaaatatttcaggcatactgacactttgccagaaagca

SEQ ID NO: 2006 - DNA, 50 bp, Homo sapiens
gtgtaacacagtgccttcaataaatggtatagcaaatgttttgacatgaa

SEQ ID NO: 2007 - DNA, 50 bp, Homo sapiens
tgggactattacatccacatgatacctctgatcaagtatttttgacattt

SEQ ID NO: 2008 - DNA, 50 bp, Homo sapiens
cattcgtatgagaagcggcttttctgaaaagggatccagcacacctcctc

SEQ ID NO: 2009 - DNA, 50 bp, Homo sapiens
cttcagactgaacatgtacactggtttgagcttagtgaaatgacttccgg

SEQ ID NO: 2010 - DNA, 50 bp, Homo sapiens
tttaaatgtttgtgttaatacacattaaaacatcgcacaaaaacgatgca

SEQ ID NO: 2011 - DNA, 50 bp, Homo sapiens
gcaaccttgcatccatctgggctaccccacccaagtatacaataaagtct

SEQ ID NO: 2012 - DNA, 50 bp, Homo sapiens
tgctggtggggaaagacttaaaagtggattaaagacctgcgtattgatga

SEQ ID NO: 2013 - DNA, 50 bp, Homo sapiens
aggggcgctcgcttccgcatcctagtctctatcattaaagttctagtgac

SEQ ID NO: 2014 - DNA, 50 bp, Homo sapiens
agctgatcctcgggaagaacaaagctaaagctgccttttgtctgttattt

SEQ ID NO: 2015 - DNA, 50 bp, Homo sapiens
cacaggcccatggactcacttttgtaacaaactcctaccaacactgacca

SEQ ID NO: 2016 - DNA, 50 bp, Homo sapiens
aggaggagtttctattaaaatctgtcacttgagtgatgtcatttaagtcc

SEQ ID NO: 2017 - DNA, 50 bp, Homo sapiens
cctgtgcaatagacacatacatgtcacatttagctgtgctcagaagggct

SEQ ID NO: 2018 - DNA, 50 bp, Homo sapiens; identical to SEQ ID NO: 2017

SEQ ID NO: 2019 - DNA, 50 bp, Homo sapiens
tgcacctgttactgttgggctttccactgagatctactggataaagaata

SEQ ID NO: 2020 - DNA, 50 bp, Homo sapiens
aagaaggagcttaatgccaggaacagattttgcagttggtggggtctcaa

SEQ ID NO: 2021 - DNA, 50 bp, Homo sapiens
agggctacctgcgatctgtgtttgctctgacgaatggaatttatcctcac

SEQ ID NO: 2022 - DNA, 50 bp, Homo sapiens
ccatgattatttttctaagctggttggttaataaacagtacctgctctca

SEQ ID NO: 2023 - DNA, 50 bp, Homo sapiens
aaaggctaaagaacttgccactaaactgggttaaatgtacactgttgagt

SEQ ID NO: 2024 - DNA, 50 bp, Homo sapiens
ggaaccaagactgtgcaggagaaagagaactagtgctgagggcctcaata

SEQ ID NO: 2025 - DNA, 50 bp, Homo sapiens
tggttccagcagaagtatgatgggatcatccttcctggcaaataaattcc

SEQ ID NO: 2026 - DNA, 50 bp, Homo sapiens
ttggttgtttggttagtgactgatgtaaaacggttttcttgtggggaggt

SEQ ID NO: 2027 - DNA, 50 bp, Homo sapiens
atgctggcagcattgcatgattctccagtatatttgtaaaaaataaaaaa

SEQ ID NO: 2028 - DNA, 50 bp, Homo sapiens
cgggccagccgaggctacaaaaactaaccctggatcctactctcttatta

SEQ ID NO: 2029 - DNA, 50 bp, Homo sapiens; identical to SEQ ID NO: 106

SEQ ID NO: 2030 - DNA, 50 bp, Homo sapiens
ttcaactaaagcgccacctgctccacccagagaagcacactttgtgagaa

SEQ ID NO: 2031 - DNA, 50 bp, Homo sapiens
ttggaaatcatagtcaaagggcttccttggttcgccactcatttatttgt

SEQ ID NO: 2032 - DNA, 50 bp, Homo sapiens; identical to SEQ ID NO: 2031

SEQ ID NO: 2033 - DNA, 50 bp, Homo sapiens
cctgatggagagaagaaggcatatgttcgactggctcctgattacgatgc

SEQ ID NO: 2034 - DNA, 50 bp, Homo sapiens
cagaagaaactgaagaaacaaaaacttatggcacgggagtaaattcagca

SEQ ID NO: 2035 - DNA, 50 bp, Homo sapiens
gtttcagctccccgagttggtggaaaacgctaaactggcagattagattt

SEQ ID NO: 2036 - DNA, 50 bp, Homo sapiens
ctcctgttgggtaagggtgttgagtgtgacttgtgctgaaaacctggttc

SEQ ID NO: 2037 - DNA, 50 bp, Homo sapiens
gaacaagtggttcttccagaaactgcggttttagatgctttgttttgatc

SEQ ID NO: 2038 - DNA, 50 bp, Homo sapiens
ggcttgaagccacatggagggagtttcattaaatgctaactacttttaaa

SEQ ID NO: 2039 - DNA, 50 bp, Homo sapiens
atctacagacagtcaatgtggatgagaactaatcgctgatcaaataacgt

SEQ ID NO: 2040 - DNA, 50 bp, Homo sapiens
gcgcagtgaagaaaatgagtaggcagctcatgtgcacgttttctgtttaa

SEQ ID NO: 2041 - DNA, 50 bp, Homo sapiens
caatcttcctgctaaggccattggacacagaatccgagtgatgctgtacc

SEQ ID NO: 2042 - DNA, 50 bp, Homo sapiens
ggcagctgttgcagcatccagttcatcttaagaatgtcaacgattagtca

SEQ ID NO: 2043 - DNA, 50 bp, Homo sapiens
agacgctcctctactctttggagacatcactggcctataataaatgggtt

SEQ ID NO: 2044 - DNA, 50 bp, Homo sapiens
tctgttatgaacacgttggttggctggattcagtaataaatatgtaaggc

SEQ ID NO: 2045 - DNA, 50 bp, Homo sapiens
tgagaagaaggaggagtctgaagagtcagatgatgacatgggatttggcc

SEQ ID NO: 2046 - DNA, 50 bp, Homo sapiens
gctaaagttgaacgagctgatggatatgaaccaccagtccaagaatctgt

SEQ ID NO: 2047 - DNA, 50 bp, Homo sapiens
gctggccaccaaacagagcagtggctaaattgcagtagcagcatatcttt

SEQ ID NO: 2048 - DNA, 50 bp, Homo sapiens
gccaagtccaaccgctgattttcccagctgctgcccaataaacctgtctg

SEQ ID NO: 2049 - DNA, 50 bp, Homo sapiens
tggtgtctataagaagctcacgggcaaggatgttaattttgaattcccag

SEQ ID NO: 2050 - DNA, 50 bp, Homo sapiens; identical to SEQ ID NO: 78

SEQ ID NO: 2051 - DNA, 50 bp, Homo sapiens
catctacagcctctgccctggtcgcataaatttgtctgtgtactcaagca

SEQ ID NO: 2052 - DNA, 50 bp, Homo sapiens
ctaccagaaatcctaccgataagcccatcgtgactcaaaactcacttgta

SEQ ID NO: 2053 - DNA, 50 bp, Homo sapiens
ctcggggacctgtttgaattttttctgtagtgctgtattattttcaataa

SEQ ID NO: 2054 - DNA, 50 bp, Homo sapiens
gctgccaacaagaagcattagaacaaaccatgctgggttaataaattgcc

SEQ ID NO: 2055 - DNA, 50 bp, Homo sapiens
gatggcatcgtctcaaagaacttttgactggagagaatcacagatgtgga

SEQ ID NO: 2056 - DNA, 50 bp, Homo sapiens; identical to SEQ ID NO: 2055

SEQ ID NO: 2057 - DNA, 50 bp, Homo sapiens
ccaatgtttctcttttggccctatacaaaggcaagaaggaaagaccaaga

SEQ ID NO: 2058 - DNA, 50 bp, Homo sapiens
ctggcaaaaagccgaaggagtaaaggtgctgcaatgatgttagctgtggc

SEQ ID NO: 2059 - DNA, 50 bp, Homo sapiens
tggtgaagatgcatgaataggtccaaccagctgtacatttggaaaaataa

SEQ ID NO: 2060 - DNA, 50 bp, Homo sapiens
gccagtgtttccgtcagtacgcgaaggatatcggtttcattaagttggac

SEQ ID NO: 2061 - DNA, 50 bp, Homo sapiens
gagtgataactcatgagaagtactgataggacctttatctggatatggtc

SEQ ID NO: 2062 - DNA, 50 bp, Homo sapiens
ggtgattcttctctgttgaactgaagtttgtgagagtagttttcctttgc

SEQ ID NO: 2063 - DNA, 50 bp, Homo sapiens; identical to SEQ ID NO: 1804

SEQ ID NO: 2064 - DNA, 50 bp, Homo sapiens
ggggaaggtgtttttagtacaagacatcaaagtgaagtaaagcccaagtg

SEQ ID NO: 2065 - DNA, 50 bp, Homo sapiens
aggaaaacatccaaaacaacaagcaagaaaccgaagaagacatcttttga

SEQ ID NO: 2066 - DNA, 50 bp, Homo sapiens
agctgccacctcagtctcttctctgtattatcatagtctggtttaaataa

SEQ ID NO: 2067 - DNA, 50 bp, Homo sapiens
ggaggcagccagggcttacctgtacactgacttgagaccagttgaataaa

SEQ ID NO: 2068 - DNA, 50 bp, Homo sapiens
agcaaagatttcagtagaattttagtcctgaacgctacggggaaaatgca

SEQ ID NO: 2069 - DNA, 50 bp, Homo sapiens
tggtggtattcagtggtccaggattctgtaatgctttacacaggcagttt

SEQ ID NO: 2070 - DNA, 50 bp, Homo sapiens
tgcttttatgtgtcccttgataacagtgacttaacaatatacattcctca

SEQ ID NO: 2071 - DNA, 50 bp, Homo sapiens
ttgtttcaaaatgctgtttcatttttataaagtaccagtgtttagctgct

SEQ ID NO: 2072 - DNA, 50 bp, Homo sapiens
agagatggacaagagcagccaggagacccagcgatctgagcataaaactc

SEQ ID NO: 2073 - DNA, 50 bp, Homo sapiens
tgaaagagaaagactgattacctcctgtgtggaagaaggaaacaccgagt

SEQ ID NO: 2074 - DNA, 50 bp, Homo sapiens
ggaatacctcagaagagatgcttcattgagtgttcattaaaccacacatg

SEQ ID NO: 2075 - DNA, 50 bp, Homo sapiens
accatgatactttaattagaagcttagccttgaaattgtgaactcttgga

SEQ ID NO: 2076 - DNA, 50 bp, Homo sapiens; identical to SEQ ID NO: 2075

SEQ ID NO: 2077 - DNA, 50 bp, Homo sapiens
gcctctgccctggtttggctatgtcagatccaataaacatcctgaacctc

SEQ ID NO: 2078 - DNA, 50 bp, Homo sapiens
tgccttttctaccccatccctcacagcctcttgctgctaaaatagatgtt

SEQ ID NO: 2079 - DNA, 50 bp, Homo sapiens
ggccaggcccaagtaagtgtaccttgtactttataaataaacctcaagca

SEQ ID NO: 2080 - DNA, 50 bp, Homo sapiens
gccgaattgtctttggtgcttttcacttgtgttttaaaataaggattttt

SEQ ID NO: 2081 - DNA, 50 bp, Homo sapiens; identical to SEQ ID NO: 1720

SEQ ID NO: 2082 - DNA, 50 bp, Homo sapiens
agaagtcccccatgtggatatttcttatactaattgtatcataaagccgt

SEQ ID NO: 2083 - DNA, 50 bp, Homo sapiens
gggcaggagcatggggtgcttggttgtttccttcctaataaaataaacgc

SEQ ID NO: 2084 - DNA, 50 bp, Homo sapiens
atgcatttggtatgaatctgtggttgtatctgttcaattctaaagtacaa

SEQ ID NO: 2085 - DNA, 50 bp, Homo sapiens
ttctctaggttactgttgggagcttaatggtagaaacttccttggtttca

SEQ ID NO: 2086 - DNA, 50 bp, Homo sapiens
cctcccagcaacccactacctctggtacctgtaaaggtcaaacaagaaac

SEQ ID NO: 2087 - DNA, 50 bp, Homo sapiens
ccgtgtctgtttgtaggcggagaaaccgttgggtaacttgttcaagatat

SEQ ID NO: 2088 - DNA, 50 bp, Homo sapiens
tgagggtgagggcaggctgaggcaacgagtgggaggttcaaacaagagtg

SEQ ID NO: 2089 - DNA, 50 bp, Homo sapiens
cccaaacaatctgtggatggaaaagcaccacttgctactggagaggatga

SEQ ID NO: 2090 - DNA, 50 bp, Homo sapiens
aatcaacttcaaggagcaccttcattagtacagcttgcatatttaacatt

SEQ ID NO: 2091 - DNA, 50 bp, Homo sapiens
aggcgatgatattctcaccatcctgactgaagtgaactatgaagtaagca

SEQ ID NO: 2092 - DNA, 50 bp, Homo sapiens
tgacgacctggtagaatctctctaaccatttgaagttgatttctcaatgc

SEQ ID NO: 2093 - DNA, 50 bp, Homo sapiens
gctgcgaaagacccacatgctacaagacgggcaaaataaagtgacagatg

SEQ ID NO: 2094 - DNA, 50 bp, Homo sapiens
cgcccatgatgggagggattgacatgtttcaacaaaataatgcacttcct

SEQ ID NO: 2095 - DNA, 50 bp, Homo sapiens
tctttcagatagcaggcagggaagcaatgtagtgtggtgggcagagcccc

SEQ ID NO: 2096 - DNA, 50 bp, Homo sapiens
caggaggatggcaaagagagtcgcatctcagtgcaggagagacagtgagg

SEQ ID NO: 2097 - DNA, 50 bp, Homo sapiens
gggggtagtggtggcaggacaagagaaggcattgagctttttctttcatt

SEQ ID NO: 2098 - DNA, 50 bp, Homo sapiens
gccatgaaggagcaagttttgtatttgtgacctcagctttgggaataaag

SEQ ID NO: 2099 - DNA, 50 bp, Homo sapiens; identical to SEQ ID NO: 621

SEQ ID NO: 2100 - DNA, 50 bp, Homo sapiens
accaagtttcaggggacatgagttttccagcttttatacacacgtatctc

SEQ ID NO: 2101 - DNA, 50 bp, Homo sapiens
ggcaaatgaggaacagggcaatagtatgatgaatcttgattggagttggt

SEQ ID NO: 2102 - DNA, 50 bp, Homo sapiens; identical to SEQ ID NO: 165

SEQ ID NO: 2103 - DNA, 50 bp, Homo sapiens
tataccatgagatgagatgaccaccaatcatttccttggggggagggggt

SEQ ID NO: 2104 - DNA, 50 bp, Homo sapiens
cctaggaaatcacaggcttctgagcacagctgcattaaaacaaaggaagt

SEQ ID NO: 2105 - DNA, 50 bp, Homo sapiens
aaatgtaaccttttgctttccaaattaaagaactccatgccactcctcaa

SEQ ID NO: 2106 - DNA, 50 bp, Homo sapiens
acacacatacacacaccccaaaacacatacattgaaagtgcctcatctga

SEQ ID NO: 2107 - DNA, 50 bp, Homo sapiens
gaccctatcctcccaccgcctccgttaacacgatcctgaataaatcttga

SEQ ID NO: 2108 - DNA, 50 bp, Homo sapiens
acagcaaagcccattggccagaaaggaaagacaataattttgttttttca

SEQ ID NO: 2109 - DNA, 50 bp, Homo sapiens
aaggagtaaagatttgcctttaaataacttggtattttcctggctttcgt

SEQ ID NO: 2110 - DNA, 50 bp, Homo sapiens
ggcctcgtttacttttaaaaaatgaaattgttcattgctgggagaagaat

SEQ ID NO: 2111 - DNA, 50 bp, Homo sapiens
tcaactaatgatttagtgatcaaattgtgcagtactttgtgcattctgga

SEQ ID NO: 2112 - DNA, 50 bp, Homo sapiens
taggtttctgacttttgtggatcattttgcacatagctttatcaactttt

SEQ ID NO: 2113 - DNA, 50 bp, Homo sapiens
aaatcagtactttttaatggaaacaacttgacccccaaatttgtcacaga

SEQ ID NO: 2114 - DNA, 50 bp, Homo sapiens; identical to SEQ ID NO: 88

SEQ ID NO: 2115 - DNA, 50 bp, Homo sapiens
caggaggggggagggaagggagccaagggatggacatcttgtcatttttt

SEQ ID NO: 2116 - DNA, 50 bp, Homo sapiens
gcaagtatgctgctctctctgttgatggtgaagatgaaaatgagggagaa

SEQ ID NO: 2117 - DNA, 50 bp, Homo sapiens
ttgtgggtgtgaaacaaatggtgagaatttgaattggtccctcctattat

SEQ ID NO: 2118 - DNA, 50 bp, Homo sapiens
aaagggaaaaagacctcgtggagaatttttactggggattcttgaacttg

SEQ ID NO: 2119 - DNA, 50 bp, Homo sapiens
aaatgtatttactatgcgtgtttccagcagttggcattaaagtgcctttt

SEQ ID NO: 2120 - DNA, 50 bp, Homo sapiens
atttgcattactctggtggattgttctagtactgtattgggcttcttcgt

SEQ ID NO: 2121 - DNA, 50 bp, Homo sapiens
gaggaggtctcttctatgccaccggcctctgccagctttgcaccagcgtg

SEQ ID NO: 2122 - DNA, 50 bp, Homo sapiens; identical to SEQ ID NO: 1465

SEQ ID NO: 2123 - DNA, 50 bp, Homo sapiens
tttgaagagccattttggtaaacggtttttattaaagatgctatggaaca

SEQ ID NO: 2124 - DNA, 50 bp, Homo sapiens
gtcaggattgcgagagatgtgtgttgatactgttgcacgtgtgtttttct

SEQ ID NO: 2125 - DNA, 50 bp, Homo sapiens; identical to SEQ ID NO: 1857

SEQ ID NO: 2126 - DNA, 50 bp, Homo sapiens
taatggccccttaccctgggtgaagcacttacccttggaacagaactcta

SEQ ID NO: 2127 - DNA, 50 bp, Homo sapiens
aaggcctcatcctggggaggatacgtaggcacacagaggggagtcaccag

SEQ ID NO: 2128 - DNA, 50 bp, Homo sapiens
tggggtaagtggagttgggaaatacaagaagagaaagaccagtggggatt

SEQ ID NO: 2129 - DNA, 50 bp, Homo sapiens
acctagcggacaatgatggagagatctatgatgatattgctgatggctgc

SEQ ID NO: 2130 - DNA, 50 bp, Homo sapiens
gtgatggtgtagccctcccactttgctgttccttactttactgcctgaat

SEQ ID NO: 2131 - DNA, 50 bp, Homo sapiens
gcctctacttctgtctcaaaatggctccaaatgatttctgtactgcaaaa

SEQ ID NO: 2132 - DNA, 50 bp, Homo sapiens
tctccttccacagtttatttcctcgcttcctttgcatctaaacctttctt

SEQ ID NO: 2133 - DNA, 50 bp, Homo sapiens
acactgttgccctggctgtattcataagattccagctccttcaggtgttt

SEQ ID NO: 2134 - DNA, 50 bp, Homo sapiens
gtcaatattctgcaatttcagccccatttgtactacgtgcgagacagcct

SEQ ID NO: 2135 - DNA, 50 bp, Homo sapiens
ggcgggactgggcggggcggggcatcagaactcaggtgttttttatttac

SEQ ID NO: 2136 - DNA, 50 bp, Homo sapiens
ttccttttgctctttgtggttggatctaacactaactgtattgttttgtt

SEQ ID NO: 2137 - DNA, 50 bp, Homo sapiens
acgtcttccaaataaattatgtgttggtgccatcgcacatgctcaataaa

SEQ ID NO: 2138 - DNA, 50 bp, Homo sapiens; identical to SEQ ID NO: 1705

SEQ ID NO: 2139 - DNA, 50 bp, Homo sapiens
ctgagactggctgctgactttgagaactctgtgagacaaggtccttaggc

SEQ ID NO: 2140 - DNA, 50 bp, Homo sapiens
gcagggaagctttgcatgttgctctaaggtacatttttaaagagttgttt

SEQ ID NO: 2141 - DNA, 50 bp, Homo sapiens
cgaaccaaagctagaagcaaatgtcgagataagagagcagatgttggaga

SEQ ID NO: 2142 - DNA, 50 bp, Homo sapiens
ggaaggaaaagagtgctgagaaatggctctgtataatctatggctatccg

SEQ ID NO: 2143 - DNA, 50 bp, Homo sapiens
accaaggctagaaccacctgcctatattttttgttaaatgatttcattca

SEQ ID NO: 2144 - DNA, 50 bp, Homo sapiens
cctctgccaaagtactcttaggtgccagtctggtaactgaactccctctg

SEQ ID NO: 2145 - DNA, 50 bp, Homo sapiens
aaaataatgcaccacttttaacagaacagacagatgaggacagagctggt

SEQ ID NO: 2146 - DNA, 50 bp, Homo sapiens
gaattgggggatagatctataatgttcactgttcaaaacgaagactagct

SEQ ID NO: 2147 - DNA, 50 bp, Homo sapiens
ccgtttgctttcagaaaatgttttagggtaaatgcataagactatgcaat

SEQ ID NO: 2148 - DNA, 50 bp, Homo sapiens
cccaaattctttcagtggctacctacatacaattccaaacacatacagga

SEQ ID NO: 2149 - DNA, 50 bp, Homo sapiens
aaattaataagtcacaagaaaaacaaaagtgccagaagatgtccagccac

SEQ ID NO: 2150 - DNA, 50 bp, Homo sapiens
agaggctcctaactgggcaactcaagattctggcttctactgaagaacca

SEQ ID NO: 2151 - DNA, 50 bp, Homo sapiens
ggttttctactgttatgtgagaacattaggccccagcaacacgtcattgt

SEQ ID NO: 2152 - DNA, 50 bp, Homo sapiens
cagcttctgccacttcccaggtaagcaggaggaggtgccaacagtgttag

SEQ ID NO: 2153 - DNA, 50 bp, Homo sapiens
accatttttgttactctcttccacatgttactggataaattgtttagtgg

SEQ ID NO: 2154 - DNA, 50 bp, Homo sapiens
gtgccactaacggttgagttttgactgcttggaactggaatcctttcagc

SEQ ID NO: 2155 - DNA, 50 bp, Homo sapiens
tctccaccaccatctcccctctacttctcatttcctaactctctgctgaa

SEQ ID NO: 2156 - DNA, 50 bp, Homo sapiens
ggtgttggacttaaatcagttgaaatgtatttctgtaccacaatttacgc

SEQ ID NO: 2157 - DNA, 50 bp, Homo sapiens
cccttccgctgttcctgaaataacctttcataaagtgctttgggtgccat

SEQ ID NO: 2158 - DNA, 50 bp, Homo sapiens
ttctcatgtataaaactaggaatcctccaaccaggctcctgtgatagagt

SEQ ID NO: 2159 - DNA, 50 bp, Homo sapiens
agacacgtctatcagcttattccttctctactggaatattggtatagtca

SEQ ID NO: 2160 - DNA, 50 bp, Homo sapiens
tgtctggtaacaagatgtgactttttggtagcactgttgtggttcattct

SEQ ID NO: 2161 - DNA, 50 bp, Homo sapiens
tcctctttccagtggatcataagacaatggaccctttttgttatgatggt

SEQ ID NO: 2162 - DNA, 50 bp, Homo sapiens
actgttttgtatacttgttttcagttttcatttcgacaaacaagcactgt

SEQ ID NO: 2163 - DNA, 50 bp, Homo sapiens
acatagtttttatttttgtgtctgtgaaagtgccaagaacccctccccac

SEQ ID NO: 2164 - DNA, 50 bp, Homo sapiens
tcacctggacttaagcgtctggctctaattcacagtgctctttctcctca

SEQ ID NO: 2165 - DNA, 50 bp, Homo sapiens
agatgcctggcagggctgggtggcgattcataaagacctcgtgttgattc

SEQ ID NO: 2166 - DNA, 50 bp, Homo sapiens
ggatagtcaggagcgtcaatgtgcttgtacatagagtgctgtagctgtgt

SEQ ID NO: 2167 - DNA, 50 bp, Homo sapiens
ttgtgaaatatcttgttactgcttttatttagcagactgtggactgtaat

SEQ ID NO: 2168 - DNA, 50 bp, Homo sapiens
ctggaggacctgttgatgctagttcagagtatcaccaagagctggagagg

SEQ ID NO: 2169 - DNA, 50 bp, Homo sapiens
gctgcacaagagccttgattgaagatatattctttctgaacagtatttaa

SEQ ID NO: 2170 - DNA, 50 bp, Homo sapiens
ttgcctttataaaaacttgctgcctgactaaagattaacaggttatagtt

SEQ ID NO: 2171 - DNA, 50 bp, Homo sapiens
tggttctgctttttgacctctctctaccttttcagggtaatctttgtggc

SEQ ID NO: 2172 - DNA, 50 bp, Homo sapiens
cctgtccttgtgtttgtgtgtgctaacagaaataagttgcagtatggtcg

SEQ ID NO: 2173 - DNA, 50 bp, Homo sapiens
aaaagtgttggttttctgccatcagtgaaaattcttaaacttggagcaac

SEQ ID NO: 2174 - DNA, 50 bp, Homo sapiens
agggtttggctgtgtctaaactgcattaccgcgttgtaaaaaatagctgt

SEQ ID NO: 2175 - DNA, 50 bp, Homo sapiens
cctaggctgcgctccagcactgcggggcttttctgcaataaagtcacgag

SEQ ID NO: 2176 - DNA, 50 bp, Homo sapiens
ggcagcacagagacccccggaacaagcctaaaaattgtttcaaaataaaa

SEQ ID NO: 2177 - DNA, 50 bp, Homo sapiens
aagtcttttccacaaaccaccatctattttgtgaactttgttagtcatct

SEQ ID NO: 2178 - DNA, 50 bp, Homo sapiens
tggcaagttggaaaatatgtaactggaatctcaaaagttctttgggacaa

SEQ ID NO: 2179 - DNA, 50 bp, Homo sapiens
tctgcttatggcacaatttgcctcaaatccattccaagttgtatatttgt

SEQ ID NO: 2180 - DNA, 50 bp, Homo sapiens
ccattgttgtcaaatgcccagtgtccatcagatgtgttcctccattttct

SEQ ID NO: 2181 - DNA, 50 bp, Homo sapiens
gctgcctctgtaaattcatgtattcaaaggaaaagacaccttgcctataa

SEQ ID NO: 2182 - DNA, 50 bp, Homo sapiens
tcaagtcagcaacagagcaaaataaaggttagataagtccttgtgtagca

SEQ ID NO: 2183 - DNA, 50 bp, Homo sapiens; identical to SEQ ID NO: 1719

SEQ ID NO: 2184 - DNA, 50 bp, Homo sapiens
tggttttgaatgcaattaggttatgctatttggacaataaactcaccttg

SEQ ID NO: 2185 - DNA, 50 bp, Homo sapiens
tgcaaggtttaggctggtggcccaggaccatcatcctactgtaataaaga

SEQ ID NO: 2186 - DNA, 50 bp, Homo sapiens
gtgtggtcggggtgagaacccaagcgttggaactgtagacccgtcctgtc

SEQ ID NO: 2187 - DNA, 50 bp, Homo sapiens
agcagcagtgacataaaattccatgttagataagcatatgttacttacct

SEQ ID NO: 2188 - DNA, 50 bp, Homo sapiens
ctccacaataaggtcaatgccagagacggaagcctttttccccaaagtct

SEQ ID NO: 2189 - DNA, 50 bp, Homo sapiens
tggaggtattcaatatcctttgcctcaaggacttcggcagatactgtctc

SEQ ID NO: 2190 - DNA, 50 bp, Homo sapiens
ggtgcccaccattcttggcctgttacttacctgagatgagctcttttaac

SEQ ID NO: 2191 - DNA, 50 bp, Homo sapiens
ttaagaagaaatacccactaacaaagaacaagcattagttttggctgtca

SEQ ID NO: 2192 - DNA, 50 bp, Homo sapiens; identical to SEQ ID NO: 248

SEQ ID NO: 2193 - DNA, 50 bp, Homo sapiens
gggcggcccggagccagccaggcagttttattgaaatctttttaaataat

SEQ ID NO: 2194 - DNA, 50 bp, Homo sapiens; identical to SEQ ID NO: 235

SEQ ID NO: 2195 - DNA, 50 bp, Homo sapiens
agagaacactggacaacattttactactgagggaaatagccaaaaaggca

SEQ ID NO: 2196 - DNA, 50 bp, Homo sapiens
catgggggcaacagccaaaataggggggtaatgatgtaggggccaagcag

SEQ ID NO: 2197 - DNA, 50 bp, Homo sapiens
ttctggaagatggtcagctatgaagtaatagagtttgcttaatcatttgt

SEQ ID NO: 2198 - DNA, 50 bp, Homo sapiens
gggtggctctgatatagtagctctggtgtagtttctgcatttcaagaaga

SEQ ID NO: 2199 - DNA, 50 bp, Homo sapiens
ttccagtcagtttttctcttaagtgcctgtttgagtttactgaaacagtt

SEQ ID NO: 2200 - DNA, 50 bp, Homo sapiens
aaggaccaaggagatgaagcaaacacattaagccttccacactcacctct

SEQ ID NO: 2201 - DNA, 50 bp, Homo sapiens
aggtgcagcctctggaagtggatcaaactagaactcatatgccatactag

SEQ ID NO: 2202 - DNA, 50 bp, Homo sapiens
acttaaaagtttagggttttctcttggttgtagagtggcccagaattgca

SEQ ID NO: 2203 - DNA, 50 bp, Homo sapiens
gtcttgtgactagtgctgaagcttattaatgctaagggcaggcccaaatt

SEQ ID NO: 2204 - DNA, 50 bp, Homo sapiens
ccagagctgctattagaagctgcttcctgtgaagatcaatcttcctgagt

SEQ ID NO: 2205 - DNA, 50 bp, Homo sapiens
tcctctttctcccagcttcaaatgcacaattcatcattgggctcacttct

SEQ ID NO: 2206 - DNA, 50 bp, Homo sapiens
cagcttcaccctgtcaagttaacaaggaatgcctgtgccaataaaaggtt

SEQ ID NO: 2207 - DNA, 50 bp, Homo sapiens
ctcgaatcattgaagatccgagtgtgatttgaattctgtgatattttcac

SEQ ID NO: 2208 - DNA, 50 bp, Homo sapiens
cttcatctggaagaagaggcaagggggcaggagaccaggctctagctctg

SEQ ID NO: 2209 - DNA, 50 bp, Homo sapiens
agactttgccattgttgccattgttttcttttgtacctgaagcattttga

SEQ ID NO: 2210 - DNA, 50 bp, Homo sapiens
aaaagtaggggaggggctgggtctgcaaattaataaatagaagagggggt

SEQ ID NO: 2211 - DNA, 50 bp, Homo sapiens; identical to SEQ ID NO: 467

SEQ ID NO: 2212 - DNA, 50 bp, Homo sapiens
tcagtaaacaaattctttcacaaggtacaaaatcttgcataagctgaact

SEQ ID NO: 2213 - DNA, 50 bp, Homo sapiens
gttttacttaggacaagttgtaccttgccctctctccagctctgctccca

SEQ ID NO: 2214 - DNA, 50 bp, Homo sapiens; identical to SEQ ID NO: 306

SEQ ID NO: 2215 - DNA, 50 bp, Homo sapiens
tggatgtggctgctttcaacaagatctaaaatccatcctggatcatggca

SEQ ID NO: 2216 - DNA, 50 bp, Homo sapiens
tgtggtgtatatccttccaaaaaattaaaacgaaaataaagtagctgcga

SEQ ID NO: 2217 - DNA, 50 bp, Homo sapiens
gtcttccatgtgaacagcataagtttggagcactagtttgattattatgt

SEQ ID NO: 2218 - DNA, 50 bp, Homo sapiens
gcccacacccacactctccagcatctggcacaataaacattctctgtttt

SEQ ID NO: 2219 - DNA, 50 bp, Homo sapiens
agctgtttcctgggtaaatctagagtggggttttggttctttattttccc

SEQ ID NO: 2220 - DNA, 50 bp, Homo sapiens
gcaggagacattggtattctgggcagcttcctaatatgctttacaatctg

SEQ ID NO: 2221 - DNA, 50 bp, Homo sapiens
tggttttcatatcaaaagatcatgttgggattaacttgcctttttcccca

SEQ ID NO: 2222 - DNA, 50 bp, Homo sapiens
atctacaagcggagaaagtgacctagagattgcaagggcggggagaggag

SEQ ID NO: 2223 - DNA, 50 bp, Homo sapiens
tgtttaaatggcttggtgtctttcttttctaattatgcagaataagctct

SEQ ID NO: 2224 - DNA, 50 bp, Homo sapiens
aaaactgtactttgattcacatgttttcaaatggagttggagttcattca

SEQ ID NO: 2225 - DNA, 50 bp, Homo sapiens
tccatcagagctggtctgcacactcacattatcttgctatcactgtaacc

SEQ ID NO: 2226 - DNA, 50 bp, Homo sapiens
gacactttcgagctcccagctccagcttcgtctcaccttgagttaggctg

SEQ ID NO: 2227 - DNA, 50 bp, Homo sapiens; identical to SEQ ID NO: 115

SEQ ID NO: 2228 - DNA, 50 bp, Homo sapiens
aggagtcttttacccggtgtgctttgccgcagtcatccaaaataaattca

SEQ ID NO: 2229 - DNA, 50 bp, Homo sapiens
tagggagccgcaccttgtcatgtaccatcaataaagtaccctgtgctcaa

SEQ ID NO: 2230 - DNA, 50 bp, Homo sapiens
gctgtatataaacgtgtcccgagcttagattctgtatgcggtgacggcgg

SEQ ID NO: 2231 - DNA, 50 bp, Homo sapiens
tgtcttatgtgtcaaaagtcctaggaaagtggttgatgtttcttatagca

SEQ ID NO: 2232 - DNA, 50 bp, Homo sapiens
gctgaatgacatattttatcttgttctttaaaatcacaacacagagctgc

SEQ ID NO: 2233 - DNA, 50 bp, Homo sapiens
tgtctctctctctttttcttttctatggagcaaaacaaagctgatttccc

SEQ ID NO: 2234 - DNA, 50 bp, Homo sapiens
cagtgtactgcaaggaagctggatgcaagatagatactatattaaactgt

SEQ ID NO: 2235 - DNA, 50 bp, Homo sapiens
tgtattgtatgcaaatctgtgattgttggcagtgtcatctctgagaaaca

SEQ ID NO: 2236 - DNA, 50 bp, Homo sapiens
ggggtgtttgtgtgtgtgcgcgtgtgcgtttcaataaagtttgtacactt

SEQ ID NO: 2237 - DNA, 50 bp, Homo sapiens
tttagtatttttcccccaggccagatcattcgtgagtgtgcgagtgtgtg

SEQ ID NO: 2238 - DNA, 50 bp, Homo sapiens
tgctttgtttaaaggactgcagaccaaggagtcgagctttctctcagagc

SEQ ID NO: 2239 - DNA, 50 bp, Homo sapiens
accttatttccactctggtggataagttcaataaaggtcatatcccaaac

SEQ ID NO: 2240 - DNA, 50 bp, Homo sapiens
aatgttgtctgtcttctgtgctgttcctgtaagtttgctattaaaataca

SEQ ID NO: 2241 - DNA, 50 bp, Homo sapiens
accttcctcatttcacagataaggaatctttggggattaaccaacctcct

SEQ ID NO: 2242 - DNA, 50 bp, Homo sapiens
agatacctccccaccaccaattgccaaaggtccaataaaatgcctcaacc

SEQ ID NO: 2243 - DNA, 50 bp, Homo sapiens
gcaatccacaatctgacattctcaggaagcccccaagttgatatttctat

SEQ ID NO: 2244 - DNA, 50 bp, Homo sapiens
tctcaggctgcgtgcagcaacagtgcccagggctctgatgagtctctcat

SEQ ID NO: 2245 - DNA, 50 bp, Homo sapiens
gcctccaaccatgttcccttcttcttagcaccacaaataatcaaaaccca

SEQ ID NO: 2246 - DNA, 50 bp, Homo sapiens
ctcatcttcaacttttgtgctcccctttgcctaaaccctatggcctcctg

SEQ ID NO: 2247 - DNA, 50 bp, Homo sapiens; identical to SEQ ID NO: 818

SEQ ID NO: 2248 - DNA, 50 bp, Homo sapiens
tgtgtgtatggtagcacagcaaacttgtaggaattagtatcaatagtaaa

SEQ ID NO: 2249 - DNA, 50 bp, Homo sapiens
cctgcctggctctctcttcctaccctccttccacatgtacataaactgtc

SEQ ID NO: 2250 - DNA, 50 bp, Homo sapiens
agatgggaatgaagcttgtgtatccattatcatgtgtaatcaataaacga

SEQ ID NO: 2251 - DNA, 50 bp, Homo sapiens
ttaagatttttctcaaagttttgaaaagctattagccaggatcatggtgt

SEQ ID NO: 2252 - DNA, 50 bp, Homo sapiens; identical to SEQ ID NO: 647

SEQ ID NO: 2253 - DNA, 50 bp, Homo sapiens
ccattttgcctttctgacatttccttgggaatctgcaagaacctcccctt

SEQ ID NO: 2254 - DNA, 50 bp, Homo sapiens
ttccgtttggtagactccttccaatgaaatctcaggaataattaaactct

SEQ ID NO: 2255 - DNA, 50 bp, Homo sapiens
ggcagagaaggaggagtatgagcatcagaagagggagctggagcaaatct

SEQ ID NO: 2256 - DNA, 50 bp, Homo sapiens
agcagcctttctgtggagagtgagaataattgtgtacaaagtagagaagt

SEQ ID NO: 2257 - DNA, 50 bp, Homo sapiens
aatgataactaatgacatccagtgtctccaaaattgtttccttgtactga

SEQ ID NO: 2258 - DNA, 50 bp, Homo sapiens
tccctctgggactggacaattgcttcaagcattcttcaaccagcagatgc

SEQ ID NO: 2259 - DNA, 50 bp, Homo sapiens
cggctacatgcctcagtgaaggactagtagttcctgctacaacttcagca

SEQ ID NO: 2260 - DNA, 50 bp, Homo sapiens
catgagtcaagagcatcctgcttctaccatgtggatttggtcacaaggtt

SEQ ID NO: 2261 - DNA, 50 bp, Homo sapiens
gtcagaggtcctgtctggatggaggctggaggctcccccctcaacccctc

SEQ ID NO: 2262 - DNA, 50 bp, Homo sapiens
cctgatacacaattatgaccagaaaatatggctccatgaaggtgctactt

SEQ ID NO: 2263 - DNA, 50 bp, Homo sapiens
attcaattccagagtagtttcaagtttcacatcgtaaccattttcgcccg

SEQ ID NO: 2264 - DNA, 50 bp, Homo sapiens
tggaaatgtcatctaaccattaagtcatgtgtgaacacataaggacgtgt

SEQ ID NO: 2265 - DNA, 50 bp, Homo sapiens
aattcccagatttgaagacaaaaatactctaattctaaccagagcaagct

SEQ ID NO: 2266 - DNA, 50 bp, Homo sapiens
tggcagctacccccttcttgagagtccaagaacctggagcagaaataatt

SEQ ID NO: 2267 - DNA, 50 bp, Homo sapiens; identical to SEQ ID NO: 1730

SEQ ID NO: 2268 - DNA, 50 bp, Homo sapiens
tgccaagcacagtgcctgcatgtatttatccaataaatgtgaaattctgt

SEQ ID NO: 2269 - DNA, 50 bp, Homo sapiens
accactgtatgtttacttctcaccatttgagttgcccatcttgtttcaca

SEQ ID NO: 2270 - DNA, 50 bp, Homo sapiens
ggctgagggttctgctgtcctgtgccaccccattaaagtgcagttcctcc

SEQ ID NO: 2271 - DNA, 50 bp, Homo sapiens; identical to SEQ ID NO: 1840

SEQ ID NO: 2272 - DNA, 50 bp, Homo sapiens
agtctctaaagagtttattttaagacgtgtttgtgtttgtgtgtgtttgt

SEQ ID NO: 2273 - DNA, 50 bp, Homo sapiens
tggaagactaaagaggtgcaatgtgatctgagcctccatcattgtcctcc

SEQ ID NO: 2274 - DNA, 50 bp, Homo sapiens
gcagccagcagatctcagcagcccagtccaaataaacgtcctgtctagca

SEQ ID NO: 2275 - DNA, 50 bp, Homo sapiens
ggtaggagcaaccactgactggtcttaagctgttcttgcataggctctta

SEQ ID NO: 2276 - DNA, 50 bp, Homo sapiens
tcagctacactttgtttttaagtttgtttttgacatgtttatttggcaaa

SEQ ID NO: 2277 - DNA, 50 bp, Homo sapiens
tcccccctccgcctcccaggaagaaagaatgttactgccttaataaaaaa

SEQ ID NO: 2278 - DNA, 50 bp, Homo sapiens
gtgaatttgggctcacagaatcaaagcctatgcttggtagctcttgaaca

SEQ ID NO: 2279 - DNA, 50 bp, Homo sapiens
tccttcctttccactgaaaagcacatggccttgggtgacaaattcctctt

SEQ ID NO: 2280 - DNA, 50 bp, Homo sapiens
agaaatgttcagtaatgaaaaaatatatccaatcagagccatcccgaaaa

SEQ ID NO: 2281 - DNA, 50 bp, Homo sapiens
ttttaacttttaaggttgaaaagacaatagcccaaagccaagaaagaaaa

SEQ ID NO: 2282 - DNA, 50 bp, Homo sapiens
gcactcctttgtcatatactctgcatcactgtcatactcacaacttcgtg

SEQ ID NO: 2283 - DNA, 50 bp, Homo sapiens
tggcagtgggaaaaatgtaggagactgtttggaaattgattttgaacctg

SEQ ID NO: 2284 - DNA, 50 bp, Homo sapiens
catgcaaataaaaagaatgggacctaaactcgtgccgctcgtgccgaatt

SEQ ID NO: 2285 - DNA, 50 bp, Homo sapiens
ggattgcccatccatctgcttacaattccctgctgtcgtcttagcaagaa

SEQ ID NO: 2286 - DNA, 50 bp, Homo sapiens
gagcactggattgctttcccattatgagcgtccttcatctgggcagaccc

SEQ ID NO: 2287 - DNA, 50 bp, Homo sapiens; identical to SEQ ID NO: 1765

SEQ ID NO: 2288 - DNA, 50 bp, Homo sapiens; identical to SEQ ID NO: 1772

SEQ ID NO: 2289 - DNA, 50 bp, Homo sapiens; identical to SEQ ID NO: 1572

SEQ ID NO: 2290 - DNA, 50 bp, Homo sapiens
gacatgcgggctgggcagctgttagagtccaacgtggggcagcacagaga

SEQ ID NO: 2291 - DNA, 50 bp, Homo sapiens
accaaaattcagtgaaggcattctacaagttttgagttagcattacattt

SEQ ID NO: 2292 - DNA, 50 bp, Homo sapiens
taacactgcatcggatgcggggcgtggaggcaccgctgtattaaaggaag

SEQ ID NO: 2293 - DNA, 50 bp, Homo sapiens
tccatcgagcacgtctgaaacccctggtagccccgacttctttttaatta

SEQ ID NO: 2294 - DNA, 50 bp, Homo sapiens
cagtcactggtgtcaccctggataggcaagggataactcttctaacacaa

SEQ ID NO: 2295 - DNA, 50 bp, Homo sapiens
gggaagcactcgtgtgcaacagacaagtgactgtatctgtgtagactatt

SEQ ID NO: 2296 - DNA, 50 bp, Homo sapiens
tctatgagctttgtcagtgcgcgtagatgtcaataaatgttacatacaca

SEQ ID NO: 2297 - DNA, 50 bp, Homo sapiens
atatggtgctgttttctacccttggaaagaaatgtagatgatatgtttcg

SEQ ID NO: 2298 - DNA, 50 bp, Homo sapiens
ttgctaggcgagatagggggaagacagatatgggtgtttttaataaatct

SEQ ID NO: 2299 - DNA, 50 bp, Homo sapiens
aagttgcttcctaacatccttggactgagaaattatacttacttctggca

SEQ ID NO: 2300 - DNA, 50 bp, Homo sapiens
ctcaggcaaagaaaatgaaatgcatatttgcaaagtgtattaggaagtgt

SEQ ID NO: 2301 - DNA, 50 bp, Homo sapiens
tggaagagaggaataaataattcacctatatgtgtttgaggttgtgacag

SEQ ID NO: 2302 - DNA, 50 bp, Homo sapiens
gcctgagcaaagggcctgcccagacaagattttttaattgtttaaaaacc

SEQ ID NO: 2303 - DNA, 50 bp, Homo sapiens
aaatgacacatctgtgcaatagaatgatgtctgctctagggaaaccttca

SEQ ID NO: 2304 - DNA, 50 bp, Homo sapiens
atatttttatttgtttcagttcagataattggcaactgggtgaatctggc

SEQ ID NO: 2305 - DNA, 50 bp, Homo sapiens
ttcccaggaccgaacaagttccagaaaagactgaagaataatcacaattc

SEQ ID NO: 2306 - DNA, 50 bp, Homo sapiens
ttccttatctccctcagacgcagagtttttagtttctctagaaattttgt

SEQ ID NO: 2307 - DNA, 50 bp, Homo sapiens
ttttggaggggtttatgctcaatccatgttctatttcagtgccaataaaa

SEQ ID NO: 2308 - DNA, 50 bp, Homo sapiens
cattgagtggcgcagagccgggtttcatctggaattaactggatggaagg

SEQ ID NO: 2309 - DNA, 50 bp, Homo sapiens
tggaaattcccgtgttgcttcaaactgagacagatgggacttaacaggca

SEQ ID NO: 2310 - DNA, 50 bp, Homo sapiens; identical to SEQ ID NO: 2309

SEQ ID NO: 2311 - DNA, 50 bp, Homo sapiens
cgtcctgcggagccctgtctcctctctctgtaataaactcatttctagcc

SEQ ID NO: 2312 - DNA, 50 bp, Homo sapiens
tttccctgattatgatgagcttccattgttctgttaagtcttgaagagga

SEQ ID NO: 2313 - DNA, 50 bp, Homo sapiens
caaatgcaacctcacaaccttggctgagtcttgagactgaaagatttagc

SEQ ID NO: 2314 - DNA, 50 bp, Homo sapiens; identical to SEQ ID NO: 1862

SEQ ID NO: 2315 - DNA, 50 bp, Homo sapiens
tctgtcatgcccacaatccctttctaaggaagactgccctactatagcag

SEQ ID NO: 2316 - DNA, 50 bp, Homo sapiens
ggagaaataggaatttgtgaacccctaaaattgtagcaactttgaaaggt

SEQ ID NO: 2317 - DNA, 50 bp, Homo sapiens
acaagagtatccacaaaataggttggcactgactatatctctgcttgact

SEQ ID NO: 2318 - DNA, 50 bp, Homo sapiens
gccctcctgaaacttacacacaaaacgttaagtgatgaacattaaatagc

SEQ ID NO: 2319 - DNA, 50 bp, Homo sapiens
aaaccatctactatatgttagacatgacattctttttctctccttcctga

SEQ ID NO: 2320 - DNA, 50 bp, Homo sapiens
gtgtatctcgtggaatcagtggttagcattgccgctattatatttactca

SEQ ID NO: 2321 - DNA, 50 bp, Homo sapiens
ttgtgatgttaagaaatttgtatggtgtggcagtggtctattcctaagga

SEQ ID NO: 2322 - DNA, 50 bp, Homo sapiens
cggatgactgaccaagaggctattcaagatctctggcagtggaggaagtc

SEQ ID NO: 2323 - DNA, 50 bp, Homo sapiens
cctaaatctgtgtgtgtattgtgaagtggtataagaaatgactttgaacc

SEQ ID NO: 2324 - DNA, 50 bp, Homo sapiens
caggctgaggtggaccaagaaggcaaccaagtccccagaggagacccgcg

SEQ ID NO: 2325 - DNA, 50 bp, Homo sapiens
gaatgtagggaagaggtgccaagccaaccgtggggttagctctaattatt

SEQ ID NO: 2326 - DNA, 50 bp, Homo sapiens
acggggatgtcagggaggcaagtgtgttgtgttactgtgtcaataaactg

SEQ ID NO: 2327 - DNA, 50 bp, Homo sapiens
ggcagaatgggccaaaagcttagtgttgtgacctgtttttaaaataaagt

SEQ ID NO: 2328 - DNA, 50 bp, Homo sapiens
caagatggggtgggggatattgagggagacagcgctaaggatggttttat

SEQ ID NO: 2329 - DNA, 50 bp, Homo sapiens
taggcttctatttcctttccacccactcttcacaggctattctactttaa

SEQ ID NO: 2330 - DNA, 50 bp, Homo sapiens
ggtaaccaggtccaatcagtaaaaataagctgcttataactggaaatggc

SEQ ID NO: 2331 - DNA, 50 bp, Homo sapiens
tctgttttaagtaacagaattgataactgagcaaggaaacgtaatttgga

SEQ ID NO: 2332 - DNA, 50 bp, Homo sapiens
tgcctttaattgttctcataatgaagaataagtaggtaccctccatgccc

SEQ ID NO: 2333 - DNA, 50 bp, Homo sapiens
tgccattaagcaggaatgtcatgttccagttcattacaaaagaaaacaat

SEQ ID NO: 2334 - DNA, 50 bp, Homo sapiens
acctgttttgtatacctgagagcctgctatgttcttcttttgttgatcca

SEQ ID NO: 2335 - DNA, 50 bp, Homo sapiens
ctgcttccttcagtttgtaaagtcggtgattatatttttgggggctttcc

SEQ ID NO: 2336 - DNA, 50 bp, Homo sapiens
agcatacttcttttttccagtttcaatctaactgtgaaagaaacttctga

SEQ ID NO: 2337 - DNA, 50 bp, Homo sapiens
gaactctaacacttctctcctccactctgagccccctgaccttccaaacc

SEQ ID NO: 2338 - DNA, 50 bp, Homo sapiens
ccagtgcgtgctgtctgtggagtgtgtctcatgctttcagatgtgcatat

SEQ ID NO: 2339 - DNA, 50 bp, Homo sapiens
ccctgccacatgggtccagtgttcatctgagcataactgtactaaatcct

SEQ ID NO: 2340 - DNA, 50 bp, Homo sapiens
tgcttaaggcaagagtttcagatttactgttgaaataaacccaactgttc

SEQ ID NO: 2341 - DNA, 50 bp, Homo sapiens
cctgacccctcccatccttcccatttcctttgatgttattttgttacagc

SEQ ID NO: 2342 - DNA, 50 bp, Homo sapiens
taagtccctgctgcccttccccttcccacactgtccattcttcctcccat

SEQ ID NO: 2343 - DNA, 50 bp, Homo sapiens
tgatgtgattgtagctttttaaactatgaaacccctgagagattgtacct

SEQ ID NO: 2344 - DNA, 50 bp, Homo sapiens
cccaaaggttcctaagcctggctgcaaagaagaatcaacagggacacttt

SEQ ID NO: 2345 - DNA, 50 bp, Homo sapiens
tagaagtttgctttttccctgcctgtcttggtcactaccacctcttccct

SEQ ID NO: 2346 - DNA, 50 bp, Homo sapiens
tgaccagcactgtctcagtttcactttcacatagatgtccctttcttggc

SEQ ID NO: 2347 - DNA, 50 bp, Homo sapiens
ctgcccatctcagcctcaccatcaccctgctaatgactgccagactgtgg

SEQ ID NO: 2348 - DNA, 50 bp, Homo sapiens
ttcctgaagctgttcccactcccagatggttttatcaatagcctagaggt

SEQ ID NO: 2349 - DNA, 50 bp, Homo sapiens
ggattacctttccttgtaaagaggatgctgccttaagaattgcatgttgt

SEQ ID NO: 2350 - DNA, 50 bp, Homo sapiens
gggtctttggtgtttttaaatgattgtttcttcttcatgcttttgcttgc

SEQ ID NO: 2351 - DNA, 50 bp, Homo sapiens
catggggcgggggcgggaccagggagaattaataaagttctggacttttg

SEQ ID NO: 2352 - DNA, 50 bp, Homo sapiens
atttaaagcacagtttgtttttctgtcacctatagagtgcaagaatgcac

SEQ ID NO: 2353 - DNA, 50 bp, Homo sapiens
cagcactgtctccagataggaacatgcacaaagcagttaattaggcagcc

SEQ ID NO: 2354 - DNA, 50 bp, Homo sapiens
ctcccctcccattcctctggtccctgccttggtcccttgcctgggaagag

SEQ ID NO: 2355 - DNA, 50 bp, Homo sapiens
aaggttggttaaaagatggcagaaagaagatgaaaataaataagcctggt

SEQ ID NO: 2356 - DNA, 50 bp, Homo sapiens
ctcatcaccggttctgtgcctgtgctctgttgtgttggagggaaggactg

SEQ ID NO: 2357 - DNA, 50 bp, Homo sapiens
tttgcttggcaacacgacttgaaataaataaaactttgtttcttaggaga

SEQ ID NO: 2358 - DNA, 50 bp, Homo sapiens
aaaagaaatctgtttcaacagatgaccgtgtacaataccgtgtggtgaaa

SEQ ID NO: 2359 - DNA, 50 bp, Homo sapiens
gacgccacacaccattttcagatgccgttgcaattaaatcttgccacact

SEQ ID NO: 2360 - DNA, 50 bp, Homo sapiens
atgttttagtaacagttggctgtaatcactcctcgccgtgtctggcactg

SEQ ID NO: 2361 - DNA, 50 bp, Homo sapiens
agttctgcgtttggcatcttcactctttccaaaatgtatctgtacatcag

SEQ ID NO: 2362 - DNA, 50 bp, Homo sapiens
tgtgtttgcagagctagtggatgtgtttgtctacaagtatgattgctgtt

SEQ ID NO: 2363 - DNA, 50 bp, Homo sapiens
aaatctggggaagaggttttatttacattttagggtgggtaagaaagcca

SEQ ID NO: 2364 - DNA, 50 bp, Homo sapiens
cagagcggaggctgggatctagcgagagagatgcagaagatgtgaagaaa

SEQ ID NO: 2365 - DNA, 50 bp, Homo sapiens
cgtttggaggggcggtttctggtagttgtggcttttatgctttcaaagaa

SEQ ID NO: 2366 - DNA, 50 bp, Homo sapiens
ggggtgggagggatggggagtcggttagtcattgatagaactactttgaa

SEQ ID NO: 2367 - DNA, 50 bp, Homo sapiens
tgcagaaacagaaaggttttcttctttttgcttcaaaaacattcttacat

SEQ ID NO: 2368 - DNA, 50 bp, Homo sapiens
agattaactgctggacctcctacctgcattatctcattctggcttccttg

SEQ ID NO: 2369 - DNA, 50 bp, Homo sapiens
ctttgtggttttaaagacaactgtgaaataaaattgtttcaccgcctggt

SEQ ID NO: 2370 - DNA, 50 bp, Homo sapiens
gaactcagctgggttggtgaattaactaatggaagacatgaaattgttcc

SEQ ID NO: 2371 - DNA, 50 bp, Homo sapiens
acgatgatggttacccttcatggacgtcttaatcttccacacacatcccc

SEQ ID NO: 2372 - DNA, 50 bp, Homo sapiens
ttcagttctaataatgtccttaaattttatttccagctcctgttccttgg

SEQ ID NO: 2373 - DNA, 50 bp, Homo sapiens
gcctttccattccatttattcacactgagtgtcctacaataaacttccgt

SEQ ID NO: 2374 - DNA, 50 bp, Homo sapiens
tgcattatccagaactgaagttgccctacttttaactttgaacttggcta

SEQ ID NO: 2375 - DNA, 50 bp, Homo sapiens
gcccagtaagacactcatgtggctagtgtttgccgaatgaaactcaactc

SEQ ID NO: 2376 - DNA, 50 bp, Homo sapiens
taagtcttatgccaaattcagtgctactcctcgttacatgacatacaact

SEQ ID NO: 2377 - DNA, 50 bp, Homo sapiens
aagtgagtggacagcctttgtgtgtatctctccaataaagctctgtgggc

SEQ ID NO: 2378 - DNA, 50 bp, Homo sapiens
tctccaagtctttggttgaagagaagatatatgactgttgagtgtgctct

SEQ ID NO: 2379 - DNA, 50 bp, Homo sapiens
ggggaattgtcgcctcctgctcttttgttactgagtgagataaggttgtt

SEQ ID NO: 2380 - DNA, 50 bp, Homo sapiens; identical to SEQ ID NO: 1624

SEQ ID NO: 2381 - DNA, 50 bp, Homo sapiens
cgggcactgggtggggcagggcacgagttatttaaaacagttacactgca

SEQ ID NO: 2382 - DNA, 50 bp, Homo sapiens
cggacatcttttccgttgcggtttgagaatgttcctataataaacccctc

SEQ ID NO: 2383 - DNA, 50 bp, Homo sapiens
tttggcctgttttgatgtatgtgtgaaacaatgttgtccaacaataaaca

SEQ ID NO: 2384 - DNA, 50 bp, Homo sapiens
agcgagctgctctgctatgtccttaagccaatatttactcatcaggtcat

SEQ ID NO: 2385 - DNA, 50 bp, Homo sapiens
tgtagttggggtagattatgatttaggaagcaaaagtaagaagcagcatt

SEQ ID NO: 2386 - DNA, 50 bp, Homo sapiens
gcgatggacagactcacaacctgaacctaggagtgccccattcttttgta

SEQ ID NO: 2387 - DNA, 50 bp, Homo sapiens
gctcaggagggtacaagctccagaacagtaaccaagtgggaaaataaaga

SEQ ID NO: 2388 - DNA, 50 bp, Homo sapiens
ctggattcatgcagccagctttgcaggttatcagagatcaaagattgtaa

SEQ ID NO: 2389 - DNA, 50 bp, Homo sapiens; identical to SEQ ID NO: 1809

SEQ ID NO: 2390 - DNA, 50 bp, Homo sapiens
ctgtggaaaaatatttaagatagttttgccagaacagtttgtacagacgt

SEQ ID NO: 2391 - DNA, 50 bp, Homo sapiens
actctcaaataattaaaaaggactgtattgttgaacagagggacaattgt

SEQ ID NO: 2392 - DNA, 50 bp, Homo sapiens
aactcatgggaataattgtgagtcagcgtaacatttcaagagtctaaagg

SEQ ID NO: 2393 - DNA, 50 bp, Homo sapiens
tgctcctgttctgtcacttgtcatggtctttcttggtattaaaggccacc

SEQ ID NO: 2394 - DNA, 50 bp, Homo sapiens
ggggttgtaaatatcaactattcaacagtttaggatgcaattacgagtgt

SEQ ID NO: 2395 - DNA, 50 bp, Homo sapiens
aatcttatgtttccaagagaactaaagctggagagacctgacccttctct

SEQ ID NO: 2396 - DNA, 50 bp, Homo sapiens
tgcaccaggtgttggaaaaacacaattatggtaaaataaagtgttctcct

SEQ ID NO: 2397 - DNA, 50 bp, Homo sapiens
aatgggcacacagggaacaggaaatgggaatgagagcaagggttgggttg

SEQ ID NO: 2398 - DNA, 50 bp, Homo sapiens
tcttcttcatctctgttttgctcttaaaaatataaaaaggcaattccccg

SEQ ID NO: 2399 - DNA, 50 bp, Homo sapiens
agatgtaacccaccttgaccataaattggcttttcatagtgctcagatgt

SEQ ID NO: 2400 - DNA, 50 bp, Homo sapiens
ctaggctctgggcacatttcctgttcttgaattctgctcctgaagagggt

SEQ ID NO: 2401 - DNA, 50 bp, Homo sapiens
taccctgcccctctttttcggtttgtttttattctttcatttttacaagg

SEQ ID NO: 2402 - DNA, 50 bp, Homo sapiens
gctgcctaacttatccatctttgaacttctgactacttgttgtatctgct

SEQ ID NO: 2403 - DNA, 50 bp, Homo sapiens
cctttaaaacaataaggcgctttcattttgcactctaacttaagagtttt

SEQ ID NO: 2404 - DNA, 50 bp, Homo sapiens
tcctgcctcctgcggctgttggatttgggaatgaccttggtgagagtctc

SEQ ID NO: 2405 - DNA, 50 bp, Homo sapiens
atactctgagctgtggactgaactggcagacacaacctgtacagattgaa

SEQ ID NO: 2406 - DNA, 50 bp, Homo sapiens
aaggaattatgtggtcagtgcattgttttttaaactggaaatcattttgt

SEQ ID NO: 2407 - DNA, 50 bp, Homo sapiens
tgctcttaaaaccagggagtcagatatatttgtaaggttaaatcattggt

SEQ ID NO: 2408 - DNA, 50 bp, Homo sapiens
gccaaaaatctgtcttgaaggcagctacactttgaagtggtctttgaata

SEQ ID NO: 2409 - DNA, 50 bp, Homo sapiens; identical to SEQ ID NO: 651

SEQ ID NO: 2410 - DNA, 50 bp, Homo sapiens
tgactatctgtaatggatcaattttggatatgactttgggtgggggtaaa

SEQ ID NO: 2411 - DNA, 50 bp, Homo sapiens; identical to SEQ ID NO: 1839

SEQ ID NO: 2412 - DNA, 50 bp, Homo sapiens
ggtagtgcctccaggggcagaggaaaagaagaagtgttactgcattttgt

SEQ ID NO: 2413 - DNA, 50 bp, Homo sapiens
atggtcagattagatgcaagaataaagcagttgtccgagtctaagtttct

SEQ ID NO: 2414 - DNA, 50 bp, Homo sapiens
tggtattctgttctgaagtctaggatatttttcagcctataaagccccct

SEQ ID NO: 2415 - DNA, 50 bp, Homo sapiens
acttacccagatgttgcttttgaaaagttgaaatgtgtaattgttttgga

SEQ ID NO: 2416 - DNA, 50 bp, Homo sapiens
agcggactcaggctccagctgtggctacaacatagggtttttatacaaga

SEQ ID NO: 2417 - DNA, 50 bp, Homo sapiens
ttattgtggcaaatgttgtctgacttactgtttcaacaaaccagaagaca

SEQ ID NO: 2418 - DNA, 50 bp, Homo sapiens
tggacagtagcattagaattgtggaaaaggaacacgcaaagggagaagtg

SEQ ID NO: 2419 - DNA, 50 bp, Homo sapiens
ctggtaaattttgtgcttatcttcaaggctggcttaagtataaaattgtt

SEQ ID NO: 2420 - DNA, 50 bp, Homo sapiens
ccctggctccttcagacacgtgcttgatgctgagcaagttcaataaagat

SEQ ID NO: 2421 - DNA, 50 bp, Homo sapiens
gttaacttccaggagttcctcattctggtgataaagatgggctggcagcc

SEQ ID NO: 2422 - DNA, 50 bp, Homo sapiens
cctgtctcgtggcaacaaggctatgttctgttaggagttaccttaaactg

SEQ ID NO: 2423 - DNA, 50 bp, Homo sapiens
agtcagatctttctccttgaatatctttcgataaacaacaaggtggtgtg

SEQ ID NO: 2424 - DNA, 50 bp, Homo sapiens; identical to SEQ ID NO: 1861

SEQ ID NO: 2425 - DNA, 50 bp, Homo sapiens
ccacgggtgatgcttccaggggttctggcgggagtctcagccgaagagag

SEQ ID NO: 2426 - DNA, 50 bp, Homo sapiens; identical to SEQ ID NO: 150

SEQ ID NO: 2427 - DNA, 50 bp, Homo sapiens
accagactgacaaatgtgtatcggatgcttttgttcagggctgtgatcgg

SEQ ID NO: 2428 - DNA, 50 bp, Homo sapiens; identical to SEQ ID NO: 1685

SEQ ID NO: 2429 - DNA, 50 bp, Homo sapiens
cgaagaagagccacagtgagggagatcccatccccttgtctgaactggag

SEQ ID NO: 2430 - DNA, 50 bp, Homo sapiens
gacctgatacggctccccagtacaccccacctcttccttgtaaatatgat

SEQ ID NO: 2431 - DNA, 50 bp, Homo sapiens
ctcaagcgtcctgggatctccttctccctcctgtcctgtccttgcccctc

SEQ ID NO: 2432 - DNA, 50 bp, Homo sapiens
cctcaagggaggagtgatcttcaccaccaagaagggccagcagttctgtg

SEQ ID NO: 2433 - DNA, 50 bp, Homo sapiens
tcctgtgtgtcatgttggtttttggtacttgtattgtcatttggagaaac

SEQ ID NO: 2434 - DNA, 50 bp, Homo sapiens
tcctgtgatggaaatacaactggtatcttcacttttttaggaattgggaa

SEQ ID NO: 2435 - DNA, 50 bp, Homo sapiens
aatttgcagtaaacttttaattaaatgctcatctggtaactcaacacccc

SEQ ID NO: 2436 - DNA, 50 bp, Homo sapiens
gctgcttttgaggagaaaatatatagctttggacacgaggaagatctaga

SEQ ID NO: 2437 - DNA, 50 bp, Homo sapiens
aaacgcttggagtgcttctgaatatacagaagttccatttaagggcaagt

SEQ ID NO: 2438 - DNA, 50 bp, Homo sapiens
tgcatcgtgtttctacctttagtaccttgccactcttttaaaacgctgct

SEQ ID NO: 2439 - DNA, 50 bp, Homo sapiens; identical to SEQ ID NO: 196

SEQ ID NO: 2440 - DNA, 50 bp, Homo sapiens
agacctttctttgggactgtgtggaccaaggagcttccatctagtgacaa

SEQ ID NO: 2441 - DNA, 50 bp, Homo sapiens
gctcagtaacataactgcttcttggagctttggaatattttatcctgtat

SEQ ID NO: 2442 - DNA, 50 bp, Homo sapiens; identical to SEQ ID NO: 1855

SEQ ID NO: 2443 - DNA, 50 bp, Homo sapiens
cgggccttgcatataaataacggagcatacagtgagcacatctagctgat

SEQ ID NO: 2444 - DNA, 50 bp, Homo sapiens
agagatgcctttgtttgatgagattcaaacttgatgctatgctttaaaat

SEQ ID NO: 2445 - DNA, 50 bp, Homo sapiens
agtcccattcttccttttcaatacctacccccaaatcttctcctaaccct

SEQ ID NO: 2446 - DNA, 50 bp, Homo sapiens
tgtcacactggctatcaaagaataagaaaattattgagtatgagtgtgtt

SEQ ID NO: 2447 - DNA, 50 bp, Homo sapiens
gcaaaacccagaagctaaaaagtcaataaacagaaagaatgattttgaga

SEQ ID NO: 2448 - DNA, 50 bp, Homo sapiens
ttgtgaccaaatgggcctcaaagattcagattgaaacaaacaaaaagctt

SEQ ID NO: 2449 - DNA, 50 bp, Homo sapiens
aaggttctattaaccacttctaagggtacacctccctccaaactactgca

SEQ ID NO: 2450 - DNA, 50 bp, Homo sapiens
gttgtatcacccccgagttagcatatcccaggctcgcagactcaacacag

SEQ ID NO: 2451 - DNA, 50 bp, Homo sapiens
ccacttgagtttgtcctccaagggtaggtgtctcatttgttctggcccct

SEQ ID NO: 2452 - DNA, 50 bp, Homo sapiens
tcctgtctctctcctccttactcttggataaataaacagcctgtgagcac

SEQ ID NO: 2453 - DNA, 50 bp, Homo sapiens
cctgaccctctttgaattaagtggactgtggcatgacattctgcaatact

SEQ ID NO: 2454 - DNA, 50 bp, Homo sapiens
tctaaactttattttcaaaagcttaaggcccaaatacaaacttctctgga

SEQ ID NO: 2455 - DNA, 50 bp, Homo sapiens
catggtgatagcctgaaagagctttcctcactagaaaccaaatggtgtaa

SEQ ID NO: 2456 - DNA, 50 bp, Homo sapiens
ggagaaggattagaaagttatgtggcagataaagaattccatgcacctct

SEQ ID NO: 2457 - DNA, 50 bp, Homo sapiens
acagtttttcttttgaatttagtatttgagatgagttgttgggacatgca

SEQ ID NO: 2458 - DNA, 50 bp, Homo sapiens
gatctagtctgttacaccatttagaactttcctcagccattatcagtcat

SEQ ID NO: 2459 - DNA, 50 bp, Homo sapiens
agcatggtaagttcccttagctatatgaattttggcatgtttcagagaga

SEQ ID NO: 2460 - DNA, 50 bp, Homo sapiens
acatttttattctttctactgagggcattgtctgttttctttgtaaatgc

SEQ ID NO: 2461 - DNA, 50 bp, Homo sapiens
aaaaggaaaaccgaattaggtccacttcaatgtccacctgtgagaaagga

SEQ ID NO: 2462 - DNA, 50 bp, Homo sapiens
cctatccccggatgtgtgagaataatgtgttcataaagcatggatctcgt

SEQ ID NO: 2463 - DNA, 50 bp, Homo sapiens
ccagtgtctattctgggttagagaagtgcttactaaggggttttctaata

SEQ ID NO: 2464 - DNA, 50 bp, Homo sapiens
gggtgatctgcttttatctaaatgcaaataaggatgtgttctctgagacc

SEQ ID NO: 2465 - DNA, 50 bp, Homo sapiens; identical to SEQ ID NO: 1748

SEQ ID NO: 2466 - DNA, 50 bp, Homo sapiens
gagccaatccactccttcctttctatcattcccctgcccacctccttcca

SEQ ID NO: 2467 - DNA, 50 bp, Homo sapiens; identical to SEQ ID NO: 184

SEQ ID NO: 2468 - DNA, 50 bp, Homo sapiens
gctgctgccaccgcttcctgcctgtcatttgaataaacagtgtttctatt

SEQ ID NO: 2469 - DNA, 50 bp, Homo sapiens
tgggactcatccaaaagggacgagaagaaagaagaaggaacctgattcgg

SEQ ID NO: 2470 - DNA, 50 bp, Homo sapiens
tcaagactgcctttatgctggatcatgtgctactggtataaagttctggc

SEQ ID NO: 2471 - DNA, 50 bp, Homo sapiens
gtacacccctcaaccctatgcagcctggagtgggcatcaataaaatgaac

SEQ ID NO: 2472 - DNA, 50 bp, Homo sapiens
ccatgagactgatccctggccactgaaaagctttcctgacaataaaaatg

SEQ ID NO: 2473 - DNA, 50 bp, Homo sapiens
ttgggaagtgaccatttctaggcttatacataatagcaataataaaggct

SEQ ID NO: 2474 - DNA, 50 bp, Homo sapiens
atgtggtaaaacccagaaagcatccatcatgaatgcaagatactttcaat

SEQ ID NO: 2475 - DNA, 50 bp, Homo sapiens
ttcacattgtattcagagttgatggttgtacatataagtgattgctggtt

SEQ ID NO: 2476 - DNA, 50 bp, Homo sapiens
gccactggtttctcagaatccaaagatcacatattctagtgtaacactgc

SEQ ID NO: 2477 - DNA, 50 bp, Homo sapiens
ctgtgctttttgcttgggataatggagtttttctttagaaacagtgccaa

SEQ ID NO: 2478 - DNA, 50 bp, Homo sapiens
tatcagactagtgacaagctcctggtcttgagatgtcttctcgttaagga

SEQ ID NO: 2479 - DNA, 50 bp, Homo sapiens
agggcttgaggtgaatttcattaaatggaataatatgatgccactttgca

SEQ ID NO: 2480 - DNA, 50 bp, Homo sapiens
ttgacctcccatttttactatttgccaatacctttttctaggaatgtgct

SEQ ID NO: 2481 - DNA, 50 bp, Homo sapiens
agcgggaaggattttgggtaaatctgagagctgcgataaagtcctaggtt

SEQ ID NO: 2482 - DNA, 50 bp, Homo sapiens
tgatgtttgatggacctatgaatctatttagggagacacagatggctggg

SEQ ID NO: 2483 - DNA, 50 bp, Homo sapiens
agccctgaggatgaacaacctcagagaagaggtggtttagagcaaggaaa

SEQ ID NO: 2484 - DNA, 50 bp, Homo sapiens; identical to SEQ ID NO: 1844

SEQ ID NO: 2485 - DNA, 50 bp, Homo sapiens; identical to SEQ ID NO: 1453

SEQ ID NO: 2486 - DNA, 50 bp, Homo sapiens
gcgggggtggacagggaggcagcttgtgaatttttgttttactgtttaac

SEQ ID NO: 2487 - DNA, 50 bp, Homo sapiens
aacttcagatacttgtgaacatgccttatatttgtccaacaactgtcaga

SEQ ID NO: 2488 - DNA, 50 bp, Homo sapiens
gaagggttggcctgcctggctggggaggtcagtaaactttgaatagtaag

SEQ ID NO: 2489 - DNA, 50 bp, Homo sapiens
aagatgtacccttcaggtgaacctggtatcagacccacagtacttgctgt

SEQ ID NO: 2490 - DNA, 50 bp, Homo sapiens; identical to SEQ ID NO: 1733

SEQ ID NO: 2491 - DNA, 50 bp, Homo sapiens
agtggaatgttctatccccacaagaaggattatatcttatagacttgtct

SEQ ID NO: 2492 - DNA, 50 bp, Homo sapiens
cccgtggccctggagcctcaataaagtgtccctttcattgactggagcag

SEQ ID NO: 2493 - DNA, 50 bp, Homo sapiens
ttatgcatttatcacttccaaatctaactttgcacaagtaacccatgtaa

SEQ ID NO: 2494 - DNA, 50 bp, Homo sapiens
tccgcactatataattcgcacacattaattagggtttatgtaccatacaa

SEQ ID NO: 2495 - DNA, 50 bp, Homo sapiens
gcttgtgaccattttgtatggcttgtctggaaacttctgtaaatcttatg

SEQ ID NO: 2496 - DNA, 50 bp, Homo sapiens
tgctgatttatgcaaagggctggcattctgatgcttttcaggtttaatcc

SEQ ID NO: 2497 - DNA, 50 bp, Homo sapiens
tgcattctggcagttcttttaggattataggttgcaaattatccaaatat

SEQ ID NO: 2498 - DNA, 50 bp, Homo sapiens
ccgacagcccagcctagcccacttgtcatccataaagcaagctcaacctt

SEQ ID NO: 2499 - DNA, 50 bp, Homo sapiens
tttgctgttagtcgggttagagttggctctacgcgaggtttgttaataaa

SEQ ID NO: 2500 - DNA, 50 bp, Homo sapiens
cagactgctagtgttctgtctaaaaaccagacaaggaaatacccttcttt

SEQ ID NO: 2501 - DNA, 50 bp, Homo sapiens
ttttccagtgaggtaaaataaggcataaatgcaggtaattattcccagct

SEQ ID NO: 2502 - DNA, 50 bp, Homo sapiens
ccggcacttctagtggtctcacctggaggcaagagggagggtacagagcc

SEQ ID NO: 2503 - DNA, 50 bp, Homo sapiens; identical to SEQ ID NO: 1701

SEQ ID NO: 2504 - DNA, 50 bp, Homo sapiens; identical to SEQ ID NO: 1264

SEQ ID NO: 2505 - DNA, 50 bp, Homo sapiens
tttccagcaagtatccaaccaacttggttctgcttcaataaatctttgga

SEQ ID NO: 2506 - DNA, 50 bp, Homo sapiens
atgacttgcatcccagctttccaccaaccaaattcaaacattcactgctt

SEQ ID NO: 2507 - DNA, 50 bp, Homo sapiens
tgtatgagactttttgttgcaaaggacacatttatcatattcattcacac

SEQ ID NO: 2508 - DNA, 50 bp, Homo sapiens
tgatctgtccagtgtcactctgtaccctcaacatatatcccttgtgcgat

SEQ ID NO: 2509 - DNA, 50 bp, Homo sapiens
aattcacccctcccacctctttcttcaattaatggaaaagcgttaaggga

SEQ ID NO: 2510 - DNA, 50 bp, Homo sapiens
ctcagtactttgcagaaaacaccaaacaaaaatgccattttaaaaaaggt

SEQ ID NO: 2511 - DNA, 50 bp, Homo sapiens
agccttcagtcagagctcaaaccttagtcaacaccagagaattcacatga

SEQ ID NO: 2512 - DNA, 50 bp, Homo sapiens
aaccctctaagaatacctgtttaagtcttgagtgttgaaaggaattgttt

SEQ ID NO: 2513 - DNA, 50 bp, Homo sapiens; identical to SEQ ID NO: 652

SEQ ID NO: 2514 - DNA, 50 bp, Homo sapiens
tcaggagtgggttgatttcagcacctacagtgtacagtcttgtattaagt

SEQ ID NO: 2515 - DNA, 50 bp, Homo sapiens
ccttcagttatactttcaatgaccttttgtgcatctgttaaggcaaaaca

SEQ ID NO: 2516 - DNA, 50 bp, Homo sapiens
aagtgaacaaaataagcaactaaatgagacctaataattggccttcgatt

SEQ ID NO: 2517 - DNA, 50 bp, Homo sapiens
cacaaccaaatttgatgcgatctgctcagtaatataatttgccattttta

SEQ ID NO: 2518 - DNA, 50 bp, Homo sapiens
acattgtaatagaaacagatttcccaaattccagcctggcatgaggtaat

SEQ ID NO: 2519 - DNA, 50 bp, Homo sapiens
cagactgaatagatcttaactgtctcctacatgtgtgttttcaaatgtgt

SEQ ID NO: 2520 - DNA, 50 bp, Homo sapiens
gatatcccagcggtggtacttcggagacacctgtctgcatctgactgagc

SEQ ID NO: 2521 - DNA, 50 bp, Homo sapiens
acactttcctctgcctttttctcttatatgtgggttcatggttcagttcg

SEQ ID NO: 2522 - DNA, 50 bp, Homo sapiens
agataatgtcaccagtcctcttccttcacttcttgttgtaattgcagcca

SEQ ID NO: 2523 - DNA, 50 bp, Homo sapiens
ccggcacacagggactaggtctagtgagaacatcaggagcagccagggat

SEQ ID NO: 2524 - DNA, 50 bp, Homo sapiens
catcgggttttgggtgtgtgttttcatagcgtggttactttctataatgc

SEQ ID NO: 2525 - DNA, 50 bp, Homo sapiens
atgtatttctttctgactagacttgtgatatgcgtgtgtttatgtacaga

SEQ ID NO: 2526 - DNA, 50 bp, Homo sapiens
gttctgtatcagttgaatttttgtgctcttttccctgtgtacgtggtggt

SEQ ID NO: 2527 - DNA, 50 bp, Homo sapiens
catttatgagttccatgatatgtggtctaagaaagaccaaacagatttct

SEQ ID NO: 2528 - DNA, 50 bp, Homo sapiens
aaatcggttgggtaccatgctttttctccccttcacgtttgcagttgatg

SEQ ID NO: 2529 - DNA, 50 bp, Homo sapiens
gttcatgttggaaagaatgaaaacaacttcaagttcataggcagccagcc

SEQ ID NO: 2530 - DNA, 50 bp, Homo sapiens
tgtcatttaaagacatcaggttcatctgtttactgagctagaaacatagt

SEQ ID NO: 2531 - DNA, 50 bp, Homo sapiens
atctggtgccaaatgaagatttttaggagtgattactaattatcaagggc

SEQ ID NO: 2532 - DNA, 50 bp, Homo sapiens
ttctgcactgggaggtgtaatacatcacaaagacaaagaaaacgcatact

SEQ ID NO: 2533 - DNA, 50 bp, Homo sapiens
agttgaaggaaaatgttcatgttcatatgtacttgtttgctatgactaca

SEQ ID NO: 2534 - DNA, 50 bp, Homo sapiens
cactggggaagtcaagaatggggcctggggctctcagggagaactgcttc

SEQ ID NO: 2535 - DNA, 50 bp, Homo sapiens
ccctagatacagcagtttatacccacacacctgtctacagtgtcattcaa

SEQ ID NO: 2536 - DNA, 50 bp, Homo sapiens
gaaagtgcttagctctctccctcctgacctctgggcagccagtcatcaaa

SEQ ID NO: 2537 - DNA, 50 bp, Homo sapiens
atcatgtatgcaatactttccccctttttgctttgctaaccaaagagcat

SEQ ID NO: 2538 - DNA, 50 bp, Homo sapiens
ctgctgtctcttcagtctgctccatccatcacccatttacccatctctca

SEQ ID NO: 2539 - DNA, 50 bp, Homo sapiens
tatagaaaatgtacagttgtgtgaatgtgaaataaatgtcctcaactccc

SEQ ID NO: 2540 - DNA, 50 bp, Homo sapiens
ggccgtgttcaaagagcaatattccagtaaatgcagactgctgcaaagct

SEQ ID NO: 2541 - DNA, 50 bp, Homo sapiens; identical to SEQ ID NO: 689

SEQ ID NO: 2542 - DNA, 50 bp, Homo sapiens
gaactgacttcaaaggcagcttctggacaggtggtgggaggggacccttc

SEQ ID NO: 2543 - DNA, 50 bp, Homo sapiens
ggagaggctctgtttccagccagttagttttctctgggagacttctctgt

SEQ ID NO: 2544 - DNA, 50 bp, Homo sapiens
tttctattccatacttctgcccacgttgttttctctcaaaatccattcct

SEQ ID NO: 2545 - DNA, 50 bp, Homo sapiens
cctgtacacagccgagcagcatttccgttgaaggacttgcatccccattg

SEQ ID NO: 2546 - DNA, 50 bp, Homo sapiens
ttgatgcttagtggaatgtgtgtctaacttgctctctgacatttagcaga

SEQ ID NO: 2547 - DNA, 50 bp, Homo sapiens
aagaagttaacatgaactcttgaagtcacaccagggcaactcttggaaga

SEQ ID NO: 2548 - DNA, 50 bp, Homo sapiens
ggtggatctccaaccaggccagagaagattctcacagaaggttttgaact

SEQ ID NO: 2549 - DNA, 50 bp, Homo sapiens; identical to SEQ ID NO: 63

SEQ ID NO: 2550 - DNA, 50 bp, Homo sapiens
ggttcgctctactatggagatcaacagttactgtgactgagtcggcccat

SEQ ID NO: 2551 - DNA, 50 bp, Homo sapiens
gctcacactcagcgtgggaccccgaatgttaagcaatgataataaagtat

SEQ ID NO: 2552 - DNA, 50 bp, Homo sapiens
ctgctcgcccctatcgctccagccaaggcgaagaagcacgaacgaatgtc

SEQ ID NO: 2553 - DNA, 50 bp, Homo sapiens
acctgccaccatgttttgtaatttgaggtcttgatttcaccattgtcggt

SEQ ID NO: 2554 - DNA, 50 bp, Homo sapiens
aacgaaaggaagttctgttggaagcatctgaagaaactggaaagagggtt

SEQ ID NO: 2555 - DNA, 50 bp, Homo sapiens
acatttacctgaatgttgtctgaggactgaactgtggactttactattca

SEQ ID NO: 2556 - DNA, 50 bp, Homo sapiens
aaatccagctgcagaaacagacaccccaatgctatttacatacagctcta

SEQ ID NO: 2557 - DNA, 50 bp, Homo sapiens
ccccgttcctcacttttcccttttcattcccaccccctagactttgattt

SEQ ID NO: 2558 - DNA, 50 bp, Homo sapiens
ttcaggcactaagaggggctggacctggcggcaggaagccaaagagactg

SEQ ID NO: 2559 - DNA, 50 bp, Homo sapiens
cgcaacaatccatctctcaagtagtgtatcacagtagtagcctccaggtt

SEQ ID NO: 2560 - DNA, 50 bp, Homo sapiens
cccaggctagggggctatagaaacatctagaaatagactgaaagaaaatc

SEQ ID NO: 2561 - DNA, 50 bp, Homo sapiens
acctacaaaaaagttactgtggtatctatgagttatcatcttagctgtgt

SEQ ID NO: 2562 - DNA, 50 bp, Homo sapiens
tggtgtttagtggataccacatcggaagtgattttctaaattggatttga

SEQ ID NO: 2563 - DNA, 50 bp, Homo sapiens
tcactatctttctgataacagaattgccaaggcagcgggatctcgtatct

SEQ ID NO: 2564 - DNA, 50 bp, Homo sapiens
gaaaagatggagaaaatgaacaggacatggggctcctggaaagaaagggc

SEQ ID NO: 2565 - DNA, 50 bp, Homo sapiens
gtggttttaggatgtcattctttgcagttcttcatcatgagacaagtctt

SEQ ID NO: 2566 - DNA, 50 bp, Homo sapiens
aagggtgaggatgagaagtggtcacgggatttattcagccttggtcagag

SEQ ID NO: 2567 - DNA, 50 bp, Homo sapiens
gagaagattcaggacctcttggtggactctggaaagttcatctacttaga

SEQ ID NO: 2568 - DNA, 50 bp, Homo sapiens
agtacaactggaagccaaaacaaggtggaagatgtcctgaattaagacgt

SEQ ID NO: 2569 - DNA, 50 bp, Homo sapiens
gttgctggcctaatgagcaatgttctcaattttcgttttcattttgctgt

SEQ ID NO: 2570 - DNA, 50 bp, Homo sapiens
acagacctccagaggggacttatggaaaagctgacacctaagtttaccaa

SEQ ID NO: 2571 - DNA, 50 bp, Homo sapiens; identical to SEQ ID NO: 1736

SEQ ID NO: 2572 - DNA, 50 bp, Homo sapiens
tggctttatgtccattttaccactgtttttatccaataaactaagtcggt

SEQ ID NO: 2573 - DNA, 50 bp, Homo sapiens; identical to SEQ ID NO: 688

SEQ ID NO: 2574 - DNA, 50 bp, Homo sapiens
cctttaaggttggaactttgaagttggagaaggtggaataaagttacacc

SEQ ID NO: 2575 - DNA, 50 bp, Homo sapiens
tgccttcgggttgtgctttagtctgtaaaattctaaaggagagctgctaa

SEQ ID NO: 2576 - DNA, 50 bp, Homo sapiens
gcaaaaacctgggaccagcccccttctcccacaaataaagcccaataaag

SEQ ID NO: 2577 - DNA, 50 bp, Homo sapiens
gtcatcggctttcagagggagaccacgggaatgttcagggaaacaatgtc

SEQ ID NO: 2578 - DNA, 50 bp, Homo sapiens
tgaattgcctgttcagggttccttatgcagagaaataaagcagattcagg

SEQ ID NO: 2579 - DNA, 50 bp, Homo sapiens
accaaccacctttccagccatagagattttaattagcccaactagaagcc

SEQ ID NO: 2580 - DNA, 50 bp, Homo sapiens
ctactttgtatgatgaccctgtcctccctcacccaggctgcagtgccatg

SEQ ID NO: 2581 - DNA, 50 bp, Homo sapiens
aaagaggagtggtttgtgacaagcggaatccaaatggcattcgagtggct

SEQ ID NO: 2582 - DNA, 50 bp, Homo sapiens
gaagagccatctcaacagaatcgcaccaaactatactttcaggatgaatt

SEQ ID NO: 2583 - DNA, 50 bp, Homo sapiens
tctgggttgtagagaactctttgtaagcaataaagtttggggtgatgaca

SEQ ID NO: 2584 - DNA, 50 bp, Homo sapiens
ctgctgtccactttccttcaggctctgtgaatacttcaacctgctgtgat

SEQ ID NO: 2585 - DNA, 50 bp, Homo sapiens
gcacctgctccaaaggcatctggcaagaaagcataagtggcaatcataaa

SEQ ID NO: 2586 - DNA, 50 bp, Homo sapiens; identical to SEQ ID NO: 1657

SEQ ID NO: 2587 - DNA, 50 bp, Homo sapiens
agctgccagaaagcacagatttgacccaagctatttatatgttataaagt

SEQ ID NO: 2588 - DNA, 50 bp, Homo sapiens; identical to SEQ ID NO: 1829

SEQ ID NO: 2589 - DNA, 50 bp, Homo sapiens
gatgaggctgacaaagttggggctgagaacacaatcacctattcacttct

SEQ ID NO: 2590 - DNA, 50 bp, Homo sapiens
tcctgcccccgccctgctgtatgatattaatgtggaaggtcatcaataaa

SEQ ID NO: 2591 - DNA, 50 bp, Homo sapiens
aaactgtaaatcataatgtaactgaagcataaacatcacatggcatgttt

SEQ ID NO: 2592 - DNA, 50 bp, Homo sapiens
acaaggacgctggctactgtctattaaaattctgatgtttctgtgaaatt

SEQ ID NO: 2593 - DNA, 50 bp, Homo sapiens
cttccttatggagctggagcagcccgcctagaacccagtctaatgagaac

SEQ ID NO: 2594 - DNA, 50 bp, Homo sapiens
tgcatctcattttgcctaaattggttctgtattcataaacactttccaca

SEQ ID NO: 2595 - DNA, 50 bp, Homo sapiens
agtgaagtctatgatgtgaaacactttgcctcctgtgtactgtgtcataa

SEQ ID NO: 2596 - DNA, 50 bp, Homo sapiens
ttgatgatgtaacttgaccttccagagttatggaaattttgtccccatgt

SEQ ID NO: 2597 - DNA, 50 bp, Homo sapiens
agctcacacgttccacccactgtccctcaaacaatgtcatttcagaaaga

SEQ ID NO: 2598 - DNA, 50 bp, Homo sapiens
ggaccacttttatttattgtcagacacttatttattgggatgtgagcccc

SEQ ID NO: 2599 - DNA, 50 bp, Homo sapiens
gggctgtacccaagctgatttctcatctggtcaataaagctgtttagacc

SEQ ID NO: 2600 - DNA, 50 bp, Homo sapiens
gctctgagggaaacgctgtctgctgccttcatacagatgctgattaaagt

SEQ ID NO: 2601 - DNA, 50 bp, Homo sapiens
ttttagctcaggaaaatatgtcaggctcaaaccacttctcaggcagttta

SEQ ID NO: 2602 - DNA, 50 bp, Homo sapiens
ttgttgaaccataaagtttgcaaagtaaaggttaagtatgaggtcaatgt

SEQ ID NO: 2603 - DNA, 50 bp, Homo sapiens
tgtggtttcagtctctgctagttcatattgcatgtttattttggacagtc

SEQ ID NO: 2604 - DNA, 50 bp, Homo sapiens
agcagaaattttgaagccagaaggacaacatatgaagcttaggagtgaag

SEQ ID NO: 2605 - DNA, 50 bp, Homo sapiens
actgcttcatctccttttgcgcttatttggaaattttagttatagtgttt

SEQ ID NO: 2606 - DNA, 50 bp, Homo sapiens
gagagagtacgggctcagcagccagaggaggccggtgaagtgcatcttct

SEQ ID NO: 2607 - DNA, 50 bp, Homo sapiens
cccagtcaccctcttggagcttccctgctttgaattaaagaccactcatg

SEQ ID NO: 2608 - DNA, 50 bp, Homo sapiens; identical to SEQ ID NO: 2607

SEQ ID NO: 2609 - DNA, 50 bp, Homo sapiens
ggagcgtggcacttacctttgtcccttgcttcattcttgtgagatgataa

SEQ ID NO: 2610 - DNA, 50 bp, Homo sapiens
gcatacacatgcactcagtgtggactgggaagcattactttgtagatgta

SEQ ID NO: 2611 - DNA, 50 bp, Homo sapiens
aagcctcaccattgacttcttccccccatcctcagacattaaagagcctg

SEQ ID NO: 2612 - DNA, 50 bp, Homo sapiens
ctgacctcggcccagcttggactgcacatctggcagctgaggagtcagtg

SEQ ID NO: 2613 - DNA, 50 bp, Homo sapiens
ggaagatcattaaggacggtgagcagcatgaagatctcaatgaagtagcc

SEQ ID NO: 2614 - DNA, 50 bp, Homo sapiens
ttacctctgtcttggctttcatgttattaaacgtatgcatgtgaagaagg

SEQ ID NO: 2615 - DNA, 50 bp, Homo sapiens
agttactggtctctttctgccgaatgttatgttttgcttttatctcacag

SEQ ID NO: 2616 - DNA, 50 bp, Homo sapiens
cacaaagtggcctttggggagaaagtcatgtatttgttcgcaattatgct

SEQ ID NO: 2617 - DNA, 50 bp, Homo sapiens
atttactccaagtcctctccccagctaccaccagtcccttactctgttct

SEQ ID NO: 2618 - DNA, 50 bp, Homo sapiens
gcccatccctgagccaggtaccaccattgtaaggaaacactttcagaaat

SEQ ID NO: 2619 - DNA, 50 bp, Homo sapiens
aggaccgacgcttctggagaaaatacctgcacctgagcttccatgccctg

SEQ ID NO: 2620 - DNA, 50 bp, Homo sapiens
ttcacaaagatttgcgttaatgaagactacacagaaaacctttctaggga

SEQ ID NO: 2621 - DNA, 50 bp, Homo sapiens
atacctgactttagagagagtaaaatgtgccaggagccataggaatatct

SEQ ID NO: 2622 - DNA, 50 bp, Homo sapiens; identical to SEQ ID NO: 679

SEQ ID NO: 2623 - DNA, 50 bp, Homo sapiens
acatccagaaagaaggacacttgtatgctagtctatggtcagttgaggaa

SEQ ID NO: 2624 - DNA, 50 bp, Homo sapiens
ttgactagtaaaagttactgcctagtctttttaccttaggcttacagaat

SEQ ID NO: 2625 - DNA, 50 bp, Homo sapiens
ttgcccaggccagttagaaaatcccttggggaactgtgatgaatattcca

SEQ ID NO: 2626 - DNA, 50 bp, Homo sapiens
ataatcacagttgtgttcctgacactcaataaacagtcactggaaagagt

SEQ ID NO: 2627 - DNA, 50 bp, Homo sapiens
tgaccggattccctcactgttgtatcttgaataaacgctgctgcttcatc

SEQ ID NO: 2628 - DNA, 50 bp, Homo sapiens
ccaaagttggagcttctattgccatgaaccatgcttacaaagaaagcact

SEQ ID NO: 2629 - DNA, 50 bp, Homo sapiens
gtgaactcctgcactggcatttggatgtgtgttaatgctatttgttttgt

SEQ ID NO: 2630 - DNA, 50 bp, Homo sapiens
gctgggtggaaactgctttgcactatcgtttgcttggtgtttgtttttaa

SEQ ID NO: 2631 - DNA, 50 bp, Homo sapiens
gcttgttatcagctttcagggccatggttcacattagaataaaaggtagt

SEQ ID NO: 2632 - DNA, 50 bp, Homo sapiens
ctttgccttgcagccacatggccccatcccagttggggaagccaggtgag

SEQ ID NO: 2633 - DNA, 50 bp, Homo sapiens
tgcgggttattgatttgttctttacaactattgttctcatatttctcaca

SEQ ID NO: 2634 - DNA, 50 bp, Homo sapiens
agttattagttctgctttagctttccaatatgctgtatagcctttgtcat

SEQ ID NO: 2635 - DNA, 50 bp, Homo sapiens
gctgttttcaacattgtatttggactatgcatgtgttttttccccattgt

SEQ ID NO: 2636 - DNA, 50 bp, Homo sapiens
aagtaaatgtacagtgatttgaaatacaataatgaaggcaatgcatggcc

SEQ ID NO: 2637 - DNA, 50 bp, Homo sapiens; identical to SEQ ID NO: 1636

SEQ ID NO: 2638 - DNA, 50 bp, Homo sapiens
tcttaagcaggtttgttttcagcactgatggaaaataccagtgttgggtt

SEQ ID NO: 2639 - DNA, 50 bp, Homo sapiens
ggggttggaaacttagcactttatatttatacagaacattcaggatttgt

SEQ ID NO: 2640 - DNA, 50 bp, Homo sapiens
acccgtgtgaatgtgaagaaaagcagtatgttactggttgttgttgttgt

SEQ ID NO: 2641 - DNA, 50 bp, Homo sapiens
ttgcactgtgagcaaatgctaatacagtaaatatattgtgtttgctgaca

SEQ ID NO: 2642 - DNA, 50 bp, Homo sapiens
aaatgaagtcacacaggacaattattcttatgcctaagttaacagtggat

SEQ ID NO: 2643 - DNA, 50 bp, Homo sapiens
gtcgctgcatatgtgactgtcatgagatcctacttagtatgatcctggct

SEQ ID NO: 2644 - DNA, 50 bp, Homo sapiens
aaggacaaaagttgttgccttcctaagaaccttctttaataaactcattt

SEQ ID NO: 2645 - DNA, 50 bp, Homo sapiens
ctgcattttgattctgaaaagaaagctggctttgcccatttcttattaaa

SEQ ID NO: 2646 - DNA, 50 bp, Homo sapiens
acctgtctgcataataaagctgatcatgttttgctacagtttgcaggtga

SEQ ID NO: 2647 - DNA, 50 bp, Homo sapiens
tactggtagatgtgctcattctccctgaaacatacccatcatattgtcct

SEQ ID NO: 2648 - DNA, 50 bp, Homo sapiens
aggaagcaatgtggttggacctggttaagggaaaggctgattacggaaat

SEQ ID NO: 2649 - DNA, 50 bp, Homo sapiens
aactaatactttgctgttgaaatgttgtgaaatgttaagtgtctggaaat

SEQ ID NO: 2650 - DNA, 50 bp, Homo sapiens
gagctttgtcacttgccacatggtgtcttccaacatgggagggatcagcc

SEQ ID NO: 2651 - DNA, 50 bp, Homo sapiens
ccctgttcactctacttagcatgtccctaccgagtctcttctccactgga

SEQ ID NO: 2652 - DNA, 50 bp, Homo sapiens
tgcacattgtttttcttctgacttccagaaataaaagtgtttccatggga

SEQ ID NO: 2653 - DNA, 50 bp, Homo sapiens
actaaaaaaggagaaattataataaattagccgtcttgcgcccctaggcc

SEQ ID NO: 2654 - DNA, 50 bp, Homo sapiens
acgacaaacctccttgtcaaagtgtgtaaaaataaaggattgctccatcc

SEQ ID NO: 2655 - DNA, 50 bp, Homo sapiens
ccactggggaagggaagtttcagtaacatgacactaaaatggcagagacg

SEQ ID NO: 2656 - DNA, 50 bp, Homo sapiens
aaagattggagctgaagacctaaagtgcttgctttttgcccgttgaccag

SEQ ID NO: 2657 - DNA, 50 bp, Homo sapiens
gaagtcagtgggaaacacacagaaatttattttaaaatctttcaggagct

SEQ ID NO: 2658 - DNA, 50 bp, Homo sapiens
agatgtattagaagtcctgactttcaagtgtaatttgctttggaggagga

SEQ ID NO: 2659 - DNA, 50 bp, Homo sapiens
ctgtgcagaagagctgccaggcagtgtcttagatgtgagacggaggccat

SEQ ID NO: 2660 - DNA, 50 bp, Homo sapiens
acatcatggagggtttagtgcttatctaatttgtgcctcactggacttgt

SEQ ID NO: 2661 - DNA, 50 bp, Homo sapiens
ttgcttaccaaaggaggcccaatttcactcaaatgttttgagaactgtgt

SEQ ID NO: 2662 - DNA, 50 bp, Homo sapiens
tcactcctctgtcctatgaagaccgctgccattggtgttgagaataataa

SEQ ID NO: 2663 - DNA, 50 bp, Homo sapiens
gttaagccaggacatccagaattcattgctttaataaagaacccaggccg

SEQ ID NO: 2664 - DNA, 50 bp, Homo sapiens
tcagttttaacaaatgctattaaagtggagaagcacactctggtcttgga

SEQ ID NO: 2665 - DNA, 50 bp, Homo sapiens
ctcactgcctctttgcagtaggggagagagcagagaagtacaggtcatct

SEQ ID NO: 2666 - DNA, 50 bp, Homo sapiens
ttgactttgctcgaggcaccttttttcctgtttctccttttctgttgtcg

SEQ ID NO: 2667 - DNA, 50 bp, Homo sapiens
aaatgggtttcactgtgaatgcgtgacaataagatattcccttgttccta

SEQ ID NO: 2668 - DNA, 50 bp, Homo sapiens
aacgaatttcctgaacctatcaaactggacaagaatgaccgggccaaggc

SEQ ID NO: 2669 - DNA, 50 bp, Homo sapiens
cttcccctggtcccctgtccctggggctgtttgttaaaaaagagtaataa

SEQ ID NO: 2670 - DNA, 50 bp, Homo sapiens
accgtgaaaattggtttcatttaacaaaagatcagatccctccttcagct

SEQ ID NO: 2671 - DNA, 50 bp, Homo sapiens
tttcttgttacacccactgcactctgcaaccagtgttgcctgcctcatgg

SEQ ID NO: 2672 - DNA, 50 bp, Homo sapiens
gggaaaaacaagaatttcatgactctacctgtggtctatctttaatttca

SEQ ID NO: 2673 - DNA, 50 bp, Homo sapiens
gctgtgcccttgaagagaatagtaatgatgggaatttagaggtttatgac

SEQ ID NO: 2674 - DNA, 50 bp, Homo sapiens
tccaaggaaatggtaacctgtttctgagaacacctgaaatcaatggctat

SEQ ID NO: 2675 - DNA, 50 bp, Homo sapiens
ttcattgtaatccactgttttggctttcatgaacaagtaaattacagtgt

SEQ ID NO: 2676 - DNA, 50 bp, Homo sapiens
acttatttccatgtttctgaatcttctttgtttcaaatggtgctgcatgt

SEQ ID NO: 2677 - DNA, 50 bp, Homo sapiens
atgcccggcctgggatgctgtttggagacggaataaatgttttctcattc

SEQ ID NO: 2678 - DNA, 50 bp, Homo sapiens
tactctaaacctgttatttctgtgctaataaacgagatgcagaacccttg

SEQ ID NO: 2679 - DNA, 50 bp, Homo sapiens
tgcagagagatactaagcagcaaaatcttggtgttgtgatgtacagaaat

SEQ ID NO: 2680 - DNA, 50 bp, Homo sapiens
agtctttgatcttgaaccgatacttttggatctcattgttgatatacctg

SEQ ID NO: 2681 - DNA, 50 bp, Homo sapiens
tggaatcaaataaaatgcttccactaccaaaagacattagagaaaacctt

SEQ ID NO: 2682 - DNA, 50 bp, Homo sapiens
tgccgaataccttaaagtaactaattatccttacacacaaaaggctcagt

SEQ ID NO: 2683 - DNA, 50 bp, Homo sapiens
ctttcccaggatcaaggccacagggaggaagattgcacgggcactgttct

SEQ ID NO: 2684 - DNA, 50 bp, Homo sapiens
cttgtaaactagcgccaaggaactgcagcaaataaactccaactctgccc

SEQ ID NO: 2685 - DNA, 50 bp, Homo sapiens; identical to SEQ ID NO: 1846

SEQ ID NO: 2686 - DNA, 50 bp, Homo sapiens
aggagggtttaaatagggttcagagatcataggaatattaggagttacct

SEQ ID NO: 2687 - DNA, 50 bp, Homo sapiens
tggtggaagtaaaaactggtaactcactcaagtgaatgaatggtcttgca

SEQ ID NO: 2688 - DNA, 50 bp, Homo sapiens
gcaggaaagggaaacagacgcgacagcaacaagagcaccagaagtatatg

SEQ ID NO: 2689 - DNA, 50 bp, Homo sapiens
tccattctgtttcggattttaagtttgagagacttgctaatgaatctcct

SEQ ID NO: 2690 - DNA, 50 bp, Homo sapiens
ccttcagaaacaccgtaattctaaataaacctcttcccatacacctttcc

SEQ ID NO: 2691 - DNA, 50 bp, Homo sapiens
ctggacaactttgagtactgacatcattgataaataaactggcttgtggt

SEQ ID NO: 2692 - DNA, 50 bp, Homo sapiens
cccaggggattttttaagtagatggggggacacggtgaactggctgtgtc

SEQ ID NO: 2693 - DNA, 50 bp, Homo sapiens
actccaaaataaatcaaggctgcaatgcagctggtgctgttcagattcca

SEQ ID NO: 2694 - DNA, 50 bp, Homo sapiens
tgaaatcttaagtgtcttatatgtaatcctgtaggttggtacttccccca

SEQ ID NO: 2695 - DNA, 50 bp, Homo sapiens
tgggagtcttctcttttagacaggggctttttgtttttaaccccaattgt

SEQ ID NO: 2696 - DNA, 50 bp, Homo sapiens
tgacccagatatggaaacagaagacaaaattgtaagccagagtcaacaaa

SEQ ID NO: 2697 - DNA, 50 bp, Homo sapiens
aggtttcatcaggtggttaaagtcgtcaaagttgtaagtgactaaccaag

SEQ ID NO: 2698 - DNA, 50 bp, Homo sapiens
atgctgtcaaagttacagtttacgcaggacattcttgccgtattctcatg

SEQ ID NO: 2699 - DNA, 50 bp, Homo sapiens
tgtgtgtttactaacccttccctgaggcttgtgtatgttggatattgtgg

SEQ ID NO: 2700 - DNA, 50 bp, Homo sapiens
tctgtaatcaaatgattggtgtcattttcccatttgccaatgtagtctca

SEQ ID NO: 2701 - DNA, 50 bp, Homo sapiens
tgcccagcagccatcttaatacattaaaccagtttaaaaaataccttcca

SEQ ID NO: 2702 - DNA, 50 bp, Homo sapiens
gccagagttgccaacccccggctggataccttcagcagagaaatcttccg

SEQ ID NO: 2703 - DNA, 50 bp, Homo sapiens
aatccattaacacctgctcacatcttactcaaaattgtagagttcatagt

SEQ ID NO: 2704 - DNA, 50 bp, Homo sapiens
atttgcaatttggaatttgtgtgagttgatttagtaaaatgttaaaccgc

SEQ ID NO: 2705 - DNA, 50 bp, Homo sapiens
aagtaaagcctcaggaatgcccacgcctttcttccaaagcctttgtctct

SEQ ID NO: 2706 - DNA, 50 bp, Homo sapiens
tcaaacaaatgactttcatattgcaacaatctttgtaagaaccactcaaa

SEQ ID NO: 2707 - DNA, 50 bp, Homo sapiens
ggggaatgtgttccttcattgtatttgggccttttgtattgcactcttga

SEQ ID NO: 2708 - DNA, 50 bp, Homo sapiens
ttgtttacctttcgtgcggtggattctttttaactccgtctacctggcgt

SEQ ID NO: 2709 - DNA, 50 bp, Homo sapiens
ggggtttgtgctatacactgggatgtctaattgcagcaataaagcctttc

SEQ ID NO: 2710 - DNA, 50 bp, Homo sapiens; identical to SEQ ID NO: 1614

SEQ ID NO: 2711 - DNA, 50 bp, Homo sapiens
agcctgcttctgccacacctcgctctcagtctctccacatttccatagag

SEQ ID NO: 2712 - DNA, 50 bp, Homo sapiens
aagtttctcagctcccatttctactctcccatggcttcatgcttctttca

SEQ ID NO: 2713 - DNA, 50 bp, Homo sapiens
gagctactgtgctcatctaaagtgtttgccccacttcccaccccgtctcc

SEQ ID NO: 2714 - DNA, 50 bp, Homo sapiens
atgttaagatttgtgtacaaattgaaatgtctgtactgatcctcaaccaa

SEQ ID NO: 2715 - DNA, 50 bp, Homo sapiens
tctgttgatagctggagaactttagtttcaagtactacattgtgaaagca

SEQ ID NO: 2716 - DNA, 50 bp, Homo sapiens
tgaggggtttcagaattttgcattgcagtcatagaagagatttatttcct

SEQ ID NO: 2717 - DNA, 50 bp, Homo sapiens
ccttgggagggagacttcatgtggtttattgcgagttttttgtttacttt

SEQ ID NO: 2718 - DNA, 50 bp, Homo sapiens
gtatgttaatgccagtcaccagcaggctatttcaaggtcagaagtaatga

SEQ ID NO: 2719 - DNA, 50 bp, Homo sapiens
gcccctaaaggcaagaagaaaaagtaaaagaccttggctcatagaaagtc

SEQ ID NO: 2720 - DNA, 50 bp, Homo sapiens
agtgaaatatgttacagaacatgcacttgccctaataaaaaatcagtgaa

SEQ ID NO: 2721 - DNA, 50 bp, Homo sapiens
tgcagatgctcttaaaagcattgataacctttgtgacgaacataaagaga

SEQ ID NO: 2722 - DNA, 50 bp, Homo sapiens
gctagttcatgtgttctccattcttgtgagcatcctaataaatctgttcc

SEQ ID NO: 2723 - DNA, 50 bp, Homo sapiens
aaccctcccaatatccctagcagcagcagcaaaccaaagtcaaagtatcc

SEQ ID NO: 2724 - DNA, 50 bp, Homo sapiens
cacctccccctacccatatccctcccgtgtgtggttggaaaacttttgtt

SEQ ID NO: 2725 - DNA, 50 bp, Homo sapiens
gagtcctgagccactgccaacatttcccttcttccagttgcactattctg

SEQ ID NO: 2726 - DNA, 50 bp, Homo sapiens
ccccaccccagaacagaaccgtgtctctgataaaggttttgaagtgaata

SEQ ID NO: 2727 - DNA, 50 bp, Homo sapiens
cccatttcttgtttttaaaagaccaacaaatctcaagccctataaatggc

SEQ ID NO: 2728 - DNA, 50 bp, Homo sapiens
agtgtagcttctgaaaggtgctttctccatttatttaaaactacccatgc

SEQ ID NO: 2729 - DNA, 50 bp, Homo sapiens
gagtgcccgattcctcttagagaaaatccatagccttcagatcttggtgt

SEQ ID NO: 2730 - DNA, 50 bp, Homo sapiens
actttgacacctactgtgttataaaatatatcatcagatgtgccttgaga

SEQ ID NO: 2731 - DNA, 50 bp, Homo sapiens; identical to SEQ ID NO: 1697

SEQ ID NO: 2732 - DNA, 50 bp, Homo sapiens
tgatattcaactctgagcatcaggttctaaaaaataatacatactggggt

SEQ ID NO: 2733 - DNA, 50 bp, Homo sapiens
gtcatctccccatttggtcccctggactgtctttgttgattctaacttgt

SEQ ID NO: 2734 - DNA, 50 bp, Homo sapiens
gagaataatgatgtaccaataagtggagattcctccttatgatgtatgct

SEQ ID NO: 2735 - DNA, 50 bp, Homo sapiens
acaagacagactccactcaaaatttatatgaacaccactagatacttcct

SEQ ID NO: 2736 - DNA, 50 bp, Homo sapiens
tccataccattgtgtgtggaggatttacagctaagctgtagttgcagagt

SEQ ID NO: 2737 - DNA, 50 bp, Homo sapiens
acacttttgattgttttctagatgtctaccaataaatgcaatttgtgacc

SEQ ID NO: 2738 - DNA, 50 bp, Homo sapiens
actgtacaatttctgaagatggttattaacactgtgctgttaagcatcca

SEQ ID NO: 2739 - DNA, 50 bp, Homo sapiens
tcagtcctttcttagggaaatgacagggcaaagcaatttttctgttggct

SEQ ID NO: 2740 - DNA, 50 bp, Homo sapiens
agtacaaggcccgaagggtagtgatggtgctaaactcaacatggatttgg

SEQ ID NO: 2741 - DNA, 50 bp, Homo sapiens
ccccagtctgcaaaagaagcacaattctattgctttgtcttgcttatagt

SEQ ID NO: 2742 - DNA, 50 bp, Homo sapiens; identical to SEQ ID NO: 256

SEQ ID NO: 2743 - DNA, 50 bp, Homo sapiens; identical to SEQ ID NO: 1718

SEQ ID NO: 2744 - DNA, 50 bp, Homo sapiens
ccttctttcacaggcatcaggaattgtcaaatgatgattatgagttccct

SEQ ID NO: 2745 - DNA, 50 bp, Homo sapiens
catcttcagcatcgtcttcttgcacatgaaggagaaggagaagtccgact

SEQ ID NO: 2746 - DNA, 50 bp, Homo sapiens
gggaatgctgcaaatgccaaacagctttatgatttcattcacacctcttt

SEQ ID NO: 2747 - DNA, 50 bp, Homo sapiens
ttaaaaatggttgtttaagactttaacaatgggaaccccttgtgagcatg

SEQ ID NO: 2748 - DNA, 50 bp, Homo sapiens
gggagaagtttgcagagcacttcccacctctctgaatagtgtgtatgtgt

SEQ ID NO: 2749 - DNA, 50 bp, Homo sapiens
tggttgacccttgtatgtcacagctctgctctatttattattattttgca

SEQ ID NO: 2750 - DNA, 50 bp, Homo sapiens
tgggaaggaaggctctgtcttcaactctttgaccctccatgtgtaccata

SEQ ID NO: 2751 - DNA, 50 bp, Homo sapiens; identical to SEQ ID NO: 1777

SEQ ID NO: 2752 - DNA, 50 bp, Homo sapiens
ctccccgtgctaaggcccacaaaagccaggactctctgtgcgtgaccctc

SEQ ID NO: 2753 - DNA, 50 bp, Homo sapiens
aattcaagaagaaaaacccaagaagaagaagaaggcacaggaggatctct

SEQ ID NO: 2754 - DNA, 50 bp, Homo sapiens
tcccagagctgatgctattgtacttgcacattggagactgaaaggaaaga

SEQ ID NO: 2755 - DNA, 50 bp, Homo sapiens
ggggaagccgaaggttacaaaggcaaagaaggcagctccgaagaaaaagt

SEQ ID NO: 2756 - DNA, 50 bp, Homo sapiens
tccctgaagaaatatctgtgaaccttctttctgttcagtcctaaaattcg

SEQ ID NO: 2757 - DNA, 50 bp, Homo sapiens
cctctccgaccttcatcactattcttaggataatgctggcgggcagagat

SEQ ID NO: 2758 - DNA, 50 bp, Homo sapiens
actgccatcttacgactatttcttctttttaatacacttaactcaggcca

SEQ ID NO: 2759 - DNA, 50 bp, Homo sapiens
agggtgtttcgttccctttaaatgaatcaacactgccaccttctgtacga

SEQ ID NO: 2760 - DNA, 50 bp, Homo sapiens; identical to SEQ ID NO: 130

SEQ ID NO: 2761 - DNA, 50 bp, Homo sapiens
catttcctgagaccaccagagagaggggagaagcctgggattgacagaag

SEQ ID NO: 2762 - DNA, 50 bp, Homo sapiens; identical to SEQ ID NO: 2761

SEQ ID NO: 2763 - DNA, 50 bp, Homo sapiens
gctaagaagcctataagaggaatttcttttccttcattcatagggaaagg

SEQ ID NO: 2764 - DNA, 50 bp, Homo sapiens
actgacagagtgaactacagaaatagcttttcttcctaaaggggattgtt

SEQ ID NO: 2765 - DNA, 50 bp, Homo sapiens
cagacaatggatgtggggtagaagaagaaaactttgaaggcttaatctct

SEQ ID NO: 2766 - DNA, 50 bp, Homo sapiens
aaaagaagaggaaaagtttagccaagagaatcagagaaagatgctgcatt

SEQ ID NO: 2767 - DNA, 50 bp, Homo sapiens
agtgcacatatttcataaccaaattagcagcaccggtcttaatttgatgt

SEQ ID NO: 2768 - DNA, 50 bp, Homo sapiens
tagacctctttttcttaccagtctcctcccctactctgccccctaagctg

SEQ ID NO: 2769 - DNA, 50 bp, Homo sapiens
agcacagtaaaagtaaagactattctgtttctaggctgttgaatcaaagt

SEQ ID NO: 2770 - DNA, 50 bp, Homo sapiens
catgggcacagtggtgacccccttgattcccaccgtacaaccccctccac

SEQ ID NO: 2771 - DNA, 50 bp, Homo sapiens
cgttatccagtgtgaaaatcagtgagtcctccctggcatcctcgtgaaag

SEQ ID NO: 2772 - DNA, 50 bp, Homo sapiens
gctgaagagtatagtaaagacacctcaaaaggcatgggagggtattatgc

SEQ ID NO: 2773 - DNA, 50 bp, Homo sapiens
ttcagactggtttctgttttttggttattaaaatggtttcctattttgct

SEQ ID NO: 2774 - DNA, 50 bp, Homo sapiens
tttatgattaggtgacgagttgacattgagattgtccttttcccctgatc

SEQ ID NO: 2775 - DNA, 50 bp, Homo sapiens
ccccaaccaggtccgtatgcggtaccttttaaaggttcagtttaatttcc

SEQ ID NO: 2776 - DNA, 50 bp, Homo sapiens
tcctgcaaggctggactgtgatcttcaatcatcctgcccatctctggtac

SEQ ID NO: 2777 - DNA, 50 bp, Homo sapiens
ggtcacggctactcatggaagcaggaccagtaagggaccttcgattaaaa

SEQ ID NO: 2778 - DNA, 50 bp, Homo sapiens
ccttctaacctgaactgatgggtttctccagagggaattgcagagtactg

SEQ ID NO: 2779 - DNA, 50 bp, Homo sapiens
atgtgtaggaggaagagttcaggtggaaaaggagggagctactctcaggc

SEQ ID NO: 2780 - DNA, 50 bp, Homo sapiens
aacgattgtctgcccatgtcctgcctgaaataccatgattgtttatggaa

SEQ ID NO: 2781 - DNA, 50 bp, Homo sapiens
ttccttttaggtatattgcgctaagtgaaacttgtcaaataaatcctcct

SEQ ID NO: 2782 - DNA, 50 bp, Homo sapiens
gtcttgactttggcaaatgagccggagccccttgggcaggtcacacaacc

SEQ ID NO: 2783 - DNA, 50 bp, Homo sapiens
gatacagagttgtccttggaggatggagacaggtgcaaggccaagatgtg

SEQ ID NO: 2784 - DNA, 50 bp, Homo sapiens
tcccatgatggaagtctgcgtaaccaataaattgtgcctttctcactcaa

SEQ ID NO: 2785 - DNA, 50 bp, Homo sapiens
tctacatgtcttgggggcgggctcaaattcttcgaaagtggttggattaa

SEQ ID NO: 2786 - DNA, 50 bp, Homo sapiens
acctgttatcctttgtagagcacacagagttaaaagttgaatatagcaat

SEQ ID NO: 2787 - DNA, 50 bp, Homo sapiens
tgagcttctccagcagtgcgggtcctgggctcctgaaggcttattccatc

SEQ ID NO: 2788 - DNA, 50 bp, Homo sapiens
gcatgtcctcatcctttcctgccataaaagctatgacacgagaatcagaa

SEQ ID NO: 2789 - DNA, 50 bp, Homo sapiens
acccctccccatgaacacaagggttttatcctttcctttaaaaacagtgt

SEQ ID NO: 2790 - DNA, 50 bp, Homo sapiens
tgcaaccaactatccaagtgttataccaactaaaacccccaataaacctt

SEQ ID NO: 2791 - DNA, 50 bp, Homo sapiens
atgcccagacaaaaagctaataccagtcactcgataataaagtattcgca

SEQ ID NO: 2792 - DNA, 50 bp, Homo sapiens
tggcactgagaaacatgcaagatacaggaaaaatgaaaatgttacaagct

SEQ ID NO: 2793 - DNA, 50 bp, Homo sapiens
tctcaaaggagtaactgcagcttggtttgaaatttgtactgtttctatca

SEQ ID NO: 2794 - DNA, 50 bp, Homo sapiens
gtcaacctttgtgagaagccgtatccacttcacaggataaaattgtccat

SEQ ID NO: 2795 - DNA, 50 bp, Homo sapiens
atctccacagcccacccatcccctgagcacactaaccacctcatgcaggc

SEQ ID NO: 2796 - DNA, 50 bp, Homo sapiens
tttcctgactcctccttgcaaacaaaatgatagttgacactttatcctga

SEQ ID NO: 2797 - DNA, 50 bp, Homo sapiens
cctgcagtaacccataggaaataaactgtagagttccatattctgcggcc

SEQ ID NO: 2798 - DNA, 50 bp, Homo sapiens
tagaaagggtttttatggaccaatgccccagttgtcagtcagagccgttg

SEQ ID NO: 2799 - DNA, 50 bp, Homo sapiens
tgtgatgacgtgagatcaataagaagaacctagtctagagacaatgatgc

SEQ ID NO: 2800 - DNA, 50 bp, Homo sapiens
gtgcttgctgtctctcccggacacccttaaagactgtctttttagcaaaa

SEQ ID NO: 2801 - DNA, 50 bp, Homo sapiens
aacattgtttttgtatattgggtgtagatttctgacatcaaaacttggac

SEQ ID NO: 2802 - DNA, 50 bp, Homo sapiens
tgtgtaactggattccttgcatggatcttgtatatagttttatttgctga

SEQ ID NO: 2803 - DNA, 50 bp, Homo sapiens
caggacctccaagccactgagcaatgtataaccccaaagggaattcaaaa

SEQ ID NO: 2804 - DNA, 50 bp, Homo sapiens
gatctgacccaccagtttgtacatcacgtcctgcatgtcccacaccattt

SEQ ID NO: 2805 - DNA, 50 bp, Homo sapiens; identical to SEQ ID NO: 1639

SEQ ID NO: 2806 - DNA, 50 bp, Homo sapiens
tgcgtcttgtgaaattgtgtagagtgtttgtgagctttttgttccctcat

SEQ ID NO: 2807 - DNA, 50 bp, Homo sapiens
cttcggcctccctggccctgggttaaaataaaagctttctggtgatcctg

SEQ ID NO: 2808 - DNA, 50 bp, Homo sapiens
tgagcttgtgcttagtatttacattggatgccagttttgtaatcactgac

SEQ ID NO: 2809 - DNA, 50 bp, Homo sapiens
atttgaaattttctgcagcattaaagctggcgcttaataagaataagtaa

SEQ ID NO: 2810 - DNA, 50 bp, Homo sapiens
tcgcattctgtttcttgctttaaaagaagagtaaagacaagagtgttgga

SEQ ID NO: 2811 - DNA, 50 bp, Homo sapiens; identical to SEQ ID NO: 618

SEQ ID NO: 2812 - DNA, 50 bp, Homo sapiens
ctgtcagccaaggtgcctgaaacgatacgtgtgcccactccactgtcaca

SEQ ID NO: 2813 - DNA, 50 bp, Homo sapiens; identical to SEQ ID NO: 1278

SEQ ID NO: 2814 - DNA, 50 bp, Homo sapiens
tcgatcagtgctcagagattgtgaaatgcagtgttagctccctgggattc

SEQ ID NO: 2815 - DNA, 50 bp, Homo sapiens
aggacaaatcttgttgtattaacagcagggtcacttctcattttctttgc

SEQ ID NO: 2816 - DNA, 50 bp, Homo sapiens
agtcgtattctgtcacataatattttgaagaaaacttggctgtcgaaaca

SEQ ID NO: 2817 - DNA, 50 bp, Homo sapiens
aggagggtgggtggaacaggtggactggagtttctcttgagggcaataaa

SEQ ID NO: 2818 - DNA, 50 bp, Homo sapiens; identical to SEQ ID NO: 2817

SEQ ID NO: 2819 - DNA, 50 bp, Homo sapiens
tgcacctcaagattttaaggagataatgtttttagagagaatttctgctt

SEQ ID NO: 2820 - DNA, 50 bp, Homo sapiens
gcttatggtccccagcatttacagtaacttgtgaatgttaagtatcatct

SEQ ID NO: 2821 - DNA, 50 bp, Homo sapiens
cttgttttgtttgtctctccttttcttttgttactgttcttgctgctaga

SEQ ID NO: 2822 - DNA, 50 bp, Homo sapiens; identical to SEQ ID NO: 704

SEQ ID NO: 2823 - DNA, 50 bp, Homo sapiens
tcaagaataaaaatgcctctccagccttaagtatttacatgctcccaggt

SEQ ID NO: 2824 - DNA, 50 bp, Homo sapiens
tctggaaatgtgttataagctaggagaatccctttggacagtctttattt

SEQ ID NO: 2825 - DNA, 50 bp, Homo sapiens
atttcctatcaccatacttttccatgtgaaaacctgagcctatttctagt

SEQ ID NO: 2826 - DNA, 50 bp, Homo sapiens
tggctgttgctttgcttcatgtgtatggctatttgtatttaacaagactt

SEQ ID NO: 2827 - DNA, 50 bp, Homo sapiens
atagccatcctctttgcagtcctgttggttgtgctcatcctcttcctagt

SEQ ID NO: 2828 - DNA, 50 bp, Homo sapiens
agggccagggctggtgtccctaaggttgtacagactcttgtgaatatttg

SEQ ID NO: 2829 - DNA, 50 bp, Homo sapiens
gccgtgacaatttgttctttgatgtgattgtatttccaatttcttgttca

SEQ ID NO: 2830 - DNA, 50 bp, Homo sapiens
tggtatatacaactttcagagcctcttgtatttggaaggctggaagggcc

SEQ ID NO: 2831 - DNA, 50 bp, Homo sapiens
gctactgcagggtgaggaagaaggggaagaagattgatcaaacagaatga

SEQ ID NO: 2832 - DNA, 50 bp, Homo sapiens
tgtttcaagcccttctgtaaaatatgaagaaaagtctcttagcattctgt

SEQ ID NO: 2833 - DNA, 50 bp, Homo sapiens; identical to SEQ ID NO: 490

SEQ ID NO: 2834 - DNA, 50 bp, Homo sapiens
atctttgtgagcaattatgctcccaaatctaagcaagtaataaagaaggg

SEQ ID NO: 2835 - DNA, 50 bp, Homo sapiens
tgtaaagtttgtacaatttgtcctgaagctttgtgtttggctgcacctgc

SEQ ID NO: 2836 - DNA, 50 bp, Homo sapiens
acagtataactcctgaatgctacttaaataaaccaggattcaaactgcaa

SEQ ID NO: 2837 - DNA, 50 bp, Homo sapiens
agaagcagattttcctgtagaaaaactaatttttctgccttttaccaaaa

SEQ ID NO: 2838 - DNA, 50 bp, Homo sapiens
gagcttgctccagattctgatgcatacggctatattggtttatgtagtca

SEQ ID NO: 2839 - DNA, 50 bp, Homo sapiens
atgggtgttatcacctagctgaatgtttttctaaaggagtttatgttcca

SEQ ID NO: 2840 - DNA, 50 bp, Homo sapiens
acgtgcttcttggtacaggtttgtgaatgacagtttatcgtcatgctgtt

SEQ ID NO: 2841 - DNA, 50 bp, Homo sapiens
tgttgttgttggcaagctgcaggtttgtaatgcaaaaggctgattactga

SEQ ID NO: 2842 - DNA, 50 bp, Homo sapiens
tcattgttcgcttctgtaattctgaaaaactttaaactggtagaacttgg

SEQ ID NO: 2843 - DNA, 50 bp, Homo sapiens
ccagtgctgtttggtggtctgccttctttttaatggtattttcttcctca

SEQ ID NO: 2844 - DNA, 50 bp, Homo sapiens
gccccaccattcatcctgtctgaaggtcctgggtttggtgtgaccgcttg

SEQ ID NO: 2845 - DNA, 50 bp, Homo sapiens
ccgacaggtgggcctgggaggaaaatgtttacatttttaaaggcacactg

SEQ ID NO: 2846 - DNA, 50 bp, Homo sapiens
ggggtggacgcctctgccttcacttgaacacaaatgtgcttcctataaaa

SEQ ID NO: 2847 - DNA, 50 bp, Homo sapiens
ggcagcccccagtccctttctgtcccagctcagttttccaaaagacactg

SEQ ID NO: 2848 - DNA, 50 bp, Homo sapiens
ctgttaagcactgttatgctcagtcatacacgcgaaaggtacaatgtctt

SEQ ID NO: 2849 - DNA, 50 bp, Homo sapiens; identical to SEQ ID NO: 198

SEQ ID NO: 2850 - DNA, 50 bp, Homo sapiens
ttcagttttgctttcaattttatgtaccttagttctgagttagacctgca

SEQ ID NO: 2851 - DNA, 50 bp, Homo sapiens
aaggattatgaggaggttggtgtgcattctgttgaaggagagggtgagga

SEQ ID NO: 2852 - DNA, 50 bp, Homo sapiens
tcccttccttctgttgctggtgtactctaggacttcaaagtgtgtctggg

SEQ ID NO: 2853 - DNA, 50 bp, Homo sapiens
agttcattaaaaactgcaaaaccaatctgtatcatgtaccaaactgactt

SEQ ID NO: 2854 - DNA, 50 bp, Homo sapiens
tgcacgttcctcctggttccttcgcttgtgtttctgtacttaccaaaaat

SEQ ID NO: 2855 - DNA, 50 bp, Homo sapiens
tgccagacctccttcctgacctctgaggcaggagaggaataaagacggtc

SEQ ID NO: 2856 - DNA, 50 bp, Homo sapiens
agtcccaagggtgttttgttactgttttctccatgaataaactcacttga

SEQ ID NO: 2857 - DNA, 50 bp, Homo sapiens
attaatgtcatttctggaagtgtgaaaatgttaatgttcaacaagcaaca

SEQ ID NO: 2858 - DNA, 50 bp, Homo sapiens
gcgggtgggccgagcagtgtggacatcagccactttttatattcatgtac

SEQ ID NO: 2859 - DNA, 50 bp, Homo sapiens
ccactgagaactaaatgctgtaccacagagccgggtgtgaactatggttt

SEQ ID NO: 2860 - DNA, 50 bp, Homo sapiens
aaacaatcgctccgggctcagggctgcgcggctcttcccttcattccatg

SEQ ID NO: 2861 - DNA, 50 bp, Homo sapiens
tgtcctctgttcaattcctaacgcaaactacaataaatggtgacacacgt

SEQ ID NO: 2862 - DNA, 50 bp, Homo sapiens
agcacctaaggagcttgaatcttggttcctgtaaaatttcaaattgatgt

SEQ ID NO: 2863 - DNA, 50 bp, Homo sapiens
accaacactgtcccaaggtgaaatgaagcaacagagaggaaattgtacat

SEQ ID NO: 2864 - DNA, 50 bp, Homo sapiens
tgtcagccatttcaatgtcttgggaaacaattttttgtttttgttctgtt

SEQ ID NO: 2865 - DNA, 50 bp, Homo sapiens
agagcttgatcgccagtggaagaagattagtgcaatcattgagaagagga

SEQ ID NO: 2866 - DNA, 50 bp, Homo sapiens
tttccctcttccctgacctcccaactctaaagccaagcactttatatttt

SEQ ID NO: 2867 - DNA, 50 bp, Homo sapiens
ggcaggtgaccattggcacacgctagaagtttatggcagagctttacaaa

SEQ ID NO: 2868 - DNA, 50 bp, Homo sapiens
ctgtttgtagataggttttttatctctcagtacacattgccaaatggagt

SEQ ID NO: 2869 - DNA, 50 bp, Homo sapiens; identical to SEQ ID NO: 84

SEQ ID NO: 2870 - DNA, 50 bp, Homo sapiens
tagactcattgtaagttgccactgccaacatgagaccaaagtgtgtgact

SEQ ID NO: 2871 - DNA, 50 bp, Homo sapiens
caaacctttctggcctgttatgattctgaacatttgacttgaaccacaag

SEQ ID NO: 2872 - DNA, 50 bp, Homo sapiens
gggaaagtatagcatgaaaccagaggttctcagaatgaccgtaagatagc

SEQ ID NO: 2873 - DNA, 50 bp, Homo sapiens; identical to SEQ ID NO: 1594

SEQ ID NO: 2874 - DNA, 50 bp, Homo sapiens; identical to SEQ ID NO: 1643

SEQ ID NO: 2875 - DNA, 50 bp, Homo sapiens
cttctggcacccctggggttcaatactggaagtgccttatttaaccagac

SEQ ID NO: 2876 - DNA, 50 bp, Homo sapiens
ggtctttagcctccaccttgtctaagctttggtctataaagtgcgctaca

SEQ ID NO: 2877 - DNA, 50 bp, Homo sapiens
tgatgatatgacatctggctaaaaagaaattattgcaaaactaaccacga

SEQ ID NO: 2878 - DNA, 50 bp, Homo sapiens
tccaaagcagtctccactgttgttgtgactacagctccgtctcctaaaca

SEQ ID NO: 2879 - DNA, 50 bp, Homo sapiens
attgtcaccaggttggaactcttgcctctgtgaggatgccttctctactg

SEQ ID NO: 2880 - DNA, 50 bp, Homo sapiens
ttttctttgtatatttctagtatggcacatgatatgagtcactgcctttt

SEQ ID NO: 2881 - DNA, 50 bp, Homo sapiens
tgaccttcatgataccagtgagaagccaggctagagaaataaaatcctga

SEQ ID NO: 2882 - DNA, 50 bp, Homo sapiens
acggattggttaaaaaatgcttcatatttgaaaaagctgggaattgctgt

SEQ ID NO: 2883 - DNA, 50 bp, Homo sapiens
gtctctctccattgtgttccgatccatttctgtgtgttcccccaaccttt

SEQ ID NO: 2884 - DNA, 50 bp, Homo sapiens
gccactgccataacttgtttgtaaaagagctgttctttttgactgattgt

SEQ ID NO: 2885 - DNA, 50 bp, Homo sapiens
gaacattgcccagcactacggcatgtcgtacctcctggagaccctggagt

SEQ ID NO: 2886 - DNA, 50 bp, Homo sapiens
atcttcattgggggattgagcagcatttaataaagtctatgtttgtattt

SEQ ID NO: 2887 - DNA, 50 bp, Homo sapiens
ttataaccgagggctggcgttttggaatcgaatttcgacagggattggaa

SEQ ID NO: 2888 - DNA, 50 bp, Homo sapiens; identical to SEQ ID NO: 1820

SEQ ID NO: 2889 - DNA, 50 bp, Homo sapiens; identical to SEQ ID NO: 206

SEQ ID NO: 2890 - DNA, 50 bp, Homo sapiens
aaccaaggagttttccccgtttgtaaaaagacattgtagataattgaatg

SEQ ID NO: 2891 - DNA, 50 bp, Homo sapiens
accatgttctttcgttaaagatttgctttatacaagattgttgcagtacc

SEQ ID NO: 2892 - DNA, 50 bp, Homo sapiens
cacatctgcttccactgtgttcccacgggtgccatgaagtgtgtgaggag

SEQ ID NO: 2893 - DNA, 50 bp, Homo sapiens
cgcactacttcacctgagccacccaacctaaatgtacttatctgtcccca

SEQ ID NO: 2894 - DNA, 50 bp, Homo sapiens; identical to SEQ ID NO: 2193

SEQ ID NO: 2895 - DNA, 50 bp, Homo sapiens
ctctccaagagtattattaacgctgctgtacctcgatctgaatctgccgg

SEQ ID NO: 2896 - DNA, 50 bp, Homo sapiens
tccctaatagaaagccacctattctttgttggatttcttcaagtttttct

SEQ ID NO: 2897 - DNA, 50 bp, Homo sapiens
agtactgcttttgtatgtatgttgaacaggatccaggtttttatagcttg

SEQ ID NO: 2898 - DNA, 50 bp, Homo sapiens
cactttctatcctctgtaaactttttgtgctgaatgttgggactgctaaa

SEQ ID NO: 2899 - DNA, 50 bp, Homo sapiens
gaagaatgggcaaagaagtaatcatgtagttgaagtctgtggatgcagct

SEQ ID NO: 2900 - DNA, 50 bp, Homo sapiens
caaaggttcttgagactcttgatatttctgtcttctccttgtgctttcct

SEQ ID NO: 2901 - DNA, 50 bp, Homo sapiens
ccgatggatctacagttgcaatgagaagcagaagttacttcctcaccagc

SEQ ID NO: 2902 - DNA, 50 bp, Homo sapiens
ttcctgcataactcaatctgaaccaaggattgtagtttagttttcctcct

SEQ ID NO: 2903 - DNA, 50 bp, Homo sapiens
gcagggtggtggtattctgtcatttacacacgtcgttctaattaaaaagc

SEQ ID NO: 2904 - DNA, 50 bp, Homo sapiens
gcactttttgtttgaatgttagatgcttagtgtgaagttgatacgcaagc

SEQ ID NO: 2905 - DNA, 50 bp, Homo sapiens
gcaagaaatattccattgaaatattgtgctgtaacatgggaaagtgtaaa

SEQ ID NO: 2906 - DNA, 50 bp, Homo sapiens
gccaacactgtctgtctcaaatactgtgctgtgagttgtttcaataaagg

SEQ ID NO: 2907 - DNA, 50 bp, Homo sapiens
gacctcatctccaagatggagaagatctgacctccacggagccgctgtcc

SEQ ID NO: 2908 - DNA, 50 bp, Homo sapiens
ctttactaaaaaagaagcacctgagtggtctaagaaacaaaagatgaaga

SEQ ID NO: 2909 - DNA, 50 bp, Homo sapiens
gcctggaagactctgaaggagcgtgagagcatcctgaagctgctggatgg

SEQ ID NO: 2910 - DNA, 50 bp, Homo sapiens
caggaggaagctctggcccttgtattacacattctggacattaaaaataa

SEQ ID NO: 2911 - DNA, 50 bp, Homo sapiens
gccttttgagtctttccgatacctgagtttttatgcttataatttttgtt

SEQ ID NO: 2912 - DNA, 50 bp, Homo sapiens
ttaagctgaggatacaaccaggaaatgcaacggtgtcagattgtgttcaa

SEQ ID NO: 2913 - DNA, 50 bp, Homo sapiens; identical to SEQ ID NO: 1714

SEQ ID NO: 2914 - DNA, 50 bp, Homo sapiens
agcaataaactctggatgtttgtgcgcgtgtgtggacagtcttatcttcc

SEQ ID NO: 2915 - DNA, 50 bp, Homo sapiens
agctgttgatgctggttggacaggtttgagtcaaattgtactttgctcca

SEQ ID NO: 2916 - DNA, 50 bp, Homo sapiens
aggtgacatttcccaccctgtgcccgtgttcccaataaaaacaaattcac

SEQ ID NO: 2917 - DNA, 50 bp, Homo sapiens
ctgtggctgactgtaatactgtacaactgtttctgaccattaaatgctgt

SEQ ID NO: 2918 - DNA, 50 bp, Homo sapiens
acatatgcagacctgacactcaagagtggctagctacacagagtccatct

SEQ ID NO: 2919 - DNA, 50 bp, Homo sapiens
tgacttcacagacatggtctagaatctgtacccttacccacatatgaaga

SEQ ID NO: 2920 - DNA, 50 bp, Homo sapiens
cccagtctctgtcagcactcccttcttcccttttatagttcatcagccac

SEQ ID NO: 2921 - DNA, 50 bp, Homo sapiens
tgactgagtacccctttagtgagtacccctttagtgctatatttgtgcca

SEQ ID NO: 2922 - DNA, 50 bp, Homo sapiens
tgccttttgagcaaatagggaatctaagggaggaaattatcaactgtgca

SEQ ID NO: 2923 - DNA, 50 bp, Homo sapiens
gcggggccggggggactctggtatctaattctttaatgattcctataaat

SEQ ID NO: 2924 - DNA, 50 bp, Homo sapiens
acaactttctgtacaatattgattcccatctggcatattctaatcaggtt

SEQ ID NO: 2925 - DNA, 50 bp, Homo sapiens; identical to SEQ ID NO: 633

SEQ ID NO: 2926 - DNA, 50 bp, Homo sapiens
aacaacattaacttgtggcctctttctacacctggaaatttactcttgaa

SEQ ID NO: 2927 - DNA, 50 bp, Homo sapiens
acagccgagtcctgcatcagccctttatcctcacacgcttttctacaatg

SEQ ID NO: 2928 - DNA, 50 bp, Homo sapiens
gtcaaggctaagtcaaatgaaactgaattttaaactttttgcatgcttct

SEQ ID NO: 2929 - DNA, 50 bp, Homo sapiens
aaacgacatgaaggtagatgaagtcctttacgaagactcgtcaacagctt

SEQ ID NO: 2930 - DNA, 50 bp, Homo sapiens
cccaataccaagaccaactggcatagagccaactgagataaatgctattt

SEQ ID NO: 2931 - DNA, 50 bp, Homo sapiens
gggtctatacagagtcaatatattttttcagagaaagttagttcggctcg

SEQ ID NO: 2932 - DNA, 50 bp, Homo sapiens
ccagaaagtgtgggctgaagatggttggtttcatgtgggggtattatgta

SEQ ID NO: 2933 - DNA, 50 bp, Homo sapiens
tccaaccttgagatccagtgtcaggagttctctattcctcccaactctga

SEQ ID NO: 2934 - DNA, 50 bp, Homo sapiens
tggcacagaaaagggaccaagtttaaaaaagggttttaaatgtaatgaga

SEQ ID NO: 2935 - DNA, 50 bp, Homo sapiens
ggggtaggttggttgttcagagtcttcccaataaagatgagtttttgagc

SEQ ID NO: 2936 - DNA, 50 bp, Homo sapiens
tgggcatagggacccatcattgatgactgatgaaaccatgtaataaagca

SEQ ID NO: 2937 - DNA, 50 bp, Homo sapiens
attttcctacagccctttgtacttcaaaatatgtttttgtgtccatcagt

SEQ ID NO: 2938 - DNA, 50 bp, Homo sapiens
tcagcactaactaaataaatttgttggttcagttgtacttgtcctgcaaa

SEQ ID NO: 2939 - DNA, 50 bp, Homo sapiens
agagggtggatcacacctcagtgggaagaaaaataaaatttccttcaggt

SEQ ID NO: 2940 - DNA, 50 bp, Homo sapiens
tgtgtaagtctgcctaaataggtagcttaaacttatgtcaaaatgtctgc

SEQ ID NO: 2941 - DNA, 50 bp, Homo sapiens
tcctttctgcttagtgaatgaatactggaatccatctgtgttgatacaat

SEQ ID NO: 2942 - DNA, 50 bp, Homo sapiens
gcaataccaagagaaaatgcacaaatatcactggatggagatgtcacatt

SEQ ID NO: 2943 - DNA, 50 bp, Homo sapiens
tggggatctcagggccaggagttatgttttgatttggaattttaattatt

SEQ ID NO: 2944 - DNA, 50 bp, Homo sapiens
ccagtaacttcgctctgttagaggtggaggattttcctatgttcccccca

SEQ ID NO: 2945 - DNA, 50 bp, Homo sapiens
tgctgaaaagattgtactttgtgatcccaatcagagggatggagctaatc

SEQ ID NO: 2946 - DNA, 50 bp, Homo sapiens
tcagactgctgagaaggaagaatttgaacatcaacagaaagagctggaga

SEQ ID NO: 2947 - DNA, 50 bp, Homo sapiens
tgggcagcttgggtaagtacgcaacttacttttccaccaaagaactgtca

SEQ ID NO: 2948 - DNA, 50 bp, Homo sapiens; identical to SEQ ID NO: 1651

SEQ ID NO: 2949 - DNA, 50 bp, Homo sapiens; identical to SEQ ID NO: 1702

SEQ ID NO: 2950 - DNA, 50 bp, Homo sapiens; identical to SEQ ID NO: 629

SEQ ID NO: 2951 - DNA, 50 bp, Homo sapiens
atgggccaggcagagaacagaactggaggcagtccatctagggaatggga

SEQ ID NO: 2952 - DNA, 50 bp, Homo sapiens
gtttcctttttgggtgaaatggatttatgtgagtgctttaaacaaatagc

SEQ ID NO: 2953 - DNA, 50 bp, Homo sapiens
gaacaatggagccagctgaaggaacagatttctgacatagatgacgcagt

SEQ ID NO: 2954 - DNA, 50 bp, Homo sapiens; identical to SEQ ID NO: 1747

SEQ ID NO: 2955 - DNA, 50 bp, Homo sapiens; identical to SEQ ID NO: 1664

SEQ ID NO: 2956 - DNA, 50 bp, Homo sapiens
agcacagatggtgcaatactttccttctttgaagagatcccaaagttagt

SEQ ID NO: 2957 - DNA, 50 bp, Homo sapiens
tggaagaatgtacagcttatggacaaatgtacacctttttgttactttaa

SEQ ID NO: 2958 - DNA, 50 bp, Homo sapiens
ttttggagcaaaaactatgggttgtaatttgaataaagtgtcactaagca

SEQ ID NO: 2959 - DNA, 50 bp, Homo sapiens
ttcagcaggaaaatgattcaatttttaaacaaaatgtaacagatggcagt

SEQ ID NO: 2960 - DNA, 50 bp, Homo sapiens
aagtagccaagctaagatgcctggctgggcttctgaggaattaatacact

SEQ ID NO: 2961 - DNA, 50 bp, Homo sapiens
ctgaccgccactctcacatttgggctcttcgctggccttggtggagctgg

SEQ ID NO: 2962 - DNA, 50 bp, Homo sapiens
tgcattgtgtagctagttttctggaaaagtcaatcttttaggaattgttt

SEQ ID NO: 2963 - DNA, 50 bp, Homo sapiens
acagctatactttgttgtgtaatgttatggttccctttctgtaaaatgtt

SEQ ID NO: 2964 - DNA, 50 bp, Homo sapiens
gacaggatcccccagagaccccatttgcctctcaacactcagaccttcaa

SEQ ID NO: 2965 - DNA, 50 bp, Homo sapiens
tttggtttaaaatgtaagataggaaaatgttggatatttgaggccatgct

SEQ ID NO: 2966 - DNA, 50 bp, Homo sapiens
aatctacattttcttaccaggagcagcattgaggtttttgagcatagtac

SEQ ID NO: 2967 - DNA, 50 bp, Homo sapiens
actaacccacgattctgagccctgagtatgcctggacattgatgctaaca

SEQ ID NO: 2968 - DNA, 50 bp, Homo sapiens
ttattctgcgtccccttctccaataaaacaagccagttgggcgtggttat

SEQ ID NO: 2969 - DNA, 50 bp, Homo sapiens
tccttcccactctctccaacatcacattcactttaaatttttctgtatat

SEQ ID NO: 2970 - DNA, 50 bp, Homo sapiens
agtcccaaaaaagccttgtgaaaatgttatgccctatgtaacagcagagt

SEQ ID NO: 2971 - DNA, 50 bp, Homo sapiens
aggggagggcactacacttccttgagagaaaccgctgtcattaataaaag

SEQ ID NO: 2972 - DNA, 50 bp, Homo sapiens
aggctgtagaaggaaatataccttaacaggctgatttggagtgacccaga

SEQ ID NO: 2973 - DNA, 50 bp, Homo sapiens
accagttacccaaaatctgattagaagtataaggtgctctgaagtgtcct

SEQ ID NO: 2974 - DNA, 50 bp, Homo sapiens
tgaggcttgtgaggccaatcaaaataatgtttgtgatctctactactgtt

SEQ ID NO: 2975 - DNA, 50 bp, Homo sapiens
cagttcccaaggacttgtcatttcatgttcttattttagacctgttttgt

SEQ ID NO: 2976 - DNA, 50 bp, Homo sapiens
accactagaagattccgggaacgttgggagtcacctgattctgcaaagat

SEQ ID NO: 2977 - DNA, 50 bp, Homo sapiens
gtcaagctgaccttgctgatggtgacattgcacctggatgtactatccaa

SEQ ID NO: 2978 - DNA, 50 bp, Homo sapiens
acagctcaagtaccctaatttagttcttttggactaatacaattcaggaa

SEQ ID NO: 2979 - DNA, 50 bp, Homo sapiens
gatgacgctgggcacagagggtcaggtcctgtcaagaggagctgggtgtc

SEQ ID NO: 2980 - DNA, 50 bp, Homo sapiens
aacatctctcttctccttcccaactactgcatgaagaaattctacttcca

SEQ ID NO: 2981 - DNA, 50 bp, Homo sapiens
ttcctgcctggattatttaaaaagccatgtgtggaaacccactatttaat

SEQ ID NO: 2982 - DNA, 50 bp, Homo sapiens
tgctacatttccaaggtgaagatgtgtgggcacatgttatggcagattga

SEQ ID NO: 2983 - DNA, 50 bp, Homo sapiens
acaaccatcaacattgctgttcaaagaaattacagtttacgtccattcca

SEQ ID NO: 2984 - DNA, 50 bp, Homo sapiens
cccacccataggccctgtccatacccatgtaaggtgttcaataaagaaca

SEQ ID NO: 2985 - DNA, 50 bp, Homo sapiens
actcttcaggagcttggcatcatggactgttaatgtatgtgattttcccc

SEQ ID NO: 2986 - DNA, 50 bp, Homo sapiens
ggtcaagggtgtcctccactctttaacagctgctggacagacacattaga

SEQ ID NO: 2987 - DNA, 50 bp, Homo sapiens
gcaacttcatgtcaactttctggctcctcaaacagtaggttggcagtaag

SEQ ID NO: 2988 - DNA, 50 bp, Homo sapiens
ccaagtggagacggggatggggaaaaatactgattctgtggaaaataccc

SEQ ID NO: 2989 - DNA, 50 bp, Homo sapiens; identical to SEQ ID NO: 1684

SEQ ID NO: 2990 - DNA, 50 bp, Homo sapiens
gcaggggctccagcaacaaaaaagaaacagcaacagaaaaagaagaaagg

SEQ ID NO: 2991 - DNA, 50 bp, Homo sapiens
agactcacttaccctcttggaaagctggtacagaaggaagtctgtggctg

SEQ ID NO: 2992 - DNA, 50 bp, Homo sapiens
cctggtcattggtggatgttaaacccatattcctttcaactgctgcctgc

SEQ ID NO: 2993 - DNA, 50 bp, Homo sapiens
aatgaattggcctggctaccactgtggtcgcgtgctacaggtttgacaaa

SEQ ID NO: 2994 - DNA, 50 bp, Homo sapiens
ttgatttgccataagtcttcccttgcttgcatcttccaaagctatttcga

SEQ ID NO: 2995 - DNA, 50 bp, Homo sapiens
agtgaagttacagtggaaatgagtggagggggattgtctttcaacgcagc

SEQ ID NO: 2996 - DNA, 50 bp, Homo sapiens
gcttggtcattatgaaccaggtgagcaatgcctacctataccgcaagagg

SEQ ID NO: 2997 - DNA, 50 bp, Homo sapiens
aaggcactgaaaatataaaaggactggtagtttactgatgtagatgtgaa

SEQ ID NO: 2998 - DNA, 50 bp, Homo sapiens
gcagaaaaggggaactcatttagctcacgagtggtcgagtgaagattgaa

SEQ ID NO: 2999 - DNA, 50 bp, Homo sapiens
tatcttgagacgccttacaaatgatggaggattccaaagagtttttgttt

SEQ ID NO: 3000 - DNA, 50 bp, Homo sapiens
aaaatgttgttgtgtacataccatgctttcaatgttggcttccaagtttt

SEQ ID NO: 3001 - DNA, 50 bp, Homo sapiens
ggtagaatgtgctcttctatatctactcctcaataaagcatgttctctgc

SEQ ID NO: 3002 - DNA, 50 bp, Homo sapiens
ccacaagaggatttaagggaggaatgtttataggacacacacacaaaagc

SEQ ID NO: 3003 - DNA, 50 bp, Homo sapiens
ctccagcagggtcagccattcacacccatccactcacctcccattcccag

SEQ ID NO: 3004 - DNA, 50 bp, Homo sapiens
aaactggcagaatgtccgggccttatatatcaagagcaccatgggcaagc

SEQ ID NO: 3005 - DNA, 50 bp, Homo sapiens; identical to SEQ ID NO: 1797

SEQ ID NO: 3006 - DNA, 50 bp, Homo sapiens
tgggagtgaggatgggaatgctgtatctgtggaagtcatgttatactgga

SEQ ID NO: 3007 - DNA, 50 bp, Homo sapiens
tgcttagatcactgcagcttctaggacccggtttcttttactgatttaaa

SEQ ID NO: 3008 - DNA, 50 bp, Homo sapiens
ctgaactaccaaatagctgtgggctttctggaactgctggctgggttgct

SEQ ID NO: 3009 - DNA, 50 bp, Homo sapiens
gctctgtgactttaagagaagaaggggggaggggtcccggattttatgtt

SEQ ID NO: 3010 - DNA, 50 bp, Homo sapiens
agaaatgtccttctttcactctgcatctttcttttctttgagtcgttttt

SEQ ID NO: 3011 - DNA, 50 bp, Homo sapiens
tccagataaagcaagaatagttgcaagaagtaaattctggcacaaagcgt

SEQ ID NO: 3012 - DNA, 50 bp, Homo sapiens
cccacaatggctttgattatgatttccccctgctgtgtgccgagctgcgg

SEQ ID NO: 3013 - DNA, 50 bp, Homo sapiens
aaattacagaaacatgttaaaggccggacaaaggaaagacaataaaatca

SEQ ID NO: 3014 - DNA, 50 bp, Homo sapiens
gaagtacgcggtcaaggcctgaggggcgcattgtcaataaagcacagctg

SEQ ID NO: 3015 - DNA, 50 bp, Homo sapiens
tctacagccatgtcctattccttgatcatccaaagcacctgcagagtcca

SEQ ID NO: 3016 - DNA, 50 bp, Homo sapiens
aatgtagcttaatcataatctcacactgaagattttgcatcacttttgct

SEQ ID NO: 3017 - DNA, 50 bp, Homo sapiens
tgatgatgatgttcaaagagaaagaaatggagtgattcagcacacaggcg

SEQ ID NO: 3018 - DNA, 50 bp, Homo sapiens
gccaccagccaagcaaccccctaaaacattcatatctaggcagtattttg

SEQ ID NO: 3019 - DNA, 50 bp, Homo sapiens
gcctttaccatgttctctccacatccgtaaataaacttccttcactacaa

SEQ ID NO: 3020 - DNA, 50 bp, Homo sapiens
ccacacctggcgagtaggccaagaaggaaaatctgacgaataaagacccc

SEQ ID NO: 3021 - DNA, 50 bp, Homo sapiens
gggctgagccccgcccagctcccctccacaataaacgctgtttctccttg

SEQ ID NO: 3022 - DNA, 50 bp, Homo sapiens
tttctcagcctacaaattgtgtctatacatttctaagccttgtttgcaga

SEQ ID NO: 3023 - DNA, 50 bp, Homo sapiens
gagcccacccccagcacccccatctgttaataaatatctcaactccaaaa

SEQ ID NO: 3024 - DNA, 50 bp, Homo sapiens
tggagtgatttcacagtgtgtactgttttgccacatacttctaaagaaca

SEQ ID NO: 3025 - DNA, 50 bp, Homo sapiens
ccctttggaaatggtgaaggaaccagcccaatagaagtacagagccagct

SEQ ID NO: 3026 - DNA, 50 bp, Homo sapiens
ctccctcaaggctgggaggagataaacaccaacccaggaattctcaataa

SEQ ID NO: 3027 - DNA, 50 bp, Homo sapiens
agggactgaaattgtggggggaaggtaggaggcacatcaataaagaggaa

SEQ ID NO: 3028 - DNA, 50 bp, Homo sapiens
tggggcaaaaccttgctaattttctcaaaagcatttatcattcttgttgc

SEQ ID NO: 3029 - DNA, 50 bp, Homo sapiens
cccccagtgtgcaagggcagtgaagacttgattgtacaaaatacgttttg

SEQ ID NO: 3030 - DNA, 50 bp, Homo sapiens
agatggcgagaacctaagtttcagttgattttacaattgaaatgactaaa

SEQ ID NO: 3031 - DNA, 50 bp, Homo sapiens
tgtcagaccttcttccacagcaaatgagatgtatgcccaaagcggtagaa

SEQ ID NO: 3032 - DNA, 50 bp, Homo sapiens
gttgcagggcgaggtcaagagagttctgacctggatggcccatagacctg

SEQ ID NO: 3033 - DNA, 50 bp, Homo sapiens
gacagcaggattggatgttgtgtattgtggtttattttattttcttcatt

SEQ ID NO: 3034 - DNA, 50 bp, Homo sapiens
agtgccttccctgcctgtgggggtcatgctgccacttttaatgggtcctc

SEQ ID NO: 3035 - DNA, 50 bp, Homo sapiens
tttggagtttttctgaaaaatggagcagtaatgcagcatcaacctattaa

SEQ ID NO: 3036 - DNA, 50 bp, Homo sapiens
caatggacaagtatttcctaatggtaccagaccactggacaggcttgggt

SEQ ID NO: 3037 - DNA, 50 bp, Homo sapiens
gtgttggagaggggctgtgtctgggtgagggatggcggggtactgatttt

SEQ ID NO: 3038 - DNA, 50 bp, Homo sapiens
gtgctttgagggtcagcctttaggaaggtgcagctttgttgtcctttgag

SEQ ID NO: 3039 - DNA, 50 bp, Homo sapiens
ggctcacatcaaaaggctaataggtgaatttgaccaacagcaagcagagt

SEQ ID NO: 3040 - DNA, 50 bp, Homo sapiens
cagaaagcaaacaacacaattacaaggttgaatctgaggaaaataatcct

SEQ ID NO: 3041 - DNA, 50 bp, Homo sapiens
tctctctgtgttctctgtattgtactaaccaacctcccaaatcgctgagc

SEQ ID NO: 3042 - DNA, 50 bp, Homo sapiens
cctggaataaaactcaacatgcagatttgcctactcatagggactttgcc

SEQ ID NO: 3043 - DNA, 50 bp, Homo sapiens
tgcctccctgatggaaaactatataaaattgtagacttaaaaggtttgtg

SEQ ID NO: 3044 - DNA, 50 bp, Homo sapiens
ttcattgtaaagatgttgatggtctcaataaaatgctaacttgccagtga

SEQ ID NO: 3045 - DNA, 50 bp, Homo sapiens
cgtccgcacggtacgtcttcatgggagtcattttattccttacagcttcc

SEQ ID NO: 3046 - DNA, 50 bp, Homo sapiens
tggtgtttggtttggggtgttttttaagttttttcttttatatcatccag

SEQ ID NO: 3047 - DNA, 50 bp, Homo sapiens
ctccctgctcttggttctcctctagattgaagtttgttttctgatgctgt

SEQ ID NO: 3048 - DNA, 50 bp, Homo sapiens
tgaagacatagttcacctaaaatggcatcctgctctgaatctagactttt

SEQ ID NO: 3049 - DNA, 50 bp, Homo sapiens
ccctttgagatttgtgtttgtgtcctgctttgagctgtaccttgtccagt

SEQ ID NO: 3050 - DNA, 50 bp, Homo sapiens; identical to SEQ ID NO: 477

SEQ ID NO: 3051 - DNA, 50 bp, Homo sapiens
ccagtgacacctctgaaagcccccattccctgagaatcctgttgttagta

SEQ ID NO: 3052 - DNA, 50 bp, Homo sapiens
cctggtcagtggtggtcttcaagacgacagctctgtatctgccatgtgaa

SEQ ID NO: 3053 - DNA, 50 bp, Homo sapiens
cccacttcccatgctggatgggcagaagacattgcttattggagacaaat

SEQ ID NO: 3054 - DNA, 50 bp, Homo sapiens
ttactggcatatgttttgtagactgtttaatgactggatatcttccttca

SEQ ID NO: 3055 - DNA, 50 bp, Homo sapiens
aatgtaaggttgttttgggggatggagttagaaccttaatgataatttct

SEQ ID NO: 3056 - DNA, 50 bp, Homo sapiens
tttggagtgggcaaagtaacctcttgcttggtgcaactatttgtttcaaa

SEQ ID NO: 3057 - DNA, 50 bp, Homo sapiens
gcttataaacacatttgaggaataggaggtccgggttttccataatgggt

SEQ ID NO: 3058 - DNA, 50 bp, Homo sapiens
tcttatcattgcatacattttctggatgcttgagccatcagatatcagct

SEQ ID NO: 3059 - DNA, 50 bp, Homo sapiens; identical to SEQ ID NO: 989

SEQ ID NO: 3060 - DNA, 50 bp, Homo sapiens
tgcattattgtgtagccacggttttctggaaaagttgatattttaggaat

SEQ ID NO: 3061 - DNA, 50 bp, Homo sapiens
attacattggaagggagctttcaagatggtaggatattgactaactgagc

SEQ ID NO: 3062 - DNA, 50 bp, Homo sapiens
catggtacaggcttggagcttgcaggtccctttctactgtggtgttggag

SEQ ID NO: 3063 - DNA, 50 bp, Homo sapiens
tgtgcagggacagttggcttccagaggtttcagctttcagttatttgaga

SEQ ID NO: 3064 - DNA, 50 bp, Homo sapiens
aattccattttattgggaacccattttccacctggtctttcttgacaggg

SEQ ID NO: 3065 - DNA, 50 bp, Homo sapiens
aaataaacttgtgtggtaaaagtacatgccatgtgtccctcaactgaaaa

SEQ ID NO: 3066 - DNA, 50 bp, Homo sapiens
ttcaagacaattttaattgtgaacctaccatgttgcctcccatcttctga

SEQ ID NO: 3067 - DNA, 50 bp, Homo sapiens
tttgtaagagctgggagcaaacacgtttatgagtgtgtcggaatcccgtg

SEQ ID NO: 3068 - DNA, 50 bp, Homo sapiens
cccaaacaggcatgtatcaaaacacctgtggagtactttagactccaaca

SEQ ID NO: 3069 - DNA, 50 bp, Homo sapiens
tggggccaaaagtccagtgaaattgtaagcttcaataaaaggatgaaact

SEQ ID NO: 3070 - DNA, 50 bp, Homo sapiens
tgggctggagtagaggactctggtgggaaggttttgctgctaatgtattt

SEQ ID NO: 3071 - DNA, 50 bp, Homo sapiens
agctaaacagtacttaaatagcggttggaactaggtagcctttcgaattt

SEQ ID NO: 3072 - DNA, 50 bp, Homo sapiens
tgtcattcatttttcagaatataaccactcaagctactggcacatagtga

SEQ ID NO: 3073 - DNA, 50 bp, Homo sapiens
tctgatagagaaaaagactgctttgtcactcaaacatgttccttcgacct

SEQ ID NO: 3074 - DNA, 50 bp, Homo sapiens; identical to SEQ ID NO: 1404

SEQ ID NO: 3075 - DNA, 50 bp, Homo sapiens
tttgatgttaaacagtaaatgccagtagtgaccaagaacacagtgattat

SEQ ID NO: 3076 - DNA, 50 bp, Homo sapiens
cctttgcctttatactttaggggtcttactccattaattcatttgttaca

SEQ ID NO: 3077 - DNA, 50 bp, Homo sapiens
tgcacgttatggtgtttctccctctcactgtctgagagtttagttgtagc

SEQ ID NO: 3078 - DNA, 50 bp, Homo sapiens
ctgtagagagtcttcaagatcccggagtggtagcgctgtctcctggtgaa

SEQ ID NO: 3079 - DNA, 50 bp, Homo sapiens; identical to SEQ ID NO: 960

SEQ ID NO: 3080 - DNA, 50 bp, Homo sapiens
gatccagaatccactctccagtctccctcccctgactccctctgctgtcc

SEQ ID NO: 3081 - DNA, 50 bp, Homo sapiens
attccattctattgtttacacaacgattactcgaagatgactgcaaaggt

SEQ ID NO: 3082 - DNA, 50 bp, Homo sapiens
agccaagaagagagcattaaacccaagaacattgtggagaagattgactt

SEQ ID NO: 3083 - DNA, 50 bp, Homo sapiens
tatattgtacttactgtgacagcagataataaaccagtctcttggagggc

SEQ ID NO: 3084 - DNA, 50 bp, Homo sapiens
cttattctcccattgggcagctgaggaccgaggcacagaggtgcggtgac

SEQ ID NO: 3085 - DNA, 50 bp, Homo sapiens
tcactgtataccactggagttttctggttatctctcgtatagcaaaatct

SEQ ID NO: 3086 - DNA, 50 bp, Homo sapiens
gctgccacctcctgttcatttagaactatgcaaagactccgcttccgttt

SEQ ID NO: 3087 - DNA, 50 bp, Homo sapiens
acagcaaagccccaactaatctttagaagcatattggaactgataactcc

SEQ ID NO: 3088 - DNA, 50 bp, Homo sapiens; identical to SEQ ID NO: 530

SEQ ID NO: 3089 - DNA, 50 bp, Homo sapiens
gtcaacatcatccggcaccctctggggtaggagaacagccattccacatg

SEQ ID NO: 3090 - DNA, 50 bp, Homo sapiens
tcatatgtgtggttatactcataataatgggccttgtaagccttttcacc

SEQ ID NO: 3091 - DNA, 50 bp, Homo sapiens
ctgcttgactcaccggcttcctatttgatgcacccaggcccccttgtggc

SEQ ID NO: 3092 - DNA, 50 bp, Homo sapiens
gggacagaaacacaaacgcaaaaaattcagacaaaagcagtaatgtttaa

SEQ ID NO: 3093 - DNA, 50 bp, Homo sapiens
gcgatcctcatcccttcagcaatatgtatttgagttcacactatttctgt

SEQ ID NO: 3094 - DNA, 50 bp, Homo sapiens
ttttgaacagcgaaaccagcgtttgcgagggagccccaatttcacaccag

SEQ ID NO: 3095 - DNA, 50 bp, Homo sapiens
ttccaaaagaaaaactagttgcagtcagggagccagcgaaaagacaaaaa

SEQ ID NO: 3096 - DNA, 50 bp, Homo sapiens
actgagagtggtgtctggatatattccttttgtcttcatcactttctgaa

SEQ ID NO: 3097 - DNA, 50 bp, Homo sapiens
gcatgcattcattggttgttcaataagtgagatgattacagataatactg

SEQ ID NO: 3098 - DNA, 50 bp, Homo sapiens
ctgatttcataaccaggccggaccacgtgcaatagggtggaaaccaaact

SEQ ID NO: 3099 - DNA, 50 bp, Homo sapiens
gaagacgacgcggattactactgctctgttggctacggctttagtcccta

SEQ ID NO: 3100 - DNA, 50 bp, Homo sapiens
tgaacctcagcccattaggcaggaaaagttgatatttaataaacaaggaa

SEQ ID NO: 3101 - DNA, 50 bp, Homo sapiens
ccaaggcacttggtttttctgttttatatactaataatcagggcctaagt

SEQ ID NO: 3102 - DNA, 50 bp, Homo sapiens
gggggccattcgattcgcctcagttgctgctgtaataaaagtctactttt

SEQ ID NO: 3103 - DNA, 50 bp, Homo sapiens
actttaagaaaaaacaaataattgttgcagaggtctctgtattttgcagc

SEQ ID NO: 3104 - DNA, 50 bp, Homo sapiens
ctgtaccagtgctggctgcaggtattaagtccaagtttattaactagata

SEQ ID NO: 3105 - DNA, 50 bp, Homo sapiens
gccacctctgtgttcctgtcatagcaaatatgggaccatcaccagcttac

SEQ ID NO: 3106 - DNA, 50 bp, Homo sapiens
tcctgaggtgatatacttcatatttgtaatcaactgaaagagctgtgcat

SEQ ID NO: 3107 - DNA, 50 bp, Homo sapiens
tgctgggtttgccatctttttgttttctttgaaaagcagcttagttaccc

SEQ ID NO: 3108 - DNA, 50 bp, Homo sapiens
ccactagttgatgtatggtatctttagatatttgcctgtctgtttgctca

SEQ ID NO: 3109 - DNA, 50 bp, Homo sapiens
aatggcctacaaccaagctatttgtcccctactttgagtcttaactgtgg

SEQ ID NO: 3110 - DNA, 50 bp, Homo sapiens
atcctgagctgcacttacctgtgagagtcttcaaacttttaaaccttgcc

SEQ ID NO: 3111 - DNA, 50 bp, Homo sapiens
tgctctgagatggggaacagaacacacaagtatgaagtttctttcaggtg

SEQ ID NO: 3112 - DNA, 50 bp, Homo sapiens
aagcacacccgtggttgtgaaaatagtatagcaaaaaagaaaaatccccg

SEQ ID NO: 3113 - DNA, 50 bp, Homo sapiens
tgtttacctgcttgcagcatattagaacagacgatccatgctaatattgt

SEQ ID NO: 3114 - DNA, 50 bp, Homo sapiens
aatccttacttaaaattcttccgttaccacccttgaaacaattagctttt

SEQ ID NO: 3115 - DNA, 50 bp, Homo sapiens
ataacagttctatttggaatgatacccacaactctacaagcatcttatcc

SEQ ID NO: 3116 - DNA, 50 bp, Homo sapiens
agagatttgtacatttgtgtaataggccttttcatgctttatgtgtagct

SEQ ID NO: 3117 - DNA, 50 bp, Homo sapiens
tcttggtgtatttcttatgcaaacaatcttcaggcagcaaagatgtctgt

SEQ ID NO: 3118 - DNA, 50 bp, Homo sapiens
aacctgtactgttggtattgtgttagtgtatggaccaatactgcctgtaa

SEQ ID NO: 3119 - DNA, 50 bp, Homo sapiens
aattgagggaccatcagataactgtattttgtcaggtgcaataaaaacaa

SEQ ID NO: 3120 - DNA, 50 bp, Homo sapiens
ctatgtgtactcctcatccctcctgctgtatattttctcattttttgcgt

SEQ ID NO: 3121 - DNA, 50 bp, Homo sapiens
ttaaaagtaacaaaaactgccatttgacagtaaaggctcttggcttctgt

SEQ ID NO: 3122 - DNA, 50 bp, Homo sapiens
gctcccttctctttgatagcagttataatgcccttgttcccaataaaact

SEQ ID NO: 3123 - DNA, 50 bp, Homo sapiens
ctgagatactgctgctggaatgggcgagacattgctgcaaagaagtcaag

SEQ ID NO: 3124 - DNA, 50 bp, Homo sapiens
ctgcggcgtgttaggaatgacctggaattgtcaataaacagatgctgctg

SEQ ID NO: 3125 - DNA, 50 bp, Homo sapiens
agctccctagctgaacgggttaccctggtcattaataaagctgtgactgg

SEQ ID NO: 3126 - DNA, 50 bp, Homo sapiens
ctcatctaaagacaccttcctttccactggctgtcaagccacagggcacc

SEQ ID NO: 3127 - DNA, 50 bp, Homo sapiens
ggcagaatccacaccagcttatcaaccaacacagctaattttagaatagg

SEQ ID NO: 3128 - DNA, 50 bp, Homo sapiens
gacaggacagtgaccttgggaggaaggggctactccgccatccttaaaag

SEQ ID NO: 3129 - DNA, 50 bp, Homo sapiens
ggacaagttggaacagaagaccaagagtggcctcactggatacatcaagg

SEQ ID NO: 3130 - DNA, 50 bp, Homo sapiens
ccccaattctgtggcgcatccagattgtgaaaatgtacaataaatgtgta

SEQ ID NO: 3131 - DNA, 50 bp, Homo sapiens
ttcagagaactttttgcatgcttatggttgatcagttaaaaaagaatgtt

SEQ ID NO: 3132 - DNA, 50 bp, Homo sapiens
tgctgtttctgtagccatattgtattctgtgtcaaataaagtccagttgg

SEQ ID NO: 3133 - DNA, 50 bp, Homo sapiens
acgccacccaaacctttcactttccaaagagctagccgtcctccacccag

SEQ ID NO: 3134 - DNA, 50 bp, Homo sapiens
gcatctgagatcctgttggaaaccacagcaacctgtattcattattagga

SEQ ID NO: 3135 - DNA, 50 bp, Homo sapiens
ggacgtgacctgtgctgagggctgtgagaatgtgaaacaacagtgtgaaa

SEQ ID NO: 3136 - DNA, 50 bp, Homo sapiens
gccatcagattgatcttcttcacaccaagctctgtttacattccgagagg

SEQ ID NO: 3137 - DNA, 50 bp, Homo sapiens
cctttcctcacagggaccaagacaaagcatgggacatgaaattaagagtg

SEQ ID NO: 3138 - DNA, 50 bp, Homo sapiens
aagcatgattcccacaaggactaagtatcagtgatttgtaattttcctgt

SEQ ID NO: 3139 - DNA, 50 bp, Homo sapiens
acctgttggttttaatgtgcatgtgaatggcctagagaacctatttttgt

SEQ ID NO: 3140 - DNA, 50 bp, Homo sapiens
ccgaccaagatccctccctgcaagacagatgggaatgtgtataataacta

SEQ ID NO: 3141 - DNA, 50 bp, Homo sapiens; identical to SEQ ID NO: 890

SEQ ID NO: 3142 - DNA, 50 bp, Homo sapiens
ggacggtgtccccgcacgtttgtattgtgtataaatacattcattaataa

SEQ ID NO: 3143 - DNA, 50 bp, Homo sapiens
atcctttcctcaacctcctcctttcccaattaatttcaaccatagtacga

SEQ ID NO: 3144 - DNA, 50 bp, Homo sapiens
gccagctatgtcctctaggaaatgacagacccaaccaccagcaataaaca

SEQ ID NO: 3145 - DNA, 50 bp, Homo sapiens
ctgtaaaaagacaattcatctcattgtgagtggaagtagttatctggaat

SEQ ID NO: 3146 - DNA, 50 bp, Homo sapiens
gcatttcagaatgtgtcttttgaagggctataccagttattaaatagtgt

SEQ ID NO: 3147 - DNA, 50 bp, Homo sapiens
ccagggtttctgcactggtcccctcttttcccttcagtcttcttcacttc

SEQ ID NO: 3148 - DNA, 50 bp, Homo sapiens
acactgctacaccattactttcttgagacatttgtaagtcctttgataca

SEQ ID NO: 3149 - DNA, 50 bp, Homo sapiens
tgaataactagtgataccctcaataaaacagggattgccaagaagggaac

SEQ ID NO: 3150 - DNA, 50 bp, Homo sapiens
acctttaacatgtaaagatgctcaccttgttcagaagagaataaaccagt

SEQ ID NO: 3151 - DNA, 50 bp, Homo sapiens
tatgtcataaacatgtaaataaaagatgttgaatcttgttgaaagcgcgg

SEQ ID NO: 3152 - DNA, 50 bp, Homo sapiens
ttgtattctggaagcgtgaattgcttttgaagtctgtcagtattactggt

SEQ ID NO: 3153 - DNA, 50 bp, Homo sapiens
tttgtaagcgaaggagatggaggtcgtcttaaaccagagagctactgaat

SEQ ID NO: 3154 - DNA, 50 bp, Homo sapiens
actcacaacttcttaagctaaatggtattttcatttttctcaagctctcc

SEQ ID NO: 3155 - DNA, 50 bp, Homo sapiens
agtttagcaatatgacattcttggtgacagtggaatctttgtctcttcac

SEQ ID NO: 3156 - DNA, 50 bp, Homo sapiens
gccactgaccttggctcaccttagaggaatttcctcgagaacaacagaga

SEQ ID NO: 3157 - DNA, 50 bp, Homo sapiens
acttctgtctttgctggaaagtgtatttgtgcataaataaagtctgtgta

SEQ ID NO: 3158 - DNA, 50 bp, Homo sapiens
ttctctttcttcacaatgtatgtcctcagtggtacctattattgatgcct

SEQ ID NO: 3159 - DNA, 50 bp, Homo sapiens
ctgtgacccgctcccgcctcatgagcaaggagagtggttcatcaatgatt

SEQ ID NO: 3160 - DNA, 50 bp, Homo sapiens; identical to SEQ ID NO: 77

SEQ ID NO: 3161 - DNA, 50 bp, Homo sapiens
agaacttccaaatgctgagcccagatccaaagttgtcttctgtccacgag

SEQ ID NO: 3162 - DNA, 50 bp, Homo sapiens
tgacaaattagaagaacggcctcacctgccatccaccttcaactacaacc

SEQ ID NO: 3163 - DNA, 50 bp, Homo sapiens
tggatattttaacctgttaagtgtgtgtgtgttttctgtacccaaccaga

SEQ ID NO: 3164 - DNA, 50 bp, Homo sapiens
taaatagggaagatggagacacctctgggggtcctctctgagtcaaatcc

SEQ ID NO: 3165 - DNA, 50 bp, Homo sapiens
tgtgttaggttgaataaggtgtggaaaatgcttttctgttagtagaatgc

SEQ ID NO: 3166 - DNA, 50 bp, Homo sapiens
gcagtaaccactgaacgtcaatcagccctccatggggttctttcgatttt

SEQ ID NO: 3167 - DNA, 50 bp, Homo sapiens
gtttgaagttgtgactctcctgctaccaattaaataaagcttactttgcc

SEQ ID NO: 3168 - DNA, 50 bp, Homo sapiens
tgcaagatgaatggctaatattttggtgcagtgtttgatgttcaaaacaa

SEQ ID NO: 3169 - DNA, 50 bp, Homo sapiens
ctgcctgttcagaactgtttaatagcagttactcttgagtgtatttacct

SEQ ID NO: 3170 - DNA, 50 bp, Homo sapiens
attctagagtttggaatgcaaaattaattgttttaccctcaagctgggaa

SEQ ID NO: 3171 - DNA, 50 bp, Homo sapiens
tggggtgaatttgttaaaatgagtaactttgataaagtttttcatgcaca

SEQ ID NO: 3172 - DNA, 50 bp, Homo sapiens
aaaagtatagagttggaaactctgggaaaacttacggaaatacacaaatg

SEQ ID NO: 3173 - DNA, 50 bp, Homo sapiens; identical to SEQ ID NO: 1619

SEQ ID NO: 3174 - DNA, 50 bp, Homo sapiens
tacaatgcttccaaactggaactctacattttgtatcttttaaagctcct

SEQ ID NO: 3175 - DNA, 50 bp, Homo sapiens; identical to SEQ ID NO: 1584

SEQ ID NO: 3176 - DNA, 50 bp, Homo sapiens; identical to SEQ ID NO: 1632

SEQ ID NO: 3177 - DNA, 50 bp, Homo sapiens
tggtgtttgattattggaatggtgccatattgtcactccttctacttgct

SEQ ID NO: 3178 - DNA, 50 bp, Homo sapiens; identical to SEQ ID NO: 1640

SEQ ID NO: 3179 - DNA, 50 bp, Homo sapiens
ggctaaacgattcttactcagtgtgatgtataatgatgcaacagggaccc

SEQ ID NO: 3180 - DNA, 50 bp, Homo sapiens; identical to SEQ ID NO: 1592

SEQ ID NO: 3181 - DNA, 50 bp, Homo sapiens
ataccttctgaacgggaagagacagccagcacagtgtttatgccactggt

SEQ ID NO: 3182 - DNA, 50 bp, Homo sapiens
ttccactagtatatccctgttgatttgtttgtgccttttattaactgcca

SEQ ID NO: 3183 - DNA, 50 bp, Homo sapiens
tcatctgtgccatgctctagaaccttgaccttgatagttcaccacgtctg

SEQ ID NO: 3184 - DNA, 50 bp, Homo sapiens
actgcccttaactctggtatacaccaaaaagaaatctttactttccttgt

SEQ ID NO: 3185 - DNA, 50 bp, Homo sapiens
aggcagcctttctttaatgttttcagttggtttgtattttgtagctcagt

SEQ ID NO: 3186 - DNA, 50 bp, Homo sapiens
ccagaatggtctttaatgagcatggaacctgagcaaagggaataggtggg

SEQ ID NO: 3187 - DNA, 50 bp, Homo sapiens
tctctctctacactgtggtgcacttaacttgtggaatttttatactaaaa

SEQ ID NO: 3188 - DNA, 50 bp, Homo sapiens
actcagcctaaggaaacaagtacactccacacatgcataaaggaaatcaa

SEQ ID NO: 3189 - DNA, 50 bp, Homo sapiens; identical to SEQ ID NO: 476

SEQ ID NO: 3190 - DNA, 50 bp, Homo sapiens
tttgcatcatgtagtcattgagtgagggggagatataagccaaggatttt

SEQ ID NO: 3191 - DNA, 50 bp, Homo sapiens
gcttacttcacaatgtgcccaggtcagctgtataaaataaatactgcatt

SEQ ID NO: 3192 - DNA, 50 bp, Homo sapiens
tgtaatggttggtttattgttctataaccccagcccatcattttctgtgt

SEQ ID NO: 3193 - DNA, 50 bp, Homo sapiens
agtcaatgtttcgtgttccgcattatttgaaccatttgcccttacagaaa

SEQ ID NO: 3194 - DNA, 50 bp, Homo sapiens
agggagcagtgcttttgggtcctagaacctgttgagtttctaatgaatat

SEQ ID NO: 3195 - DNA, 50 bp, Homo sapiens
aatgacttgttatagctcagtgtgcccttgaatccatacagtttcttaaa

SEQ ID NO: 3196 - DNA, 50 bp, Homo sapiens
tgttttgttttctgggttttgttttttgtttttgtctgtgcaagacctgc

SEQ ID NO: 3197 - DNA, 50 bp, Homo sapiens; identical to SEQ ID NO: 455

SEQ ID NO: 3198 - DNA, 50 bp, Homo sapiens
cctgacctgtgcaataaggattgttccctgcgaagttttgttggatgtaa

SEQ ID NO: 3199 - DNA, 50 bp, Homo sapiens
gagtctggggtaagggtgggggttgaaagttgttatctttaaatacatgt

SEQ ID NO: 3200 - DNA, 50 bp, Homo sapiens
ttgatctgccaaggatttcctctcagagctgttgcacagacagagattgt

SEQ ID NO: 3201 - DNA, 50 bp, Homo sapiens
gggggtttccacaatgtgagggggaaccaagaaaattttaaatacagtgt

SEQ ID NO: 3202 - DNA, 50 bp, Homo sapiens
tgcctgtcccaagttttgttccattttttaaaaatttgttgtaaactgca

SEQ ID NO: 3203 - DNA, 50 bp, Homo sapiens
tattgttacatatgtttgcatcaagctagcagccaagaggttaattgtgc

SEQ ID NO: 3204 - DNA, 50 bp, Homo sapiens
aaaccagaacaagcaacaaactgtatttatgcaagcaaaattgatgagaa

SEQ ID NO: 3205 - DNA, 50 bp, Homo sapiens
tgatgtttctgaatactaccaaacagccatacatgtctgcaatgaagaga

SEQ ID NO: 3206 - DNA, 50 bp, Homo sapiens
tatcatcctccttctcaacccatctccctaaccccacatgcttgccagtt

SEQ ID NO: 3207 - DNA, 50 bp, Homo sapiens
ttctgaaattgggaaacatttattttaaatgcaatcaggtagtgttgctt

SEQ ID NO: 3208 - DNA, 50 bp, Homo sapiens
gactgaatttgacatctggtatgctggtatgtagctcatacatcaagagt

SEQ ID NO: 3209 - DNA, 50 bp, Homo sapiens
ttgtacttttcagaaccattttgtctcattattcctgttttagctgaaga

SEQ ID NO: 3210 - DNA, 50 bp, Homo sapiens
ctggctgtgtcacagggtgagccccaaaattggggttcagcgtgggaggc

SEQ ID NO: 3211 - DNA, 50 bp, Homo sapiens
aatggtcccctgtgtttgtagagaactcccttatacagagttttggttct

SEQ ID NO: 3212 - DNA, 50 bp, Homo sapiens
ttctttcatgtcctccctacttcctcagtgtcaatcagattaaagtgtgt

SEQ ID NO: 3213 - DNA, 50 bp, Homo sapiens
tttgaactttggtcatagagtcttcatatttcagtatttggtggtcccta

SEQ ID NO: 3214 - DNA, 50 bp, Homo sapiens
accctagagttactctcttttgggaacataaggaggtatacagaactgca

SEQ ID NO: 3215 - DNA, 50 bp, Homo sapiens
ttgatgtgtcacaaaacattactcatttgatttcccccacccccgccaac

SEQ ID NO: 3216 - DNA, 50 bp, Homo sapiens
tcagggcgtttgaatgtgaattaggaccagcgcaatgaatgctcaagttg

SEQ ID NO: 3217 - DNA, 50 bp, Homo sapiens
agttcccagtctcttctgtcctgcagcccttgcctctttcccacaggttc

SEQ ID NO: 3218 - DNA, 50 bp, Homo sapiens
gtagaatcaggcactgctcgcagaaggaacacagattgtagagattaaca

SEQ ID NO: 3219 - DNA, 50 bp, Homo sapiens
ttttctcagcgcagttttgttttgtgtgtccattggattacaaactttat

SEQ ID NO: 3220 - DNA, 50 bp, Homo sapiens
tgcctcattatcttgcagctgtaaacatattggaatgtacatgtcaataa

SEQ ID NO: 3221 - DNA, 50 bp, Homo sapiens
gccatagcctgaatcttttaggggtattaaggtcagcctctcactcttcc

SEQ ID NO: 3222 - DNA, 50 bp, Homo sapiens
agccgccttccaggcccgctatgcagacatctttccctccaaggtttgtc

SEQ ID NO: 3223 - DNA, 50 bp, Homo sapiens
agcagctttcttcaagtcgctctttagccctttgtggttaatctctcagt

SEQ ID NO: 3224 - DNA, 50 bp, Homo sapiens
tgcactgatacaacattaccattcttctatggaaagaaaacttttgatga

SEQ ID NO: 3225 - DNA, 50 bp, Homo sapiens
atagaggaggaggcacttcaggggtgaggcggaggaggagtcaacgtatt

SEQ ID NO: 3226 - DNA, 50 bp, Homo sapiens
atacccacacagcaactggtccactgctttactgtctgttggataatggc

SEQ ID NO: 3227 - DNA, 50 bp, Homo sapiens
agatttgtgtcctctcattccctctcttcctcttgtaagtgcccttctaa

SEQ ID NO: 3228 - DNA, 50 bp, Homo sapiens
gcactgtttttaaacccaagtaaagactgcttgaaacctgttgatggaaa

SEQ ID NO: 3229 - DNA, 50 bp, Homo sapiens
agatttcccctcagtttccattgacttagatcaggttacagagaaaggca

SEQ ID NO: 3230 - DNA, 50 bp, Homo sapiens
agatcgagatcttcagtcctctgcttcatctgtgagcttgccttcagtca

SEQ ID NO: 3231 - DNA, 50 bp, Homo sapiens; identical to SEQ ID NO: 1184

SEQ ID NO: 3232 - DNA, 50 bp, Homo sapiens
tggcactctgtggctccttgtagtattatagctatactgggaaagcatag

SEQ ID NO: 3233 - DNA, 50 bp, Homo sapiens; identical to SEQ ID NO: 1204

SEQ ID NO: 3234 - DNA, 50 bp, Homo sapiens
aattgaccaacctaatgttacaactactttgaggtggccaaatgtaaact

SEQ ID NO: 3235 - DNA, 50 bp, Homo sapiens
ctactacgctgccctgggtgctgtaggagcccatctgactcaccagaaat

SEQ ID NO: 3236 - DNA, 50 bp, Homo sapiens
aaggcctcagttttaattattttcttcccaaaataaatcacacatttggt

SEQ ID NO: 3237 - DNA, 50 bp, Homo sapiens
ggtggggtgatagggtgggctaaaaaccatgcactctggaatttgttgta

SEQ ID NO: 3238 - DNA, 50 bp, Homo sapiens
agaggcagcttctagacagagttgcttaatgaaagggtttgtaatacttt

SEQ ID NO: 3239 - DNA, 50 bp, Homo sapiens; identical to SEQ ID NO: 1582

SEQ ID NO: 3240 - DNA, 50 bp, Homo sapiens
caacggccaggagaagcactttaaggacgaggacgaggacgaggacgtgg

SEQ ID NO: 3241 - DNA, 50 bp, Homo sapiens
atacagccccggcagaaaacgcctaaagtcagatgagagaccagtacata

SEQ ID NO: 3242 - DNA, 50 bp, Homo sapiens
accagaaacttcaaatgtgtcacaaaagatgagcagaactatcccgaggt

SEQ ID NO: 3243 - DNA, 50 bp, Homo sapiens
aaagcgaagtcatgggagagccacacttgatggtggaatataaacttggt

SEQ ID NO: 3244 - DNA, 50 bp, Homo sapiens
tccctgccataacatcttttgccacgtatagctggaattaagtgttgtct

SEQ ID NO: 3245 - DNA, 50 bp, Homo sapiens
ctggtgactccacacttccaacctgctctaaaaaacgcaaaatagaacag

SEQ ID NO: 3246 - DNA, 50 bp, Homo sapiens
tgtgtagtggatggagtttactgtttgtggaataaaaacggctgtttccg

SEQ ID NO: 3247 - DNA, 50 bp, Homo sapiens
acagggatttcttatgtctttggctacactagatattttgtgattggcaa

SEQ ID NO: 3248 - DNA, 50 bp, Homo sapiens
aggcctgagtgtgtgcgggagaccaaataaaccggcttgggtgcgcaaaa

SEQ ID NO: 3249 - DNA, 50 bp, Homo sapiens
aagaaagaagagagagaacttgatgccaagtccacgaaaaaacaattttt

SEQ ID NO: 3250 - DNA, 50 bp, Homo sapiens
gatccagctgtgcttaagagccagtaatgtcttaataaacatgtggcagc

SEQ ID NO: 3251 - DNA, 50 bp, Homo sapiens
aagcacttgttttattttgtgtgtggagtataaaggctacacccttattg

SEQ ID NO: 3252 - DNA, 50 bp, Homo sapiens
cctttttctacagaatcatcaggcatgggtaaggtggctaacgctgagat

SEQ ID NO: 3253 - DNA, 50 bp, Homo sapiens
tgggtatgttctagagatttaccaccattgcttattgcttttttctttaa

SEQ ID NO: 3254 - DNA, 50 bp, Homo sapiens
tcttcttgatagatgaggccatggtgtaaatggaagtttcagagaggaca

SEQ ID NO: 3255 - DNA, 50 bp, Homo sapiens
gtgggttggtcccactaatggaaatggaaatgcctgagccaggccagcgg

SEQ ID NO: 3256 - DNA, 50 bp, Homo sapiens
aatctattcctgcacctgttacggtttctggaagcagttaataaaaagta

SEQ ID NO: 3257 - DNA, 50 bp, Homo sapiens
gcatggagtcaggagaaaaccaccttcataaactgctctgtgcaaagagg

SEQ ID NO: 3258 - DNA, 50 bp, Homo sapiens
acaaatgcccctgtttatcaataggtgactacttactacacatggaacca

SEQ ID NO: 3259 - DNA, 50 bp, Homo sapiens
tgattatatgcagattcctagtagcatgccttacctacagcactatgtgc

SEQ ID NO: 3260 - DNA, 50 bp, Homo sapiens
ggtcattgagcctcaggtagggaatatatcaacccgatttcttcctctct

SEQ ID NO: 3261 - DNA, 50 bp, Homo sapiens
tttcaaagtgcccagactgtgtacaaagacacatgtaatggagattgtac

SEQ ID NO: 3262 - DNA, 50 bp, Homo sapiens
aggaccgaagtgtttcaagtggatctcagtaaaggatctttggagccaga

SEQ ID NO: 3263 - DNA, 50 bp, Homo sapiens
agtttcactgtcagagatattgtaggtgctaatactggatttcgtctcag

SEQ ID NO: 3264 - DNA, 50 bp, Homo sapiens
agttagaagagcaatatgtttccttctctgtaacagtgtcctaacagtga

SEQ ID NO: 3265 - DNA, 50 bp, Homo sapiens
agctgccacttcccagaagcctacataattatttgctctatgaagacgtt

SEQ ID NO: 3266 - DNA, 50 bp, Homo sapiens
gccactaataacattgggctaatatctgctgtgcttctctgacaggtagt

SEQ ID NO: 3267 - DNA, 50 bp, Homo sapiens
agcatgcagttctctgtgaaatctcaaatattgttgtaatagtctgtttc

SEQ ID NO: 3268 - DNA, 50 bp, Homo sapiens
tgaatctatcccccaagaaaccatcttatccctgtaataaatcagcatgt

SEQ ID NO: 3269 - DNA, 50 bp, Homo sapiens
gtgcttccaggcggcactgacagcctcagtaacaataaaaacaatggtag

SEQ ID NO: 3270 - DNA, 50 bp, Homo sapiens
gtccatgtttctaggggtattcatttgctttctcgttgaaacctgttgtt

SEQ ID NO: 3271 - DNA, 50 bp, Homo sapiens
taggtccataaatgttgtaataaatattcctttgatcttggtgtttgcgt

SEQ ID NO: 3272 - DNA, 50 bp, Homo sapiens
gctagtacctgttatttattacctggaggcctgtccagcacccaccctac

SEQ ID NO: 3273 - DNA, 50 bp, Homo sapiens
cccactatgcacagattaaacttcacctacaaactccttaatatgatctg

SEQ ID NO: 3274 - DNA, 50 bp, Homo sapiens
tgtgctctgttttaccttactctgtttagaaaagtatacaagcgtgtttt

SEQ ID NO: 3275 - DNA, 50 bp, Homo sapiens
tgagtgtgtctctggattttgaccccttattgattcattgtaatatgtaa

SEQ ID NO: 3276 - DNA, 50 bp, Homo sapiens
acatttgtaagggctctcaaagattcacacatgcctatattatcataaga

SEQ ID NO: 3277 - DNA, 50 bp, Homo sapiens
tccgcatccattatttaaaccagtggaaattgtctctatttttggaaagt

SEQ ID NO: 3278 - DNA, 50 bp, Homo sapiens
acggagctgtagtgccattagaaactgtgaatttccaaataaatctgaac

SEQ ID NO: 3279 - DNA, 50 bp, Homo sapiens
agccttcagtttcttaaatgaaatcaaatgttccttcagtacaggtaact

SEQ ID NO: 3280 - DNA, 50 bp, Homo sapiens
ccagacccccatcacttgatgggccacacaagtttgagagtggtacaagg

SEQ ID NO: 3281 - DNA, 50 bp, Homo sapiens
tcaggttaaacccagcagcagcaaagaactccccagtgacttccagttat

SEQ ID NO: 3282 - DNA, 50 bp, Homo sapiens
ggtgggcatttttgggctacctggttcgtttttataagattttgctgggt

SEQ ID NO: 3283 - DNA, 50 bp, Homo sapiens
agtgcaataatactgtatagctttcccccacctcccacaaaatcacccag

SEQ ID NO: 3284 - DNA, 50 bp, Homo sapiens
aatcatgttgcagaaccagcaggtggatagtatataggtttatgcctggg

SEQ ID NO: 3285 - DNA, 50 bp, Homo sapiens
ggtgcagcgtgtcagacacaacattcatgttactcttacattggaatctg

SEQ ID NO: 3286 - DNA, 50 bp, Homo sapiens
ggactgacaccacagatgacagccccacctccttgagctttatttaccta

SEQ ID NO: 3287 - DNA, 50 bp, Homo sapiens
acgacccattttgcaagacttaaagccggaagaacacattttcagattgt

SEQ ID NO: 3288 - DNA, 50 bp, Homo sapiens
aggaattactgtaacaaaatatgtatgtccgaagggaaaaagctgcaagg

SEQ ID NO: 3289 - DNA, 50 bp, Homo sapiens
tcctgtggaatctgatatgtctggtagcatgtcattgatgggacatgaag

SEQ ID NO: 3290 - DNA, 50 bp, Homo sapiens
atggcactaggcagcatttgtatagtaactaatggcaaaaattcatggct

SEQ ID NO: 3291 - DNA, 50 bp, Homo sapiens
atttgattaaaattatttcccactgacctaaactttcagtgatttgtggg

SEQ ID NO: 3292 - DNA, 50 bp, Homo sapiens
aaagcaagtgttttgtacatttcttttcaaaaagtgccaaatttgtcagt

SEQ ID NO: 3293 - DNA, 50 bp, Homo sapiens
aatctgcactgatattacatccacagtaccacagtatttatgtgtatgaa

SEQ ID NO: 3294 - DNA, 50 bp, Homo sapiens
atggtagctgagccaaacacgtaggatttccgttttaaggttcacatgga

SEQ ID NO: 3295 - DNA, 50 bp, Homo sapiens
aagccagaacctgctgttttcagggtgggtgatgtaaatatagtgtgtac

SEQ ID NO: 3296 - DNA, 50 bp, Homo sapiens; identical to SEQ ID NO: 3162

SEQ ID NO: 3297 - DNA, 50 bp, Homo sapiens
tctttctggtttctggagataacccatcaataaaagctgcttcctctggt

SEQ ID NO: 3298 - DNA, 50 bp, Homo sapiens
gggacccctcctacccttgactcctctgtgctttggtaataaattgtttt

SEQ ID NO: 3299 - DNA, 50 bp, Homo sapiens
gttctgaatgctgtcctcaaagtatataatgtttcatgtaccaagaccct

SEQ ID NO: 3300 - DNA, 50 bp, Homo sapiens
gacatctgctccctcctcctgcaacacagcccagccctgaaggccatccg

SEQ ID NO: 3301 - DNA, 50 bp, Homo sapiens
tgggaagatcctgacctcctccaaggaagaaatccagaaagccttaagac

SEQ ID NO: 3302 - DNA, 50 bp, Homo sapiens
agccagtgatctctctgactttcaatcagtttccaagcttaaccagggca

SEQ ID NO: 3303 - DNA, 50 bp, Homo sapiens
aaacgcatccgctatctctacaaacactttaaccgacatgggaagtttcg

SEQ ID NO: 3304 - DNA, 50 bp, Homo sapiens; identical to SEQ ID NO: 745

SEQ ID NO: 3305 - DNA, 50 bp, Homo sapiens
ttccaggcttttgctactcttcactcagctacaataaacatcctgaatgt

SEQ ID NO: 3306 - DNA, 50 bp, Homo sapiens
acacctagtcatagaaatcagtctctctggtttgttttgtattatgttgt

SEQ ID NO: 3307 - DNA, 50 bp, Homo sapiens
cactgcttccttctgctccaggcctcaattttcccttcttgtaaaatgga

SEQ ID NO: 3308 - DNA, 50 bp, Homo sapiens
actttcggagggagtttattattgagtctttatctgtgacagtatttgga

SEQ ID NO: 3309 - DNA, 50 bp, Homo sapiens
atagagaggtaattaaattgctggagccaactatttcacaacttctgtaa

SEQ ID NO: 3310 - DNA, 50 bp, Homo sapiens
gttccaccagtatttaccaggaaaacaaagaatgtgttaagggatgctcc

SEQ ID NO: 3311 - DNA, 50 bp, Homo sapiens
tgctatttcctattttcaccaaaattggggaaggagtgccactttccagc

SEQ ID NO: 3312 - DNA, 50 bp, Homo sapiens
tgctgccacttttcaattctgtcagtgcttccacatggaaacaaaatgca

SEQ ID NO: 3313 - DNA, 50 bp, Homo sapiens
tcactttctgtattttaattttgttgaagggctgattgggatttccatgt

SEQ ID NO: 3314 - DNA, 50 bp, Homo sapiens
gcatgaagagacatagccttttagttttgctaattgtgaaatggaaatgc

SEQ ID NO: 3315 - DNA, 50 bp, Homo sapiens
tgttgtccctgaacttagctaaatggtgcaacttagtttctccttgcttt

SEQ ID NO: 3316 - DNA, 50 bp, Homo sapiens
tcatagtgtcagtgaggtcccgtgagtctttgtgagtccttgtgtcatcg

SEQ ID NO: 3317 - DNA, 50 bp, Homo sapiens
gtgcgtagaatattacgtatgcatgttcatgtctaaagaatggctgttga

SEQ ID NO: 3318 - DNA, 50 bp, Homo sapiens; identical to SEQ ID NO: 1463

SEQ ID NO: 3319 - DNA, 50 bp, Homo sapiens
ggacattggttattttatgctttcttggatataaccatgatcagagtgcc

SEQ ID NO: 3320 - DNA, 50 bp, Homo sapiens
gcaagtgtaggagtggtgggcctgaactgggccattgatcagactaaata

SEQ ID NO: 3321 - DNA, 50 bp, Homo sapiens
aatcagaagagcctggaaaaagacctagcccaacttcccttgtgggaaac

SEQ ID NO: 3322 - DNA, 50 bp, Homo sapiens
tcaacaaaggggattttgtacacataacatgggttatttagtttaactct

SEQ ID NO: 3323 - DNA, 50 bp, Homo sapiens
cttttgtgcagcgactatgttggtgttaggggtggtgtggagattgttaa

SEQ ID NO: 3324 - DNA, 50 bp, Homo sapiens
atttatgccttaaatgttttcttccccattccttcctccccctcggtagg

SEQ ID NO: 3325 - DNA, 50 bp, Homo sapiens
tttgtatttgtgaactcatctgtgggaggagtaaagaaaatccaaaagca

SEQ ID NO: 3326 - DNA, 50 bp, Homo sapiens
cccccgtgggcatggaccacctttattttatacaaaattaaaaacaagtt

SEQ ID NO: 3327 - DNA, 50 bp, Homo sapiens
actgtaaactaatctgtcattgtttttaccttccttttctttttcagtgc

SEQ ID NO: 3328 - DNA, 50 bp, Homo sapiens
tacttgctgtggtggtcttgtgaaaggtgatgggttttattcgttgggct

SEQ ID NO: 3329 - DNA, 50 bp, Homo sapiens
aaagaattagtgtatgcttcctgaataaaaaggagccaaagttgatcaga

SEQ ID NO: 3330 - DNA, 50 bp, Homo sapiens; identical to SEQ ID NO: 1251

SEQ ID NO: 3331 - DNA, 50 bp, Homo sapiens
agcttaaggttttaaaaatgttgcccgtaatgttgaacgtgtctgttaga

SEQ ID NO: 3332 - DNA, 50 bp, Homo sapiens
ggatgcacgtacagaatacattcagccgtcaggtaataacatgaagcagt

SEQ ID NO: 3333 - DNA, 50 bp, Homo sapiens
ggacagtttctattgcttttccttttttccatcccttccctaccatcaaa

SEQ ID NO: 3334 - DNA, 50 bp, Homo sapiens
agacttacattactgctttaacgtgtatatcactgggcatccccaagggc

SEQ ID NO: 3335 - DNA, 50 bp, Homo sapiens
gtcaggttaggtcaaagccagggagtgacagaatctgggaaatcaaacaa

SEQ ID NO: 3336 - DNA, 50 bp, Homo sapiens
cctcttgatgcctaagcaggtaagcagatgcctaagctgtatttctccaa

SEQ ID NO: 3337 - DNA, 50 bp, Homo sapiens
tggatctgtcaaactaacacttatgcctttagtctcattgtatgaggtgt

SEQ ID NO: 3338 - DNA, 50 bp, Homo sapiens
acctgccatcattggtctttactaagtgaagtgacttctttctttaacaa

SEQ ID NO: 3339 - DNA, 50 bp, Homo sapiens
gctgccaactgtagtaatgatgcttttaataaaagtgacccatgatatgc

SEQ ID NO: 3340 - DNA, 50 bp, Homo sapiens
actgttgtccccccacccttttttccttaaataaagtaaaaatgacaccc

SEQ ID NO: 3341 - DNA, 50 bp, Homo sapiens
tgtgaatactgtgtagcaggatcttgagagtccttgttcttacataggca

SEQ ID NO: 3342 - DNA, 50 bp, Homo sapiens
aagaggcttccatccctccttccttctttcctcctacagtgctgagcaaa

SEQ ID NO: 3343 - DNA, 50 bp, Homo sapiens
gttgaattggggtggatggggggagcaagcataatttttaagtgtgaagc

SEQ ID NO: 3344 - DNA, 50 bp, Homo sapiens; identical to SEQ ID NO: 876

SEQ ID NO: 3345 - DNA, 50 bp, Homo sapiens
cccactgaagtctttgggtagctcttaagccataactaaggagcagcatt

SEQ ID NO: 3346 - DNA, 50 bp, Homo sapiens
agtgacgaggaggaagtggcctacacgggttagctgcccagtgagccatc

SEQ ID NO: 3347 - DNA, 50 bp, Homo sapiens
aacagaagtcaagagaacatagaccaacttgctgcatgagtaaggtggct

SEQ ID NO: 3348 - DNA, 50 bp, Homo sapiens
ttttccctgctattgaggaagtattttgccttccctactcactgagaagt

SEQ ID NO: 3349 - DNA, 50 bp, Homo sapiens
cggaaccagaatttgatctcaactatgttccactaaaggcacaggaatgg

SEQ ID NO: 3350 - DNA, 50 bp, Homo sapiens
cgcaccttgtgtcttgtagggtatggtatgtgggacttcgctgtttttat

SEQ ID NO: 3351 - DNA, 50 bp, Homo sapiens
agcagttatattgccccttggtttttattcagtttaactactgtttccaa

SEQ ID NO: 3352 - DNA, 50 bp, Homo sapiens
agcaaaatcctcagaaatggtctaaataaaacacttgatatgcctagaga

SEQ ID NO: 3353 - DNA, 50 bp, Homo sapiens; identical to SEQ ID NO: 879

SEQ ID NO: 3354 - DNA, 50 bp, Homo sapiens
ttacctggattccattggctggttttaccactcctatcagattgtagtgt

SEQ ID NO: 3355 - DNA, 50 bp, Homo sapiens
ctctttgccctctatcctgagtaactaatggacatcttctcatgcaaggt

SEQ ID NO: 3356 - DNA, 50 bp, Homo sapiens
gccacagaatggtcacccagcttatttaggtgtagacaagtatgacacag

SEQ ID NO: 3357 - DNA, 50 bp, Homo sapiens
gccacagaggctccaatacctgggaatgttcacaaagtcatcaactggaa

SEQ ID NO: 3358 - DNA, 50 bp, Homo sapiens
agaatgtgtgtgcctgtgggtctctacaagtgacagatgtgttgttttca

SEQ ID NO: 3359 - DNA, 50 bp, Homo sapiens
tccaaattgtttcctaacattctattttatgcctttgcgtattaaacgtg

SEQ ID NO: 3360 - DNA, 50 bp, Homo sapiens
gcctctactgtggcctcaaccctggcaattatagctactcccatccctta

SEQ ID NO: 3361 - DNA, 50 bp, Homo sapiens
aactgaacacaattttgggacaacgtttaaacattacttttcatacttga

SEQ ID NO: 3362 - DNA, 50 bp, Homo sapiens
ctcagcccagcccgcctgtccctagattcagccacatcagaaataaactg

SEQ ID NO: 3363 - DNA, 50 bp, Homo sapiens
actgtgccatggacatttttcctctggggaattaacatctaaattctggt

SEQ ID NO: 3364 - DNA, 50 bp, Homo sapiens
acaacgctcttagagaatccgtgaatgtgaacagacaaatgtggctaacc

SEQ ID NO: 3365 - DNA, 50 bp, Homo sapiens
taggagaataagagtctggagactgggagccttcacttcggcctccgatt

SEQ ID NO: 3366 - DNA, 50 bp, Homo sapiens
tgctgagtggttacactttgcaagctgtggtgaagatcacactgtgaaga

SEQ ID NO: 3367 - DNA, 50 bp, Homo sapiens
cccagtgctgatggagatgccactttcgtgtgactgcgaacattaaagca

SEQ ID NO: 3368 - DNA, 50 bp, Homo sapiens
tgttcaggatctcctcccttgtttaaatgtcaataaatgccccaactgct

SEQ ID NO: 3369 - DNA, 50 bp, Homo sapiens
ttattcatatattcctgtccaaagccacactgaaaacagaggcagagaca

SEQ ID NO: 3370 - DNA, 50 bp, Homo sapiens
aggtcatccacacacttctgcccccactgcattgaattttttgcttatgt

SEQ ID NO: 3371 - DNA, 50 bp, Homo sapiens
ttttcgttctcctcctaccccagatctctacaaggacattgcccctaagc

SEQ ID NO: 3372 - DNA, 50 bp, Homo sapiens
gtgtttgtaattcttctttgtccttttacctacagaaatggtcacatggt

SEQ ID NO: 3373 - DNA, 50 bp, Homo sapiens
aggatgtttgtagtgctataatatagaatgggatttactctgctttacca

SEQ ID NO: 3374 - DNA, 50 bp, Homo sapiens
agctaattatctctttgagtccttgcttctgtttgctcacagtaagctca

SEQ ID NO: 3375 - DNA, 50 bp, Homo sapiens
tcctacttatttaagctatttgagctccgggtctcttctacctgcattct

SEQ ID NO: 3376 - DNA, 50 bp, Homo sapiens
agtgattgccacctaaatcagaagacgttctaaagtcagtaagaaagtgt

SEQ ID NO: 3377 - DNA, 50 bp, Homo sapiens
cacgcttagggcagggatctgggaaattccagtgatctcctttagcagag

SEQ ID NO: 3378 - DNA, 50 bp, Homo sapiens
tttctaatcgaggtgtgaaaaagttctaggttcagttgaagttctgatga

SEQ ID NO: 3379 - DNA, 50 bp, Homo sapiens
tcattctgtttttgatgaacatttggaaactgtcgggctttttattaaag

SEQ ID NO: 3380 - DNA, 50 bp, Homo sapiens
caatgccctgtgttaaattgtttaaaagtttcccttttcttttttgccaa

SEQ ID NO: 3381 - DNA, 50 bp, Homo sapiens
acctattgcatggaaagatgctcattatagtgaagttaataaagcacctt

SEQ ID NO: 3382 - DNA, 50 bp, Homo sapiens
agaggactatagtggaagtgaaagcattctgtgtttactctttgcattaa

SEQ ID NO: 3383 - DNA, 50 bp, Homo sapiens
tgaattgcactgtgaaaagcactcttccctctcagttttcgttcatcctg

SEQ ID NO: 3384 - DNA, 50 bp, Homo sapiens
ccatggggtcagaagggcacggtagttcttgcaattatttttgttttacc

SEQ ID NO: 3385 - DNA, 50 bp, Homo sapiens
aatgtgggaaggatttatttacagtgtgttgtaattttgtaaggccaact

SEQ ID NO: 3386 - DNA, 50 bp, Homo sapiens
agctactgtgacagaaacagaaaagcagtggacaacacgtttccaagaag

SEQ ID NO: 3387 - DNA, 50 bp, Homo sapiens
tgctcatgctgacttaaaacactagcagtaaaacgctgtaaactgtaaca

SEQ ID NO: 3388 - DNA, 50 bp, Homo sapiens
tccaatgcagtcccattctttatggcctatagtctcactcccaactaccc

SEQ ID NO: 3389 - DNA, 50 bp, Homo sapiens
ggtgtctgacttaatgactcctgctgaagttgaattgtgagatgttatcc

SEQ ID NO: 3390 - DNA, 50 bp, Homo sapiens
catttgtctggaaatgctgccgggagcctattgtgtaaatgtaggtattt

SEQ ID NO: 3391 - DNA, 50 bp, Homo sapiens; identical to SEQ ID NO: 814

SEQ ID NO: 3392 - DNA, 50 bp, Homo sapiens
caggtcaacccccaccggacctacaacccgcagtcccacatcatctcagg

SEQ ID NO: 3393 - DNA, 50 bp, Homo sapiens; identical to SEQ ID NO: 3392

SEQ ID NO: 3394 - DNA, 50 bp, Homo sapiens
tttagggttgtgactggctttggtgcaaatgtgtgctcaagctaataagt

SEQ ID NO: 3395 - DNA, 50 bp, Homo sapiens
acttgtgttttgtttgggggctgggaaatgtatttttacattgtagccaa

SEQ ID NO: 3396 - DNA, 50 bp, Homo sapiens
aacattgtgctctaacagtatgactattctttcccccactcttaaacagt

SEQ ID NO: 3397 - DNA, 50 bp, Homo sapiens
ccaagggaggagggaggaggtaaaaggcagggagttaataacatgaatta

SEQ ID NO: 3398 - DNA, 50 bp, Homo sapiens
tactctttggcatccagtctctcgtggcgattgattatgcttgtgtgagg

SEQ ID NO: 3399 - DNA, 50 bp, Homo sapiens
ccttccagaagctacgaaaaagggagctgtttaaatttaataaatctctg

SEQ ID NO: 3400 - DNA, 50 bp, Homo sapiens
aagtgccatagaagaccaataactgtttagttgaggctagtctggaacct

SEQ ID NO: 3401 - DNA, 50 bp, Homo sapiens
tggattcaagttactgaagtgaataccaataaaaagaaaaccctaggcca

SEQ ID NO: 3402 - DNA, 50 bp, Homo sapiens
aggagtggatcccaccttcaacaccttacaagtaaagacaatgaagaaca

SEQ ID NO: 3403 - DNA, 50 bp, Homo sapiens
cagtaatagctgaacctgttcaaaatgttaataaaggtttcgttgcatgg

SEQ ID NO: 3404 - DNA, 50 bp, Homo sapiens
agggagtggggaggtggtaagaacacctgacaacttctgaatattggaca

SEQ ID NO: 3405 - DNA, 50 bp, Homo sapiens
aaaattagtggattgactccactttgttgtgttgttttcattgttgaaaa

SEQ ID NO: 3406 - DNA, 50 bp, Homo sapiens
aatggaggcacgaacgcaggggccaaatagcaataaatgggttttgtttt

SEQ ID NO: 3407 - DNA, 50 bp, Homo sapiens
tgttttgattgttttgcaaggaagaaagacaatggaataacataccttca

SEQ ID NO: 3408 - DNA, 50 bp, Homo sapiens
tcattgctgtctacaggtttctttcagattatgttcatgggtttgtgtgt

SEQ ID NO: 3409 - DNA, 50 bp, Homo sapiens
gaaaacagaccttgtgctgaggacacgtcaataaaaattataccttcccc

SEQ ID NO: 3410 - DNA, 50 bp, Homo sapiens
gggataccagctgagtctgaattctgctctaaataaagacgactacagag

SEQ ID NO: 3411 - DNA, 50 bp, Homo sapiens
tggctcggataagagatgggacatcattcagtcactagttggatggcaca

SEQ ID NO: 3412 - DNA, 50 bp, Homo sapiens
aacttgatgaaagtattgcagtattgatgccattgtagaatagaactgga

SEQ ID NO: 3413 - DNA, 50 bp, Homo sapiens
tttgtgtgttgggaccaaacagttgtcaataaactttacaagcgagcatc

SEQ ID NO: 3414 - DNA, 50 bp, Homo sapiens; identical to SEQ ID NO: 1675

SEQ ID NO: 3415 - DNA, 50 bp, Homo sapiens
aggtggtcaatgaatgttttgatgaaatgaatgtttttgtataatggcct

SEQ ID NO: 3416 - DNA, 50 bp, Homo sapiens
acgggacaattttaagatgtaataccaatactttagaagtttggtcgtgt

SEQ ID NO: 3417 - DNA, 50 bp, Homo sapiens; identical to SEQ ID NO: 612

SEQ ID NO: 3418 - DNA, 50 bp, Homo sapiens; identical to SEQ ID NO: 612

SEQ ID NO: 3419 - DNA, 50 bp, Homo sapiens
acttttatgtaaaaaagtgcacctttagttttacaagtaaagcaggttgt

SEQ ID NO: 3420 - DNA, 50 bp, Homo sapiens
tcttaataataatgaagacgacttaccctgtggaattgaacacactggtg

SEQ ID NO: 3421 - DNA, 50 bp, Homo sapiens
gctgctgtgtgtatttatgaatattaatgaataaaaactgcttggatggt

SEQ ID NO: 3422 - DNA, 50 bp, Homo sapiens; identical to SEQ ID NO: 812

SEQ ID NO: 3423 - DNA, 50 bp, Homo sapiens
taaatttatttatttatgaaaaaacctcgtgccgaattcttggcctcgag

SEQ ID NO: 3424 - DNA, 50 bp, Homo sapiens
gggtttccgctggctctcccagtatattgactgatgtttggacggtgaaa

SEQ ID NO: 3425 - DNA, 50 bp, Homo sapiens
gtacagttactcatgtcattgtaatgatttcactcctaactgtgacattt

SEQ ID NO: 3426 - DNA, 50 bp, Homo sapiens
actgagttgtcagaaattatgtcaaaatgaaaactgtttgtttcatgaca

SEQ ID NO: 3427 - DNA, 50 bp, Homo sapiens
acctgacttcaccatgtttattccctttgcctacaaccagttaatatctg

SEQ ID NO: 3428 - DNA, 50 bp, Homo sapiens
tcatgcgtgaacaatttaaaaaacgacagaataaggtacaaatgtagtgt

SEQ ID NO: 3429 - DNA, 50 bp, Homo sapiens
cccatcccccctccccacccccatccccaatacagctacgtttgtacatc

SEQ ID NO: 3430 - DNA, 50 bp, Homo sapiens
ccaacaaaattgggatcatccaaactgagtccatctggctaattctaaat

SEQ ID NO: 3431 - DNA, 50 bp, Homo sapiens
tgactggaactgagagtaaattgggaatgtatgaccaatcttagaccctg

SEQ ID NO: 3432 - DNA, 50 bp, Homo sapiens
tgtttaaatgatggtgaatactttcttaacactggtttgtctgcatgtgt

SEQ ID NO: 3433 - DNA, 50 bp, Homo sapiens
acctaaggtcaagctgggagagagaaatgactgagatgaatgtctttact

SEQ ID NO: 3434 - DNA, 50 bp, Homo sapiens
gcttagggaaatttcacagttcattgtggagtgttaaacttagaacatgt

SEQ ID NO: 3435 - DNA, 50 bp, Homo sapiens
tgttacaggtttccaaggtggacttgaacagatggccttatattaccaaa

SEQ ID NO: 3436 - DNA, 50 bp, Homo sapiens
tgttactgctttgccagttctacgttatttacaattattcagctcttgca

SEQ ID NO: 3437 - DNA, 50 bp, Homo sapiens
tttctgtattgcagtgtttataggcttcttgtgtgttaaacttgatttca

SEQ ID NO: 3438 - DNA, 50 bp, Homo sapiens; identical to SEQ ID NO: 860

SEQ ID NO: 3439 - DNA, 50 bp, Homo sapiens
gtttgtgttaccctcctgtaaatggtgtacataatgtattgttggtaatt

SEQ ID NO: 3440 - DNA, 50 bp, Homo sapiens
gctcaccatacggctctaacagattaggggctaaaacgattactgacttt

SEQ ID NO: 3441 - DNA, 50 bp, Homo sapiens
cggctgatgggacaggaattgaagaagagaattgactcgtatgaacagga

SEQ ID NO: 3442 - DNA, 50 bp, Homo sapiens
tggtgctacgaagccatttctcttgatttttagtaaacttttatgacagc

SEQ ID NO: 3443 - DNA, 50 bp, Homo sapiens
tgagaaactgtttgacctggttcgaagaatgttagaatatgatccaactc

SEQ ID NO: 3444 - DNA, 50 bp, Homo sapiens
ggtgggacacgccaagctcttcagtgaagacacgatgttattaaaagcct

SEQ ID NO: 3445 - DNA, 50 bp, Homo sapiens
tgctttgaagctacctggatatttcctatttgaaataaaattgttcggtc

SEQ ID NO: 3446 - DNA, 50 bp, Homo sapiens
atcgccaagaacctggttagaggcataaagaccttttttcaccgttacct

SEQ ID NO: 3447 - DNA, 50 bp, Homo sapiens
tgctgcgacgcacatacatacgtgttgtgtctgtcaataaagtgtaaata

SEQ ID NO: 3448 - DNA, 50 bp, Homo sapiens
tgggaggagataagaagagaaagggccaagtgatccagttctaagtgtca

SEQ ID NO: 3449 - DNA, 50 bp, Homo sapiens
tgcagtagttgactttgctgtatggaaaaataaagtgaaattgccctaat

SEQ ID NO: 3450 - DNA, 50 bp, Homo sapiens
gctaaataaggaatactcatgccaagatcatcgaattgtgcctcctccct

SEQ ID NO: 3451 - DNA, 50 bp, Homo sapiens; identical to SEQ ID NO: 1780

SEQ ID NO: 3452 - DNA, 50 bp, Homo sapiens
ggagtcagtcagtgctcctatatttttcattttttgtcaaagcaagaagt

SEQ ID NO: 3453 - DNA, 50 bp, Homo sapiens
tttgtggccgagtgtaacaaccatataataaatcacctcttccgctgttt

SEQ ID NO: 3454 - DNA, 50 bp, Homo sapiens
ttctacatgaaatgtttagctcttacactctatccttcctagaaaatggt

SEQ ID NO: 3455 - DNA, 50 bp, Homo sapiens
ggacgacagtgaaatctagagtaaaaccaagctggcccaagtgtcctgca

SEQ ID NO: 3456 - DNA, 50 bp, Homo sapiens
tgttttggggtctgtgagagtacatgtattatatacaagcacaacagggc

SEQ ID NO: 3457 - DNA, 50 bp, Homo sapiens
aggaacagttagttctcatctagaatgaaagttccatatatgcattggtg

SEQ ID NO: 3458 - DNA, 50 bp, Homo sapiens
tgtgtgtgtatcccataccccactctggaaggaaccatccagtaaaggtc

SEQ ID NO: 3459 - DNA, 50 bp, Homo sapiens
gtgcaaggggagcacatattggatgtatatgttaccatatgttaggaaat

SEQ ID NO: 3460 - DNA, 50 bp, Homo sapiens; identical to SEQ ID NO: 293

SEQ ID NO: 3461 - DNA, 50 bp, Homo sapiens
acccagtcacctctgtcttcagcaccctcataagtcgtcactaatacaca

SEQ ID NO: 3462 - DNA, 50 bp, Homo sapiens
tgaatcacattgtcagaattttttcctcctcgctgttcaattttgtagtt

SEQ ID NO: 3463 - DNA, 50 bp, Homo sapiens
agatgccttgttgctttgaagaagggagtgatgtcaattctcttgttaca

SEQ ID NO: 3464 - DNA, 50 bp, Homo sapiens; identical to SEQ ID NO: 649

SEQ ID NO: 3465 - DNA, 50 bp, Homo sapiens
aaaagttctctgtagatttctgaagtgcatattcattgatgccaagaaaa

SEQ ID NO: 3466 - DNA, 50 bp, Homo sapiens
ggaggagtttgcatgtctcatgataaccaaatgtaagatgaaaataaaag

SEQ ID NO: 3467 - DNA, 50 bp, Homo sapiens
ttggtgacttagtgattttgtcattttttacatcaacttcatggtcttgt

SEQ ID NO: 3468 - DNA, 50 bp, Homo sapiens
cgcccggcagcccccatccatctgtgtctgtctgttggcctgtatctgtt

SEQ ID NO: 3469 - DNA, 50 bp, Homo sapiens
ggcatcgccaacgcctgcctcgtgccacctcatgcttataataaagccgg

SEQ ID NO: 3470 - DNA, 50 bp, Homo sapiens; identical to SEQ ID NO: 3210

SEQ ID NO: 3471 - DNA, 50 bp, Homo sapiens
gccgtcctcagttacctttcatgaggcttctagccaaagatgataaaggg

SEQ ID NO: 3472 - DNA, 50 bp, Homo sapiens
aggataaaatcattgtctctggaggcaatttggaaattatttctgcttct

SEQ ID NO: 3473 - DNA, 50 bp, Homo sapiens
cgggtgattacaggcaccagtgcagtgatgattgtacttatttgacacat

SEQ ID NO: 3474 - DNA, 50 bp, Homo sapiens
gcctctggtgctttgtcctgtatttggtttaatgtttttgtcctaatctc

SEQ ID NO: 3475 - DNA, 50 bp, Homo sapiens
ttgatgtgaattcagttattgaacttgttacttgtttttgccagaaatgt

SEQ ID NO: 3476 - DNA, 50 bp, Homo sapiens
aagcttcgaactcaaaatcatggaaaggttttaagatttgaggttggttt

SEQ ID NO: 3477 - DNA, 50 bp, Homo sapiens
cccagttagatatcagtgagtttgaataactgaagaaatgttgacaatgt

SEQ ID NO: 3478 - DNA, 50 bp, Homo sapiens
aagtacacctgtcagctgtttcttaccacttcgatggttgtgattaattt

SEQ ID NO: 3479 - DNA, 50 bp, Homo sapiens
tgtttgcttgaacagttgtgtaaatcatacaggattttgtgggtattggt

SEQ ID NO: 3480 - DNA, 50 bp, Homo sapiens
tgaccttctgtgtttttgtttctgacttgaataatttatcaatggtgttg

SEQ ID NO: 3481 - DNA, 50 bp, Homo sapiens
ccagggctgctttgctgtgatgatgattgcatttcaacacatgccagatg

SEQ ID NO: 3482 - DNA, 50 bp, Homo sapiens
gagttaccacaccccatgagggaagctctaaatagccaacacccatctgt

SEQ ID NO: 3483 - DNA, 50 bp, Homo sapiens
ttctatccttgacttagattctggtggagagaagtgagaataggcagccc

SEQ ID NO: 3484 - DNA, 50 bp, Homo sapiens
tcttgctctttctactctgaactaataaagctgttgccaagctggacggc

SEQ ID NO: 3485 - DNA, 50 bp, Homo sapiens
tgcaaacaaatgcataaatgcaaatgtaaagtaaagctgaaattgatctc

SEQ ID NO: 3486 - DNA, 50 bp, Homo sapiens; identical to SEQ ID NO: 1727

SEQ ID NO: 3487 - DNA, 50 bp, Homo sapiens
tgcaatggaatataaatatcacaaagttgtttaactagactgcgtgttgt

SEQ ID NO: 3488 - DNA, 50 bp, Homo sapiens
tttcacctcctcagtcccttgcctaccccagtgagagtctgatcttgttt

SEQ ID NO: 3489 - DNA, 50 bp, Homo sapiens
cgcctctccccgtggaccctgttaatcccaataaaattctgagcaagttc

SEQ ID NO: 3490 - DNA, 50 bp, Homo sapiens
aggattcgctgttgaaacaagttgtccaagcaatgttatattcattttta

SEQ ID NO: 3491 - DNA, 50 bp, Homo sapiens
ggaagggggacaagggtcagtctgtcgggtgggggcagaaatcaaatcag

SEQ ID NO: 3492 - DNA, 50 bp, Homo sapiens; identical to SEQ ID NO: 3491

SEQ ID NO: 3493 - DNA, 50 bp, Homo sapiens
tttttcccagctcgccacagaatggatcatgaagactgacaactgcaaaa

SEQ ID NO: 3494 - DNA, 50 bp, Homo sapiens
aggagtggcctaagaaatgcgtgtttcagtgactagattataaatattct

SEQ ID NO: 3495 - DNA, 50 bp, Homo sapiens
agctgtgaacttcgtaactttgtaaagcaagatataaagcaaatacaaga

SEQ ID NO: 3496 - DNA, 50 bp, Homo sapiens
aggagggatcacctgcactgagaatgaggcagtttgacacagatcacaaa

SEQ ID NO: 3497 - DNA, 50 bp, Homo sapiens
tgttccactaccagccttacttgtttaataaaaatcagtgcaaagagaaa

SEQ ID NO: 3498 - DNA, 50 bp, Homo sapiens
acctcagattttgttacctgtcttttaaaaatgcagattttgtcaaatca

SEQ ID NO: 3499 - DNA, 50 bp, Homo sapiens
ttaacggcttcactggacagttttccttagaaggtagttttgtgtgactg

SEQ ID NO: 3500 - DNA, 50 bp, Homo sapiens
accgtgggtgtgtccaagaagaaataagtctgtaggccttgtctgttaat

SEQ ID NO: 3501 - DNA, 50 bp, Homo sapiens
ccaatggatatttctgtattactagggaggcatttacagtcctctaatgt

SEQ ID NO: 3502 - DNA, 50 bp, Homo sapiens
tagctttagaaaataacagtttgtgaacttacttccctatatttgcagct

SEQ ID NO: 3503 - DNA, 50 bp, Homo sapiens
ctttgtggactagccaaggctgtgagggccagaataaacaactgctcaac

SEQ ID NO: 3504 - DNA, 50 bp, Homo sapiens
gccgagcaatgacccttttcaatttcttatttctgtgttactgaggaccc

SEQ ID NO: 3505 - DNA, 50 bp, Homo sapiens
gaaacatgtggatttgctgtggaatgacaagcttcaaggatttacccagg

SEQ ID NO: 3506 - DNA, 50 bp, Homo sapiens
tttgatctgaaatgtttgagaagacacgaataaagttacttgggcagaaa

SEQ ID NO: 3507 - DNA, 50 bp, Homo sapiens
tcccatcaaaaaggtatcaaatgccttggaagctccctgatcctacaaaa

SEQ ID NO: 3508 - DNA, 50 bp, Homo sapiens
atctgacattattgtaactaccgtgtgatcagtaagattcctgtaagaaa

SEQ ID NO: 3509 - DNA, 50 bp, Homo sapiens
accttgtaccatggaaaacatgaaaagagtcttagaagtaaagaacaaca

SEQ ID NO: 3510 - DNA, 50 bp, Homo sapiens
agcatgtgtctgccatttcatttgtacgcttgttcaaaaccaagtttgtt

SEQ ID NO: 3511 - DNA, 50 bp, Homo sapiens
tgagctgtattaccataagtagaattttaagtaaactggtgaatttgggc

SEQ ID NO: 3512 - DNA, 50 bp, Homo sapiens
gccccattaaagggtgaacttgtaataaattggaatttcaaataaacctc

SEQ ID NO: 3513 - DNA, 50 bp, Homo sapiens; identical to SEQ ID NO: 991

SEQ ID NO: 3514 - DNA, 50 bp, Homo sapiens
aacgtcatgtgcacctttacactgtggttagtgtaataaaacatgttcct

SEQ ID NO: 3515 - DNA, 50 bp, Homo sapiens; identical to SEQ ID NO: 3369

SEQ ID NO: 3516 - DNA, 50 bp, Homo sapiens
gcagccacccactgggagtcttgtttttatttataataaaattgttgggg

SEQ ID NO: 3517 - DNA, 50 bp, Homo sapiens
atccaccaaaaattaggtcatcatagttgaggtatgtgtctgctatttgc

SEQ ID NO: 3518 - DNA, 50 bp, Homo sapiens
ccattggctggaacatggattggggatttgatagaaaaataaaccctgct

SEQ ID NO: 3519 - DNA, 50 bp, Homo sapiens
gttccttactctgtccttgatggaggggagaagggagggcaaagaagtta

SEQ ID NO: 3520 - DNA, 50 bp, Homo sapiens
tggttttcctttggggacgtggttaacggtccagaagaatcccttctaga

SEQ ID NO: 3521 - DNA, 50 bp, Homo sapiens
acccctttcactcttggctttcttatgttgctttcatgaatggaatggaa

SEQ ID NO: 3522 - DNA, 50 bp, Homo sapiens
cccatcctcatcccccacactgggatagatgcttgtttgtaaaaactcac

SEQ ID NO: 3523 - DNA, 50 bp, Homo sapiens
tcaggccgcctagctgcccctttgccaggttaataaagcactgacttgtt

SEQ ID NO: 3524 - DNA, 50 bp, Homo sapiens
aaggattttaaataactgccgacttcaaaagtgttcttaaaacgaaagat

SEQ ID NO: 3525 - DNA, 50 bp, Homo sapiens
cacccaccctccccccaatcagtgttcttatttcagtgacaataaaccat

SEQ ID NO: 3526 - DNA, 50 bp, Homo sapiens
atagctggtgacaaacagatggttgctcagggacaaggtgccttccaatg

SEQ ID NO: 3527 - DNA, 50 bp, Homo sapiens; identical to SEQ ID NO: 922

SEQ ID NO: 3528 - DNA, 50 bp, Homo sapiens; identical to SEQ ID NO: 1047

SEQ ID NO: 3529 - DNA, 50 bp, Homo sapiens; identical to SEQ ID NO: 1104

SEQ ID NO: 3530 - DNA, 50 bp, Homo sapiens
gctgctgtgtgtggtctcagaggctctgcttccttaggttacaaaacaaa

SEQ ID NO: 3531 - DNA, 50 bp, Homo sapiens; identical to SEQ ID NO: 817

SEQ ID NO: 3532 - DNA, 50 bp, Homo sapiens
ccccacaatggtctcttttctccctgctcccttattaaagaactctttct

SEQ ID NO: 3533 - DNA, 50 bp, Homo sapiens
cagtggttcccattgattctccccatatctttttgctctcaggctctggc

SEQ ID NO: 3534 - DNA, 50 bp, Homo sapiens
cttgtatctctaaatatggtgtgatatgaaccagtccattcacattggaa

SEQ ID NO: 3535 - DNA, 50 bp, Homo sapiens
acatagattttctgccaacaaatcctctctgctgttcacattatcctttg

SEQ ID NO: 3536 - DNA, 50 bp, Homo sapiens; identical to SEQ ID NO: 1484

SEQ ID NO: 3537 - DNA, 50 bp, Homo sapiens
ttagaaccaaagttattcttaataaaaatcaccacatgcttggaccatgc

SEQ ID NO: 3538 - DNA, 50 bp, Homo sapiens
gctcttacacttcgtctttaatgttctttttggagttaggacctctcagt

SEQ ID NO: 3539 - DNA, 50 bp, Homo sapiens
accttgacatgggttgtctaataaaactcggacccttcttgtgaaatcaa

SEQ ID NO: 3540 - DNA, 50 bp, Homo sapiens
atcccagtgcacagtgagttgtatatcacaaataggaggccacttcagga

SEQ ID NO: 3541 - DNA, 50 bp, Homo sapiens
gaagctgctaggggaaggactggcctggctccagaatgttgttgcctttt

SEQ ID NO: 3542 - DNA, 50 bp, Homo sapiens
gggaaggaaaaggggtgtggcagctgggagcgtttatttatgttctttct

SEQ ID NO: 3543 - DNA, 50 bp, Homo sapiens
gagtggtgttcccagtgtggctcccagagctttgaccagattgtgatccc

SEQ ID NO: 3544 - DNA, 50 bp, Homo sapiens
ctttgcatttagggacacagcccggagccgcagaaggtcagcagggagca

SEQ ID NO: 3545 - DNA, 50 bp, Homo sapiens
cattgcctactttaacacctgtcagagaaacgtgatatggggtaaggagg

SEQ ID NO: 3546 - DNA, 50 bp, Homo sapiens
gcaatctgggagcagcacattgttgatggagtccaagtgagcacatttca

SEQ ID NO: 3547 - DNA, 50 bp, Homo sapiens
ctctcctggactgttgcagttgggtgtggctgatttgaaattgtgcttca

SEQ ID NO: 3548 - DNA, 50 bp, Homo sapiens
taacaagaattgcattgaggaaacaaggctccacagggccaatcttctgg

SEQ ID NO: 3549 - DNA, 50 bp, Homo sapiens
aagaagttacatcttcaatgtccagggatgatcgtttgaagagaacctct

SEQ ID NO: 3550 - DNA, 50 bp, Homo sapiens
aaaacattgccagaccatttagtcctcttggaagggcctctccggtgggg

SEQ ID NO: 3551 - DNA, 50 bp, Homo sapiens
agggataataaggttagctgttaaccaagcaactgagcttttaaccaaag

SEQ ID NO: 3552 - DNA, 50 bp, Homo sapiens
caagacactgtggacttggtcaccagctcctcccttgttctctaagttcc

SEQ ID NO: 3553 - DNA, 50 bp, Homo sapiens
tctttgacggggttttccttgctcctgccaggattaaaagtccatgagtt

SEQ ID NO: 3554 - DNA, 50 bp, Homo sapiens
cttaaagtatatgttttcaaattgccattgctactattgcttgtcggtgt

SEQ ID NO: 3555 - DNA, 50 bp, Homo sapiens
ctcctgtcaccggccttgtgacattcactcagagaagaccacaccaagga

SEQ ID NO: 3556 - DNA, 50 bp, Homo sapiens
gtcggactatgtaattgtaactatacctctggttcccattaaaagtgacc

SEQ ID NO: 3557 - DNA, 50 bp, Homo sapiens
gctagtgtttgaatatgctctcttgttgctctaattctgtgcctccgtgc

SEQ ID NO: 3558 - DNA, 50 bp, Homo sapiens
agaggaacttgaaaccttgaaagacatttgttctcccaaaactgattact

SEQ ID NO: 3559 - DNA, 50 bp, Homo sapiens
actgggatattgcccacatgatcagtggctttgaatgaaatacagatgca

SEQ ID NO: 3560 - DNA, 50 bp, Homo sapiens; identical to SEQ ID NO: 2932

SEQ ID NO: 3561 - DNA, 50 bp, Homo sapiens
tttcttaggacaccatttgggctagtttctgtgtaagtgtaaatactaca

SEQ ID NO: 3562 - DNA, 50 bp, Homo sapiens; identical to SEQ ID NO: 2488

SEQ ID NO: 3563 - DNA, 50 bp, Homo sapiens
ttaacaccccacacccacccctcagttgggacaaataaaggattctcatg

SEQ ID NO: 3564 - DNA, 50 bp, Homo sapiens
caagccgccacatgcccacaacctcaccagagggagaattatgtttctaa

SEQ ID NO: 3565 - DNA, 50 bp, Homo sapiens
gtgtattgatccaagtagtcaaagtgtcttaaagggcacctatttgtcct

SEQ ID NO: 3566 - DNA, 50 bp, Homo sapiens
agtgctttccaaatgtgattgttctgggtgatgggacatatgggcagttg

SEQ ID NO: 3567 - DNA, 50 bp, Homo sapiens
cgggggaataggaggaaaaacatggcatggaacaaaccaacataaaaggt

SEQ ID NO: 3568 - DNA, 50 bp, Homo sapiens
actaattctgctctttggacaagtgcctgacatctgcttcattgggtttt

SEQ ID NO: 3569 - DNA, 50 bp, Homo sapiens
aggaataaagttaagtatttcccacttggaaattgtaccactcctggggt

SEQ ID NO: 3570 - DNA, 50 bp, Homo sapiens; identical to SEQ ID NO: 2144

SEQ ID NO: 3571 - DNA, 50 bp, Homo sapiens
gtctggtaagccgatgctaatggcagaagcaatagaagtccaaggcacta

SEQ ID NO: 3572 - DNA, 50 bp, Homo sapiens; identical to SEQ ID NO: 3416

SEQ ID NO: 3573 - DNA, 50 bp, Homo sapiens
ctctcagttcccaagatggccccacattcccattgttttccccaagagaa

SEQ ID NO: 3574 - DNA, 50 bp, Homo sapiens
ggttgttgtattgtaccagtgaaatgccaaatttgaaaggcctgtactgc

SEQ ID NO: 3575 - DNA, 50 bp, Homo sapiens
ttgtttgccatctgttgatcaggaactacttcagctacttgcatttgatt

SEQ ID NO: 3576 - DNA, 50 bp, Homo sapiens; identical to SEQ ID NO: 2966

SEQ ID NO: 3577 - DNA, 50 bp, Homo sapiens
acagagagcacccaggaggtacacatactaaagtgacacaaagagaatga

SEQ ID NO: 3578 - DNA, 50 bp, Homo sapiens; identical to SEQ ID NO: 1887

SEQ ID NO: 3579 - DNA, 50 bp, Homo sapiens
agcatgttgtttaatttctttttaaaaatcactgttgggctttgaaagca

SEQ ID NO: 3580 - DNA, 50 bp, Homo sapiens
gctgacaaaacctgggaatttgggttgtgtatgcgaatgtttcagtgcct

SEQ ID NO: 3581 - DNA, 50 bp, Homo sapiens
tcactttccaaatgcctgttttgtgctttacaataaatgatatgaaacct

SEQ ID NO: 3582 - DNA, 50 bp, Homo sapiens
tttatgcgtatttaagccttggaaacacagggactatcttgtggattggg

SEQ ID NO: 3583 - DNA, 50 bp, Homo sapiens; identical to SEQ ID NO: 2782

SEQ ID NO: 3584 - DNA, 50 bp, Homo sapiens
acatccagtgtctccaaaattgtttccttgtactgatataaacacttcca

SEQ ID NO: 3585 - DNA, 50 bp, Homo sapiens
ggtacagttggagcactatatgtactctctggactactttggacagaagt

SEQ ID NO: 3586 - DNA, 50 bp, Homo sapiens
aaaatcacctcaacagccctgtgaagtgacctcagtgagatatttggatc

SEQ ID NO: 3587 - DNA, 50 bp, Homo sapiens
ttaaagtgcaccttccaaaatgtctcccataagtaggtaagaccaacctg

SEQ ID NO: 3588 - DNA, 50 bp, Homo sapiens
aatgatgagtgtgtggctacatacaaaggagttccctttgaggtgaaagg

SEQ ID NO: 3589 - DNA, 50 bp, Homo sapiens; identical to SEQ ID NO: 2872

SEQ ID NO: 3590 - DNA, 50 bp, Homo sapiens; identical to SEQ ID NO: 2749

SEQ ID NO: 3591 - DNA, 50 bp, Homo sapiens
ttgtccacaagtaaaaggaaatcctcctccagggagtctcagcttcaccc

SEQ ID NO: 3592 - DNA, 50 bp, Homo sapiens
cattgctctttagtgtgtgttaacctgtggtttgaaagaaatgctcttgt

SEQ ID NO: 3593 - DNA, 50 bp, Homo sapiens
gtctggcttaactatttttgaaaatataactgtttcccctctctgctgct

SEQ ID NO: 3594 - DNA, 50 bp, Homo sapiens
aaaagcaattacccttaaaactgtactctggcctacttttctattttgca

SEQ ID NO: 3595 - DNA, 50 bp, Homo sapiens
ggctctcagtgtgccatagaggacagcaactggtgattgtttcagagaaa

SEQ ID NO: 3596 - DNA, 50 bp, Homo sapiens
aaactgtttctttggtgtcctttacattgaaataaattgtgtttgtgcct

SEQ ID NO: 3597 - DNA, 50 bp, Homo sapiens; identical to SEQ ID NO: 2640

SEQ ID NO: 3598 - DNA, 50 bp, Homo sapiens
agagagggaacatcaaatgctggcactatatacatacgatcagcctgatt

SEQ ID NO: 3599 - DNA, 50 bp, Homo sapiens
gtcttccgagaaacttttctgatcagtttgcgagttttgatgagttttgt

SEQ ID NO: 3600 - DNA, 50 bp, Homo sapiens
gctgctgttgctgctttgtgatgacgtgagatcaataagaagaacctagt

SEQ ID NO: 3601 - DNA, 50 bp, Homo sapiens
aggactgaactgaacccctccccatgaacacaagggttttatcctttcct

SEQ ID NO: 3602 - DNA, 50 bp, Homo sapiens
gatgtggtaactgttaaattgctgtgtatctgatagctctttggcagtct

SEQ ID NO: 3603 - DNA, 50 bp, Homo sapiens
gatcaaaagggctatgggaagggcagaccccgccaatgatttctcttcac

SEQ ID NO: 3604 - DNA, 50 bp, Homo sapiens
gaacagctttgtgctccggctttccctcagggaacagcagagagcagttg

SEQ ID NO: 3605 - DNA, 50 bp, Homo sapiens
tccagggaccaacattaacacaaccaatcaacacatcatgttacagaact

SEQ ID NO: 3606 - DNA, 50 bp, Homo sapiens
tattaaaggcttttggcagcaaagtgtcagtgttggcagcgaagtgtcag

SEQ ID NO: 3607 - DNA, 50 bp, Homo sapiens
ttcacaagatgctttgaaggttctgattttcaactgatcaaactaatgca

SEQ ID NO: 3608 - DNA, 50 bp, Homo sapiens; identical to SEQ ID NO: 1944

SEQ ID NO: 3609 - DNA, 50 bp, Homo sapiens; identical to SEQ ID NO: 2738

SEQ ID NO: 3610 - DNA, 50 bp, Homo sapiens
ctgtgtctggcaccacccacacatccatgtctccctcacaacccaggagg

SEQ ID NO: 3611 - DNA, 50 bp, Homo sapiens
catgtatgtaggtgcctgggagtgtgtgtggtccttgctctggccctttc

SEQ ID NO: 3612 - DNA, 50 bp, Homo sapiens; identical to SEQ ID NO: 2263

SEQ ID NO: 3613 - DNA, 50 bp, Homo sapiens
tcttcggaaagaagaaggtgggaggatgtgaattgttagtttctgagttt

SEQ ID NO: 3614 - DNA, 50 bp, Homo sapiens
atcaagcctctgtgcctcagtttctctctcaggataaagagtgaatagag

SEQ ID NO: 3615 - DNA, 50 bp, Homo sapiens
gcgatagaggaaatctactccctatcttgggtccttgaactacagcctgc

SEQ ID NO: 3616 - DNA, 50 bp, Homo sapiens
ctagggagccgcaccttgtcatgtaccatcaataaagtaccctgtgctca

SEQ ID NO: 3617 - DNA, 50 bp, Homo sapiens
tttctccccctagtttgtgagaaacatctcaataaagtgctttccaaaaa

SEQ ID NO: 3618 - DNA, 50 bp, Homo sapiens; identical to SEQ ID NO: 3507

SEQ ID NO: 3619 - DNA, 50 bp, Homo sapiens
tgccaaaagtttgccatgtgccttaaacatattactatatattttcccct

SEQ ID NO: 3620 - DNA, 50 bp, Homo sapiens; identical to SEQ ID NO: 2975

SEQ ID NO: 3621 - DNA, 50 bp, Homo sapiens
ttaccaagaaggacttaagggagtaaggggcgcagattagcattgctcaa

SEQ ID NO: 3622 - DNA, 50 bp, Homo sapiens
gatatgcacatcaaagcctttaccagtatcttcctgtattccgtatcaga

SEQ ID NO: 3623 - DNA, 50 bp, Homo sapiens
ctctgaggcgtgaggactcgcagtcaggggcagctgaccatggaagattg

SEQ ID NO: 3624 - DNA, 50 bp, Homo sapiens
cctctcttcctccctggaatcttgtaaaggtcctggcaaagatgatcagt

SEQ ID NO: 3625 - DNA, 50 bp, Homo sapiens
gcctcctggtctcttcaccactgtagttctctcatttccaaaccatcagc

SEQ ID NO: 3626 - DNA, 50 bp, Homo sapiens
ttttccttctaacacttgtatttggaggctcttctgtgattttgagaagt

SEQ ID NO: 3627 - DNA, 50 bp, Homo sapiens; identical to SEQ ID NO: 2578

SEQ ID NO: 3628 - DNA, 50 bp, Homo sapiens
ggacatccactagagatgggtttgaggattttccaagcgtgtaataatga

SEQ ID NO: 3629 - DNA, 50 bp, Homo sapiens
ttgcacgcagagcctttaagtgactaaggaacaacatagatagtgagcat

SEQ ID NO: 3630 - DNA, 50 bp, Homo sapiens
actttaatctgatcttgtgtcttagagaagcccccatacctggtagagca

SEQ ID NO: 3631 - DNA, 50 bp, Homo sapiens
tgtaggaaaggatgcttcacaaactgaggtagataatgctatgctgtcgt

SEQ ID NO: 3632 - DNA, 50 bp, Homo sapiens; identical to SEQ ID NO: 3631

SEQ ID NO: 3633 - DNA, 50 bp, Homo sapiens
ctggggagaggctgaggacaaatacctgctgtcactccagaggacatttt

SEQ ID NO: 3634 - DNA, 50 bp, Homo sapiens
cattacttgtgagctgctgaacaaacaagtcaaggtgagcccggacatgg

SEQ ID NO: 3635 - DNA, 50 bp, Homo sapiens; identical to SEQ ID NO: 2547

SEQ ID NO: 3636 - DNA, 50 bp, Homo sapiens
gaaacttgctacagacttacccgtaatatttgtcaagatcatagctgact

SEQ ID NO: 3637 - DNA, 50 bp, Homo sapiens; identical to SEQ ID NO: 47

SEQ ID NO: 3638 - DNA, 50 bp, Homo sapiens
tgctaaatatgttattgtggaaagatgaatgcaatagtaggactgctgac

SEQ ID NO: 3639 - DNA, 50 bp, Homo sapiens; identical to SEQ ID NO: 2914

SEQ ID NO: 3640 - DNA, 50 bp, Homo sapiens
tcctcttttctttcaagaactatatataaatgacctgttttcacgcggcc

SEQ ID NO: 3641 - DNA, 50 bp, Homo sapiens
agctgcaaagtgttttgtaccagtgaatttttgcaataatgcagtatggt

SEQ ID NO: 3642 - DNA, 50 bp, Homo sapiens; identical to SEQ ID NO: 2661

SEQ ID NO: 3643 - DNA, 50 bp, Homo sapiens
acatagtgaaagtttataagaggatgaagtgatatggtgagcagcggact

SEQ ID NO: 3644 - DNA, 50 bp, Homo sapiens
aacagcctttctggctgaccacatggttaaatgcataccttcccagtact

SEQ ID NO: 3645 - DNA, 50 bp, Homo sapiens
tgtgcctcacctggacttgtccaattaatgaagttgattcatattgcatc

SEQ ID NO: 3646 - DNA, 50 bp, Homo sapiens
ctatagatgaagacataaaagacactggtaaacaccaatgtaaaagggcc

SEQ ID NO: 3647 - DNA, 50 bp, Homo sapiens; identical to SEQ ID NO: 2915

SEQ ID NO: 3648 - DNA, 50 bp, Homo sapiens; identical to SEQ ID NO: 2750

SEQ ID NO: 3649 - DNA, 50 bp, Homo sapiens
gattcttgctgtagcgtggatagctgtgattggtgagtcaaccgtctgtg

SEQ ID NO: 3650 - DNA, 50 bp, Homo sapiens
tgggcattttaaagccatctcaagaggcatcttctacatgttttgtacgc

SEQ ID NO: 3651 - DNA, 50 bp, Homo sapiens
aagtcagggaccacttgctgaagcacgaagagcccttgtggcaatgttaa

SEQ ID NO: 3652 - DNA, 50 bp, Homo sapiens
gactgctggaagatgatctttctgcactgagactgtggagtttggggaag

SEQ ID NO: 3653 - DNA, 50 bp, Homo sapiens; identical to SEQ ID NO: 2117

SEQ ID NO: 3654 - DNA, 50 bp, Homo sapiens
aattccagctgagcgccggtcgctaccattaccgttggtcttggtgtcaa

SEQ ID NO: 3655 - DNA, 50 bp, Homo sapiens
ccccaaccctcaaattaaaactagaactatagatccacatgaacgcacgc

SEQ ID NO: 3656 - DNA, 50 bp, Homo sapiens
agcttttgaaataaaatttaaaaaccccaagcctgggtgagtgtgggaaa

SEQ ID NO: 3657 - DNA, 50 bp, Homo sapiens; identical to SEQ ID NO: 2700

SEQ ID NO: 3658 - DNA, 50 bp, Homo sapiens; identical to SEQ ID NO: 2844

SEQ ID NO: 3659 - DNA, 50 bp, Homo sapiens; identical to SEQ ID NO: 2981

SEQ ID NO: 3660 - DNA, 50 bp, Homo sapiens; identical to SEQ ID NO: 2511

SEQ ID NO: 3661 - DNA, 50 bp, Homo sapiens
gaattttcagtttgtgcttacattttctaacattggatgtttgctttggc

SEQ ID NO: 3662 - DNA, 50 bp, Homo sapiens
tatgactttaagagcccacattaggttttatgattcatttgccaggtttt

SEQ ID NO: 3663 - DNA, 50 bp, Homo sapiens
ggcgtgccgttgagggggaaaacgaagcccagtatttgctactgtttttc

SEQ ID NO: 3664 - DNA, 50 bp, Homo sapiens
ctcttgggcataaaatctcagaggaagctacttaggacatcatcttggcc

SEQ ID NO: 3665 - DNA, 50 bp, Homo sapiens
tctacagtagcctgtgctgaactgatctcttaaataaacttgcttctggt

SEQ ID NO: 3666 - DNA, 50 bp, Homo sapiens
ttctcaagtttgatactgagttgactgttcccttatccctcaccgttccc

SEQ ID NO: 3667 - DNA, 50 bp, Homo sapiens
agacttttccaaccctcatcaccaacgtctgtgccattttgtattttact

SEQ ID NO: 3668 - DNA, 50 bp, Homo sapiens
ccagcggcatctttccttgtcgaatgatactgtaatgaccttccaaagtg

SEQ ID NO: 3669 - DNA, 50 bp, Homo sapiens; identical to SEQ ID NO: 163

SEQ ID NO: 3670 - DNA, 50 bp, Homo sapiens
tgtgggttgagaccagcactctgtgaaaccttgaaatgagaagtaaaggc

SEQ ID NO: 3671 - DNA, 50 bp, Homo sapiens
tgaatacaaagaaccaagaaaaaggaatgaagactcgcaatttcacgaca

SEQ ID NO: 3672 - DNA, 50 bp, Homo sapiens
ctgaatttggttttgggaggtgaggcttcccaaccacggaagactacttt

SEQ ID NO: 3673 - DNA, 50 bp, Homo sapiens; identical to SEQ ID NO: 3039

SEQ ID NO: 3674 - DNA, 50 bp, Homo sapiens
gacgccttacaaatgatggaggattccaaagagtttttgtttatttgggt

SEQ ID NO: 3675 - DNA, 50 bp, Homo sapiens; identical to SEQ ID NO: 2992

SEQ ID NO: 3676 - DNA, 50 bp, Homo sapiens; identical to SEQ ID NO: 123

SEQ ID NO: 3677 - DNA, 50 bp, Homo sapiens
cagctctgggaaatagaagactagggttgtttcttaaatttagctcatgt

SEQ ID NO: 3678 - DNA, 50 bp, Homo sapiens
tgacttatgagctgtgactcaactgcttcattaaacattctgcattgggt

SEQ ID NO: 3679 - DNA, 50 bp, Homo sapiens
acactgagatagtcagttgtgtgtgactctaataaacggagcctaccttt

SEQ ID NO: 3680 - DNA, 50 bp, Homo sapiens; identical to SEQ ID NO: 3153

SEQ ID NO: 3681 - DNA, 50 bp, Homo sapiens
ggatgataacaccctatgcccattgtcctgatctgaaaattcttggaaat

SEQ ID NO: 3682 - DNA, 50 bp, Homo sapiens; identical to SEQ ID NO: 117

SEQ ID NO: 3683 - DNA, 50 bp, Homo sapiens
aaaagcatttaagttgaatgcgaccaaccttgtgctcttttcattctgga

SEQ ID NO: 3684 - DNA, 50 bp, Homo sapiens
ccttgagaaacacccatctccactcctagacaaaccaatgaacattagtc

SEQ ID NO: 3685 - DNA, 50 bp, Homo sapiens
tcttaaggtgtggcagagacagggtatttgggatatacttttcagactcc

SEQ ID NO: 3686 - DNA, 50 bp, Homo sapiens
aacaataaaatatggctagactggcctctggttgcctaaacagagcatca

SEQ ID NO: 3687 - DNA, 50 bp, Homo sapiens
cttaactgagggcttgtcctggttataaatgtctgggtgggggtgggcac

SEQ ID NO: 3688 - DNA, 50 bp, Homo sapiens
aactgtgaggcaaataaaatgcttctcaaactgtgtggctcttatggggt

SEQ ID NO: 3689 - DNA, 50 bp, Homo sapiens
gtggctaagtcattgcaggaacggggctgtgttctctgctgggacaaaac

SEQ ID NO: 3690 - DNA, 50 bp, Homo sapiens
attgcgactgtatggagaagaactgtttgtcattcagtgccgtgggatat

SEQ ID NO: 3691 - DNA, 50 bp, Homo sapiens
tttatagaacaattcctttctcttctcttgaatgtggcagtcattactgc

SEQ ID NO: 3692 - DNA, 50 bp, Homo sapiens
ttgattagagcaatgggaagcatactgtggcctaccagcatctggaagtg

SEQ ID NO: 3693 - DNA, 50 bp, Homo sapiens
tcaattgaggccccttccctaagattacaacattgataacctgtcctttt

SEQ ID NO: 3694 - DNA, 50 bp, Homo sapiens
cagccctccgtcgctttttataaaactttgtgtgagaagaatatattgat

SEQ ID NO: 3695 - DNA, 50 bp, Homo sapiens
acttcagatccttttgtgtttaaataaaggaaaagctgcacatccaaaaa

SEQ ID NO: 3696 - DNA, 50 bp, Homo sapiens
agcctacctcctaccccagctgtctgttgagagcagtgctgaccccagca

SEQ ID NO: 3697 - DNA, 50 bp, Homo sapiens
gaagagctgctctcacctctctgcatcccaatagatatccccctatgtgc

SEQ ID NO: 3698 - DNA, 50 bp, Homo sapiens; identical to SEQ ID NO: 1921

SEQ ID NO: 3699 - DNA, 50 bp, Homo sapiens
aaatacaaacattctaattaaaggctttgcaacacatgccttgtctgttt

SEQ ID NO: 3700 - DNA, 50 bp, Homo sapiens
gccattaccaactgtaccttcccttcttgctcagccaataaatatatcct

SEQ ID NO: 3701 - DNA, 50 bp, Homo sapiens; identical to SEQ ID NO: 1986

SEQ ID NO: 3702 - DNA, 50 bp, Homo sapiens; identical to SEQ ID NO: 1875

SEQ ID NO: 3703 - DNA, 50 bp, Homo sapiens
ctggggaggaggtccagggaggaggaggaaagttctcaagttcgtctgac

SEQ ID NO: 3704 - DNA, 50 bp, Homo sapiens
aactaacagtcacgccgtgggatgtctctgtccacattaaactaacagca

SEQ ID NO: 3705 - DNA, 50 bp, Homo sapiens; identical to SEQ ID NO: 2151

SEQ ID NO: 3706 - DNA, 50 bp, Homo sapiens
tttgtctatattctgctcccagcctgccaggccaggaggaaataaacatg

SEQ ID NO: 3707 - DNA, 50 bp, Homo sapiens
ttcctctttggccacaagaataagcagcaaataaacaactatggctgttg

SEQ ID NO: 3708 - DNA, 50 bp, Homo sapiens; identical to SEQ ID NO: 3126

SEQ ID NO: 3709 - DNA, 50 bp, Homo sapiens
gcagtttgaatatcctttgtttcagagccagatcatttcttggaaagtgt

SEQ ID NO: 3710 - DNA, 50 bp, Homo sapiens
ccctggttgacttgactcatgcttgtttcactttcacatggaatttccca

SEQ ID NO: 3711 - DNA, 50 bp, Homo sapiens; identical to SEQ ID NO: 2005

SEQ ID NO: 3712 - DNA, 50 bp, Homo sapiens
cacaaggtaaagaaactcaattcccctgcttggagcccagcaaacacaat

SEQ ID NO: 3713 - DNA, 50 bp, Homo sapiens
tgtggaggaaactaaacattcccttgatggtctcaagctatgatcagaag

SEQ ID NO: 3714 - DNA, 50 bp, Homo sapiens
ggaggagaccagtcccccacccagccgtaccagaaataaaggcttctgtg

SEQ ID NO: 3715 - DNA, 50 bp, Homo sapiens; identical to SEQ ID NO: 243

SEQ ID NO: 3716 - DNA, 50 bp, Homo sapiens
cgctgttaggccggaattaaagtggctttttgaggtttggtttttcacaa

SEQ ID NO: 3717 - DNA, 50 bp, Homo sapiens
ggggtttatgtcctaactgctttgtatgctgttttataaagggatagaag

SEQ ID NO: 3718 - DNA, 50 bp, Homo sapiens
acaccaacctgcttccactttattcttgtttacacattctcctgctccca

SEQ ID NO: 3719 - DNA, 50 bp, Homo sapiens
aagatgtttgtggaaatgttcatttgtatctggatctctgttatgtgcca

SEQ ID NO: 3720 - DNA, 50 bp, Homo sapiens; identical to SEQ ID NO: 3482

SEQ ID NO: 3721 - DNA, 50 bp, Homo sapiens; identical to SEQ ID NO: 2348

SEQ ID NO: 3722 - DNA, 50 bp, Homo sapiens; identical to SEQ ID NO: 1983

SEQ ID NO: 3723 - DNA, 50 bp, Homo sapiens
tcgaatcattgaagatccgagtgtgatttgaattctgtgatattttcaca

SEQ ID NO: 3724 - DNA, 50 bp, Homo sapiens
atatccaatattcgctgtgtcagcatagaagtaacttacttaggtgtggg

SEQ ID NO: 3725 - DNA, 50 bp, Homo sapiens; identical to SEQ ID NO: 1980

SEQ ID NO: 3726 - DNA, 50 bp, Homo sapiens; identical to SEQ ID NO: 2712

SEQ ID NO: 3727 - DNA, 50 bp, Homo sapiens
tctccatgttgtcaaaatcatgccgtttatagctattttcacctcagtgg

SEQ ID NO: 3728 - DNA, 50 bp, Homo sapiens
gccccgttttggggacgtgaacgttttaataatttttgctgaattcttta

SEQ ID NO: 3729 - DNA, 50 bp, Homo sapiens
aggtgggcacaagtattacacatcagaaaatcctgacaaaagggacacat

SEQ ID NO: 3730 - DNA, 50 bp, Homo sapiens
gttcaacaacaccagaactgtgtgtctcatggtatgtaactcttaaagca

SEQ ID NO: 3731 - DNA, 50 bp, Homo sapiens; identical to SEQ ID NO: 2480

SEQ ID NO: 3732 - DNA, 50 bp, Homo sapiens
aaagctgttcaaatactcgagcccagtcttgtggatggaaatgtagtgct

SEQ ID NO: 3733 - DNA, 50 bp, Homo sapiens
cttaagtctgacggacctgtcctgtccaggccagtgcccagggaaggtgt

SEQ ID NO: 3734 - DNA, 50 bp, Homo sapiens
tttctaaccctgacacggactgtgcatactttccctcatccatgctgtgc

SEQ ID NO: 3735 - DNA, 50 bp, Homo sapiens
cagcagctgcctgcttttctgtgatgtatgtatcctgttgacttttccag

SEQ ID NO: 3736 - DNA, 50 bp, Homo sapiens; identical to SEQ ID NO: 2756

SEQ ID NO: 3737 - DNA, 50 bp, Homo sapiens; identical to SEQ ID NO: 113

SEQ ID NO: 3738 - DNA, 50 bp, Homo sapiens
acccatttctactttttgcaccttattttctctgttcctgagcccccaca

SEQ ID NO: 3739 - DNA, 50 bp, Homo sapiens; identical to SEQ ID NO: 2362

SEQ ID NO: 3740 - DNA, 50 bp, Homo sapiens
ggcccagcattgctggttctatttaatggacatgagataatgttagaggt

SEQ ID NO: 3741 - DNA, 50 bp, Homo sapiens
tgaatataatatatttgtgtatttaacagggaggggaagagggggcgatc

SEQ ID NO: 3742 - DNA, 50 bp, Homo sapiens
tggcactttaacattgctttcacctatattttgtgtactttgttacttgc

SEQ ID NO: 3743 - DNA, 50 bp, Homo sapiens
agtaaatgtacagtgatttgaaatacaataatgaaggcaatgcatggcct

SEQ ID NO: 3744 - DNA, 50 bp, Homo sapiens
cttaatgtgacctagcaataggcatagctacgtggcactatattctggcc

SEQ ID NO: 3745 - DNA, 50 bp, Homo sapiens
aggagcacctcacagatgccaacctcaacctgaccgtggacgagggtgtc

SEQ ID NO: 3746 - DNA, 50 bp, Homo sapiens
ccacgacttctgcccattctctccagtgtgtgtaacagggtcacaagaat

SEQ ID NO: 3747 - DNA, 50 bp, Homo sapiens
ggcccaaacctatttgtaaccaaagagctgggagcagcacaaggacccag

SEQ ID NO: 3748 - DNA, 50 bp, Homo sapiens
gcgagcaagcattttgaacacatggatttccttgaagcaggctgacaaga

SEQ ID NO: 3749 - DNA, 50 bp, Homo sapiens
tcggatgggctgtttagatgttatataatccacaaaaggttcattgagct

SEQ ID NO: 3750 - DNA, 50 bp, Homo sapiens; identical to SEQ ID NO: 2285

SEQ ID NO: 3751 - DNA, 50 bp, Homo sapiens
aaaatgaagtcacacaggacaattattcttatgcctaagttaacagtgga

SEQ ID NO: 3752 - DNA, 50 bp, Homo sapiens
gccttgtttaatggtagttttacagtgtttctggcttagaacaaaggggc

SEQ ID NO: 3753 - DNA, 50 bp, Homo sapiens; identical to SEQ ID NO: 3034

SEQ ID NO: 3754 - DNA, 50 bp, Homo sapiens; identical to SEQ ID NO: 2199

SEQ ID NO: 3755 - DNA, 50 bp, Homo sapiens; identical to SEQ ID NO: 3388

SEQ ID NO: 3756 - DNA, 50 bp, Homo sapiens
tggtataagaaatgactttgaaccactttgcaattgtagattcccaacaa

SEQ ID NO: 3757 - DNA, 50 bp, Homo sapiens
cccctgctactttgaaaccagaaaataatgactggccattcgttacatct

SEQ ID NO: 3758 - DNA, 50 bp, Homo sapiens; identical to SEQ ID NO: 2508

SEQ ID NO: 3759 - DNA, 50 bp, Homo sapiens
aaaagccttgtgaaaatgttatgccctatgtaacagcagagtaacataaa

SEQ ID NO: 3760 - DNA, 50 bp, Homo sapiens
ccaccacgggagactagagctgcaggatcccgggggaggggtctctcctc

SEQ ID NO: 3761 - DNA, 50 bp, Homo sapiens
cagtggaagtcccacagaagctacagctgccaggtcacgcatgaagggag

SEQ ID NO: 3762 - DNA, 50 bp, Homo sapiens
cccacactgctttgctgtgtatacgcttgttgccctgaaataaatatgca

SEQ ID NO: 3763 - DNA, 50 bp, Homo sapiens; identical to SEQ ID NO: 3762

SEQ ID NO: 3764 - DNA, 50 bp, Homo sapiens; identical to SEQ ID NO: 1425

SEQ ID NO: 3765 - DNA, 50 bp, Homo sapiens
agagaccagttttctctggaagtttgtttaaatgacagaagcgtatatga

SEQ ID NO: 3766 - DNA, 50 bp, Homo sapiens
cgcccctgccacctccctgacccgtctaatatataaatatagagatgtgt

SEQ ID NO: 3767 - DNA, 50 bp, Homo sapiens
gccagtcagatgtttctcatccttcttgctctgcctttgagttgttccgt

SEQ ID NO: 3768 - DNA, 50 bp, Homo sapiens
aaatactgatgttcctagtgaaagaggcagcttgaaactgagatgtgaac

SEQ ID NO: 3769 - DNA, 50 bp, Homo sapiens
agaagctgcactaggccccgagtccccatgtgtctccttgaattgatgag

SEQ ID NO: 3770 - DNA, 50 bp, Homo sapiens; identical to SEQ ID NO: 2177

SEQ ID NO: 3771 - DNA, 50 bp, Homo sapiens
aaattttatttccagctcctgttccttggaaaatctccattgtatgtgca

SEQ ID NO: 3772 - DNA, 50 bp, Homo sapiens
cctgaaacagctgccaccatcactcgcaagagaatcccctccatctttgg

SEQ ID NO: 3773 - DNA, 50 bp, Homo sapiens
ttctgtgtgtatggtagcacagcaaacttgtaggaattagtatcaatagt

SEQ ID NO: 3774 - DNA, 50 bp, Homo sapiens; identical to SEQ ID NO: 2106

SEQ ID NO: 3775 - DNA, 50 bp, Homo sapiens
gatctcctcttagggtagaagaagtctctgggacatccctggggtgtgtg

SEQ ID NO: 3776 - DNA, 50 bp, Homo sapiens
ggctgccgcaataaaacccagatttctttggtgcgaatgccttacgcatg

SEQ ID NO: 3777 - DNA, 50 bp, Homo sapiens
tcatcatctggatttaggaattgctcttgtcatacccccaagtttctaag

SEQ ID NO: 3778 - DNA, 50 bp, Homo sapiens
tgcccaccactgaaagagtgactttgacaagatgtttctacctcttccca

SEQ ID NO: 3779 - DNA, 50 bp, Homo sapiens
tttgatcaggattcagatgtggacatcttcccctcagacttccctactga

SEQ ID NO: 3780 - DNA, 50 bp, Homo sapiens; identical to SEQ ID NO: 180

SEQ ID NO: 3781 - DNA, 50 bp, Homo sapiens
cggattgttgctgttaatgctgctcattttagcactgtggaagattggat

SEQ ID NO: 3782 - DNA, 50 bp, Homo sapiens
tagagattgtgaagaagaatttcgatctccgccctggggtcattgtcagg

SEQ ID NO: 3783 - DNA, 50 bp, Homo sapiens; identical to SEQ ID NO: 2036

SEQ ID NO: 3784 - DNA, 50 bp, Homo sapiens; identical to SEQ ID NO: 2461

SEQ ID NO: 3785 - DNA, 50 bp, Homo sapiens
ggaagaaccgtccagagctgagtgacgctgggatccgggatcaaagttgg

SEQ ID NO: 3786 - DNA, 50 bp, Homo sapiens
tgtgcattgttattgagttgtactgtaccttatttggaaggatgaaggaa

SEQ ID NO: 3787 - DNA, 50 bp, Homo sapiens; identical to SEQ ID NO: 2727

SEQ ID NO: 3788 - DNA, 50 bp, Homo sapiens
agaagcatgtcactttcatgttcctccctaactccctgacctgagaaccc

SEQ ID NO: 3789 - DNA, 50 bp, Homo sapiens
ggatgctcctcccttctctacctcatgggggtattgtataagtccttgca

SEQ ID NO: 3790 - DNA, 50 bp, Homo sapiens
gcaccatctgtcttcatcttccgccatctgatgagcagttgaaatctgga

SEQ ID NO: 3791 - DNA, 50 bp, Homo sapiens; identical to SEQ ID NO: 3790

SEQ ID NO: 3792 - DNA, 50 bp, Homo sapiens; identical to SEQ ID NO: 2358

SEQ ID NO: 3793 - DNA, 50 bp, Homo sapiens
ggcctgttactctccatgactaactgtgtaagtgcttaaaatggaataaa

SEQ ID NO: 3794 - DNA, 50 bp, Homo sapiens; identical to SEQ ID NO: 2847

SEQ ID NO: 3795 - DNA, 50 bp, Homo sapiens
tcttgataccacctatatagatgcagcattttgtatttgtctaactgggg

SEQ ID NO: 3796 - DNA, 50 bp, Homo sapiens; identical to SEQ ID NO: 2443

SEQ ID NO: 3797 - DNA, 50 bp, Homo sapiens; identical to SEQ ID NO: 2477

SEQ ID NO: 3798 - DNA, 50 bp, Homo sapiens
ttgaggggattaatatgaaaacttatgacctcttcctttaggagggagtt

SEQ ID NO: 3799 - DNA, 50 bp, Homo sapiens
tgttaaaacccctatagccaccttttgggaatgttttaaattctccagtt

SEQ ID NO: 3800 - DNA, 50 bp, Homo sapiens
tggcaggcgtcaaccccattttatttgtccttattcctgtggaagcagta

SEQ ID NO: 3801 - DNA, 50 bp, Homo sapiens
aatacacctgcttcacgtccctatgttgggaagtccatatttgtctgctt

SEQ ID NO: 3802 - DNA, 50 bp, Homo sapiens
caggaaatgcagcaacttcaggaaatgcagcaacaaaaatacctactcct

SEQ ID NO: 3803 - DNA, 50 bp, Homo sapiens
aaacccagttgccatctgcgtgacaataaaacattaatgctaacactttt

SEQ ID NO: 3804 - DNA, 50 bp, Homo sapiens
tgctgtattacttctgaaaagactgtgcagtgtgttagttgttggctgaa

SEQ ID NO: 3805 - DNA, 50 bp, Homo sapiens
gtgtatgagagagagagtgtgtgtttgtgtgtttcaaggtcagaacaggt

SEQ ID NO: 3806 - DNA, 50 bp, Homo sapiens; identical to SEQ ID NO: 2025

SEQ ID NO: 3807 - DNA, 50 bp, Homo sapiens
tgtccccttccccaccctctagtgtatttcacagaaaacaaaacctccca

SEQ ID NO: 3808 - DNA, 50 bp, Homo sapiens
agtccagttttatgattctgcttttatgtgtcccttgataacagtgactt

SEQ ID NO: 3809 - DNA, 50 bp, Homo sapiens
aaactcatctgtccaagttcgtggcagaaaggaacgtccttgtgaagacc

SEQ ID NO: 3810 - DNA, 50 bp, Homo sapiens
agagcactgggtagccaagtgatcttcccattcacagagttagtaaacct

SEQ ID NO: 3811 - DNA, 50 bp, Homo sapiens
cccccagagaccccatttgcctctcaacactcagaccttcaactgttttt

SEQ ID NO: 3812 - DNA, 50 bp, Homo sapiens
ccagtgacaccccatattcatcacaaaattaaagcaagaagtccatagta

SEQ ID NO: 3813 - DNA, 50 bp, Homo sapiens
tgacaccaagacccaccccaatccagacttcacacagtattctcccccac

SEQ ID NO: 3814 - DNA, 50 bp, Homo sapiens
gactgcaagtcactcttaggggctgtacttccttagtactggtagcatta

SEQ ID NO: 3815 - DNA, 50 bp, Homo sapiens
aactgagcatcacgaaccctgtttggcagactgaggtcacgatggagggg

SEQ ID NO: 3816 - DNA, 50 bp, Homo sapiens
tcctccattgaagaagaatgtcaacaagaaaggaaaaatagacaaactgg

SEQ ID NO: 3817 - DNA, 50 bp, Homo sapiens
aagtctcgaatgtaattggaatcttcacctcagagtggagttgaactgct

SEQ ID NO: 3818 - DNA, 50 bp, Homo sapiens; identical to SEQ ID NO: 1984

SEQ ID NO: 3819 - DNA, 50 bp, Homo sapiens
acaaaaatagctatatcaagggctggcacctagacattaaactgtacttt

SEQ ID NO: 3820 - DNA, 50 bp, Homo sapiens
gtccaccagtctctgaaattagaacagtaggcggtatgagataatcaggc

SEQ ID NO: 3821 - DNA, 50 bp, Homo sapiens
gaaatgtagctggagtcatcatttagcagagcacggtgtccctgggttgg

SEQ ID NO: 3822 - DNA, 50 bp, Homo sapiens
gcctctgtgatccccatgtgttttgattcctgctctttgttacagttcca

SEQ ID NO: 3823 - DNA, 50 bp, Homo sapiens
aaaacaagaaacaaatgtgcccaccccactttccgcttaactgaaaagct

SEQ ID NO: 3824 - DNA, 50 bp, Homo sapiens
gtaaaaaggctgtctgtgattttccagggtttggtgggggtagggagggg

SEQ ID NO: 3825 - DNA, 50 bp, Homo sapiens
ctgactgagtctcagaatgctcaggaccaaggtgcagagatggacaagag

SEQ ID NO: 3826 - DNA, 50 bp, Homo sapiens
agcttcttgggttcctaattcctggtgtttaataattctctccacgatca

SEQ ID NO: 3827 - DNA, 50 bp, Homo sapiens; identical to SEQ ID NO: 3328

SEQ ID NO: 3828 - DNA, 50 bp, Homo sapiens
atttccagtgagcttatcatgctgtctttacatggggttttcaattttgc

SEQ ID NO: 3829 - DNA, 50 bp, Homo sapiens
tgcagctcaccagccccaggggcagaagagacccaaccacttcctatttt

SEQ ID NO: 3830 - DNA, 50 bp, Homo sapiens; identical to SEQ ID NO: 2415

SEQ ID NO: 3831 - DNA, 50 bp, Homo sapiens
tgtatatagactctggtgttctattgctgagaagcaaaccgccctgcagc

SEQ ID NO: 3832 - DNA, 50 bp, Homo sapiens
atgtcagttctgttttaagtaacagaattgataactgagcaaggaaacgt

SEQ ID NO: 3833 - DNA, 50 bp, Homo sapiens
ttggagctaagctgccacctggttaattaaggtcccaacagtgagttgtg

SEQ ID NO: 3834 - DNA, 50 bp, Homo sapiens
ctttggagggtgtcttctgggtagagggatgggaaggaagggacccttac

SEQ ID NO: 3835 - DNA, 50 bp, Homo sapiens; identical to SEQ ID NO: 2332

SEQ ID NO: 3836 - DNA, 50 bp, Homo sapiens; identical to SEQ ID NO: 2120

SEQ ID NO: 3837 - DNA, 50 bp, Homo sapiens
tttggcttagtgttttcattgcaaattataattgctgtagagccacacac

SEQ ID NO: 3838 - DNA, 50 bp, Homo sapiens; identical to SEQ ID NO: 2596

SEQ ID NO: 3839 - DNA, 50 bp, Homo sapiens
aacaaaagatgaagacctagtgttttggatgggaagcacctgtagaccat

SEQ ID NO: 3840 - DNA, 50 bp, Homo sapiens
acatgtgcaaataaatgtggcttagacttgtgtgactgcttaagactaaa

SEQ ID NO: 3841 - DNA, 50 bp, Homo sapiens; identical to SEQ ID NO: 2583

SEQ ID NO: 3842 - DNA, 50 bp, Homo sapiens; identical to SEQ ID NO: 2141

SEQ ID NO: 3843 - DNA, 50 bp, Homo sapiens
cactcttcacctattgtatgaccaaataaaggttatgctgcttgttacgc

SEQ ID NO: 3844 - DNA, 50 bp, Homo sapiens
tgctaggtgatggagtagaaatggattccctctgggaatggtttcttggt

SEQ ID NO: 3845 - DNA, 50 bp, Homo sapiens
tatgaaaacagtggattggttgggttttgtgcagggtcttgggttagagc

SEQ ID NO: 3846 - DNA, 50 bp, Homo sapiens
tgcatggatcaatcagtgtgattagctttctcagcagacattgtgccata

SEQ ID NO: 3847 - DNA, 50 bp, Homo sapiens; identical to SEQ ID NO: 2356

SEQ ID NO: 3848 - DNA, 50 bp, Homo sapiens
gcagcacactctgagaaagaaacttatcctctcctacacataagaaacca

SEQ ID NO: 3849 - DNA, 50 bp, Homo sapiens
tgcaagacacctgtttatcatcttgtttaaatgtaaatgtccccttatgc

SEQ ID NO: 3850 - DNA, 50 bp, Homo sapiens
tcaacgccaatatgtattctacaaaagagaatggttttaggctccagtgt

SEQ ID NO: 3851 - DNA, 50 bp, Homo sapiens
tggatcatcaaggtgaaacactttggtattctttggcaatcagtgctcct

SEQ ID NO: 3852 - DNA, 50 bp, Homo sapiens
gatacactgtctctcttcataggactgtttaggctctgcatcaagattgc

SEQ ID NO: 3853 - DNA, 50 bp, Homo sapiens
aaggcagggatcatgacacctgaggagtctagtttatggcttcagttgga

SEQ ID NO: 3854 - DNA, 50 bp, Homo sapiens
atggatggactgatctgaaaatcgacctcaactcaagggtggtcagctca

SEQ ID NO: 3855 - DNA, 50 bp, Homo sapiens
tgctaatgtaatcggtttttgtaatggcgtcacaaataaaaggatgctta

SEQ ID NO: 3856 - DNA, 50 bp, Homo sapiens
tgcaagacatagaatagtgttggaaaatgtgcaatatgtgatgtggcaaa

SEQ ID NO: 3857 - DNA, 50 bp, Homo sapiens
aagtttgtgaatgtgactacttagtggtgtatatgagactttcaagggaa

SEQ ID NO: 3858 - DNA, 50 bp, Homo sapiens; identical to SEQ ID NO: 2253

SEQ ID NO: 3859 - DNA, 50 bp, Homo sapiens
ctgtgcctcccccgccacctgtgtgttcttttgatacatttatcttctgt

SEQ ID NO: 3860 - DNA, 50 bp, Homo sapiens
tgtatatttatggtgggaggtggttgggaacttttaacaaaatggggtgt

SEQ ID NO: 3861 - DNA, 50 bp, Homo sapiens
tcctttggaaacagaatgaagcagaggaaactcttaatacttaaaatcgt

SEQ ID NO: 3862 - DNA, 50 bp, Homo sapiens; identical to SEQ ID NO: 2625

SEQ ID NO: 3863 - DNA, 50 bp, Homo sapiens; identical to SEQ ID NO: 1910

SEQ ID NO: 3864 - DNA, 50 bp, Homo sapiens; identical to SEQ ID NO: 2474

SEQ ID NO: 3865 - DNA, 50 bp, Homo sapiens
tgcttgattaagatgccataatagtgctgtatttgcagtgtgggctaaga

SEQ ID NO: 3866 - DNA, 50 bp, Homo sapiens
tcttctgtttcatcctgcggttctggaaccagattttgacttgcgtgtca

SEQ ID NO: 3867 - DNA, 50 bp, Homo sapiens; identical to SEQ ID NO: 2515

SEQ ID NO: 3868 - DNA, 50 bp, Homo sapiens
atgcatctaccgctccttgggaaataatctgaaaggtctaaaaataaaaa

SEQ ID NO: 3869 - DNA, 50 bp, Homo sapiens
cgcaagaagcaggaagaggaaagagaagaaaagcacaacggggaaagata

SEQ ID NO: 3870 - DNA, 50 bp, Homo sapiens
gtagtgtgttgcatccctctcaccctctgatcttcgtcagtcgtgtcatg

SEQ ID NO: 3871 - DNA, 50 bp, Homo sapiens
gagggaaacccggtaataggctgggagtaatccacacacgtgctaacatt

SEQ ID NO: 3872 - DNA, 50 bp, Homo sapiens
cacacactgctacgtgacgtaccactactgccagcgcagcactagctcac

SEQ ID NO: 3873 - DNA, 50 bp, Homo sapiens
ggatcgtgacacaccgggttacacactttccacaccgtaattccatcaat

SEQ ID NO: 3874 - DNA, 50 bp, Homo sapiens
ggttgcaccaaggctgcctaggagaagtgcctgactggactaccccgatc

SEQ ID NO: 3875 - DNA, 50 bp, Homo sapiens
tctgccatctgtctatttcccaattttccttctgactgttcctttctcct

SEQ ID NO: 3876 - DNA, 50 bp, Homo sapiens
ctgtgatattttggtcatgggctggtctggtcggtttcccatttgtctgg

SEQ ID NO: 3877 - DNA, 50 bp, Homo sapiens
tacgacatttgcgaaattcgctaaaaacaagggggagttcacgcggccat

SEQ ID NO: 3878 - DNA, 50 bp, Homo sapiens
gcgcaggttaccggaacccaaggtcctttgaaattcacaactctctttgg

SEQ ID NO: 3879 - DNA, 50 bp, Homo sapiens
agctgtggaaagggcaacctgtggtttctctgtactggtgtttaatgggg

SEQ ID NO: 3880 - DNA, 50 bp, Homo sapiens
cacaaacacccgcccgagcaaccacagacacaggacacgacaccacacac

SEQ ID NO: 3881 - DNA, 50 bp, Homo sapiens
aaagggttacttttcaaaacagtctcctttcgaccggggtcagggtggcc

SEQ ID NO: 3882 - DNA, 50 bp, Homo sapiens
ggtggacagtataaggcggttaagatccgttgatggcgaaggtgagaatg

SEQ ID NO: 3883 - DNA, 50 bp, Homo sapiens
gacagagcgagtagacgggaggcggagaaggaagaggagacgagacgagg

SEQ ID NO: 3884 - DNA, 50 bp, Homo sapiens
caagacacagaggcaacggagagacacgcagacaagcaaggccacggaac

SEQ ID NO: 3885 - DNA, 50 bp, Homo sapiens
agggataggataattacagaggtactgagactcctggcgtgggtgactct

SEQ ID NO: 3886 - DNA, 50 bp, Homo sapiens
cccatcatgaaaaaacgccttaggagccgaagaagaaaacctcgggaaaa

SEQ ID NO: 3887 - DNA, 50 bp, Homo sapiens
gacacagcgagagtccaggaacaggcagacaagcgagaaagaggagaagc

SEQ ID NO: 3888 - DNA, 50 bp, Homo sapiens
gtaggaggcgagaaggaagaacaaggcacaccgaaggagcaagaccagac

SEQ ID NO: 3889 - DNA, 50 bp, Homo sapiens
caagaagcagaagcagcaaccagagacagagagacaaacgcagaacaaca

SEQ ID NO: 3890 - DNA, 50 bp, Homo sapiens
caacaagcagacgaacaacaacaaatatcaacgaggcgcagcagctcaaa

SEQ ID NO: 3891 - DNA, 50 bp, Homo sapiens
aacacacaagagaaacataaccactaaatcactacaaacacacacagaat

SEQ ID NO: 3892 - DNA, 50 bp, Homo sapiens
aaacgaattcttgcactgagagtgttcacagcgccactttcctcctcctc

SEQ ID NO: 3893 - DNA, 50 bp, Homo sapiens
cgagaagcagaagatgacagcagagcgaaagcagagaacgaacagacaag

SEQ ID NO: 3894 - DNA, 50 bp, Homo sapiens
ttggatttattaaagtccctttggaagtcttctaccattactgtagacca

SEQ ID NO: 3895 - DNA, 50 bp, Homo sapiens
tcacataccctatgccgactgagtggaacgagccgactatcacacagagc

SEQ ID NO: 3896 - DNA, 50 bp, Homo sapiens
cacatgcgcaataaacccggcgaagacgccactctgcggcaaaggacaca

SEQ ID NO: 3897 - DNA, 50 bp, Homo sapiens
ccgcagacacgaaagcaccaaccaccgaccgccaccagaaggaacaacag

SEQ ID NO: 3898 - DNA, 50 bp, Homo sapiens
gggcacttaaatggtcacctgtgtaacagtttggtgtaactcccagtgat

SEQ ID NO: 3899 - DNA, 50 bp, Homo sapiens
acaacacgaaaacgaacaagcaaagaaagaaaacggacacgagcgaacca

SEQ ID NO: 3900 - DNA, 50 bp, Homo sapiens; identical to SEQ ID NO: 3894

SEQ ID NO: 3901 - DNA, 50 bp, Homo sapiens
cagccatgtccatgacaaccagagcctgggaggagctggatggcggcctg

SEQ ID NO: 3902 - DNA, 50 bp, Homo sapiens
aaacacacagcaagaaccacgaaaagagcaacccaaaataggaaaagcgg

SEQ ID NO: 3903 - DNA, 50 bp, Homo sapiens
acagcgtggatataaggaccaagagactagggcgcatactatgattcgca

SEQ ID NO: 3904 - DNA, 50 bp, Homo sapiens
atggacacgaggacggaactgggggtactagaacaacccttctctgaaaa

SEQ ID NO: 3905 - DNA, 50 bp, Homo sapiens
agaccaaacgagaaggagaaaaagcaagaccacaaaagacaacaacagcg

SEQ ID NO: 3906 - DNA, 50 bp, Homo sapiens
aaaaaatcgggctttttctgggggaaagggaagggcggggaatgctggcc

SEQ ID NO: 3907 - DNA, 50 bp, Homo sapiens
ctacaacaatacagcacacagcataagcgcacagggcatagactaggcaa

SEQ ID NO: 3908 - DNA, 50 bp, Homo sapiens
caagagagtggagacgagtacgcgagaacgcacgacacagagcgcaagaa

SEQ ID NO: 3909 - DNA, 50 bp, Homo sapiens
tctgctgccctcttaagatctgactgccaaataaatcatcctcatgtcct

SEQ ID NO: 3910 - DNA, 50 bp, Homo sapiens
gatgagaaacaaccacaaggaagagggcagcgccggagacctacagaaag

SEQ ID NO: 3911 - DNA, 50 bp, Homo sapiens
gcgggggcactggctcttcacatttggttgcgagttgcacacaccacaac

SEQ ID NO: 3912 - DNA, 50 bp, Homo sapiens
gggggaagcggaagggttggattgggtgaaaaaagaattgttcgtgttta

SEQ ID NO: 3913 - DNA, 50 bp, Homo sapiens
ataatagaggagagatattgtaaatagagactggcagcagtttccacaaa

SEQ ID NO: 3914 - DNA, 50 bp, Homo sapiens
agtggcaggtgcaattgtcggttcgatttgtgttcccaacagtctgaaat

SEQ ID NO: 3915 - DNA, 50 bp, Homo sapiens
gagcccacggggaagggaacccagcaacacggaaataagttggaccgatc

SEQ ID NO: 3916 - DNA, 50 bp, Homo sapiens
acaacctgagaaataattcggtcaataccagactccaacattcctgatct

SEQ ID NO: 3917 - DNA, 50 bp, Homo sapiens
gtctattacaaagtaaagagagtcaattactccaggaggagaattgcagg

SEQ ID NO: 3918 - DNA, 50 bp, Homo sapiens
accagacacggacacacacgaacacaagaaaacacaaaacaagagcaacc

SEQ ID NO: 3919 - DNA, 50 bp, Homo sapiens
cggttgggtcctcaaaatatgcctgtttggttaacaaaagcggttgtgaa

SEQ ID NO: 3920 - DNA, 50 bp, Homo sapiens
gataaagaaggggcgcgggaaacagcgagggaaggacgggctgggagaac

SEQ ID NO: 3921 - DNA, 50 bp, Homo sapiens
atctctggcaatactgtctgattacgggggtgatgccgacggttaaaaac

SEQ ID NO: 3922 - DNA, 50 bp, Homo sapiens
gaacacaaaaaacctcttctataacggggacacacgccaaggggacaagt

SEQ ID NO: 3923 - DNA, 50 bp, Homo sapiens
ttgggtgcaacaaccaatacacttatacttggaaaccacgggccatatta

SEQ ID NO: 3924 - DNA, 50 bp, Homo sapiens
aggaggaacaaaaaccgcagcgtggatttcaaatttctggaagtaagtct

SEQ ID NO: 3925 - DNA, 50 bp, Homo sapiens
aaattcgcgcaccctttgttttattgccccggttacaaggttttgaactg

SEQ ID NO: 3926 - DNA, 50 bp, Homo sapiens
cgggccagtatgaatgtagggtcaaggaacgccgagggtttcacaaaagg

SEQ ID NO: 3927 - DNA, 50 bp, Homo sapiens
ctcagtgtagggcagagaggtctaacaccaacataaggtactagcagtgt

SEQ ID NO: 3928 - DNA, 50 bp, Homo sapiens
agaatatatgtattttgaaaggaaaggacttggggatttttaacagggca

SEQ ID NO: 3929 - DNA, 50 bp, Homo sapiens
gagactctcgttgtctcctcttctgctctcttctctgttggaggggagga

SEQ ID NO: 3930 - DNA, 50 bp, Homo sapiens
aggttgtggggagtatgtttggaccaaaaattaaaatattgtgggaggga

SEQ ID NO: 3931 - DNA, 50 bp, Homo sapiens
gaccttacctggtggttttgtggtttgttctcccgaaaaatgcggggttt

SEQ ID NO: 3932 - DNA, 50 bp, Homo sapiens
caccctgggttttaaagtgtgggagaaaagcgcccggaagaaggaaacaa

SEQ ID NO: 3933 - DNA, 50 bp, Homo sapiens
gaggggaccggccatctgggcaagcagatatgctaattgggaattatagg

SEQ ID NO: 3934 - DNA, 50 bp, Homo sapiens
atgacttgtgaatacctgagttatactttcccaacagatgtgcctaacac

SEQ ID NO: 3935 - DNA, 50 bp, Homo sapiens
tgatagctcacttagttaattgttttgaagcaaattttgggttggatggg

SEQ ID NO: 3936 - DNA, 50 bp, Homo sapiens
gacacagaagagagacagaagagaaacggtcgaggagaagaagcaggagc

SEQ ID NO: 3937 - DNA, 50 bp, Homo sapiens
aaagaccagagacagggagacacggcagacagagcgccgacaaagaagag

SEQ ID NO: 3938 - DNA, 50 bp, Homo sapiens
caaggcgacatgggagagcgagaaggctaggaggacgacagacaaggaaa

SEQ ID NO: 3939 - DNA, 50 bp, Homo sapiens
gaattttggggaggttactggtcgggggaaataacagggttggacaaacg

SEQ ID NO: 3940 - DNA, 50 bp, Homo sapiens
ctccacatatgggtaacacactcggtccttacaagcacctagtcacttcc

SEQ ID NO: 3941 - DNA, 50 bp, Homo sapiens
gggaccagactgctttctaaatgcacagctctttcactatcagaatgtgt

SEQ ID NO: 3942 - DNA, 50 bp, Homo sapiens
tgtggtcacttgggaaataaattccatctggcttacccaatgggtggtgg

SEQ ID NO: 3943 - DNA, 50 bp, Homo sapiens
ccacagccacaacaccagacaagccgaccaacagacagatacagaccacc

SEQ ID NO: 3944 - DNA, 50 bp, Homo sapiens
accacagcaagacaacaaggacgagaaagagaacagacaatgagcaacga

SEQ ID NO: 3945 - DNA, 50 bp, Homo sapiens
actactgcttgcgtacctctccgctttccctctccttactatcgaccata

SEQ ID NO: 3946 - DNA, 50 bp, Homo sapiens
tccgtttatattagcactgtatcccttgtgccatccaacattttgtatgt

SEQ ID NO: 3947 - DNA, 50 bp, Homo sapiens
cgggcgcaggacagtagcagagaagagaggtggagagccggacaacgcag

SEQ ID NO: 3948 - DNA, 50 bp, Homo sapiens
cttcagtcattatgggctcagtttcctcactattggttcctcgcaaggga

SEQ ID NO: 3949 - DNA, 50 bp, Homo sapiens
aagagcaacaacgaggcgaagaggaaggaggaggcaagacagaagaggaa

SEQ ID NO: 3950 - DNA, 50 bp, Homo sapiens
gaggagcaacgaccagagagacgaactgacatcaaccatagaagacgaca

SEQ ID NO: 3951 - DNA, 50 bp, Homo sapiens
aagcatgaagaagacctggatgaggctcagggaggttcccccagtttaaa

SEQ ID NO: 3952 - DNA, 50 bp, Homo sapiens
atcagtcaatcagtcagcttctcagagtagcaatccatgtgtccagagga

SEQ ID NO: 3953 - DNA, 50 bp, Homo sapiens
aaatccaatccttcggagagggaatgggcggtattaattaagggaagtcc

SEQ ID NO: 3954 - DNA, 50 bp, Homo sapiens
atgacaagacaagccagacgaagaagacaaacaagggagacacagcagac

SEQ ID NO: 3955 - DNA, 50 bp, Homo sapiens
tgcgccccaatatttgtggaacagcgttttgttcgaataaaacgatcggt

SEQ ID NO: 3956 - DNA, 50 bp, Homo sapiens
ctcgaggtgtaactcaggaaggcctagcgaatcccgactcggatggtgtc

SEQ ID NO: 3957 - DNA, 50 bp, Homo sapiens
ttcacctactctgttcttttcatccatcccctgagtcagttggttggagg

SEQ ID NO: 3958 - DNA, 50 bp, Homo sapiens
ctgttgtctggagtgtggagtctcttgtctggattgtggagtctcttgtc

SEQ ID NO: 3959 - DNA, 50 bp, Homo sapiens
caagatgatgcttgctgtcttttcctctcggctacccagaatggcatttg

SEQ ID NO: 3960 - DNA, 50 bp, Homo sapiens
agtactcatgacttgagagacgtggacggagccagcttctaccttgcttg

SEQ ID NO: 3961 - DNA, 50 bp, Homo sapiens
ggtccgaccaattaatgactccatgatcggcctcggttttcacaaacctt

SEQ ID NO: 3962 - DNA, 50 bp, Homo sapiens
agacaaagagagcataaatatagctctactcatgggtaccataccagtgt

SEQ ID NO: 3963 - DNA, 50 bp, Homo sapiens
ttacatttgtggaccatgttacagttaaagaaaaatcctgtttcagtcct

SEQ ID NO: 3964 - DNA, 50 bp, Homo sapiens
gcaggttatcgcaagatgtcttagagtagggttaaggttctcagtgacac

SEQ ID NO: 3965 - DNA, 50 bp, Homo sapiens
atttttaaatggctttaccaaacattgtcagtacctttacgtgttagaag

SEQ ID NO: 3966 - DNA, 50 bp, Homo sapiens
ctttccacagcaattgttttgtacgaggggccttacagcgcggtccactt

SEQ ID NO: 3967 - DNA, 50 bp, Homo sapiens
ttctacagcacgatgcctggatctactgacctgtcaaccacgaatcttga

SEQ ID NO: 3968 - DNA, 50 bp, Homo sapiens
gaaacagcaacaagcaaacaggatctcagcattaccaacagccagcacta

SEQ ID NO: 3969 - DNA, 50 bp, Homo sapiens
tgagcctgaacttttttagcaaattattattctcagtttccattacctgt

SEQ ID NO: 3970 - DNA, 50 bp, Homo sapiens
ccttccaaagcggtcacctgatagggaagtcttacggctaggaagttaca

SEQ ID NO: 3971 - DNA, 50 bp, Homo sapiens
gaatggtggggagaaaaaaggggggcacagtcatgatcggctcttataat

SEQ ID NO: 3972 - DNA, 50 bp, Homo sapiens
gtcacataatccggggacccaaagaaagttctccagagtggtttcacgag

SEQ ID NO: 3973 - DNA, 50 bp, Homo sapiens
acaacaacacatcacgtaaccacaacacgcataaacagcaaatcatccta

SEQ ID NO: 3974 - DNA, 50 bp, Homo sapiens
cagaacaccaacaagcagggacggaagccgaccgagcaaacagcgaaggg

SEQ ID NO: 3975 - DNA, 50 bp, Homo sapiens
gtggacggcctgggaatgtgccccccggtgtaacatcgagcccacaatgg

SEQ ID NO: 3976 - DNA, 50 bp, Homo sapiens
aggattaggagagggtcacagaacagaaagcagattacacttgggatgga

SEQ ID NO: 3977 - DNA, 50 bp, Homo sapiens
ctctgtttgtctggccgcctccgtgatcaaaccgtgtcgtcggcgtgttc

SEQ ID NO: 3978 - DNA, 50 bp, Homo sapiens
ggcttggacattgctctcaagaagattaagaaccctggaggaacactagg

SEQ ID NO: 3979 - DNA, 50 bp, Homo sapiens
tgtacagctaaatttctccaaagcactttttcaaaaccaaaaaagaaaaa

SEQ ID NO: 3980 - DNA, 50 bp, Homo sapiens
tttgcacactgaacacttacagatgtggcagatgtgaaatttgtcatcaa

SEQ ID NO: 3981 - DNA, 50 bp, Homo sapiens
acagagagtcacccgcgagtacgaaacaggcacatttttagaaactcaca

SEQ ID NO: 3982 - DNA, 50 bp, Homo sapiens
aggttcttaccaccacttttgtgcccatctttcccttcgttcccaatgtg

SEQ ID NO: 3983 - DNA, 50 bp, Homo sapiens
ccggggtggccctctcaaatttggcatggggtcctctttcaatgttgtgg

SEQ ID NO: 3984 - DNA, 50 bp, Homo sapiens
cacgagcggctggaggacacccattttgtgcagtgcccgtccgtcccttc

SEQ ID NO: 3985 - DNA, 50 bp, Homo sapiens; identical to SEQ ID NO: 834

SEQ ID NO: 3986 - DNA, 50 bp, Homo sapiens
ggtgtgtctcgcggctggcccagtctattctcggtgtttatcttcatcac

SEQ ID NO: 3987 - DNA, 50 bp, Homo sapiens
gacaacggaaactctgtctctaccaccatgtgacagacgcgttgatgcgt

SEQ ID NO: 3988 - DNA, 50 bp, Homo sapiens
caagacacaaacagcacgactcacacagagaaagcaaccatgccgaggag

SEQ ID NO: 3989 - DNA, 50 bp, Homo sapiens
cgcgtcgaacttcgggacattcccgtaaaccacaaacagataaagaatta

SEQ ID NO: 3990 - DNA, 50 bp, Homo sapiens
gcgtaaagtgatcaaaaggccctgaaggggaaaatgataaaacccgtggt

SEQ ID NO: 3991 - DNA, 50 bp, Homo sapiens
agaggaagcgtgtgaatacaacaatctaaaaaggaggagaggtcgagcac

SEQ ID NO: 3992 - DNA, 50 bp, Homo sapiens
acacattccccataccatttcgtgttattcacattccccgtaccatttct

SEQ ID NO: 3993 - DNA, 50 bp, Homo sapiens
taaaaagggggtggcggctgtagtaaggaggagcgagtaatgtatagcac

SEQ ID NO: 3994 - DNA, 50 bp, Homo sapiens
ccatgagcaggcgcaaccataacagttagagacggcacacagcacgacac

SEQ ID NO: 3995 - DNA, 50 bp, Homo sapiens
actcacgcaagagcagggggactataacagaaataaacaagtaaataaat

SEQ ID NO: 3996 - DNA, 50 bp, Homo sapiens
tacacaggcagctatgcggatcatcagacgagcacatattctaacagaga

SEQ ID NO: 3997 - DNA, 50 bp, Homo sapiens
cgtcgccgtaggacgcctccgtcgtcgtctggtctgtctcctgcatcgag

SEQ ID NO: 3998 - DNA, 50 bp, Homo sapiens
aaaggcaagagtccggggtggcagaagagtgaaaaatgaaagagagaagg

SEQ ID NO: 3999 - DNA, 50 bp, Homo sapiens
ttctgcccagagtgtatttgtgaagagtctcttatattatgttttgtgga

SEQ ID NO: 4000 - DNA, 50 bp, Homo sapiens
gtgcgaatgtggagtgttttacattgatctttgctaatgaattagcatca

SEQ ID NO: 4001 - DNA, 50 bp, Homo sapiens
cattacgcatattggtaagacgcaaaatgagacagatcgacactgggacg

SEQ ID NO: 4002 - DNA, 50 bp, Homo sapiens
cacaacgggtcttaatgacgacggaaagatacatccatcggtatgaacgc

SEQ ID NO: 4003 - DNA, 50 bp, Homo sapiens
accagcaatccgcagcagagtcataagtggggtaggtgatatgtactaac

SEQ ID NO: 4004 - DNA, 50 bp, Homo sapiens
gaaaaaacaagctaacaaacacacacgcccacaccaacatgccagaacgc

SEQ ID NO: 4005 - DNA, 50 bp, Homo sapiens
tgaacatgggtgggtttgatcacgaggattccgctgaaaagattagaggg

SEQ ID NO: 4006 - DNA, 50 bp, Homo sapiens
cgcgttcataacggcgtcgactgttcttgtgctgctgttatctatactat

SEQ ID NO: 4007 - DNA, 50 bp, Homo sapiens
gggaccagactacacggaataccagagttgaagaaaattaagatttaagc

SEQ ID NO: 4008 - DNA, 50 bp, Homo sapiens
tatactgagagtgaaggtctgggtgccaacttgagacaggtggtctagga

SEQ ID NO: 4009 - DNA, 50 bp, Homo sapiens
cccctggttttctcgttctgcctcctttggacctgtgtttgttttctgct

SEQ ID NO: 4010 - DNA, 50 bp, Homo sapiens
cccttagaatggttactgcccttgaattaacttgacacaacttgggttgg

SEQ ID NO: 4011 - DNA, 50 bp, Homo sapiens
cgaataatccctatttgattacctcagaaaagttttgtcttccgccaagg

SEQ ID NO: 4012 - DNA, 50 bp, Homo sapiens
ttggaccccagggtaaggcggatattggttgggacgttcggggagtgtat

SEQ ID NO: 4013 - DNA, 50 bp, Homo sapiens
aattacgttcggaggtatataaaaagggatcggcgcagtggatagggggt

SEQ ID NO: 4014 - DNA, 50 bp, Homo sapiens
ggagatccacagtgatctcaggccctggaccggaaaaggcagcaagatca

SEQ ID NO: 4015 - DNA, 50 bp, Homo sapiens
aagacgagtacaccaagaccaaagagcgccaacgagcacgaccgagtgaa

SEQ ID NO: 4016 - DNA, 50 bp, Homo sapiens
aacgccgactagacgtcacaaagacttaataagaaacacactgatatcca

SEQ ID NO: 4017 - DNA, 50 bp, Homo sapiens
cgcaacattatccatttaaacccctgcataacccattaccaaagccctct

SEQ ID NO: 4018 - DNA, 50 bp, Homo sapiens
ggcaccccaatccccggcaaaaacatttgttaacctcttgggaatttctt

SEQ ID NO: 4019 - DNA, 50 bp, Homo sapiens
ctcgtctgcaccggagtctcacaaatttagcatctgggtcttgagcatta

SEQ ID NO: 4020 - DNA, 50 bp, Homo sapiens
ccctccggggtctctatacccacaaccttctatcactcaatcagttggta

SEQ ID NO: 4021 - DNA, 50 bp, Homo sapiens
aacaagatagagagaagacgaagatcgacacagacaaacaaccacaaccg

SEQ ID NO: 4022 - DNA, 50 bp, Homo sapiens
tgttgggacccctcatctcacgggtcatttccaccactaaacgccctttt

SEQ ID NO: 4023 - DNA, 50 bp, Homo sapiens
ccctgaaatcctaaattccgtcacccctccaacatgaccataaaagtccc

SEQ ID NO: 4024 - DNA, 50 bp, Homo sapiens
gaccacgttatgtgcctgacttcgaggacaccctctctggtttggtattt

SEQ ID NO: 4025 - DNA, 49 bp, Homo sapiens
tctcctttcagttcctttgtaggatttctggccttgaggatagtcttca

SEQ ID NO: 4026 - DNA, 50 bp, Homo sapiens
tctcatcaacatttgactctcagaagagcctccatttgccctttctctct

SEQ ID NO: 4027 - DNA, 50 bp, Homo sapiens
gcagagcagaccttattacgcacaattgccggtaacatgtaacaccagtt

SEQ ID NO: 4028 - DNA, 50 bp, Homo sapiens
attgggcatggttggtccaatgcctcacatggccgggataacaggacgca

SEQ ID NO: 4029 - DNA, 50 bp, Homo sapiens
caaagggtgtaattccacattgacactcctgtcatgcggtgggcgggaac

SEQ ID NO: 4030 - DNA, 50 bp, Homo sapiens
ctagctcactagttgtgcctatatgccacaccgggggacccaacaagggt

SEQ ID NO: 4031 - DNA, 50 bp, Homo sapiens
atactgtgtgatttgcccttgctgtccaaccctgttcttgctgccattta

SEQ ID NO: 4032 - DNA, 50 bp, Homo sapiens
gtggcctgaagtgacccattctatgaattgttaattaaggtgccaaaaaa

SEQ ID NO: 4033 - DNA, 50 bp, Homo sapiens
gggtttgagacttgggtatggaaacagaaccggaaattgtgtgctctggt

SEQ ID NO: 4034 - DNA, 50 bp, Homo sapiens
atttctattatggaatccctggggttcagaatgtaactttgtacatgaga

SEQ ID NO: 4035 - DNA, 50 bp, Homo sapiens
gacagtacacctcagggaagggacaaacaaacacgataaatcgacacacg

SEQ ID NO: 4036 - DNA, 50 bp, Homo sapiens
tcagacccagtcttgtggatggaaatgtagtgctcgagtcacattctgct

SEQ ID NO: 4037 - DNA, 50 bp, Homo sapiens
tcctgagccccacacgcccgaagcaataaagagtccactgacttccaaaa

SEQ ID NO: 4038 - DNA, 50 bp, Homo sapiens
acgaatatcgaatctcccacgcggggggtgagacccgaatctgcggctgc

SEQ ID NO: 4039 - DNA, 50 bp, Homo sapiens
agacacacgagcaaaacgacgcagcaagaatcagatagcatagcaaacat

SEQ ID NO: 4040 - DNA, 50 bp, Homo sapiens
gcagtgggacggaacgggtgaagcctgatggctgatgcggcacgatcttg

SEQ ID NO: 4041 - DNA, 50 bp, Homo sapiens
ctttaaatcttagattgctccgcacagataaagagaaccaggattggggc

SEQ ID NO: 4042 - DNA, 50 bp, Homo sapiens
tttatttgggtacttttccccaacacaagtccttttatcccacccttggg

SEQ ID NO: 4043 - DNA, 50 bp, Homo sapiens
aaaagatctcggaaaatagcattttgttaaaaccttggggggtaaaaccc

SEQ ID NO: 4044 - DNA, 50 bp, Homo sapiens
aaccttcatgcaagtggagacgggtagggggttctatggggcattggttg

SEQ ID NO: 4045 - DNA, 50 bp, Homo sapiens
tgtgaaaagctgataagaaaaccatccagaaaaaagctcttcgttttaca

SEQ ID NO: 4046 - DNA, 50 bp, Homo sapiens
tcattataattctgtcctaggaaatcaaattagaacgctccacaagccgg

SEQ ID NO: 4047 - DNA, 50 bp, Homo sapiens
cgcagagctgggccttacaaatgggttccaaatcgggcttctcactcagg

SEQ ID NO: 4048 - DNA, 50 bp, Homo sapiens
tacaactgtaccacactgggttactctagaagtctctggtcggatccttc

SEQ ID NO: 4049 - DNA, 50 bp, Homo sapiens
catagagcacaagagacacatggaccggcacgcgacccgacccaaagcgc

SEQ ID NO: 4050 - DNA, 50 bp, Homo sapiens
tttacctcatttatttggtactttccccacacagtcctttatccacctgg

SEQ ID NO: 4051 - DNA, 50 bp, Homo sapiens
ccatttttagtgggggagaaaactgtcactgtgctggcgaaagaggtcca

SEQ ID NO: 4052 - DNA, 50 bp, Homo sapiens
ccgcaccgattaacggccagagaagcaacaagcaaataaaaagtgggaaa

SEQ ID NO: 4053 - DNA, 50 bp, Homo sapiens
aacttaactcactggcgagaatacagcgtgggacccttcagccactacaa

SEQ ID NO: 4054 - DNA, 50 bp, Homo sapiens
aggacttaacgggaatacgggaataactccaattacttcatctctagggc

SEQ ID NO: 4055 - DNA, 50 bp, Homo sapiens
aaggaggttgctcaccagtagtgcttgttaccaaaatgtcaccaggagtt

SEQ ID NO: 4056 - DNA, 50 bp, Homo sapiens
tgaattaagtgcattatcaattaaccttatggtggttggaatagtgatca

SEQ ID NO: 4057 - DNA, 50 bp, Homo sapiens
aaacacacaggaaaagggcaaagggggcaccaggagaaccgggagacaaa

SEQ ID NO: 4058 - DNA, 50 bp, Homo sapiens
cggagaaacggggccaaaaggttgccgagagacccggcgaaaaggacagg

SEQ ID NO: 4059 - DNA, 50 bp, Homo sapiens
acaaagcatcaaacagcagggagctagtggagaggtctattgtcccagtg

SEQ ID NO: 4060 - DNA, 50 bp, Homo sapiens
gggtgcatgccaagaaagtatggttggaattcctggtacactgaagtgga

SEQ ID NO: 4061 - DNA, 50 bp, Homo sapiens
atgttatcttgggaattagtgtcttgagcctctgtctgttaccgtagttt

SEQ ID NO: 4062 - DNA, 50 bp, Homo sapiens
tgaccgagtaaaaaacatctatcaattacacaaatgaacaagaatgtgag

SEQ ID NO: 4063 - DNA, 50 bp, Homo sapiens
acaagaaatggttgaggcgaatattggaaacacatgggcttaatgctgaa

SEQ ID NO: 4064 - DNA, 50 bp, Homo sapiens
ggtattgatgcttggtttttcctgccagtccgaaattcctgtatttgtca

SEQ ID NO: 4065 - DNA, 50 bp, Homo sapiens
tcatgctacttgtcctggttttgtcattgatactctcatagcccttttga

SEQ ID NO: 4066 - DNA, 50 bp, Homo sapiens
gcctggcggaccggcagcctatatgacggacttcctcattacttaccacg

SEQ ID NO: 4067 - DNA, 50 bp, Homo sapiens
aaactgtttggagaatttaagcactctctgatgggggacaactctatgga

SEQ ID NO: 4068 - DNA, 50 bp, Homo sapiens
tctttgtgcagatacgttcaccacataagtgtgagccatttaaacctggt

SEQ ID NO: 4069 - DNA, 50 bp, Homo sapiens
caccaaagtggagacaaatacatgatctcaaagatacacagtacctactt

SEQ ID NO: 4070 - DNA, 50 bp, Homo sapiens
aataattggtcttttaaacaaacacggaagtttggtggaatcggtcatgt

SEQ ID NO: 4071 - DNA, 50 bp, Homo sapiens
tgttcgtgccttccttctgggttccacaaaggtgggaccttacttatcta

SEQ ID NO: 4072 - DNA, 50 bp, Homo sapiens
agggaaaaacgcagggggttcaaaaactctctcactctatgcagtgtata

SEQ ID NO: 4073 - DNA, 50 bp, Homo sapiens
aagcagctcaatagcagcatagaggattagattaatggaacagcactgca

SEQ ID NO: 4074 - DNA, 50 bp, Homo sapiens
acatatacaaggacacagaggaaaggcgggaacaacgggaagaggttttg

SEQ ID NO: 4075 - DNA, 50 bp, Homo sapiens
tgtggcgattaagagaggtgaagcataactgatttgcaggatatggtttg

SEQ ID NO: 4076 - DNA, 50 bp, Homo sapiens
aaaagccaaaaggtttcatgtagattttagttcactaaagggtgcccaca

SEQ ID NO: 4077 - DNA, 50 bp, Homo sapiens
gcagaactctaattgtacggggtcacagaggcgtgatatggtatcccaaa

SEQ ID NO: 4078 - DNA, 50 bp, Homo sapiens
cttaaccatacagaatgatataactcctgtgcaatgaaggtgataacagt

SEQ ID NO: 4079 - DNA, 50 bp, Homo sapiens
cttcggaggctaggccgccgctccagctttgcacgtttcgatcccaaagg

SEQ ID NO: 4080 - DNA, 50 bp, Homo sapiens
caaagtcaaataactcctcattgtaaacaaactgtgtaactgcccaaagc

SEQ ID NO: 4081 - DNA, 50 bp, Homo sapiens
ccaatcccgatccaaatcataatttgttcttaagtatactgggcaggtcc

SEQ ID NO: 4082 - DNA, 50 bp, Homo sapiens
tccagctcctgttccttggaaaatctccattgtatgtgcattttttaaat

SEQ ID NO: 4083 - DNA, 50 bp, Homo sapiens
aactgatgcctgctagtgctttctgattactcgcattctgtttcttgctt

SEQ ID NO: 4084 - DNA, 50 bp, Homo sapiens
tcaggttgaagtcaagatgacagataaggtgagagtaatgactactccaa

SEQ ID NO: 4085 - DNA, 50 bp, Homo sapiens
tcctaggtagggtttaatccccagtaaaattgccatattgcacatgtctt

SEQ ID NO: 4086 - DNA, 50 bp, Homo sapiens; identical to SEQ ID NO: 2481

SEQ ID NO: 4087 - DNA, 50 bp, Homo sapiens
gaggccctagcatttctccttggataggggaccagagagagcttggaatg

SEQ ID NO: 4088 - DNA, 50 bp, Homo sapiens; identical to SEQ ID NO: 2188

SEQ ID NO: 4089 - DNA, 50 bp, Homo sapiens; identical to SEQ ID NO: 2057

SEQ ID NO: 4090 - DNA, 50 bp, Homo sapiens
tttacctctgtcttggctttcatgttattaaacgtatgcatgtgaagaag

SEQ ID NO: 4091 - DNA, 50 bp, Homo sapiens
gggaagttggtttataagcctttgccaggtgtaactgttgtgaaataccc

SEQ ID NO: 4092 - DNA, 50 bp, Homo sapiens
ccctcccttcagattatgttaactctgagtctgtccaaatgagttcactt

SEQ ID NO: 4093 - DNA, 50 bp, Homo sapiens; identical to SEQ ID NO: 3369

SEQ ID NO: 4094 - DNA, 50 bp, Homo sapiens; identical to SEQ ID NO: 2819

SEQ ID NO: 4095 - DNA, 50 bp, Homo sapiens
tatggccttcaagctcaagtccaaatcctgccatgacctctctgtactct

SEQ ID NO: 4096 - DNA, 50 bp, Homo sapiens
tccatctgtgcataaggagaggaaagttccagggtgtgtatgttttcagg

SEQ ID NO: 4097 - DNA, 50 bp, Homo sapiens
ggaccattccggagcagccccacatacctcactgtctcgtctgtctatgt

SEQ ID NO: 4098 - DNA, 50 bp, Homo sapiens; identical to SEQ ID NO: 3153

SEQ ID NO: 4099 - DNA, 50 bp, Homo sapiens; identical to SEQ ID NO: 2269

SEQ ID NO: 4100 - DNA, 50 bp, Homo sapiens
aaatctattctaacgcaaaaccactaactgaagttcagataatggatggt

SEQ ID NO: 4101 - DNA, 50 bp, Homo sapiens
tgttataaaagaggattttcccaccttgacaccaggcaatgtagttagca

SEQ ID NO: 4102 - DNA, 50 bp, Homo sapiens
accaggatgcaatggatttatttgattcaggggacctgtatttccatgtc

SEQ ID NO: 4103 - DNA, 50 bp, Homo sapiens
aacagaaacagctatggcaacagcatcaccctcagagcatcaccaacttg

SEQ ID NO: 4104 - DNA, 50 bp, Homo sapiens
tatttaacctgagtatagtatttaacgaagcctagaagcacggctgtggg

SEQ ID NO: 4105 - DNA, 50 bp, Homo sapiens; identical to SEQ ID NO: 860

SEQ ID NO: 4106 - DNA, 50 bp, Homo sapiens
atagcaagctgaactgtcctaaggcaggggcgagcacggaacaatggggc

SEQ ID NO: 4107 - DNA, 50 bp, Homo sapiens
tgacaggttcacttctgaggttgctatgagggtgatggaatgtactgcct

SEQ ID NO: 4108 - DNA, 50 bp, Homo sapiens; identical to SEQ ID NO: 2223

SEQ ID NO: 4109 - DNA, 50 bp, Homo sapiens
ttgaaattggtggcttcattctagatgtagcttgtgcagatgtagcagga

SEQ ID NO: 4110 - DNA, 50 bp, Homo sapiens
acttcttatacatttgataaagtaaggcatggttgtggttaatctggttt

SEQ ID NO: 4111 - DNA, 50 bp, Homo sapiens
catgaagaagcaagacgaaaacacacaggagggaaaatcctgggattctt

SEQ ID NO: 4112 - DNA, 50 bp, Homo sapiens
gcctggcttggaccttggcattccgtttgaattccttctaactggaacat

SEQ ID NO: 4113 - DNA, 50 bp, Homo sapiens
gtccactgtcactgtttctctgctgttgcaaatacatggataacacattt

SEQ ID NO: 4114 - DNA, 50 bp, Homo sapiens
ttgtgttgttggaaaaagtcacattgccattaaactttccttgtctgtct

SEQ ID NO: 4115 - DNA, 50 bp, Homo sapiens
cagtagcgacagcgacggcggagacgagggcgtgagtcaggaggagagac

SEQ ID NO: 4116 - DNA, 50 bp, Homo sapiens
agctgccacgggtgagagagcaggaggtatgaattaaaagtctacagcac

SEQ ID NO: 4117 - DNA, 50 bp, Homo sapiens
ctttcctcaaaatctttaagccagaggcagccttcctgccggagtggaca

SEQ ID NO: 4118 - DNA, 50 bp, Homo sapiens
tctgcctcacgtgcactgtggtggccgtgtgctacggctccttctacaat

SEQ ID NO: 4119 - DNA, 50 bp, Homo sapiens
ccatagcccaaggtgacatttcccaccctgtgccgtgttccccaataaaa

SEQ ID NO: 4120 - DNA, 50 bp, Homo sapiens
ggggtatccagaattggttgtaaatactttgcatattgtctgattaaaca

SEQ ID NO: 4121 - DNA, 50 bp, Homo sapiens
gaggctttgccttgcctgcatatttgtttcgctcttactcagtttgggaa

SEQ ID NO: 4122 - DNA, 50 bp, Homo sapiens; identical to SEQ ID NO: 3320

SEQ ID NO: 4123 - DNA, 50 bp, Homo sapiens
ttgcaaaacccagaagctaaaaagtcaataaacagaaagaatgattttga

SEQ ID NO: 4124 - DNA, 50 bp, Homo sapiens; identical to SEQ ID NO: 1636

SEQ ID NO: 4125 - DNA, 50 bp, Homo sapiens
aaaagaagccctaataaaccacccggataataaccctgtctaccatcttt

SEQ ID NO: 4126 - DNA, 50 bp, Homo sapiens
gtgaagattcctgaggatctaacttgcagttggacactatgttacatact

SEQ ID NO: 4127 - DNA, 50 bp, Homo sapiens
agaaggattagcagttcttagtaagtttactgtgtataggaacggtttgt

SEQ ID NO: 4128 - DNA, 50 bp, Homo sapiens
cggctgcctctcttgagaccatctgccaatcacacagtaactattcgggt

SEQ ID NO: 4129 - DNA, 49 bp, Homo sapiens
cccaactgaggaccactgtctacagagtcaggaaatattgtagggagaa

SEQ ID NO: 4130 - DNA, 50 bp, Homo sapiens; identical to SEQ ID NO: 2058

SEQ ID NO: 4131 - DNA, 50 bp, Homo sapiens; identical to SEQ ID NO: 3479

SEQ ID NO: 4132 - DNA, 50 bp, Homo sapiens
ggagccaagtccagatttacactgggagaggtgccagcaactgaataaat

SEQ ID NO: 4133 - DNA, 50 bp, Homo sapiens; identical to SEQ ID NO: 3789

SEQ ID NO: 4134 - DNA, 50 bp, Homo sapiens
taacttcaatgtagttttccatccttcaaataaacatgtctgcccccatg

SEQ ID NO: 4135 - DNA, 50 bp, Homo sapiens
gagtccttttgatttttaacttattccccatgtccctatacttcgtgtgc

SEQ ID NO: 4136 - DNA, 50 bp, Homo sapiens; identical to SEQ ID NO: 2854

SEQ ID NO: 4137 - DNA, 50 bp, Homo sapiens
cagcttcagctaggagtttgtaagcaaggactttgtgacacatttgtccc

SEQ ID NO: 4138 - DNA, 50 bp, Homo sapiens
aattgaaaagtaccaagaagtggaagaagaccaagacccatcatgcccca

SEQ ID NO: 4139 - DNA, 50 bp, Homo sapiens
acttcctagagacttgtttctgagacagttctttgccttcacttccctgc

SEQ ID NO: 4140 - DNA, 50 bp, Homo sapiens
acaactgacctgtctccttcacatagtccatatcaccacaaatcacacaa

SEQ ID NO: 4141 - DNA, 50 bp, Homo sapiens
gctcaggagcgggctgctgagagctaaacccagcaattttctatgatttt

SEQ ID NO: 4142 - DNA, 50 bp, Homo sapiens
aaagaaagccagtatattggtttgaaatatagagatgtgtcccaatttca

SEQ ID NO: 4143 - DNA, 50 bp, Homo sapiens
actggcaggcttatttatctgttgcacttggttagctttaattgttctgt

SEQ ID NO: 4144 - DNA, 50 bp, Homo sapiens; identical to SEQ ID NO: 2256

SEQ ID NO: 4145 - DNA, 50 bp, Homo sapiens
caactgtgctggccgggaggagagcagagacgcagtcctgcccagtgtag

SEQ ID NO: 4146 - DNA, 50 bp, Homo sapiens
cacatggctaaagaaggtttcagaaagaagtggggacagagcagaacttt

SEQ ID NO: 4147 - DNA, 50 bp, Homo sapiens
ccgacatctggttcctacttcagggtcataaagcctaaatagcccacacg

SEQ ID NO: 4148 - DNA, 50 bp, Homo sapiens
ctcatttgtattcaagcctttaacaggagggcaaagaggtgagaatgtgt

SEQ ID NO: 4149 - DNA, 50 bp, Homo sapiens; identical to SEQ ID NO: 1928

SEQ ID NO: 4150 - DNA, 50 bp, Homo sapiens
gcagacactgcttcttacttctgtgctacggatgggaacagagatgacaa

SEQ ID NO: 4151 - DNA, 50 bp, Homo sapiens
ggggaaactggaggcttcaaaactatctttggagcaggaacaagactatt

SEQ ID NO: 4152 - DNA, 50 bp, Homo sapiens
ggggaaggagggtgattatattgctttgtaatggtttgtgatacttgaaa

SEQ ID NO: 4153 - DNA, 50 bp, Homo sapiens
gtacgaatgggaggtcctcgacacctggggaactgcggactatgcggcag

SEQ ID NO: 4154 - DNA, 50 bp, Homo sapiens; identical to SEQ ID NO: 2478

SEQ ID NO: 4155 - DNA, 50 bp, Homo sapiens
tgacctccaccaaagcccatataaggagcggagttgttaaggactgaaga

SEQ ID NO: 4156 - DNA, 50 bp, Homo sapiens
tttctccggactcatcagtaaacctgtagaagtgtcgctttccagccttt

SEQ ID NO: 4157 - DNA, 50 bp, Homo sapiens; identical to SEQ ID NO: 3153

SEQ ID NO: 4158 - DNA, 50 bp, Homo sapiens
aaagttgatactgtgggttatttttgtgaacagcctgatgtttgggacct

SEQ ID NO: 4159 - DNA, 50 bp, Homo sapiens
aacttttacactttttccttccaacacttcttgattggctttgcagaaat

SEQ ID NO: 4160 - DNA, 50 bp, Homo sapiens
acagccaagacttaggttacagggcaacgcactactgttcagctttgaat

SEQ ID NO: 4161 - DNA, 50 bp, Homo sapiens
acgtgtcctgattttgccacaacctggatattgaagctatccaagctttt

SEQ ID NO: 4162 - DNA, 50 bp, Homo sapiens; identical to SEQ ID NO: 2915

SEQ ID NO: 4163 - DNA, 50 bp, Homo sapiens; identical to SEQ ID NO: 923

SEQ ID NO: 4164 - DNA, 50 bp, Homo sapiens
ccaatgacagcctacctattaccaagggctcccctacaactctgaacctt

SEQ ID NO: 4165 - DNA, 50 bp, Homo sapiens
gacaaaccctggagaaatgggagcttggggagaggatgggagtgggcaga

SEQ ID NO: 4166 - DNA, 50 bp, Homo sapiens
gtgtcagtgcccaaaggagggaggttgatggtgcttaacaaacatgaagt

SEQ ID NO: 4167 - DNA, 50 bp, Homo sapiens
tcattgtataaaagctgttatgtgcaacagtgtggagattccttgtctga

SEQ ID NO: 4168 - DNA, 50 bp, Homo sapiens; identical to SEQ ID NO: 4155

SEQ ID NO: 4169 - DNA, 50 bp, Homo sapiens
ttggcttcattacgagagagaaacataacagaggcagtgatggtttcaga

SEQ ID NO: 4170 - DNA, 50 bp, Homo sapiens; identical to SEQ ID NO: 3706

SEQ ID NO: 4171 - DNA, 50 bp, Homo sapiens
agcacattgggagatacatgataaatttctatctgcagttgctatttgca

SEQ ID NO: 4172 - DNA, 50 bp, Homo sapiens
ggcccagcagaagagcctccttcagcagctactgactgaataaccacttt

SEQ ID NO: 4173 - DNA, 50 bp, Human cytomegalovirus
aataatagattagcagaaggaataatccgtgcgaccgagcttgtgcttct

SEQ ID NO: 4174 - DNA, 50 bp, Human cytomegalovirus
acattcaaaagtttgagcgtcttcatgtacgccgttttcggcctcacgag

SEQ ID NO: 4175 - DNA, 50 bp, Human cytomegalovirus
acgaacagaaatctcaaaagacgctgacccgataagtaccgtcacggaga

SEQ ID NO: 4176 - DNA, 50 bp, Human cytomegalovirus
aggaaccagcaagtcaacaaaagactaacaaagaaaaaccatcttggaat

SEQ ID NO: 4177 - DNA, 50 bp, Human cytomegalovirus
ccaacgacacatccacaaaaatcccccatcgactctcacaatcgcatcat

SEQ ID NO: 4178 - DNA, 50 bp, Human cytomegalovirus
cctctggaggcaagagcacccaccctatggtgactagaagcaaggctgac

SEQ ID NO: 4179 - DNA, 50 bp, Human cytomegalovirus
gatgtccgtctacgcgctatcggccatcatcggcatctatctgctctacc

SEQ ID NO: 4180 - DNA, 50 bp, Human cytomegalovirus
ttcgtgggcaccaagtttcgcaagaactacactgtctgctggccgagttt

SEQ ID NO: 4181 - DNA, 50 bp, Human cytomegalovirus
gagatcgacatcgtcatcgaccgacctccgcagcaacccctacccaatcc

SEQ ID NO: 4182 - DNA, 50 bp, Human cytomegalovirus
ctttgagcaggttctcaaggctgtaactaacgtgctgtcgcccgtctttc

SEQ ID NO: 4183 - DNA, 50 bp, Human cytomegalovirus
tcttctgggacgccaacgacatctaccgcatcttcgccgaattggaaggc

SEQ ID NO: 4184 - DNA, 50 bp, Human cytomegalovirus
agagaacaacaaaaccaccacgacgatgaaacaaaacgctcaaccaaaca

SEQ ID NO: 4185 - DNA, 50 bp, Human cytomegalovirus
gagaaaagattgtgcgatctccccctggtttccagcagactcttgccaga

SEQ ID NO: 4186 - DNA, 50 bp, Human cytomegalovirus
catcttctccaccaaccagggtgggttcatgctgcctatctacgagacgg

SEQ ID NO: 4187 - DNA, 50 bp, Homo sapiens
tcccatgttccctttatttgtcttttggttctgctttttgggagattttt

SEQ ID NO: 4188 - DNA, 50 bp, Homo sapiens
tggtgcgcttttgtgtgcggtggaggagttcctaaccctcggcttgtttt

SEQ ID NO: 4189 - DNA, 50 bp, Homo sapiens
gccgttggttggcttaaacttggtttcgtcacttcgggcactttggtttt

SEQ ID NO: 4190 - DNA, 50 bp, Homo sapiens
ctggcctcccctggctctttaagctcccctttggttaaaaactgggtttt

SEQ ID NO: 4191 - DNA, 50 bp, Homo sapiens
aaaaggccaagggtgttgttggggcgtctgtctaatgtggtgggtctttt

SEQ ID NO: 4192 - DNA, 50 bp, Homo sapiens
gctgtaaatctctgtctcatcatccttctcttttgtttccatagcctttt

SEQ ID NO: 4193 - DNA, 50 bp, Homo sapiens
gtgtgtgctggctgagaagccactgtgaattgattcttcttctgaagttt

SEQ ID NO: 4194 - DNA, 50 bp, Homo sapiens
aataagggtgttgccctttgttccctcacataatcgtgaaaggctgcttt

SEQ ID NO: 4195 - DNA, 50 bp, Homo sapiens
ttcctcagtccctgttcataccatctctgcacccacaatcacactgattt

SEQ ID NO: 4196 - DNA, 50 bp, Homo sapiens
gaccacagatatgcactccttacattaacctcagccttgatgtatcattt

SEQ ID NO: 4197 - DNA, 50 bp, Homo sapiens
ccccctgttatgaaaagggttaaacttgaacccacccattttaaaaattt

SEQ ID NO: 4198 - DNA, 50 bp, Homo sapiens
ttatagctaccagaagccaccagggccttagcccagcagtagaaacctct

SEQ ID NO: 4199 - DNA, 50 bp, Homo sapiens
gatcagtagacacacccctcaatgctgcgaagaaaatgaaggccactctt

SEQ ID NO: 4200 - DNA, 50 bp, Homo sapiens
agcagacaatggacaactgtagtttttgaattgacttctatagccatctt

SEQ ID NO: 4201 - DNA, 50 bp, Homo sapiens
tccaccacagtgcatgataattccgacagaacggccttttatttgtacct

SEQ ID NO: 4202 - DNA, 50 bp, Homo sapiens
tgttctctgaactgtctggatgaaccggtcaacggcactcatcatacctt

SEQ ID NO: 4203 - DNA, 50 bp, Homo sapiens
gcttcactctgctttctgtataaagggcagtctgtggtcacgcaagactt

SEQ ID NO: 4204 - DNA, 50 bp, Homo sapiens
agcaaagaccaaattctccttgggaagtgtgggagcaggctgacattatt

SEQ ID NO: 4205 - DNA, 50 bp, Homo sapiens
gtcctttgatagcagaacaagaggctctgtgatcctctggacctcagatt

SEQ ID NO: 4206 - DNA, 50 bp, Homo sapiens
tccacgacatggtacagctcttcactttttcagctttttaaatgtccatt

SEQ ID NO: 4207 - DNA, 50 bp, Homo sapiens
gacaaggcaatgctactgatcacctgaggataatggtgaaggacttttgt

SEQ ID NO: 4208 - DNA, 50 bp, Homo sapiens
tcaatagttgtgaaattcttctcaggctccttaaaccctcgctttgttgt

SEQ ID NO: 4209 - DNA, 50 bp, Homo sapiens
aggcttacgtttatccaaaagcatttcaccttgcacattactgttgttgt

SEQ ID NO: 4210 - DNA, 50 bp, Homo sapiens
acaagcatttagatcataacatggtaaagcctattaccagccaatgttgt

SEQ ID NO: 4211 - DNA, 50 bp, Homo sapiens
tgttttggcatagagctttacttaaaatgctgcttcattttacacattgt

SEQ ID NO: 4212 - DNA, 50 bp, Homo sapiens
tggagctcaattctatgcagttgtgctgatatttcattaagtcactgtgt

SEQ ID NO: 4213 - DNA, 50 bp, Homo sapiens
tttccccttggcctgagtttttataaaatttccattaattggggcagtgt

SEQ ID NO: 4214 - DNA, 50 bp, Homo sapiens
tgcagctaaattcgaagcttttggtctatattgttaattgccattgctgt

SEQ ID NO: 4215 - DNA, 50 bp, Homo sapiens
ggatttggaagatgctttcagaaatatggcataggtttttgtcgaaatgt

SEQ ID NO: 4216 - DNA, 50 bp, Homo sapiens
aaagaaaaattcagcctgaaccctacccttataaaacaggttaattgggt

SEQ ID NO: 4217 - DNA, 50 bp, Homo sapiens
tgtaagtcccatgcccgaatttggagatttgggtttttcttttcaggggt

SEQ ID NO: 4218 - DNA, 50 bp, Homo sapiens
cggattccaaattacttaaagcctttatgggaacacggtagattgtaggt

SEQ ID NO: 4219 - DNA, 50 bp, Homo sapiens
gccttctggcctctgaggcaaaggtcagtgatactgatgggagggtaggt

SEQ ID NO: 4220 - DNA, 50 bp, Homo sapiens
gctcaagatcacctctttgtcatcttgaacaatgtttttctcttctaggt

SEQ ID NO: 4221 - DNA, 50 bp, Homo sapiens
tgtttccacttcatgggatatgactccatcacaatgaaaatgggtccagt

SEQ ID NO: 4222 - DNA, 50 bp, Homo sapiens
ttgtgattgtaaatcatgtatgtacaaatgccatgaaaattaaagccagt

SEQ ID NO: 4223 - DNA, 50 bp, Homo sapiens
tttcccttatgcaccttccagtctttggcaggacatgatttatggacagt

SEQ ID NO: 4224 - DNA, 50 bp, Homo sapiens
tgcactctaccagatttgaacatctagtgaggttcacattcatactaagt

SEQ ID NO: 4225 - DNA, 50 bp, Homo sapiens
tcaactgcagggaatctcctaggaagcggataaatctggcaattggaagt

SEQ ID NO: 4226 - DNA, 50 bp, Homo sapiens
accaccagctatttgtaattccttcttctaaggcatagtgaaaacttgct

SEQ ID NO: 4227 - DNA, 50 bp, Homo sapiens
tcgctttctaactgattccattccaccatgtcagatactcctgggctgct

SEQ ID NO: 4228 - DNA, 50 bp, Homo sapiens
cagcaatgaggggatatttttgatgagctggaatatccaattgaacagct

SEQ ID NO: 4229 - DNA, 50 bp, Homo sapiens
ccccctaagttaaaagctctgtctttttggggtttgccctatgtaaagct

SEQ ID NO: 4230 - DNA, 50 bp, Homo sapiens
gaagcctctactcttgagtctctttcattactggggatgtaaatgttcct

SEQ ID NO: 4231 - DNA, 50 bp, Homo sapiens
acacttgatctcttccttatttctctcagaaaacctgtaggattgtgcct

SEQ ID NO: 4232 - DNA, 50 bp, Homo sapiens
agtagatattttgccggtgtacttggaatacctttcagaagccaaaccct

SEQ ID NO: 4233 - DNA, 50 bp, Homo sapiens
aattccaatcctggtatatagcacctggtattatgggtaccaaaaaccct

SEQ ID NO: 4234 - DNA, 50 bp, Homo sapiens
actgctccaaatatcaaccccatgtaggcaggatgtttgatcttggtact

SEQ ID NO: 4235 - DNA, 50 bp, Homo sapiens
tgttgttggatacgtacttaactggtatgcatcccatgtctttgggtact

SEQ ID NO: 4236 - DNA, 50 bp, Homo sapiens
ttaggattgctcagtttcatcaaggtttgaaggataggcaggctctcact

SEQ ID NO: 4237 - DNA, 50 bp, Homo sapiens
ggccagtctctgtgtgtcttaatcccttgtccttcattaaaagcaaaact

SEQ ID NO: 4238 - DNA, 50 bp, Homo sapiens
gcattcccggtcactccctccctaatctgagcatcactcaagctctttat

SEQ ID NO: 4239 - DNA, 50 bp, Homo sapiens
ctgaatgccaagagcttcaagagtgtgtgtaaataaagccacacctttat

SEQ ID NO: 4240 - DNA, 50 bp, Homo sapiens
cccgaggaggaagacgaatcgttaaacatctgaaagggtcaggtgagtat

SEQ ID NO: 4241 - DNA, 50 bp, Homo sapiens
caaacttgttctgaagacaatttccaaggttgtcagccatgtcaccatat

SEQ ID NO: 4242 - DNA, 50 bp, Homo sapiens
tcaggttcgtgttaaacgctgtatgttaactatgactggaattctgtgat

SEQ ID NO: 4243 - DNA, 50 bp, Homo sapiens
atggagatccagagacgttggttttcaaatggagcaaacagcactgtgat

SEQ ID NO: 4244 - DNA, 50 bp, Homo sapiens
agctttaggctgagggcatggaaactgttacgcttttccttttatgtgat

SEQ ID NO: 4245 - DNA, 50 bp, Homo sapiens
tcactccagaatagaaattagagtataggtaggcagtccaacctctgcat

SEQ ID NO: 4246 - DNA, 50 bp, Homo sapiens
tcagatgccacacttatgagaccctcatccttctgctcactctcttccat

SEQ ID NO: 4247 - DNA, 50 bp, Homo sapiens
ccctgcctttacctctctacttgtagtgttctttcagagcctgctcccat

SEQ ID NO: 4248 - DNA, 50 bp, Homo sapiens
caaaacaagatgtgccagggcctgggggatgggataatttcagagagaat

SEQ ID NO: 4249 - DNA, 50 bp, Homo sapiens
acccaagagggcagcagttgtgtcatccagttcatcttaagaatttcaat

SEQ ID NO: 4250 - DNA, 50 bp, Homo sapiens
ggggtaggaagaggatggaattgagatgtttgagcctcatttacatcaat

SEQ ID NO: 4251 - DNA, 50 bp, Homo sapiens
gctctctgatgctggtggctgttcccccagaatggaagcattgattaaat

SEQ ID NO: 4252 - DNA, 50 bp, Homo sapiens
ggggagaagtgatatggtgaagggaagtggggagtatttgaacacagttg

SEQ ID NO: 4253 - DNA, 50 bp, Homo sapiens
caccatgcctcacttttagcgcagtgtgatcctacacaaattgccctgtg

SEQ ID NO: 4254 - DNA, 50 bp, Homo sapiens
tatggtttttaggctatgcagatattctgttggtttttgagacagctctg

SEQ ID NO: 4255 - DNA, 50 bp, Homo sapiens
ccttcctttctaaggcataagtgcgacgttcgctgctgtgcgtggaactg

SEQ ID NO: 4256 - DNA, 50 bp, Homo sapiens
gagaggaaggcagacaggcagccattttaagagagaagagccagacaatg

SEQ ID NO: 4257 - DNA, 50 bp, Homo sapiens
gttatcaaaggtggaatcggaaacaccaggctcctagtgccacggaaatg

SEQ ID NO: 4258 - DNA, 50 bp, Homo sapiens
aaatgtgcctattgctagagctcctccctctcaacacccagtttccttgg

SEQ ID NO: 4259 - DNA, 50 bp, Homo sapiens
caatcgtcttatctctacagagagaagtggaaaattctttttcaaggggg

SEQ ID NO: 4260 - DNA, 50 bp, Homo sapiens
ctatggaaggcagttggtgggcaaaagtccggtttttacgctttgagggg

SEQ ID NO: 4261 - DNA, 50 bp, Homo sapiens
gtctgatccttagaccgtctcatcacagcaaccctaactgcagagcaggg

SEQ ID NO: 4262 - DNA, 50 bp, Homo sapiens
aatggtaagaaatgccttgtgtgggtggccctccagtccccagtccaggg

SEQ ID NO: 4263 - DNA, 50 bp, Homo sapiens
aacatatccagggaggacaaactctgggctggacaatgtatccacaaggg

SEQ ID NO: 4264 - DNA, 50 bp, Homo sapiens
gcccatggtcctagaattaattcccctaaaaatttttgaaataggggcgg

SEQ ID NO: 4265 - DNA, 50 bp, Homo sapiens
gccaactgcttagaagcccaacacaacccatctggtctcttgaataaagg

SEQ ID NO: 4266 - DNA, 50 bp, Homo sapiens
gagcccttaaaattactgtatctcctctaaagtgtgatttaatggctgcg

SEQ ID NO: 4267 - DNA, 50 bp, Homo sapiens
cttttgctggagactcatcgctttgggaagtgcatttgcttcgtcgtccg

SEQ ID NO: 4268 - DNA, 50 bp, Homo sapiens
cccagttcacagtagagaggtggagcttagtacttcctgctgcccattag

SEQ ID NO: 4269 - DNA, 50 bp, Homo sapiens
ctgggctgtaggtactgctgggtcactgttgctataaatggtcactggag

SEQ ID NO: 4270 - DNA, 50 bp, Homo sapiens
ctttagatgtcccacgtcccttcaagcacatgaaagagctcacactggag

SEQ ID NO: 4271 - DNA, 50 bp, Homo sapiens
gactctggaactcgagcgtgtggctgctgcgccgacagctgaatctagag

SEQ ID NO: 4272 - DNA, 50 bp, Homo sapiens
ccttagagatcgtgacccttcctgcttgcctccctggtgggctctttcag

SEQ ID NO: 4273 - DNA, 50 bp, Homo sapiens
agagtgagaaggcagttccagttttagcacagatttgtttatgtgttcag

SEQ ID NO: 4274 - DNA, 50 bp, Homo sapiens
tctcaagagagaacgccacagcagagagacccaatccgcctaagttgcag

SEQ ID NO: 4275 - DNA, 50 bp, Homo sapiens
aggtttggggaggggtcccagtctgcgatcctttctccctcttcgtgcag

SEQ ID NO: 4276 - DNA, 50 bp, Homo sapiens
cctcagcttccaactctgattccaggacaggatggaaaacctttggacag

SEQ ID NO: 4277 - DNA, 50 bp, Homo sapiens
aatcccttgtaccatgtatacaaatgagacaagtgagcttgacattcaag

SEQ ID NO: 4278 - DNA, 50 bp, Homo sapiens
gctacagcccggaacacaaaagaagacacccatgcaaataccattaaaag

SEQ ID NO: 4279 - DNA, 50 bp, Homo sapiens
attaaccctttattgccctagccagtggggtgggagggagagattgtttc

SEQ ID NO: 4280 - DNA, 50 bp, Homo sapiens
gttatccttaggccaggtctcccacctttgagccggacaaaaccagagtc

SEQ ID NO: 4281 - DNA, 50 bp, Homo sapiens
tgctgctacagttgcaaaacactggagctagagaaaataaagtactgatc

SEQ ID NO: 4282 - DNA, 50 bp, Homo sapiens
cgagagtcttgctgagccaggacttgagtgcctcgaagttttcaatgatc

SEQ ID NO: 4283 - DNA, 50 bp, Homo sapiens
atcaggagagggagataattagttgcttcctccttcacactgtttgaatc

SEQ ID NO: 4284 - DNA, 50 bp, Homo sapiens
ttgccctttcctctcactgccttttatagccaatatcaatgtctctttgc

SEQ ID NO: 4285 - DNA, 50 bp, Homo sapiens
atccctattgccagacacatcattctctccatccagaaagccaactttgc

SEQ ID NO: 4286 - DNA, 50 bp, Homo sapiens
ctctcttcatcttctgattgggattgtgtccagtcctctgcttcttctgc

SEQ ID NO: 4287 - DNA, 50 bp, Homo sapiens
gagggttctagcaacttaatcccattagcatgttagctgaagactactgc

SEQ ID NO: 4288 - DNA, 50 bp, Homo sapiens
gtcccaagggtcagtatattggaggaaagtaaaggagtgaatcagactgc

SEQ ID NO: 4289 - DNA, 50 bp, Homo sapiens
ctggaattactaatgtggaggtgatctgagaactgggaacaaagtagggc

SEQ ID NO: 4290 - DNA, 50 bp, Homo sapiens
tccagggactgacaagagtgagtggtgtcaacctaaagagaaactcaggc

SEQ ID NO: 4291 - DNA, 50 bp, Homo sapiens
cagaactccatagacagcctcactttgtgctcgggggcctgtcccaaggc

SEQ ID NO: 4292 - DNA, 50 bp, Homo sapiens
gcacttctcccggttcatccctctcaagtaatggctcagctaataaaggc

SEQ ID NO: 4293 - DNA, 50 bp, Homo sapiens
tccatctcctttctactgtagcggagactacaagtcccaggatgccccgc

SEQ ID NO: 4294 - DNA, 50 bp, Homo sapiens
ccacattcttgctgtccacatcctgctgggtgaaattgtgttgaagtagc

SEQ ID NO: 4295 - DNA, 50 bp, Homo sapiens
tgactgtcttggtaattttcttccttgttttacttctggaaactgggagc

SEQ ID NO: 4296 - DNA, 50 bp, Homo sapiens
tgactttcaggaatgtcagcattgacctctccttgccactgttactcagc

SEQ ID NO: 4297 - DNA, 50 bp, Homo sapiens
aagtttgtgcagcacattcctgagtgtacgatattgacctgtagcccagc

SEQ ID NO: 4298 - DNA, 50 bp, Homo sapiens; identical to SEQ ID NO: 4297

SEQ ID NO: 4299 - DNA, 50 bp, Homo sapiens
accagacttcaggaagaataaaggtcgccaactcaataaaaccaccaagc

SEQ ID NO: 4300 - DNA, 50 bp, Homo sapiens
acttgccacataaacagttccatcataaaaactcttccccttcttgttcc

SEQ ID NO: 4301 - DNA, 50 bp, Homo sapiens
gcttccttgaaccacccagaaatccactcaaatttggggattgtcattcc

SEQ ID NO: 4302 - DNA, 50 bp, Homo sapiens
gggggtgatgggttaattaaataagtccattcctgggatttgagggggcc

SEQ ID NO: 4303 - DNA, 50 bp, Homo sapiens
atgcccctcgtcctagaattaattcccctaaaaatctttgaaatagggcc

SEQ ID NO: 4304 - DNA, 50 bp, Homo sapiens
tcaaactaagaccagggttgaaaactatggcccagggaccacttccagcc

SEQ ID NO: 4305 - DNA, 50 bp, Homo sapiens
gacgcgcacacaccttgagtgacagcgacctcttctctacaggttttccc

SEQ ID NO: 4306 - DNA, 50 bp, Homo sapiens
atccaagctttaattctgccatctcagaatggtgataaaccatttctccc

SEQ ID NO: 4307 - DNA, 50 bp, Homo sapiens
tacttcattgctattgtaaaccaaaaataaaatttgaagccccctgcccc

SEQ ID NO: 4308 - DNA, 50 bp, Homo sapiens
cttcatcactcaggaaacagaaaaggcttcagaaggagcggccatgcccc

SEQ ID NO: 4309 - DNA, 50 bp, Homo sapiens
agaacccgtattcataaaatttagaccaaaaaggaaggaatcgaaccccc

SEQ ID NO: 4310 - DNA, 50 bp, Homo sapiens
ttttctattttcatctgtcattttcactgcagagcgcacctcccggaccc

SEQ ID NO: 4311 - DNA, 50 bp, Homo sapiens
agactgaaggggttgaaagacccgtagacgctcctttcctcttttagacc

SEQ ID NO: 4312 - DNA, 50 bp, Homo sapiens
ctctgcggccctagagttaatcccatcagccgaggtgaggcacctgttac

SEQ ID NO: 4313 - DNA, 50 bp, Homo sapiens
ccaattccgcagtacagagcattcagcaggtagtggtgaccctgggtgac

SEQ ID NO: 4314 - DNA, 50 bp, Homo sapiens
ggctccagccaccggcagctctgaaagagtttgaagaatttattgttcac

SEQ ID NO: 4315 - DNA, 50 bp, Homo sapiens; identical to SEQ ID NO: 238

SEQ ID NO: 4316 - DNA, 50 bp, Homo sapiens
cactggaacacaacccagccatgaaaaggaagaagctctgactcaggcac

SEQ ID NO: 4317 - DNA, 50 bp, Homo sapiens
catctcatgcgtagcactgatcaatgtgccccagggtgtgtattcgccac

SEQ ID NO: 4318 - DNA, 50 bp, Homo sapiens
caatcagagcgcgagttacaagcgcggtggagtggggaagcgaatgaaac

SEQ ID NO: 4319 - DNA, 50 bp, Homo sapiens
gacattgcacatttttgaacctgtctacagcagcctgggttggtcacaac

SEQ ID NO: 4320 - DNA, 50 bp, Homo sapiens
acactggcagagtccagaaaagcagcagaagaaaaattcagagcaaaaac

SEQ ID NO: 4321 - DNA, 50 bp, Homo sapiens
tttaacgtgcttctgagacagccaccaccgaaaggcacctttagcggtta

SEQ ID NO: 4322 - DNA, 50 bp, Homo sapiens
tcagccaacctgaatctggtatctttacttaaacacagcagttgtagtta

SEQ ID NO: 4323 - DNA, 50 bp, Homo sapiens
aaaaggagacgatgtcaggcaaacactccttaccctgccatttctagtta

SEQ ID NO: 4324 - DNA, 50 bp, Homo sapiens
tcacaatcagtctcagattcccagcagcagagagtgaattgtatgttgta

SEQ ID NO: 4325 - DNA, 50 bp, Homo sapiens
taaagacaatgctatttaagtgcacagttccaggggcgcttgtggctcta

SEQ ID NO: 4326 - DNA, 50 bp, Homo sapiens
gaagaccaagtctacgcctgcaagctctcagaccgggaacatccactcta

SEQ ID NO: 4327 - DNA, 50 bp, Homo sapiens
ctgaagagacagaaagggagacaccaaaactttaatggcagttattccta

SEQ ID NO: 4328 - DNA, 50 bp, Homo sapiens
gccgcccccatgaagccctttcttactgtaagtgctcaagaacaaagata

SEQ ID NO: 4329 - DNA, 50 bp, Homo sapiens
gctagcacgactctgccttgttcctttggagacaattgttatcatcaata

SEQ ID NO: 4330 - DNA, 50 bp, Homo sapiens
attgggaatatagatcatcaacagacacagccctggacgcataaatttga

SEQ ID NO: 4331 - DNA, 50 bp, Homo sapiens
actaacgtatttcatcatggaaggtcctgtggtgatggttttccctggga

SEQ ID NO: 4332 - DNA, 50 bp, Homo sapiens
aagtaatagctccctgtttgtgccttgttagggctagggatgtttaagga

SEQ ID NO: 4333 - DNA, 50 bp, Homo sapiens
agctcctccccttagtgaccccaagtctgtttccctcagctgcataagga

SEQ ID NO: 4334 - DNA, 50 bp, Homo sapiens
ccctcaaatctcccaatctactccagggaaaagacacttcaagtgagaga

SEQ ID NO: 4335 - DNA, 50 bp, Homo sapiens
acatgcaaacagtgacttacttagtgcttctgaaaaatttctgagtcaga

SEQ ID NO: 4336 - DNA, 50 bp, Homo sapiens
aatgcccattggtaagtcaacattgttttccctgaaagtcctgagacaga

SEQ ID NO: 4337 - DNA, 50 bp, Homo sapiens
ccatgtttgctgctgctgttgagtttctgtgctttgggagtataataaga

SEQ ID NO: 4338 - DNA, 50 bp, Homo sapiens
tgtgtttggttgggtgtaatgaggaaaatacctgataaaatgtctgaaga

SEQ ID NO: 4339 - DNA, 50 bp, Homo sapiens
tggataagtgaagacagtaataacattgaagcagtgaaccagtggaaaga

SEQ ID NO: 4340 - DNA, 50 bp, Homo sapiens
agcacaaaaatgttgaagtattaggcccaagctccatgtttggttagtca

SEQ ID NO: 4341 - DNA, 50 bp, Homo sapiens
cgtttaacaataataaaggtgactgcttcatctaaggaatccgagccgca

SEQ ID NO: 4342 - DNA, 50 bp, Homo sapiens
gggcattccaccgaaattcttggggaaatttagtagccttcattttagca

SEQ ID NO: 4343 - DNA, 50 bp, Homo sapiens
tccatgttctgtgcaagaaggagacacattttcagttgaggttcccagca

SEQ ID NO: 4344 - DNA, 50 bp, Homo sapiens
agctcaacactgtggtaggaaaatagccactagaaagaaaataaaaagca

SEQ ID NO: 4345 - DNA, 50 bp, Homo sapiens
gcatctccagggtttagcatcaggacagaggattaagtaaattctttcca

SEQ ID NO: 4346 - DNA, 50 bp, Homo sapiens
gagactacagagccttagcccctttaaagcccttaaagttactacttcca

SEQ ID NO: 4347 - DNA, 50 bp, Homo sapiens
agagcaagtctcagaaataatgctgtatctacactgtcatgtatttgcca

SEQ ID NO: 4348 - DNA, 50 bp, Homo sapiens
tggttctctgatttgtaatgagcacctggatatgtcaattaaaatgccca

SEQ ID NO: 4349 - DNA, 50 bp, Homo sapiens
gcaagactgttcagtattatgttagcattgatataaaaagaagcagacca

SEQ ID NO: 4350 - DNA, 50 bp, Homo sapiens
aatgttcccaaaggccaaatttgttgccaggttttatacgcaggtcacca

SEQ ID NO: 4351 - DNA, 50 bp, Homo sapiens
tgcctattgtgattatcgctatcactacatcccctgactaagggaaacca

SEQ ID NO: 4352 - DNA, 50 bp, Homo sapiens
acaaaattcactgcaggtcggtggaatgatagaatgcattttaaatcaca

SEQ ID NO: 4353 - DNA, 50 bp, Homo sapiens
ggacggttggctgaatggcaacagtgatggaatatttatatttagccaca

SEQ ID NO: 4354 - DNA, 50 bp, Homo sapiens
acattgcacatttaatagctgcaccagacactaagagttcctctcacaca

SEQ ID NO: 4355 - DNA, 50 bp, Homo sapiens
cgcttgtcctgtgagtagctcgtcacctgaggccttgtcgtgaatattaa

SEQ ID NO: 4356 - DNA, 50 bp, Homo sapiens
tggagcaaaccacagtttcatgcccatcgtcctagaattaattcccctaa

SEQ ID NO: 4357 - DNA, 50 bp, Homo sapiens
gggacaacacagtggatttgaaatctgaaggggcattggtggtactggaa

SEQ ID NO: 4358 - DNA, 50 bp, Homo sapiens
acctccatatcttctcgtacttgttcctgctggtctcttagctctccgaa

SEQ ID NO: 4359 - DNA, 50 bp, Homo sapiens
cgaggatggtttcctgatagctttcaaacacctttgccatctcttcgcaa

SEQ ID NO: 4360 - DNA, 50 bp, Homo sapiens
actcctgacagctcatcctgcaaaattaaaatccaaaatttaagtcgcaa

SEQ ID NO: 4361 - DNA, 50 bp, Homo sapiens
gctggatctctgcctaaagtcacggtaggatgagaagtagaaacgagcaa

SEQ ID NO: 4362 - DNA, 50 bp, Homo sapiens
tcagaccataggtgggtgttgtttcttttaagtgtgtgtactgtgtccaa

SEQ ID NO: 4363 - DNA, 50 bp, Homo sapiens
tcatctatgtagcttaatctcatcgacgtttcggttcatttcctgcacaa

SEQ ID NO: 4364 - DNA, 50 bp, Homo sapiens
ttccttttccgctaatcaagagtccagggaggtgggaacagcctcaacaa

SEQ ID NO: 4365 - DNA, 50 bp, Homo sapiens
ccggcagctgtgtttagcccctccagatggaagtttcacttgaatgtaaa

SEQ ID NO: 4366 - DNA, 50 bp, Homo sapiens
acaaaggaatgaagctttatgacagggcacgtgaaatgtttatagtgaaa

SEQ ID NO: 4367 - DNA, 50 bp, Homo sapiens
actaaaggtcacaacccattaacaaccatgaaattggtgttgggaagaaa

SEQ ID NO: 4368 - DNA, 50 bp, Homo sapiens
tgctcaggaaaccaaaaaggatgtctgcatggaggacaaaaaggcacaaa

SEQ ID NO: 4369 - DNA, 50 bp, Homo sapiens
tgagaaccgcgcaccctacccatcggccacgtgaccagtcctttttaaaa

SEQ ID NO: 4370 - DNA, 50 bp, Homo sapiens
gtctttgggtcagtgtcatcattctcttcaagtctggggcttggggaaaa

SEQ ID NO: 4371 - DNA, 50 bp, Homo sapiens
ctccacacaggagaatctcggcgatttacacccacaggctacgcagaaaa

SEQ ID NO: 4372 - DNA, 50 bp, Homo sapiens
gcgctgctcccaaaatctatctgctgtttaatagtttttacctttcaaaa

SEQ ID NO: 4373 - DNA, 50 bp, Homo sapiens
gggttcagggggttttccctttgcccgtttggccctgggtttaataaaaa

SEQ ID NO: 4374 - DNA, 50 bp, Homo sapiens
ccaactcctcacagggcaggctagcgggcaccaggtcgccggggaagtgg

SEQ ID NO: 4375 - DNA, 50 bp, Homo sapiens
cggctgagagcccggtagggcccaggggccaagcgcaggcagaggccgcg

SEQ ID NO: 4376 - DNA, 50 bp, Homo sapiens
cttggggtccagggcacagcggtgccggggacacagcagttccgagggtc

SEQ ID NO: 4377 - DNA, 50 bp, Homo sapiens
agtatggtaattagaaagcatgttagaacatgtggaaaaagggggaaaaa

SEQ ID NO: 4378 - DNA, 50 bp, Homo sapiens
catcagtcctcatcagctgaagtggcttcccaaggatttaaataaatagt

SEQ ID NO: 4379 - DNA, 50 bp, Homo sapiens
agacattgactacagggtaatttctatgattatattatttagaagtatga

SEQ ID NO: 4380 - DNA, 50 bp, Homo sapiens
ccagtgaactgttagcaacaatgcagaagaatctgcatgtaataaactga

SEQ ID NO: 4381 - DNA, 50 bp, Homo sapiens
acttaaatgccttttaatttttgtcgatgtaatagtttaataccagtaaa

SEQ ID NO: 4382 - DNA, 50 bp, Homo sapiens
tttttaattctagcttctttttaaagattatttgggtacctaataaagga

SEQ ID NO: 4383 - DNA, 50 bp, Homo sapiens
caaagcctccacaggagaccccacccagcagcccagcccctacccaggag

SEQ ID NO: 4384 - DNA, 50 bp, Homo sapiens
cgagtgacattggctgacatcacagttgtctgaacctgttgtggctctat

SEQ ID NO: 4385 - DNA, 50 bp, Homo sapiens
tgaattgcttcaaaacctcttccatctcagaagaccagaccctgggaact

SEQ ID NO: 4386 - DNA, 50 bp, Homo sapiens
gctgaagtggcaatagagagagtctgctagaaagacggaagtcaccatct

SEQ ID NO: 4387 - DNA, 50 bp, Homo sapiens
tctactgactatcctagaaatcgctgtcgccttaatccaagcctacgttt

SEQ ID NO: 4388 - DNA, 50 bp, Homo sapiens
gtgtgtgcttagccaaatacagtaactgtgactggcccagggatgttctc

SEQ ID NO: 4389 - DNA, 50 bp, Homo sapiens
gtgagtccaatgtatgctttagaagtaaagacattgaccgtcacagacca

SEQ ID NO: 4390 - DNA, 50 bp, Homo sapiens
ctcaagaaaagacagaagagacagtgatttgggatgagtctactctagga

SEQ ID NO: 4391 - DNA, 50 bp, Homo sapiens
accctatgcccattgtcctgatctgaaaattcttggaaattgttccatgt

SEQ ID NO: 4392 - DNA, 50 bp, Homo sapiens
ttcacagtcttctattgttggaccacttacattgtaccaaatgttttcct

SEQ ID NO: 4393 - DNA, 50 bp, Homo sapiens
attaagcccccgtagcccatcccgcaagttagatacagctatggttaagg

SEQ ID NO: 4394 - DNA, 50 bp, Homo sapiens
ttatattgtagtggtggtatttgctttccgcctgttggctacttcgaccc

SEQ ID NO: 4395 - DNA, 50 bp, Homo sapiens
ttgttctctgtcatgcccacaatccctttctaaggaagactgccctacta

SEQ ID NO: 4396 - DNA, 50 bp, Homo sapiens
actgaggacgaggctgactactactgtcagtcttatgatagcacctatca

SEQ ID NO: 4397 - DNA, 50 bp, Homo sapiens
agatggaggatgaagctgactactactgttactcaacagacagcagtggt

SEQ ID NO: 4398 - DNA, 50 bp, Homo sapiens
catgtcaatgtgtctgttgtcatggcggaggtggacggcacctgctactg

SEQ ID NO: 4399 - DNA, 50 bp, Homo sapiens
gtcaatgtgtctgttgtcatggcggaggtggacggcacctgctactgagc

SEQ ID NO: 4400 - DNA, 50 bp, Homo sapiens
tccaacctccagtttgaggatgaggctgattattactgtgagacctggga

SEQ ID NO: 4401 - DNA, 50 bp, Homo sapiens
gactacaactggcaatcccaactcctgggctagggctttttctacctttt

SEQ ID NO: 4402 - DNA, 50 bp, Homo sapiens
tatttctgtgcgagagttccccctaaacatggcggaggcttcttctacaa

SEQ ID NO: 4403 - DNA, 50 bp, Homo sapiens
tggctaggagaccttgggcagtacctacagtcttgctgtttctgtttcat

SEQ ID NO: 4404 - DNA, 50 bp, Homo sapiens
gtgagctgaacaaatacatcatttaaatctatgctgcactttgagttgct

SEQ ID NO: 4405 - DNA, 50 bp, Homo sapiens
cccgtgtgtttacagcatttccaggtccagagaggttggcagacaagtgc

SEQ ID NO: 4406 - DNA, 50 bp, Homo sapiens
agctgtgggatataagtagtggtcattatgtcttcggaggtggcaccact

SEQ ID NO: 4407 - DNA, 50 bp, Homo sapiens
gccctttgagaaagactttgttcctgaactgctcccttctcttttagggt

SEQ ID NO: 4408 - DNA, 50 bp, Homo sapiens
ggtctggttctagatcagccttttcagtctgccctggcctggtcattaat

SEQ ID NO: 4409 - DNA, 50 bp, Homo sapiens
gaaaaacctggctagagcagagcacaggatgtaaaagggtgggggagaac

SEQ ID NO: 4410 - DNA, 50 bp, Homo sapiens
ggttatctgagcataacagggacagggtgggccacaggatacctctgagg

SEQ ID NO: 4411 - DNA, 50 bp, Homo sapiens
acaagcaggagcacatcgctcttttatgaaagcccttcaacatttaacgt

SEQ ID NO: 4412 - DNA, 50 bp, Homo sapiens
cagggacaccacttatcctgcttccactatagcatgaatcagtgctctct

SEQ ID NO: 4413 - DNA, 50 bp, Homo sapiens
catcgcacacgaatttgaatcatctgctctttggaatcgcctacaccctg

SEQ ID NO: 4414 - DNA, 50 bp, Homo sapiens
tgtatgtaggtgtctgagcttcacaagccttttatagtccattcagcact

SEQ ID NO: 4415 - DNA, 50 bp, Homo sapiens
cgacgacaacggtgtatattattgtgcgaaagatcgggcagatttgactt

SEQ ID NO: 4416 - DNA, 50 bp, Homo sapiens
cggtgagactcagtgaaagccatcagcaaaactacagtaatgcggcacta

SEQ ID NO: 4417 - DNA, 50 bp, Homo sapiens
aagttaaacaagactctgaaagccctaaatcaactagtccgtcggctgca

SEQ ID NO: 4418 - DNA, 50 bp, Homo sapiens
cttgagtggtcctcttctgcctgctgctcatttgtcttgggcaaccattt

SEQ ID NO: 4419 - DNA, 50 bp, Homo sapiens
cccaggaatatacagtacttctgtagtgtccagccattacttagcaaggg

SEQ ID NO: 4420 - DNA, 50 bp, Homo sapiens
tgctctgtctgctggtttgcattgtttctgtctgagttaagagactggca

SEQ ID NO: 4421 - DNA, 50 bp, Homo sapiens
ttcttttctccgttagccacgcagctacctactcccgcttccggttcaaa

SEQ ID NO: 4422 - DNA, 50 bp, Homo sapiens; identical to SEQ ID NO: 846

SEQ ID NO: 4423 - DNA, 50 bp, Homo sapiens
gatgaacagtctgagaggcgaggacacggccttgtttaactgtgcgagtc

SEQ ID NO: 4424 - DNA, 50 bp, Homo sapiens
tactacttgccaggtccaagaacggggcgggtcctgttatcattattaca

SEQ ID NO: 4425 - DNA, 50 bp, Homo sapiens
gctgtgtttttctgtgggtgaaataaaggtttcggagcccgttttagata

SEQ ID NO: 4426 - DNA, 50 bp, Homo sapiens
catttctgtgcgagagtgaagaggggaccctagaggatttcgttgtggga

SEQ ID NO: 4427 - DNA, 50 bp, Homo sapiens
ggactccaggctgaggacgaggctgattattagtgatgctcataaacaag

SEQ ID NO: 4428 - DNA, 50 bp, Homo sapiens
ctcttattgtgcgagagacctcccggaactgccactgaaggtggaggcta

SEQ ID NO: 4429 - DNA, 50 bp, Homo sapiens
ctccctgactatctcgggcctctagcctgaggacgaggctgattattatt

SEQ ID NO: 4430 - DNA, 50 bp, Homo sapiens
aagaactcactgtatctgcaaatgaacagcctgaaaaccgaggacacggc

SEQ ID NO: 4431 - DNA, 50 bp, Homo sapiens
cacggctgtgtttaactctgcgacatgcgggggactatggttcgggggaa

SEQ ID NO: 4432 - DNA, 50 bp, Homo sapiens
tcagggtgattgaaggacacatattgaagtacctagaatgccagaaagtg

SEQ ID NO: 4433 - DNA, 50 bp, Homo sapiens
aacaaaactgtgatttatatcaaataacaatggcttggagggggtatgga

SEQ ID NO: 4434 - DNA, 50 bp, Homo sapiens; identical to SEQ ID NO: 1036

SEQ ID NO: 4435 - DNA, 50 bp, Homo sapiens; identical to SEQ ID NO: 1036

SEQ ID NO: 4436 - DNA, 50 bp, Homo sapiens; identical to SEQ ID NO: 1036

SEQ ID NO: 4437 - DNA, 50 bp, Homo sapiens
tgtggctgtacttaaccttctccaacatacatcctgcattacatgaatgg

SEQ ID NO: 4438 - DNA, 50 bp, Homo sapiens
aagcctttgaagtgcctctgattctatgtaacttgttgcagactggtgtt

SEQ ID NO: 4439 - DNA, 50 bp, Homo sapiens
gcattgacctggaaggagagaagatagagagtggaggctctgaaggagac

SEQ ID NO: 4440 - DNA, 50 bp, Homo sapiens
cagtacagggctggcaagcagtgatctctcaggtatatttatcaataatt

SEQ ID NO: 4441 - DNA, 50 bp, Homo sapiens
caaaccctcctttctgcttgcctcaaacctgccaaatatacccacacttt

SEQ ID NO: 4442 - DNA, 50 bp, Homo sapiens; identical to SEQ ID NO: 562

SEQ ID NO: 4443 - DNA, 50 bp, Homo sapiens
agtgatttgattaactcagggcaaggctgaatatcagagtgtatcgcact

SEQ ID NO: 4444 - DNA, 50 bp, Homo sapiens
gcttccactggaggcttgtattgaccttgtaactatatgttaatctcgtg

SEQ ID NO: 4445 - DNA, 50 bp, Homo sapiens
atgcatgtttaccaaaatggctgtttacagtgcattcagttctgatattt

SEQ ID NO: 4446 - DNA, 50 bp, Homo sapiens
acatgacaggtgtaattagtctgctgagccagctttacccaatgaagggc

SEQ ID NO: 4447 - DNA, 50 bp, Homo sapiens
aacagcaaccaataacggattgtaaagtgtaaaggcacaggttactcatg

SEQ ID NO: 4448 - DNA, 50 bp, Homo sapiens
ccatgccaaggaatggaatttccatcctgagccagttcagttaggtgtca

SEQ ID NO: 4449 - DNA, 50 bp, Homo sapiens
ctagagttcatctctgagctgtaagggtgaccagggggcagggggacgat

SEQ ID NO: 4450 - DNA, 50 bp, Homo sapiens
caagtagacaccagagtcactgtttggttggtgggtgatagtggggtcac

SEQ ID NO: 4451 - DNA, 50 bp, Homo sapiens
tgtcacccttccatgacgcctcctctgtgcatttgagttcactgtttatg

SEQ ID NO: 4452 - DNA, 50 bp, Homo sapiens
ggtaacatgagctatggcagtcggttgtgaaaccacaggaagtgtatggg

SEQ ID NO: 4453 - DNA, 50 bp, Homo sapiens
caaatcgggcaccacctccttcagggcgcatgagaccatattaaattcta

SEQ ID NO: 4454 - DNA, 50 bp, Homo sapiens
cagaactgctttcctatgtttacccaggggacctcctttcagatgaactg

SEQ ID NO: 4455 - DNA, 50 bp, Homo sapiens
agcaataatatctctgttttcatttcagaacattgtgctgtctgtcagca

SEQ ID NO: 4456 - DNA, 50 bp, Homo sapiens
ttacaactacatgatgggcatcgagtttaacccttggatcgggaagtggg

SEQ ID NO: 4457 - DNA, 50 bp, Homo sapiens
aatgtttgagctgaccaagcttctgagattcttaacagaaaaagccatgt

SEQ ID NO: 4458 - DNA, 50 bp, Homo sapiens
acgtcagcttaaaactggaaagaagtcttctggtgtatactgagatttga

SEQ ID NO: 4459 - DNA, 50 bp, Homo sapiens
gcccaaaggagtagctctctgttgttactgttgtgctcttcatggataaa

SEQ ID NO: 4460 - DNA, 50 bp, Homo sapiens
gcaaaaagcccaagagcctgaatttagaccaatctatcatcttcctcctc

SEQ ID NO: 4461 - DNA, 50 bp, Homo sapiens
tggagatgtgataacaactccttatctctttgttggctcatctgaagtgt

SEQ ID NO: 4462 - DNA, 50 bp, Homo sapiens
cttgcagtaaaatgtagcccttcctcctggttgtgcaggagtggccctcg

SEQ ID NO: 4463 - DNA, 50 bp, Homo sapiens
tttctttagcccaagagtggaggctaagctacttacttccaagcctgggt

SEQ ID NO: 4464 - DNA, 50 bp, Homo sapiens
aggcaaagggaacttgaaattagaaaaccccagaaacagtcacaatggct

SEQ ID NO: 4465 - DNA, 50 bp, Homo sapiens
agggtcccttccatagtcctcctgcatcattttcctccaacttgaataaa

SEQ ID NO: 4466 - DNA, 50 bp, Homo sapiens
gccaaccagttcagagtgttcccaaggaattgccacccttactcttcaaa

SEQ ID NO: 4467 - DNA, 50 bp, Homo sapiens
atcccagtctcaaatttcttcatttggaactgatatgtaggccctcatcg

SEQ ID NO: 4468 - DNA, 50 bp, Homo sapiens
tctctcactgttatcatttttgcacaggtggtttcagcagcttgatgcca

SEQ ID NO: 4469 - DNA, 50 bp, Homo sapiens
attgtcatttagactttgaacagctctgggaaatagaagactagggttgt

SEQ ID NO: 4470 - DNA, 50 bp, Homo sapiens; identical to SEQ ID NO: 293

SEQ ID NO: 4471 - DNA, 50 bp, Homo sapiens
ggattcaccgtggccgactcttttccctgctttggtttgtttgaaatcta

SEQ ID NO: 4472 - DNA, 50 bp, Homo sapiens
ccctccacaccatcctccccgatttaaatatagtcactgctacaagtaac

SEQ ID NO: 4473 - DNA, 50 bp, Homo sapiens
ttcatcattgcttgcttgccttcctcccttctgtccgctcttactccctc

SEQ ID NO: 4474 - DNA, 50 bp, Homo sapiens
gcaaactaaccgtgtcaacggggtgagatgttgcatcttataaaattaga

SEQ ID NO: 4475 - DNA, 50 bp, Homo sapiens; identical to SEQ ID NO: 4474

SEQ ID NO: 4476 - DNA, 50 bp, Homo sapiens; identical to SEQ ID NO: 4474

SEQ ID NO: 4477 - DNA, 50 bp, Homo sapiens
agtatctgctttccaggctgaagtgattcattcattattctagtcctgct

SEQ ID NO: 4478 - DNA, 50 bp, Homo sapiens
aagctgtcttctttgttggacaatcagccagaatgataagcaaacctgca

SEQ ID NO: 4479 - DNA, 50 bp, Homo sapiens
ctctcgcggtcgcacgaggatgcttggcacgtaccccctgtacatacttc

SEQ ID NO: 4480 - DNA, 50 bp, Homo sapiens; identical to SEQ ID NO: 4479

SEQ ID NO: 4481 - DNA, 50 bp, Homo sapiens; identical to SEQ ID NO: 4479

SEQ ID NO: 4482 - DNA, 50 bp, Homo sapiens
ctcctgtggattcacatcaaataccagttcagttttgtcattgttctagt

SEQ ID NO: 4483 - DNA, 50 bp, Homo sapiens
ggctcctgattacgatgctttggatgttgccaacaaaattgggatcatct

SEQ ID NO: 4484 - DNA, 50 bp, Homo sapiens
aacgccagcattttgttagaggagttagacttggaaaagttaagggaaga

SEQ ID NO: 4485 - DNA, 50 bp, Homo sapiens
atggggactaagggattaagagtgtgaactaaaaggtaacattttccact

SEQ ID NO: 4486 - DNA, 50 bp, Homo sapiens
actggcgagtatgttctatgttgggcctcctgctgcaaaacaataaacag

SEQ ID NO: 4487 - DNA, 50 bp, Homo sapiens
gctgattaactgtattcccctttcccctatggctgctggtgtaaataaac

SEQ ID NO: 4488 - DNA, 50 bp, Homo sapiens
cccagggtttcatgtctgaggccctcaccaagtgtgagtgacagtataaa

SEQ ID NO: 4489 - DNA, 50 bp, Homo sapiens; identical to SEQ ID NO: 4488

SEQ ID NO: 4490 - DNA, 50 bp, Homo sapiens; identical to SEQ ID NO: 4063

SEQ ID NO: 4491 - DNA, 50 bp, Homo sapiens
acacctctctattttgaagtccctatgtgccctgtaatgtctcgttttaa

SEQ ID NO: 4492 - DNA, 50 bp, Homo sapiens
gggagagctcatgtcagtgaatatagatcattctgttgatacccttcttt

SEQ ID NO: 4493 - DNA, 50 bp, Homo sapiens
ttgaaacttgtaactgagatgctgtagttttttgccatctgtagtgatgt

SEQ ID NO: 4494 - DNA, 50 bp, Homo sapiens
aaagggttttatccactgtcatttcaattggataacattttgtcaagttt

SEQ ID NO: 4495 - DNA, 50 bp, Homo sapiens
tcggaaagaagaagtgggaggatgtgaattttagttctgagtttaccaaa

SEQ ID NO: 4496 - DNA, 50 bp, Homo sapiens
gatcgggaactggctccgttgtgctgaggtcatctttggtcatcagcctc

SEQ ID NO: 4497 - DNA, 50 bp, Homo sapiens
tggtgcttgtgcagcctggcagttcattgtcatctttaataaactaagga

SEQ ID NO: 4498 - DNA, 50 bp, Homo sapiens
agaagtacaagatttcgttcttccttccattaaagtacaatctccctggg

SEQ ID NO: 4499 - DNA, 50 bp, Homo sapiens
tacaagtgaaagctaagatgaacacatttaagttaaatggcagccttgtt

SEQ ID NO: 4500 - DNA, 50 bp, Homo sapiens
aaaaggatgtgacagaagcagagatgaccagaaagcacaggggcagggtt

SEQ ID NO: 4501 - DNA, 50 bp, Homo sapiens
gggttttctataaggggtttcctgctgaacaggggcgtgggattgaatta

SEQ ID NO: 4502 - DNA, 50 bp, Homo sapiens
cctgggaccagggcatattaaaggcttttggcagcaaagtgtcagtgttg

SEQ ID NO: 4503 - DNA, 50 bp, Homo sapiens
tttgtggcttggggctgcctactataaactattgggggttcgtccatttt

SEQ ID NO: 4504 - DNA, 50 bp, Homo sapiens; identical to SEQ ID NO: 746

SEQ ID NO: 4505 - DNA, 50 bp, Homo sapiens
aattcctgaaccgttggatcaccttctgtcagtccatcatctccaccctg

SEQ ID NO: 4506 - DNA, 50 bp, Homo sapiens
cttacgttgggacacctaaattcgccgcgtctgtagaaggcagattcgag

SEQ ID NO: 4507 - DNA, 50 bp, Homo sapiens
aaaaccgtgtctgtcccttcaacagagtcatcgaggaggggtggctgcta

SEQ ID NO: 4508 - DNA, 50 bp, Homo sapiens
aaactgccgggtccccatcttcaaaagagaggaggccctttctccagctt

SEQ ID NO: 4509 - DNA, 50 bp, Homo sapiens
caagaaagcaacttgagccttgggctaatctggctgagtagtcagttata

SEQ ID NO: 4510 - DNA, 50 bp, Homo sapiens
tgtgttctttgagttccccctttacccaaaagtaatttggggaccaaagt

SEQ ID NO: 4511 - DNA, 50 bp, Homo sapiens
gggaaggcaatctgatggggaagttggcaatttctggtttgggtgattta

SEQ ID NO: 4512 - DNA, 50 bp, Homo sapiens
ccagccgtcctcctggggtggaccctagtttaataaagattcaccaagtt

SEQ ID NO: 4513 - DNA, 50 bp, Homo sapiens
catgcaagggcaaaaggcagtgccatgcaagctgtttaaaataaagatgt

SEQ ID NO: 4514 - DNA, 50 bp, Homo sapiens
aggggtgggaggaagcaaaagactctgtacctattttgtatgtgtataat

SEQ ID NO: 4515 - DNA, 50 bp, Homo sapiens
tcaggatgtgagcactcgttgtgtctggatgttacaaatatgggtggttt

SEQ ID NO: 4516 - DNA, 50 bp, Homo sapiens
tgttcacgttgttcacatcccatgtagaaaaacaaagatgccacggagga

SEQ ID NO: 4517 - DNA, 50 bp, Homo sapiens
agccctgcaaaaattcagagtccttgcaaaattgtctaaaatgtcagtgt

SEQ ID NO: 4518 - DNA, 50 bp, Homo sapiens
tgtcatctcaagtcaagtcactggtctgtttgcatttgatacatttttgt

SEQ ID NO: 4519 - DNA, 50 bp, Homo sapiens
gagtgaccacagggatgccacacagctcggatttcagcctctgatgtcag

SEQ ID NO: 4520 - DNA, 50 bp, Homo sapiens
gcctgttgccctttctgtaccatttatttgctcccaatgtttatgataat

SEQ ID NO: 4521 - DNA, 50 bp, Homo sapiens; identical to SEQ ID NO: 4520

SEQ ID NO: 4522 - DNA, 50 bp, Homo sapiens
tcctggatgcctctgaagagagggacagaccgtcagaaactggagagttt

SEQ ID NO: 4523 - DNA, 50 bp, Homo sapiens
acttaaccatataaatgtggaggctatcaacaaagaatgggcttgaaaca

SEQ ID NO: 4524 - DNA, 50 bp, Homo sapiens; identical to SEQ ID NO: 1933

SEQ ID NO: 4525 - DNA, 50 bp, Homo sapiens
aaacagacctaatgctccttgttcctagagtagagtggagggagggtggc

SEQ ID NO: 4526 - DNA, 50 bp, Homo sapiens
gagatagccttgctccggcccccttgaccttcagcaaatcacttctctcc

SEQ ID NO: 4527 - DNA, 50 bp, Homo sapiens
ctgctgcgtctcccttccaaactctggtgctgaataaacccttctgatct

SEQ ID NO: 4528 - DNA, 50 bp, Homo sapiens
cacttggctgcataaatgtggtacaaccattctgtcttgaagggcaggtg

SEQ ID NO: 4529 - DNA, 50 bp, Homo sapiens
cagccaatggacacagtagggcttggtgaatgctgctgagtgaatgagta

SEQ ID NO: 4530 - DNA, 50 bp, Homo sapiens
tgcagaggattgaggcttaattctgagctggccctttccagccaataaat

SEQ ID NO: 4531 - DNA, 50 bp, Homo sapiens
ttgaccttccactagaccatgagcacctgggcggaaagccatatatctta

SEQ ID NO: 4532 - DNA, 50 bp, Homo sapiens
acaagcagacacctgaaacaatcaacgcccaataaaacaaagtaggatga

SEQ ID NO: 4533 - DNA, 50 bp, Homo sapiens
tgaggaagaaagcattttgcatcagcctggagtgaaccatgaacttggat

SEQ ID NO: 4534 - DNA, 50 bp, Homo sapiens
ggaataaggtgttgcctggaatttctggtttgtaaggtggtcactgttct

SEQ ID NO: 4535 - DNA, 50 bp, Homo sapiens
tgaacagatggattaccttttgtcaaagcatcatctcaacactaacttga

SEQ ID NO: 4536 - DNA, 50 bp, Homo sapiens
cccagagttttcagggagtacacaggtagattagtttgaagcattgacct

SEQ ID NO: 4537 - DNA, 50 bp, Homo sapiens; identical to SEQ ID NO: 280

SEQ ID NO: 4538 - DNA, 50 bp, Homo sapiens
ggctgccccagaggacagtgggtggagtggtacctacttattaaatgtct

SEQ ID NO: 4539 - DNA, 50 bp, Homo sapiens
ccgagcaaagatcaaaataaaaagtgacacagcagcttcaccagagcatt

SEQ ID NO: 4540 - DNA, 50 bp, Homo sapiens
tttccttcaagcctagcccttctctcattatttctctctgaccctctccc

SEQ ID NO: 4541 - DNA, 50 bp, Homo sapiens
gggtcagtgttcaagaaggaaagcagttgttgaagctacagaagcccagg

SEQ ID NO: 4542 - DNA, 50 bp, Homo sapiens
tgaagactttccatatcaagagacatggtattgactcaacagtttccagt

SEQ ID NO: 4543 - DNA, 50 bp, Homo sapiens
ggactgtcattcagggaggctaaggagagaggcttgcttgggatatagaa

SEQ ID NO: 4544 - DNA, 50 bp, Homo sapiens
tcacttaaccccaggccattatcatatccagatggtcttcagagttgtct

SEQ ID NO: 4545 - DNA, 50 bp, Homo sapiens
ccactggatggtcatttggcatctccgtatatgtgctctggctcctcagc

SEQ ID NO: 4546 - DNA, 50 bp, Homo sapiens
ctgggccacactgaccctgatacaggcatggcagaagaatgggaatattt

SEQ ID NO: 4547 - DNA, 50 bp, Homo sapiens; identical to SEQ ID NO: 4546

SEQ ID NO: 4548 - DNA, 50 bp, Homo sapiens
tgatagcattggtcttgacaagcaccatagtgacactgaaatggattggt

SEQ ID NO: 4549 - DNA, 50 bp, Homo sapiens
ctgaggatgtagagagaacaggtgggctgtattcacgccattggttggaa

SEQ ID NO: 4550 - DNA, 50 bp, Homo sapiens; identical to SEQ ID NO: 2058

SEQ ID NO: 4551 - DNA, 50 bp, Homo sapiens
tggtccaaaggcaaagttcgggacaagctcaataacttagtcttgtttga

SEQ ID NO: 4552 - DNA, 50 bp, Homo sapiens
caacaggtgtcacactaaggagactttgttcatggctggggacacagccc

SEQ ID NO: 4553 - DNA, 50 bp, Homo sapiens
gcatggaaattcccttcatctggaaccatcagaaacaccctcacactggg

SEQ ID NO: 4554 - DNA, 50 bp, Homo sapiens
ggcagctatggtcaaattgagaaaggtagtgtataaatgtgacaaagaca

SEQ ID NO: 4555 - DNA, 50 bp, Homo sapiens
gctatcttgtctggttttcttgagacctcagatgtgtgttcagcagggct

SEQ ID NO: 4556 - DNA, 50 bp, Homo sapiens
ccgccctgtaccctctttcacctttccctaaagaccctaaatctgaggaa

SEQ ID NO: 4557 - DNA, 50 bp, Homo sapiens
catatgggagaaggccagtgcccaggcatagggttagctcagtttccctc

SEQ ID NO: 4558 - DNA, 50 bp, Homo sapiens
ttaataccaggaacccagcggctctagccactgagcggctaaatgaaata

SEQ ID NO: 4559 - DNA, 50 bp, Homo sapiens
gtggaggggtttaccaccttcctaggtcgttcaaccaggttttgtgagga

SEQ ID NO: 4560 - DNA, 50 bp, Homo sapiens
gcaacccttcagaaaggctttgctcctgctctcagatcagatcaagcatt

SEQ ID NO: 4561 - DNA, 50 bp, Homo sapiens
aacatttggaggaaggtgggaagcagatgactgaggaagggatggactaa

SEQ ID NO: 4562 - DNA, 50 bp, Homo sapiens
tgcccagaaagctcagaaggctaaatgaatattatccctaatacctgcca

SEQ ID NO: 4563 - DNA, 50 bp, Homo sapiens
agaggactcttcgagacattgagaccttctacaacacctccattgaggaa

SEQ ID NO: 4564 - DNA, 50 bp, Homo sapiens; identical to SEQ ID NO: 2128

SEQ ID NO: 4565 - DNA, 50 bp, Homo sapiens
aaactaaaacttcatcttccccaagtgcggggagtacaaggcatggcgta

SEQ ID NO: 4566 - DNA, 50 bp, Homo sapiens
aaaaccttcccataaaatgtaagaaaagctgatgaggctggtgacgttca

SEQ ID NO: 4567 - DNA, 50 bp, Homo sapiens; identical to SEQ ID NO: 641

SEQ ID NO: 4568 - DNA, 50 bp, Homo sapiens
gccacaaaatgttctttgttctttggctccaaaaagactgtcagctttca

SEQ ID NO: 4569 - DNA, 50 bp, Homo sapiens
ctgaggctctccctttctctgtgattggacagttgacagcacccaaactc

SEQ ID NO: 4570 - DNA, 50 bp, Homo sapiens
ccctgtaactcctcactgtactgatttactggcgcatgaaattctattaa

SEQ ID NO: 4571 - DNA, 50 bp, Homo sapiens
cttgagtaaaataaatattgtctttttgtatgtcaagcgggccgccaccg

SEQ ID NO: 4572 - DNA, 50 bp, Homo sapiens
gggagggagggagggaaagcttcctcctaaatcaagcatctttctgttac

SEQ ID NO: 4573 - DNA, 50 bp, Homo sapiens
tcacagatgcatatagacacacatacataatggtactcccaaactgacaa

SEQ ID NO: 4574 - DNA, 50 bp, Homo sapiens
gctgaggactcccgccatgtggccccaggtgccaccaataaaaatcctac

SEQ ID NO: 4575 - DNA, 50 bp, Homo sapiens
caagatgaggatttgggttttctataaggggtttcctgctggacaggggc

SEQ ID NO: 4576 - DNA, 50 bp, Homo sapiens
aaacatggcctttgcttgaaagaaaataccaaggaacaggaaactgatca

SEQ ID NO: 4577 - DNA, 50 bp, Homo sapiens; identical to SEQ ID NO: 52

SEQ ID NO: 4578 - DNA, 50 bp, Homo sapiens
ggaccaaaggctgattcttggagatttaactccccacaggcaatgggttt

SEQ ID NO: 4579 - DNA, 50 bp, Homo sapiens
aatatttgtttaatccccagttcgcctggagccctccgccttcacattcc

SEQ ID NO: 4580 - DNA, 50 bp, Homo sapiens
aaagtaactggttgtcacctatgagacccttacgtgattgttagttaagt

SEQ ID NO: 4581 - DNA, 50 bp, Homo sapiens
ctcagcctcctcatctgggggagtggaatagtatcctccaggtttttcaa

SEQ ID NO: 4582 - DNA, 50 bp, Homo sapiens
ggcaggaggttctcactgttgtgaaggttgtagacgttgtgtaatgtgtt

SEQ ID NO: 4583 - DNA, 50 bp, Homo sapiens
aagtgggaattttctggaagatggtcagctatgaagtaatagagtttgct

SEQ ID NO: 4584 - DNA, 50 bp, Homo sapiens
gcctgtggcccacctggggtcacttggaaaggatctgaataaaggggacc

SEQ ID NO: 4585 - DNA, 50 bp, Homo sapiens
aaataactggctcccagggtggcggtggtggcagcagtgatcctctgaac

SEQ ID NO: 4586 - DNA, 50 bp, Homo sapiens
tgcccacacccacactctccagcatctggcacaataaacattctctgttt

SEQ ID NO: 4587 - DNA, 50 bp, Homo sapiens; identical to SEQ ID NO: 4586

SEQ ID NO: 4588 - DNA, 50 bp, Homo sapiens
gcacccacctttctgcacataagttatggttttccatcttatctgtcttc

SEQ ID NO: 4589 - DNA, 50 bp, Homo sapiens
aattgtcaaacacagcttgcaatatacatagaaacgtctgtgctcaagga

SEQ ID NO: 4590 - DNA, 50 bp, Homo sapiens
tccagaaacatgacaaggaggactttcctgcctcttggagatcagaggag

SEQ ID NO: 4591 - DNA, 50 bp, Homo sapiens
tcatagttaaatttggtattcgtgggggaagaaatgaccatttcccttgt

SEQ ID NO: 4592 - DNA, 50 bp, Homo sapiens
acacacattcttgctctacccaaagctctggctggcagcactaaatgctt

SEQ ID NO: 4593 - DNA, 50 bp, Homo sapiens; identical to SEQ ID NO: 4592

SEQ ID NO: 4594 - DNA, 50 bp, Homo sapiens
gcagtctccacagtcttcagaagacaaatgctcaggtagtcactgtttcc

SEQ ID NO: 4595 - DNA, 50 bp, Homo sapiens
gcctcccgtgcatctgtactcaccctgtacgacaaacacattacattatt

SEQ ID NO: 4596 - DNA, 50 bp, Homo sapiens
tttcctgttccagaaaaggggctgggatgtctccgtctctgtctcaaatt

SEQ ID NO: 4597 - DNA, 50 bp, Homo sapiens
cggccttctccggtgtcctgtaccaactcttctatttaagagaacctcag

SEQ ID NO: 4598 - DNA, 50 bp, Homo sapiens
gggacgttccatgcccaggttaacaaagaactgtgatatatagagtgtct

SEQ ID NO: 4599 - DNA, 50 bp, Homo sapiens
atgggagatgcctgtgtaatttcgtccgaagctgccaggaagaagaacag

SEQ ID NO: 4600 - DNA, 50 bp, Homo sapiens
cctctccattgaaggattcaggaagaagaaaactcaactcagtgccattt

SEQ ID NO: 4601 - DNA, 50 bp, Homo sapiens
cctcaccttggcaccagacacccaggacttatttaaactctgttgcaagt

SEQ ID NO: 4602 - DNA, 50 bp, Homo sapiens
tgcaaatgtgagtttcctctcctgtccgtgtttgtttagtacttttataa

SEQ ID NO: 4603 - DNA, 50 bp, Homo sapiens
agcaggaattggtggcagattttacaaaagatgtatccttccaatttgga

SEQ ID NO: 4604 - DNA, 50 bp, Homo sapiens
tggatctgccaaaaagaactaacacctgtgagaaataaagtgtatcctga

SEQ ID NO: 4605 - DNA, 50 bp, Homo sapiens
ttcctgtactattgtgttttgagtgtgttttggaaccttcatagaacaca

SEQ ID NO: 4606 - DNA, 50 bp, Homo sapiens
tgacccacttaccttgcatctcacaggtagacagtatataactaacaacc

SEQ ID NO: 4607 - DNA, 50 bp, Homo sapiens; identical to SEQ ID NO: 2312

SEQ ID NO: 4608 - DNA, 50 bp, Homo sapiens
cacgagagtgaagagtgagccagcccttctggagcaggagcaggacagaa

SEQ ID NO: 4609 - DNA, 50 bp, Homo sapiens
aagaaaggcacaaaatgtgctatttttggtcacttgctttatgacgttta

SEQ ID NO: 4610 - DNA, 50 bp, Homo sapiens
gtccctggacacagctcttcattccattgacttagaggcaacaggattga

SEQ ID NO: 4611 - DNA, 50 bp, Homo sapiens
gtaccagctctccaacacggaggcaatcgactgcatcacgcagggacgtg

SEQ ID NO: 4612 - DNA, 50 bp, Homo sapiens
gggggctagttctctcctcacttgtaaacttgtgtagtttcacagaaaaa

SEQ ID NO: 4613 - DNA, 50 bp, Homo sapiens
acagaagaatttgtgtggaagcaggatgtaacagatacaccgtaaaggca

SEQ ID NO: 4614 - DNA, 50 bp, Homo sapiens; identical to SEQ ID NO: 2339

SEQ ID NO: 4615 - DNA, 50 bp, Homo sapiens
cttgaaggaagagggaccagggtgggagagctgattgcagaaaggagaga

SEQ ID NO: 4616 - DNA, 50 bp, Homo sapiens
aaaccattaaagtatacagagaggatgacacagccacagaagaaactcat

SEQ ID NO: 4617 - DNA, 50 bp, Homo sapiens
aacatgcacaaagcagttaattaggcagcctggagaaaaccagagatcca

SEQ ID NO: 4618 - DNA, 50 bp, Homo sapiens
acttccagaaactcatcaaatgaacagacaatgtcaaaactactgtgtct

SEQ ID NO: 4619 - DNA, 50 bp, Homo sapiens
gctttatgggtttggcttgtttttcttgcatggtttggagctgatcgctt

SEQ ID NO: 4620 - DNA, 50 bp, Homo sapiens
ttctttcttggcctcaagttcaatatggagaggattgcttccctgaatcc

SEQ ID NO: 4621 - DNA, 50 bp, Homo sapiens
aactatgtggactggattaaggacaccatagctgccaacagctaaagccc

SEQ ID NO: 4622 - DNA, 50 bp, Homo sapiens
cctgacttcttcacgcgggtagccctctacgtggactggatccgttctac

SEQ ID NO: 4623 - DNA, 50 bp, Homo sapiens
agccagcaggacatgaagttgctattaaatggacttcgtgatttttgttt

SEQ ID NO: 4624 - DNA, 50 bp, Homo sapiens; identical to SEQ ID NO: 2383

SEQ ID NO: 4625 - DNA, 50 bp, Homo sapiens
aacttgtgccacaagagttacaatcaaagtggtctccttagactgaattc

SEQ ID NO: 4626 - DNA, 50 bp, Homo sapiens
aaagcctttaaaaacggctgtcaggtttgatctcagtgtaacaacatggc

SEQ ID NO: 4627 - DNA, 50 bp, Homo sapiens
gaaaatgcgccttaggctgagccaacatgactgtcccccaaactccagtg

SEQ ID NO: 4628 - DNA, 50 bp, Homo sapiens
ccagcttcggttccttccacctcatccggctgctctacgacgagtacatg

SEQ ID NO: 4629 - DNA, 50 bp, Homo sapiens
aagattggtgctcctgataaagcaaagggctaggaatacaatggaaagga

SEQ ID NO: 4630 - DNA, 50 bp, Homo sapiens
tcattggtacacattctgtatgctgctgttttcaagttggcaaattaagc

SEQ ID NO: 4631 - DNA, 50 bp, Homo sapiens
tatcagcaactgtcctcatcagtctccataccccttcagctttcctgagc

SEQ ID NO: 4632 - DNA, 50 bp, Homo sapiens
gcagcttggagaaggcgcaatactccagctccaccgttaccgctaatata

SEQ ID NO: 4633 - DNA, 50 bp, Homo sapiens; identical to SEQ ID NO: 4632

SEQ ID NO: 4634 - DNA, 50 bp, Homo sapiens
cggagcctcaaacaagcattataccttctgtgattatgatttcctctcct

SEQ ID NO: 4635 - DNA, 50 bp, Homo sapiens
atgtttcttggggaatatgttagagaattcccttactcttgattgtggga

SEQ ID NO: 4636 - DNA, 50 bp, Homo sapiens
agagtgatagtcttttgcttttggcaaaactctacttaatccaatgggtt

SEQ ID NO: 4637 - DNA, 50 bp, Homo sapiens
gcctcttgcttggcgtgataaccctgtcatcttcccaaagctcatttatg

SEQ ID NO: 4638 - DNA, 50 bp, Homo sapiens
ttcaactgaccagtcgtggttactccctgctgccaggtccttccccttcc

SEQ ID NO: 4639 - DNA, 50 bp, Homo sapiens
ggctggcacctctcaacgtctgtggactgaatgaataaaccctcctcatc

SEQ ID NO: 4640 - DNA, 50 bp, Homo sapiens
tgggaataacgtccaaaacactctggatcttatatggagaatgacattga

SEQ ID NO: 4641 - DNA, 50 bp, Homo sapiens
agtactgaactcagttccatccgtaaaatatgtaaaggtaagtggcagct

SEQ ID NO: 4642 - DNA, 50 bp, Homo sapiens
gcccaacttcatttccatacttcagggaacagcaaattgaggatttactt

SEQ ID NO: 4643 - DNA, 50 bp, Homo sapiens
ccgttgaatgagtgtgttttgtacataacttcagatacttgtgaacatgc

SEQ ID NO: 4644 - DNA, 50 bp, Homo sapiens
tttcttgggagagtcactccagccctgaagtctgtctctagctcctctgt

SEQ ID NO: 4645 - DNA, 50 bp, Homo sapiens; identical to SEQ ID NO: 2514

SEQ ID NO: 4646 - DNA, 50 bp, Homo sapiens
ttaggagtgattactaattatcaagggcacagttgtggtactgtcattga

SEQ ID NO: 4647 - DNA, 50 bp, Homo sapiens
cggacggaaggacggaaaaagctctatttttatgttaggcttatttcatg

SEQ ID NO: 4648 - DNA, 50 bp, Homo sapiens
agtccctgacagcctagaaataagctgtttgtcttctataaagcattgct

SEQ ID NO: 4649 - DNA, 50 bp, Homo sapiens
gcattttctgcctatgctggaatagctccctcttctggtcctggctcagg

SEQ ID NO: 4650 - DNA, 50 bp, Homo sapiens
agtaagggcacgtagagcatttagagttgtctttcagcattcaatcaggc

SEQ ID NO: 4651 - DNA, 50 bp, Homo sapiens
tgggtcttcagccttacccggaaatacttgtggtttctagatcaccatct

SEQ ID NO: 4652 - DNA, 50 bp, Homo sapiens
acaaggctgacaccaacagagatcgtattgatattgccaatgccagagca

SEQ ID NO: 4653 - DNA, 50 bp, Homo sapiens
agctacttctgccttatggctagggaactgtcatgtctaccatgtattgt

SEQ ID NO: 4654 - DNA, 50 bp, Homo sapiens
tgacttgttttgctccatgtctcctcattcctacacctattttctgctgc

SEQ ID NO: 4655 - DNA, 50 bp, Homo sapiens
ctgtgaaaccgtcagttcggaaggctggttagaacatgtgggagcaacat

SEQ ID NO: 4656 - DNA, 50 bp, Homo sapiens
gcctagtgtgtgtgctttcttaatgtgtgtgccaatggtggatctttgct

SEQ ID NO: 4657 - DNA, 50 bp, Homo sapiens
accaaactggactctcgtgcagaaaatgtagcccattaccacatgtagcc

SEQ ID NO: 4658 - DNA, 50 bp, Homo sapiens; identical to SEQ ID NO: 2585

SEQ ID NO: 4659 - DNA, 50 bp, Homo sapiens; identical to SEQ ID NO: 4482

SEQ ID NO: 4660 - DNA, 50 bp, Homo sapiens
gccaacagaacagaagaaaatgtttcagacggttccccaaatgccggttc

SEQ ID NO: 4661 - DNA, 50 bp, Homo sapiens
ctctagaaaggcccaagtccatgagcacagagggtctgatgaagtttgtg

SEQ ID NO: 4662 - DNA, 50 bp, Homo sapiens
agaccaagaggatattcctcaaagcagaaagtgaagaagaaatttttgcg

SEQ ID NO: 4663 - DNA, 50 bp, Homo sapiens
tggagaagttccagtcctgtctgagccctgaagagccagctcccgaatcc

SEQ ID NO: 4664 - DNA, 50 bp, Homo sapiens
gaagtagactttctgtcctcacaccgaagaacccgagtgagcaggaggga

SEQ ID NO: 4665 - DNA, 50 bp, Homo sapiens
gtgggatttctggggaggctggtgaaggagggcagggttcttttctctac

SEQ ID NO: 4666 - DNA, 50 bp, Homo sapiens
ctatagcttcatgaccgtaacatgtgacctgtgtgctggcaggacgactc

SEQ ID NO: 4667 - DNA, 50 bp, Homo sapiens
atgatccccatgttgcaatatggagtctctgccctgagatcttccccatc

SEQ ID NO: 4668 - DNA, 50 bp, Homo sapiens
tggtcagtctttgttctctgagaaattatgttggaagcagcatactttca

SEQ ID NO: 4669 - DNA, 50 bp, Homo sapiens
ccccaagatacacactggaccctctcttgctgaatgtgggcattaatttt

SEQ ID NO: 4670 - DNA, 50 bp, Homo sapiens
ttctaacacgtcgccttcaactgtaatcacaacatcctgactccgtcatt

SEQ ID NO: 4671 - DNA, 50 bp, Homo sapiens
tttttcattttggagctagttactgggagtaagggagggtggggtggggg

SEQ ID NO: 4672 - DNA, 50 bp, Homo sapiens
gggactgtcttttctgtattcgctgttcaataaacattgagtgagcacct

SEQ ID NO: 4673 - DNA, 50 bp, Homo sapiens; identical to SEQ ID NO: 4672

SEQ ID NO: 4674 - DNA, 50 bp, Homo sapiens
agagaagactcatcttcactatcggcacgtccaacaccacgggcgagtcg

SEQ ID NO: 4675 - DNA, 50 bp, Homo sapiens
aaaccgaaatattgaaatggtgtaatgttgtaccatttgcactgtgagca

SEQ ID NO: 4676 - DNA, 50 bp, Homo sapiens
aggtgggggaaaatgaattttgtatgctgaatttctaagcgcctattgtt

SEQ ID NO: 4677 - DNA, 50 bp, Homo sapiens
gtggatgtggagcaggagagctggatcgtggcatttgtttctgggttctg

SEQ ID NO: 4678 - DNA, 50 bp, Homo sapiens; identical to SEQ ID NO: 1767

SEQ ID NO: 4679 - DNA, 50 bp, Homo sapiens
tgtggttgcctctatgtgctgtttttcctcatacaagtaaacacagaaag

SEQ ID NO: 4680 - DNA, 50 bp, Homo sapiens
cccaactgaggaccactgtctacagagtcaggaaatattgtagggagaaa

SEQ ID NO: 4681 - DNA, 50 bp, Homo sapiens
tgtttgtttctttgtgttgactttgtccctggcaaaattttccactctga

SEQ ID NO: 4682 - DNA, 50 bp, Homo sapiens
aggtgacctggttacttagctaggattggtgatttgtactgctttatggt

SEQ ID NO: 4683 - DNA, 50 bp, Homo sapiens
ccctacccttgccctttaacttattgggactgaataaagaatggagaggc

SEQ ID NO: 4684 - DNA, 50 bp, Homo sapiens
gggcttttgctctggtgtattttattgtcagaaagtccagactcaagagt

SEQ ID NO: 4685 - DNA, 50 bp, Homo sapiens
tggtctgactgtgctatggcctcatcatcaagactttcaatcctatccca

SEQ ID NO: 4686 - DNA, 50 bp, Homo sapiens
gggcgaggcaggccgactgtactaaagtaacgcaataaacgcattatcag

SEQ ID NO: 4687 - DNA, 50 bp, Homo sapiens
gtacgccgctacctggacagcgcgatgcaggagaaagagttcaaatacac

SEQ ID NO: 4688 - DNA, 50 bp, Homo sapiens; identical to SEQ ID NO: 2679

SEQ ID NO: 4689 - DNA, 50 bp, Homo sapiens; identical to SEQ ID NO: 844

SEQ ID NO: 4690 - DNA, 50 bp, Homo sapiens
tgagcttgctcttacgttttaagaggtgccaggggtacatttttgcactg

SEQ ID NO: 4691 - DNA, 50 bp, Homo sapiens
actggacaactttgagtactgacatcattgataaataaactggcttgtgg

SEQ ID NO: 4692 - DNA, 50 bp, Homo sapiens
cgcagggtctacgaagaatagggtgaaaaacctcagaagggaaaactcca

SEQ ID NO: 4693 - DNA, 50 bp, Homo sapiens
aggttttgtctggttgcatataatctttgctctttttaagctctgtgagc

SEQ ID NO: 4694 - DNA, 50 bp, Homo sapiens
ccttgcagaccccaccccctgcctgctctctttccctacaactaggtcag

SEQ ID NO: 4695 - DNA, 50 bp, Homo sapiens; identical to SEQ ID NO: 2719

SEQ ID NO: 4696 - DNA, 50 bp, Homo sapiens
ggagttgcactctgggtgggaagcactcaaataaagatgcgtggtgttaa

SEQ ID NO: 4697 - DNA, 50 bp, Homo sapiens
agcttttgaaaagtggaaaggtcattttgttgcatttccccatttcttgt

SEQ ID NO: 4698 - DNA, 50 bp, Homo sapiens
acctccttattgaagggaagagggaccagcacatgaggctgaggctgagg

SEQ ID NO: 4699 - DNA, 50 bp, Homo sapiens
ggtatctcccacacagcctggcactccaaccgtaccctttatgagacctg

SEQ ID NO: 4700 - DNA, 50 bp, Homo sapiens
aaggatggtcacacaccagcactttatacacttctggctcacaggaaagt

SEQ ID NO: 4701 - DNA, 50 bp, Homo sapiens
atcatcctgccagcagcactcctcccgttcctccagcgtagactacattt

SEQ ID NO: 4702 - DNA, 50 bp, Homo sapiens
agtgctacactcgtctccactgtttgttttacttccccaaaatggacctt

SEQ ID NO: 4703 - DNA, 50 bp, Homo sapiens
acgctactattacgacaaaaacatcatccacaagacagcggggaaacgct

SEQ ID NO: 4704 - DNA, 50 bp, Homo sapiens
tttgagagggtaggagggtgggaaggaaacaaccatgtcatttcagaagt

SEQ ID NO: 4705 - DNA, 50 bp, Homo sapiens
catgctcagtatcattgtggagaaccaagagggcctcttaactgtaacaa

SEQ ID NO: 4706 - DNA, 50 bp, Homo sapiens
gaccggcttcccctgtgagcagcagagcagcacaataaatgaggccactg

SEQ ID NO: 4707 - DNA, 50 bp, Homo sapiens
gaagataccaacctgtgtgccatccacgctaagagagtcaccatcatgcc

SEQ ID NO: 4708 - DNA, 50 bp, Homo sapiens
gttatcactctgcctgtgtatagtcagatagtccatgcgaaggctgtata

SEQ ID NO: 4709 - DNA, 50 bp, Homo sapiens; identical to SEQ ID NO: 2764

SEQ ID NO: 4710 - DNA, 50 bp, Homo sapiens
taagccagcactcacaccactaacatgccctgttcagctactcccactcc

SEQ ID NO: 4711 - DNA, 50 bp, Homo sapiens
ggatgttttctagttgtgcatgaatgctggcaacttagtaagttttgaca

SEQ ID NO: 4712 - DNA, 50 bp, Homo sapiens
cccaaatagtaatgctttagagggaggcagtcatatctctgtgtgcagat

SEQ ID NO: 4713 - DNA, 50 bp, Homo sapiens; identical to SEQ ID NO: 2779

SEQ ID NO: 4714 - DNA, 50 bp, Homo sapiens
ccccttcctcacactgacctgtgttccttccctgttctcttttctattaa

SEQ ID NO: 4715 - DNA, 50 bp, Homo sapiens
aaactctaccaaggaggatgcactgggcctgcctgcggaacagggtatgt

SEQ ID NO: 4716 - DNA, 50 bp, Homo sapiens
cccttggcacgtaaacagactactagacttattgtaggttcgtttgagct

SEQ ID NO: 4717 - DNA, 50 bp, Homo sapiens
caaaggccagccagcttgggagcagcagagaaataaacagcatttctgat

SEQ ID NO: 4718 - DNA, 50 bp, Homo sapiens
gtgagatcggtgcgttctcctgatgttttgccgtggcttggggattgtac

SEQ ID NO: 4719 - DNA, 50 bp, Homo sapiens
gaactttcaggaagaagcatgttttattctggacacaatgaaagaaacca

SEQ ID NO: 4720 - DNA, 50 bp, Homo sapiens
ttgggtgtagatttctgacatcaaaacttggacccttggaaaacaaaagt

SEQ ID NO: 4721 - DNA, 50 bp, Homo sapiens
caacccagcttccctctgctgtgccacggctgttgcttcggttatttaaa

SEQ ID NO: 4722 - DNA, 50 bp, Homo sapiens; identical to SEQ ID NO: 2827

SEQ ID NO: 4723 - DNA, 50 bp, Homo sapiens
acatgagcttctacctccagatgtgccagggtgcatctcaataaacttgg

SEQ ID NO: 4724 - DNA, 50 bp, Homo sapiens
actgaaaagacaactggctacaaagaaggatgtcagaatgtaaggaaact

SEQ ID NO: 4725 - DNA, 50 bp, Homo sapiens
aagttgtggctgttcttgggaaaggggtcaccgtgtctgacaaagtgtaa

SEQ ID NO: 4726 - DNA, 50 bp, Homo sapiens
cccctcgccccgtcacaccgttatgcattactctgtgtctactattatgt

SEQ ID NO: 4727 - DNA, 50 bp, Homo sapiens
gctgtgagagcttgtttctgattgtttcattgttcgcttctgtaattctg

SEQ ID NO: 4728 - DNA, 50 bp, Homo sapiens; identical to SEQ ID NO: 2863

SEQ ID NO: 4729 - DNA, 50 bp, Homo sapiens
tgctcagtttttcagctcctctccactctgctttcccaaatggattctgt

SEQ ID NO: 4730 - DNA, 50 bp, Homo sapiens
atattcactaccaaaagaggcaagaaagtctgtacccatccaaggaaaaa

SEQ ID NO: 4731 - DNA, 50 bp, Homo sapiens
gctgcattacctctagaaacctcaaacaagtagaaacttgcctagacaat

SEQ ID NO: 4732 - DNA, 50 bp, Homo sapiens
tccaagtcgaaatcgctgctgaggctgagatgaagaaagaaaagtccaaa

SEQ ID NO: 4733 - DNA, 50 bp, Homo sapiens
catctcctcccagaacgtcacagtgctcagagacaaactggtcaagtgtg

SEQ ID NO: 4734 - DNA, 50 bp, Homo sapiens
tttgtctgcacttgagttcacttgagtttacatttgaaatgtgcatgttt

SEQ ID NO: 4735 - DNA, 50 bp, Homo sapiens
agttccctttatttcacataagcccaaactgatagacagtaacggtgttt

SEQ ID NO: 4736 - DNA, 50 bp, Homo sapiens
ggagagggtgggacccagttttgcgtggttggtttttattaattatctgg

SEQ ID NO: 4737 - DNA, 50 bp, Homo sapiens
cctctttccctctgtctgtgcttgtgttgttgacctcctgatggcttgtc

SEQ ID NO: 4738 - DNA, 50 bp, Homo sapiens
ctgattcttctgtcctcattgtgaacataaccgtgtagttgaaacagtca

SEQ ID NO: 4739 - DNA, 50 bp, Homo sapiens
tttccaatgtctgccacacaaacgtatgtaaatgtatatacccacacaca

SEQ ID NO: 4740 - DNA, 50 bp, Homo sapiens
tcctgagaaacaacacatttttccccatgaacggtgctgttctgaagtct

SEQ ID NO: 4741 - DNA, 50 bp, Homo sapiens
tattgccaccatccaactcattgagtcttatggttcacatcttgtttcct

SEQ ID NO: 4742 - DNA, 50 bp, Homo sapiens
agtcctatggttcacatcttgtttcctatagaaatgtcctgtattctggg

SEQ ID NO: 4743 - DNA, 50 bp, Homo sapiens
aaaccaggaagaaaaggtatttctttaaatccagaacaatggagccagct

SEQ ID NO: 4744 - DNA, 50 bp, Homo sapiens
aagcagttggactttcacagcagcaaggaattatcttcaagcacagagga

SEQ ID NO: 4745 - DNA, 50 bp, Homo sapiens
cttcagtgtagctctctcctcttcaaataaacatgtctgccctcatggtt

SEQ ID NO: 4746 - DNA, 50 bp, Homo sapiens
ttctctcgtgcaaccagtttgcccattctcttcctattacttgctccagg

SEQ ID NO: 4747 - DNA, 50 bp, Homo sapiens
tgctcttcagaagtttcaccctttttaatctctcagccacaaacctcagt

SEQ ID NO: 4748 - DNA, 50 bp, Homo sapiens
acgtttactggtactgctttctaaatactgttttacccgttttctcttgt

SEQ ID NO: 4749 - DNA, 50 bp, Homo sapiens
gacaaccaattcaaatgattgtgctaacttatttcccctagttgacctgt

SEQ ID NO: 4750 - DNA, 50 bp, Homo sapiens
ggccaagcccagcttaatggctcatgacctggaaataaaatttaggacca

SEQ ID NO: 4751 - DNA, 50 bp, Homo sapiens
ctcaagacagtgtttgacgaagcgatccgagcagtcctctgcccgcctcc

SEQ ID NO: 4752 - DNA, 50 bp, Homo sapiens
ctttttcaccaccgtcttcaatgcccatgagcctttccgccggggtacag

SEQ ID NO: 4753 - DNA, 50 bp, Homo sapiens
acatcgtatttgcggccagcctctacacccagtgaatgccccatgtaaaa

SEQ ID NO: 4754 - DNA, 50 bp, Homo sapiens
tattccttttatatcactgtgtttgaatcgagggggaggggtggtaaccg

SEQ ID NO: 4755 - DNA, 50 bp, Homo sapiens
atgggaatagttgcatatgggaatttaaaccaacatgtggctgagccttt

SEQ ID NO: 4756 - DNA, 50 bp, Homo sapiens
ggcctttgaatgtaaagctgcataagctgttaggttttgttttaaaagga

SEQ ID NO: 4757 - DNA, 50 bp, Homo sapiens
cagtttggccttatgctttatgcagacttgagtgtatgcaggatttcatt

SEQ ID NO: 4758 - DNA, 50 bp, Homo sapiens
cagaccaagagcaccacagactacaactgcccagcttcatctaaatactt

SEQ ID NO: 4759 - DNA, 50 bp, Homo sapiens
gtgggtaaggggctcaagctgtgatgctgctggttttatctctagtgaaa

SEQ ID NO: 4760 - DNA, 50 bp, Homo sapiens
accctcccaggttcctgctgagatatttctcacaatcagacaagagccag

SEQ ID NO: 4761 - DNA, 50 bp, Homo sapiens
gggcagagaaggtggagagtaaagacccaacattactaacaatgatacag

SEQ ID NO: 4762 - DNA, 50 bp, Homo sapiens; identical to SEQ ID NO: 3039

SEQ ID NO: 4763 - DNA, 50 bp, Homo sapiens
aacacatttgaggaataggaggtccgggttttccataatgggtaaaatgg

SEQ ID NO: 4764 - DNA, 50 bp, Homo sapiens
gctgttccacctcccttcagactatctttcagccttctgccagcagtaaa

SEQ ID NO: 4765 - DNA, 50 bp, Homo sapiens
actataagtcattttgagtgttggtgttaagcatgaaacaaacagcagct

SEQ ID NO: 4766 - DNA, 50 bp, Homo sapiens
gctattcacagttctggggaacaaccaaaggaggaggaggacaaagggaa

SEQ ID NO: 4767 - DNA, 50 bp, Homo sapiens; identical to SEQ ID NO: 1116

SEQ ID NO: 4768 - DNA, 50 bp, Homo sapiens
ctatccacagaagctggccttcgccgagtgcctgtgcagaggctgtatcg

SEQ ID NO: 4769 - DNA, 50 bp, Homo sapiens
gtcatatagtccatgtctgtgatgtgagccaagtgatatcctgtagtaca

SEQ ID NO: 4770 - DNA, 50 bp, Homo sapiens
tccactgggtgaatcctccctctcagaaccaataaaatagaattgacctt

SEQ ID NO: 4771 - DNA, 50 bp, Homo sapiens
gagtttctctatcgcattggtcaaccaaaagagacgcattccattgggcg

SEQ ID NO: 4772 - DNA, 50 bp, Homo sapiens; identical to SEQ ID NO: 183

SEQ ID NO: 4773 - DNA, 50 bp, Homo sapiens
tgcgaaattgtggactgttggactgtgattctaagtgggggaaataggct

SEQ ID NO: 4774 - DNA, 50 bp, Homo sapiens
gaacctttctgaaaccagtggcagcccaagttagagcccagcattaagtc

SEQ ID NO: 4775 - DNA, 50 bp, Homo sapiens
ccagaatcttctattcccacttcccatttctcaaatcatttgacctgtcg

SEQ ID NO: 4776 - DNA, 50 bp, Homo sapiens
cctcctggctgtggtggtctttattcacggctactatgcctgaactctat

SEQ ID NO: 4777 - DNA, 50 bp, Homo sapiens
gaaattaagcgatacgaatcccagcttcgggatcttgagcggcagtcaga

SEQ ID NO: 4778 - DNA, 50 bp, Homo sapiens
tcacagtgaccactacagagtactaagaagagaagatcaagggcatgaaa

SEQ ID NO: 4779 - DNA, 50 bp, Homo sapiens
tcttaaagccagaaataatggaggagattgtgatggaaacacgccagagg

SEQ ID NO: 4780 - DNA, 50 bp, Homo sapiens
cttttctttgtgcagcggtctggttatcgtctatccccaggggaatccac

SEQ ID NO: 4781 - DNA, 50 bp, Homo sapiens
ccacgttggggtcactactggagtggatggaggcccttcacatttctggg

SEQ ID NO: 4782 - DNA, 50 bp, Homo sapiens
tgacctttcgtgattatccgcaaatgcaaacagtttcagatctaatggtt

SEQ ID NO: 4783 - DNA, 50 bp, Homo sapiens
cagtcatggagaccatcgctgtgggctgcacctgcatcttctgaatcacc

SEQ ID NO: 4784 - DNA, 50 bp, Homo sapiens
aggtttcttcatgagtcattccaagttttctagtccataccacagtgcct

SEQ ID NO: 4785 - DNA, 50 bp, Homo sapiens
gaggtcgtcttaaaccagagagctactgaatataagaactcttgcagtct

SEQ ID NO: 4786 - DNA, 50 bp, Homo sapiens
gcagtctcccaaggacccaccatgcagaagtgtcaataaaccacaagttc

SEQ ID NO: 4787 - DNA, 50 bp, Homo sapiens
ggagggagcctctgtgcagatgtgctttctttacagtggctgtaaaaagt

SEQ ID NO: 4788 - DNA, 50 bp, Homo sapiens
gatgcttttaaagttgtagcttcgtgctttgtacagttttctttctggtt

SEQ ID NO: 4789 - DNA, 50 bp, Homo sapiens
aatatatgcaattctccctcccccagcccttccctgacccctaagttatt

SEQ ID NO: 4790 - DNA, 50 bp, Homo sapiens
aatctgccaggctatgtgacagtaggaaggaatggtttcccctaacaagc

SEQ ID NO: 4791 - DNA, 50 bp, Homo sapiens
agcacatacattgatagatggggtgtgggaccaacaaaccaaattaaaag

SEQ ID NO: 4792 - DNA, 50 bp, Homo sapiens; identical to SEQ ID NO: 3240

SEQ ID NO: 4793 - DNA, 50 bp, Homo sapiens
ttgtggaaactgtttcagcaaaggttcttgtatagagggaatagggaatt

SEQ ID NO: 4794 - DNA, 50 bp, Homo sapiens
gggggaaggaaggcttcagacttgggggaaggggagattattgcaaattg

SEQ ID NO: 4795 - DNA, 50 bp, Homo sapiens
ctatggaggaattgagggcaagcacccaggactgatgaggtcttaacaaa

SEQ ID NO: 4796 - DNA, 50 bp, Homo sapiens
acaccaaacagttaagtccattctctggtactagctacaaattcggtttc

SEQ ID NO: 4797 - DNA, 50 bp, Homo sapiens
tgcacacagggagagaacatgagtctctcttaatttttatctggttgcta

SEQ ID NO: 4798 - DNA, 50 bp, Homo sapiens
ttcaatggaaaatgaggggtttctccccactgatattttacatagagtca

SEQ ID NO: 4799 - DNA, 50 bp, Homo sapiens
gaccacattgccaataaaaggtccctgaattccaaattctggaagcacgt

SEQ ID NO: 4800 - DNA, 50 bp, Homo sapiens
aggcccaaatcacagaataaaggactaagagtggatttgctgacattcca

SEQ ID NO: 4801 - DNA, 50 bp, Homo sapiens
gctgtcctcaaagtatataatgtttcatgtaccaagacccttttcacagt

SEQ ID NO: 4802 - DNA, 50 bp, Homo sapiens
aagggtatttggtctggttcatatggtcaaatattactgccttggtagca

SEQ ID NO: 4803 - DNA, 50 bp, Homo sapiens
ggggtgccaggaaatgctctctgacctatcaataaaggaaaagcagtgat

SEQ ID NO: 4804 - DNA, 50 bp, Homo sapiens
tgggaagggaaatttggggattatttatcctcctggggacagtttgggga

SEQ ID NO: 4805 - DNA, 50 bp, Homo sapiens
gccacaaaagttccctctcactttcagtaaaaataaataaaacagcagca

SEQ ID NO: 4806 - DNA, 50 bp, Homo sapiens; identical to SEQ ID NO: 923

SEQ ID NO: 4807 - DNA, 50 bp, Homo sapiens
gatacccaggaatttcacaggaacagttctttgctgcctttatcctccaa

SEQ ID NO: 4808 - DNA, 50 bp, Homo sapiens
cccaccctgccgcccgcattataaacacaggagaataatcaatagaataa

SEQ ID NO: 4809 - DNA, 50 bp, Homo sapiens
aaaccaggcccttaaacttcagctagacaaccaatatgctgtgcttgaaa

SEQ ID NO: 4810 - DNA, 50 bp, Homo sapiens
ccagatccacagcaggcacatatctctccaagggatgaccagttttatgc

SEQ ID NO: 4811 - DNA, 50 bp, Homo sapiens
ggacttgaagaccaaagactttgaaatttgcgagctgctcatgtgtgagt

SEQ ID NO: 4812 - DNA, 50 bp, Homo sapiens
gaaacggcataaagatgagaaatgagcctatttgttagtgttcgtgctta

SEQ ID NO: 4813 - DNA, 50 bp, Homo sapiens
cctgccctcgcctggaatcagtgttactgcatctgattaaatgtctccag

SEQ ID NO: 4814 - DNA, 50 bp, Homo sapiens; identical to SEQ ID NO: 606

SEQ ID NO: 4815 - DNA, 50 bp, Homo sapiens
cagagttgacggacactgctcccaaaaggtcattactcagaataaatgta

SEQ ID NO: 4816 - DNA, 50 bp, Homo sapiens
gaacctcaggcagcagttgtgaaggctttgggggaactagacattcttct

SEQ ID NO: 4817 - DNA, 50 bp, Homo sapiens
ggactgagaagcaagatatcaatgtagcagaattgcacttgtgcctcacg

SEQ ID NO: 4818 - DNA, 50 bp, Homo sapiens
caatggttgcaccttatgaccttgagggaaagccagttcatttaagagga

SEQ ID NO: 4819 - DNA, 50 bp, Homo sapiens
gggggaggggaggggttcgtacaggagcaataaaggagaaactgaggtac

SEQ ID NO: 4820 - DNA, 50 bp, Homo sapiens; identical to SEQ ID NO: 4819

SEQ ID NO: 4821 - DNA, 50 bp, Homo sapiens
acttcttggaactttaactcctgccagcccttctaagacccacgagcggg

SEQ ID NO: 4822 - DNA, 50 bp, Homo sapiens
tgttccatcagcatcccctttttgggcgaggagaaaatcgcaactttttc

SEQ ID NO: 4823 - DNA, 50 bp, Homo sapiens
cagactattccccacctgcttcccagcttcacaataaacggctgcgtctc

SEQ ID NO: 4824 - DNA, 50 bp, Homo sapiens; identical to SEQ ID NO: 4823

SEQ ID NO: 4825 - DNA, 50 bp, Homo sapiens
gtctgtgggcctcatgggcattgtggtgggcactgtcttcatcatccaag

SEQ ID NO: 4826 - DNA, 50 bp, Homo sapiens
ctccaaacagagcaacaacaagtacgcggccagcagctacctgagcctga

SEQ ID NO: 4827 - DNA, 50 bp, Homo sapiens
ccaaagtcctcactcagaccagtgcccctccagttcagttgtctatgtat

SEQ ID NO: 4828 - DNA, 50 bp, Homo sapiens
tgtcttccaccctcaagaaactcttgaacaagaccaacaagaaggcagcg

SEQ ID NO: 4829 - DNA, 50 bp, Homo sapiens
gcaggaccagaccctccaggaaaggcaagagactcatgaccaggggacag

SEQ ID NO: 4830 - DNA, 50 bp, Homo sapiens; identical to SEQ ID NO: 3444

SEQ ID NO: 4831 - DNA, 50 bp, Homo sapiens
agcttggtgtataccttgcaggcactagtcctttacagatgacaatgctg

SEQ ID NO: 4832 - DNA, 50 bp, Homo sapiens
aggaagagccacctgcaagatggacacgagccacaagctgcactgtgaac

SEQ ID NO: 4833 - DNA, 50 bp, Homo sapiens
gggtgcagcatggctctaacaagagaagagatcacagaaacgtgaggatc

SEQ ID NO: 4834 - DNA, 50 bp, Homo sapiens
tacattctccctttagcaacctgagtaagagactctctgccactgggctg

SEQ ID NO: 4835 - DNA, 50 bp, Homo sapiens
aactcttggcctcagaggaaggaaaagcaactcaacactcatggtcaagt

SEQ ID NO: 4836 - DNA, 50 bp, Homo sapiens
agggaacaagggagcaagggaacaagggacatctgaacatctaatgtgag

SEQ ID NO: 4837 - DNA, 50 bp, Homo sapiens
gtggcccctggacgggtacaataacacactgtactgatgtcacaactttg

SEQ ID NO: 4838 - DNA, 50 bp, Homo sapiens
cccctaccctgccccaattcaatcctgccaataaatcctgtcttatttgt

SEQ ID NO: 4839 - DNA, 50 bp, Homo sapiens
acacggaagtgaagattcctgaggatctaacttgcagttggacactatgt

SEQ ID NO: 4840 - DNA, 50 bp, Homo sapiens
cggtccttttgccatacacagttacagagatcagtcaaatccataccacc

SEQ ID NO: 4841 - DNA, 50 bp, Homo sapiens
atacctgtgaggactggttgtctctcttcggtgcccttgagtctctgaat

SEQ ID NO: 4842 - DNA, 50 bp, Homo sapiens
tcatctacttcaggaatcagaaaggacactctggacttcagccaacaggt

SEQ ID NO: 4843 - DNA, 50 bp, Homo sapiens
tgcttcttgaaatggatttaacaacagccaggagcttcctgtcagtaacc

SEQ ID NO: 4844 - DNA, 50 bp, Homo sapiens
ccctccccactgctgctgagtctgtctgatgttttggttgtgtgaataaa

SEQ ID NO: 4845 - DNA, 50 bp, Homo sapiens
aggaggaactggggaaggtggtcattcaggggaagaaccaggatgcaggg

SEQ ID NO: 4846 - DNA, 50 bp, Homo sapiens
tgggaaagtgtgagttaatattggacacattttatcctgatccacagtgg

SEQ ID NO: 4847 - DNA, 50 bp, Homo sapiens
ttaaaaggagcacattaaaattctcagaggacttggcaagggccgcacag

SEQ ID NO: 4848 - DNA, 50 bp, Homo sapiens
gcacacgccatctgtgtaacttcaggatctgttctgtttcaccatgtaac

SEQ ID NO: 4849 - DNA, 50 bp, Homo sapiens; identical to SEQ ID NO: 3493

SEQ ID NO: 4850 - DNA, 50 bp, Homo sapiens
aagagaaatatatgccctagagctgctccagcacccttggtttctgattt

SEQ ID NO: 4851 - DNA, 50 bp, Homo sapiens
acagacagactcgatgcccacacagcttcactctttgagcaacatggaat

SEQ ID NO: 4852 - DNA, 50 bp, Homo sapiens
gcacggtgtgttgccacgatttgaccctcaacttctagcagtatatcagt

SEQ ID NO: 4853 - DNA, 50 bp, Homo sapiens
agtgtagttactagtcttttgacatggatgattctgaggaggaagctgtt

SEQ ID NO: 4854 - DNA, 50 bp, Homo sapiens
tcactgccatacaggttttccaatacacaagtgctagaaaatacacacaa

SEQ ID NO: 4855 - DNA, 50 bp, Homo sapiens
ttgcttgccctccatgtcttcctaaagagcagaacttggagtttctcctt

SEQ ID NO: 4856 - DNA, 50 bp, Homo sapiens
agaatgagcctgaatgttggtggtttttgaaatcctgacttggaggtaaa

SEQ ID NO: 4857 - DNA, 50 bp, Homo sapiens
cctcggccctgacaaacggggatcttttacctcactttgcactgattaat

SEQ ID NO: 4858 - DNA, 50 bp, Homo sapiens
tggcttggccttctctttggtgatcccacccccagccatttgcattgctg

SEQ ID NO: 4859 - DNA, 50 bp, Homo sapiens
aatgtttctcttcctgtgagacttactaaagcaacttagtggcaaaaagt

SEQ ID NO: 4860 - DNA, 50 bp, Homo sapiens
agtacttgagtagtctcaataggagtgtatttgtagacagcagtttccct

SEQ ID NO: 4861 - DNA, 50 bp, Homo sapiens
accctagatgagctgtcctgctccagtaacattctttttctaaaatcatt

SEQ ID NO: 4862 - DNA, 50 bp, Homo sapiens; identical to SEQ ID NO: 971

SEQ ID NO: 4863 - DNA, 50 bp, Homo sapiens
atttgagttcctgtgtgtccaaaactgaggcaccatgttctttgaaaaca

SEQ ID NO: 4864 - DNA, 50 bp, Homo sapiens; identical to SEQ ID NO: 4863

SEQ ID NO: 4865 - DNA, 50 bp, Homo sapiens; identical to SEQ ID NO: 4863

SEQ ID NO: 4866 - DNA, 50 bp, Homo sapiens
gtccacagcggaccctgctgatgcctccaccatctatgcagttgtagttt

SEQ ID NO: 4867 - DNA, 50 bp, Homo sapiens
caggctcccatatgtaccccatcccccatactcacctctttccattttga

SEQ ID NO: 4868 - DNA, 50 bp, Homo sapiens
gttgtattggcaagagggaggggtgagagctgttggagaactgagaatga

SEQ ID NO: 4869 - DNA, 50 bp, Homo sapiens
gtaccatcctcaccgtagtcatcatcatcgccgcgcagcaccacgagaac

SEQ ID NO: 4870 - DNA, 50 bp, Homo sapiens; identical to SEQ ID NO: 817

SEQ ID NO: 4871 - DNA, 50 bp, Homo sapiens
atcgctgaatatgttgatcagtgatgagttgggcttaatgcaaagatcct

SEQ ID NO: 4872 - DNA, 50 bp, Homo sapiens
aggctatttacttccatgcttctccttttcttactctatagtggcaacat

SEQ ID NO: 4873 - DNA, 50 bp, Homo sapiens
gggacccccacccagtgagtcaacataggctcatgtcaagtttgaaaata

SEQ ID NO: 4874 - DNA, 50 bp, Homo sapiens
tggtgtgatatgaaccagtccattcacattggaaaaactgatggttttaa

SEQ ID NO: 4875 - DNA, 50 bp, Homo sapiens
tttttatcagcgcctcaatctctactcgaagaagaaagagaagaaacgtt

SEQ ID NO: 4876 - DNA, 50 bp, Homo sapiens
cgctgtcgccttaatccaagcctacgttttcacacttctagtaagcctct

SEQ ID NO: 4877 - DNA, 50 bp, Homo sapiens
ctgtcgggctctgaagcgagctggtttagttgtagaagatgctctgtttg

SEQ ID NO: 4878 - DNA, 50 bp, Homo sapiens
agaagcagaatgcagaaggagaatgaatcctttggatactttcaaggaca

SEQ ID NO: 4879 - DNA, 50 bp, Homo sapiens
tctggcacagtccagctcacaacaacatcaagagcagaatttggagactt

SEQ ID NO: 4880 - DNA, 50 bp, Homo sapiens
gggacttgactttctttctggactgtttgtattgaaacaaagtggtgtca

SEQ ID NO: 4881 - DNA, 50 bp, Homo sapiens; identical to SEQ ID NO: 607

SEQ ID NO: 4882 - DNA, 50 bp, Homo sapiens
agactggtgatttggagtagtttacaagattcctcattcagagtgccctc

SEQ ID NO: 4883 - DNA, 50 bp, Homo sapiens
ttgcctcctccaatctgtgttctcaactgtggttgccacctcattaactt

SEQ ID NO: 4884 - DNA, 50 bp, Homo sapiens
tggaacataccacatgtagaaaggttgaactggtttttcagctataatgc

SEQ ID NO: 4885 - DNA, 50 bp, Homo sapiens
tcacttagcctttctggtttcccttcctgtgcattgcccattttctcatg

SEQ ID NO: 4886 - DNA, 50 bp, Homo sapiens
agccaagaggtatatcgatgatggaaattagccacatgtacactacattt

SEQ ID NO: 4887 - DNA, 50 bp, Homo sapiens
cttcaccgccctacttccacctccgcccagcctgtaatgtttatataagc

SEQ ID NO: 4888 - DNA, 50 bp, Homo sapiens
ctttcagagccagtttgtccaaggccagcatcccgtctgggagatgcacc

SEQ ID NO: 4889 - DNA, 50 bp, Homo sapiens
gccgtatattactgtgcgagagggccggagtggttactcggtatggacgt

SEQ ID NO: 4890 - DNA, 50 bp, Homo sapiens
aggcaaaagcgcctcacgcattcttgttccttgtttgcttcttcggtttt

SEQ ID NO: 4891 - DNA, 50 bp, Homo sapiens
ttagaaagaaaagtcttttattagtactgtgtagggaaggctaaagaaat

SEQ ID NO: 4892 - DNA, 50 bp, Homo sapiens
actgtgcgaaacgtactgtattacgatttttggagtggccgaagtagtcc

SEQ ID NO: 4893 - DNA, 50 bp, Homo sapiens
cagaccctggtgatgctggaaacagttcctcggagtggagaggtttacac

SEQ ID NO: 4894 - DNA, 50 bp, Homo sapiens
gtccagcaacagtgcccagggctctgatgagtctctcatcgcttgtaaag

SEQ ID NO: 4895 - DNA, 50 bp, Homo sapiens
gtgtattactgtgcgagagccttccgccatcccggagtacgtccaatatg

SEQ ID NO: 4896 - DNA, 50 bp, Homo sapiens
cccgtccctcaagagtcgagtcaccatatcagtagacaagtccaagaacc

SEQ ID NO: 4897 - DNA, 50 bp, Homo sapiens
ggctccaggctcaggatgaggctgattattactgctgctcatatacaagc

SEQ ID NO: 4898 - DNA, 50 bp, Homo sapiens
ccctcactgtcaccttcccgagaataccctaagaccaataaatacttcag

SEQ ID NO: 4899 - DNA, 50 bp, Homo sapiens
tgaatgacttctatctgggaatcttgacggtgacctggaaggcagatggt

SEQ ID NO: 4900 - DNA, 50 bp, Homo sapiens; identical to SEQ ID NO: 2269

SEQ ID NO: 4901 - DNA, 50 bp, Homo sapiens
agaacagagatgattacacctacgaagtctgagttatggtgtgagttgga

SEQ ID NO: 4902 - DNA, 50 bp, Homo sapiens
ttcatcattgcttgcttgccttcctccctcctgtccgctctcactcactc

SEQ ID NO: 4903 - DNA, 50 bp, Homo sapiens; identical to SEQ ID NO: 2215

SEQ ID NO: 4904 - DNA, 50 bp, Homo sapiens
tgaagaacgaccaaaattatttgaagaactagggaaacagatccaacagt

SEQ ID NO: 4905 - DNA, 50 bp, Homo sapiens
gtctacatacttcccaggcacccagcatggaaataaagcacccaccactg

SEQ ID NO: 4906 - DNA, 50 bp, Homo sapiens
atacttcccaggcacccagcatggaaataaagcacccaccactgccctgg

SEQ ID NO: 4907 - DNA, 50 bp, Homo sapiens
cccaaggcatcaagcccttctccctgcactcaataaaccctcaataaata

SEQ ID NO: 4908 - DNA, 50 bp, Homo sapiens
aaggcagagatcttgacacctaaggagtctagtttagggctttggttgga

SEQ ID NO: 4909 - DNA, 50 bp, Homo sapiens
gttgacattagaagcaggattctctggtactccctcagaaaatagaatgc

SEQ ID NO: 4910 - DNA, 50 bp, Homo sapiens
ttggagcgtttttgtgtttgagatattagctcaggtcaattccaaagagt

SEQ ID NO: 4911 - DNA, 50 bp, Homo sapiens; identical to SEQ ID NO: 389

SEQ ID NO: 4912 - DNA, 50 bp, Homo sapiens; identical to SEQ ID NO: 392

SEQ ID NO: 4913 - DNA, 50 bp, Homo sapiens; identical to SEQ ID NO: 394

SEQ ID NO: 4914 - DNA, 50 bp, Homo sapiens
tctgttaccacctctaaaatattggggtggaataaagctgggttcttgca

SEQ ID NO: 4915 - DNA, 50 bp, Homo sapiens; identical to SEQ ID NO: 402

SEQ ID NO: 4916 - DNA, 50 bp, Homo sapiens; identical to SEQ ID NO: 403

SEQ ID NO: 4917 - DNA, 50 bp, Homo sapiens; identical to SEQ ID NO: 404

SEQ ID NO: 4918 - DNA, 50 bp, Homo sapiens
gggtaggcagcttgcacccagttctcctttatctcaacttattgtcctgg

SEQ ID NO: 4919 - DNA, 50 bp, Homo sapiens
acttggaacagaagaacttcggcaacgagaacactatctcaagcagaaga

SEQ ID NO: 4920 - DNA, 50 bp, Homo sapiens
gcggtgtccctgagtgagggcaaagttgtaataacacttgttctctcctt

SEQ ID NO: 4921 - DNA, 50 bp, Homo sapiens; identical to SEQ ID NO: 407

SEQ ID NO: 4922 - DNA, 50 bp, Homo sapiens; identical to SEQ ID NO: 408

SEQ ID NO: 4923 - DNA, 50 bp, Homo sapiens
ggctagtggtgttcagagaaataccaaaacgtgtttttatcattgctggt

SEQ ID NO: 4924 - DNA, 50 bp, Homo sapiens
agctgcctcaggaggttcttaacatataggaatgtaattatcagattcaa

SEQ ID NO: 4925 - DNA, 50 bp, Homo sapiens
aggaaaccaagccctcacaggaaagaaagcctgattcaagaaaacaaagt

SEQ ID NO: 4926 - DNA, 50 bp, Homo sapiens; identical to SEQ ID NO: 418

SEQ ID NO: 4927 - DNA, 50 bp, Homo sapiens; identical to SEQ ID NO: 419

SEQ ID NO: 4928 - DNA, 50 bp, Homo sapiens
gccattttccctccagaaacaaaaccaagataatttatcctgaacacggt

SEQ ID NO: 4929 - DNA, 50 bp, Homo sapiens; identical to SEQ ID NO: 421

SEQ ID NO: 4930 - DNA, 50 bp, Homo sapiens
aggaccatagggaagagccagccttgccttttcttatatgattttgttta

SEQ ID NO: 4931 - DNA, 50 bp, Homo sapiens; identical to SEQ ID NO: 424

SEQ ID NO: 4932 - DNA, 50 bp, Homo sapiens; identical to SEQ ID NO: 429

SEQ ID NO: 4933 - DNA, 50 bp, Homo sapiens
tcgttctacgttatctcatctccttgttttcagtgtgcttcaataatgca

SEQ ID NO: 4934 - DNA, 50 bp, Homo sapiens; identical to SEQ ID NO: 432

SEQ ID NO: 4935 - DNA, 50 bp, Homo sapiens
tgcacttactcattagtttttagtttgaactctcctgcgaggtctaatgt

SEQ ID NO: 4936 - DNA, 50 bp, Homo sapiens
tggttcttctgatgagcaagggaacaacactgagaatgaggaggaggagt

SEQ ID NO: 4937 - DNA, 50 bp, Homo sapiens
aagcaagagattgtaaaccgggtacagatccaagagatgagagaggaccc

SEQ ID NO: 4938 - DNA, 50 bp, Homo sapiens
cgtctactgcggaaaagtcaggggaaactgccaaacaaaggaaaatgccc

SEQ ID NO: 4939 - DNA, 50 bp, Homo sapiens
gtgtttgacttcactgctgcgaaatgactgtctcctggctagtaggatct

SEQ ID NO: 4940 - DNA, 50 bp, Homo sapiens; identical to SEQ ID NO: 1311

SEQ ID NO: 4941 - DNA, 50 bp, Homo sapiens; identical to SEQ ID NO: 1315

SEQ ID NO: 4942 - DNA, 50 bp, Homo sapiens; identical to SEQ ID NO: 1320

SEQ ID NO: 4943 - DNA, 50 bp, Homo sapiens; identical to SEQ ID NO: 1321

SEQ ID NO: 4944 - DNA, 50 bp, Homo sapiens
atgtctataaatggtgtcataactagagcacgggcgttatgtaagtttct

SEQ ID NO: 4945 - DNA, 50 bp, Homo sapiens; identical to SEQ ID NO: 1340

SEQ ID NO: 4946 - DNA, 50 bp, Homo sapiens
acataggcgaagaaaacatggcattgagtgtgctgagtccagacaaatgt

SEQ ID NO: 4947 - DNA, 50 bp, Homo sapiens; identical to SEQ ID NO: 1350

SEQ ID NO: 4948 - DNA, 50 bp, Homo sapiens; identical to SEQ ID NO: 1352

SEQ ID NO: 4949 - DNA, 50 bp, Homo sapiens; identical to SEQ ID NO: 1353

SEQ ID NO: 4950 - DNA, 50 bp, Homo sapiens; identical to SEQ ID NO: 1355

SEQ ID NO: 4951 - DNA, 50 bp, Homo sapiens; identical to SEQ ID NO: 1358

SEQ ID NO: 4952 - DNA, 50 bp, Homo sapiens; identical to SEQ ID NO: 4468

SEQ ID NO: 4953 - DNA, 50 bp, Homo sapiens
aatcacagcagtaactcccagtaggaaagattctcaaaggaatagttctt

SEQ ID NO: 4954 - DNA, 50 bp, Homo sapiens
cctggccttcaagaagtcgtagtggctattttctttggacaaaagtaaga

SEQ ID NO: 4955 - DNA, 50 bp, Homo sapiens
atagacagacggaggtcctgatatccatgggccaacggcttggattattc

SEQ ID NO: 4956 - DNA, 50 bp, Homo sapiens; identical to SEQ ID NO: 1510

SEQ ID NO: 4957 - DNA, 50 bp, Homo sapiens; identical to SEQ ID NO: 1517

SEQ ID NO: 4958 - DNA, 50 bp, Homo sapiens
gatatcagacagcatcgtctctgcgagcacaaagatctgtttgctgagca

SEQ ID NO: 4959 - DNA, 50 bp, Homo sapiens; identical to SEQ ID NO: 1537

SEQ ID NO: 4960 - DNA, 50 bp, Homo sapiens; identical to SEQ ID NO: 1548

SEQ ID NO: 4961 - DNA, 50 bp, Homo sapiens
aattaacggccatcacacccacgactgacggtgatcaaacaaattcacag

SEQ ID NO: 4962 - DNA, 50 bp, Homo sapiens; identical to SEQ ID NO: 1559

SEQ ID NO: 4963 - DNA, 50 bp, Homo sapiens; identical to SEQ ID NO: 3876

SEQ ID NO: 4964 - DNA, 50 bp, Homo sapiens
ctcatagcatagccagcattcagcacacacaaacctactgcccacatttg

SEQ ID NO: 4965 - DNA, 50 bp, Homo sapiens
cacatttgaaggccaaagggaaaacgggggaagcggaagggttggattgg

SEQ ID NO: 4966 - DNA, 50 bp, Homo sapiens
tacgaccactgagaaacgggccacccggcacacggatcttggaacacaaa

SEQ ID NO: 4967 - DNA, 50 bp, Homo sapiens; identical to SEQ ID NO: 3927

SEQ ID NO: 4968 - DNA, 50 bp, Homo sapiens; identical to SEQ ID NO: 3930

SEQ ID NO: 4969 - DNA, 50 bp, Homo sapiens; identical to SEQ ID NO: 3935

SEQ ID NO: 4970 - DNA, 50 bp, Homo sapiens; identical to SEQ ID NO: 3945

SEQ ID NO: 4971 - DNA, 50 bp, Homo sapiens; identical to SEQ ID NO: 3961

SEQ ID NO: 4972 - DNA, 50 bp, Homo sapiens; identical to SEQ ID NO: 3962

SEQ ID NO: 4973 - DNA, 50 bp, Homo sapiens
gcaggttatcgcaagatgtcttagagtagggttacggttctcagtgacac

SEQ ID NO: 4974 - DNA, 50 bp, Homo sapiens
aaatggctttaccaaacattgtcagtacctttacgtgttagaaggcattt

SEQ ID NO: 4975 - DNA, 50 bp, Homo sapiens; identical to SEQ ID NO: 3966

SEQ ID NO: 4976 - DNA, 50 bp, Homo sapiens
ccctacttgattaaagattgaggtggaattctagatgtggtcattcgtgt

SEQ ID NO: 4977 - DNA, 50 bp, Homo sapiens; identical to SEQ ID NO: 3981

SEQ ID NO: 4978 - DNA, 50 bp, Homo sapiens
agaaatggtacggggaatgtgaataacacgaaatggtatggggaaatgtg

SEQ ID NO: 4979 - DNA, 50 bp, Homo sapiens; identical to SEQ ID NO: 4002

SEQ ID NO: 4980 - DNA, 50 bp, Homo sapiens
tgttcttgtgctgctgttatctatactatttttgttcgtgccttctgact

SEQ ID NO: 4981 - DNA, 50 bp, Homo sapiens
gtctgggtgccaacttgagacaggtggtctaggaaattgcggtaagagcg

SEQ ID NO: 4982 - DNA, 50 bp, Homo sapiens; identical to SEQ ID NO: 4009

SEQ ID NO: 4983 - DNA, 50 bp, Homo sapiens; identical to SEQ ID NO: 4010

SEQ ID NO: 4984 - DNA, 50 bp, Homo sapiens
aggctgattcttggagatttaacaccccacaggcaatgggtttatagaca

SEQ ID NO: 4985 - DNA, 50 bp, Homo sapiens
tctcctttcagttcctttgtaggatttctgggcttgaaggatagtcttca

SEQ ID NO: 4986 - DNA, 50 bp, Homo sapiens; identical to SEQ ID NO: 4031

SEQ ID NO: 4987 - DNA, 50 bp, Homo sapiens
agaatgtcccacttgctgtctcttagaggctgagcttcatttctatgagc

SEQ ID NO: 4988 - DNA, 50 bp, Homo sapiens
caacctctggagagtgcctactgttagaagctgaagggatgtcaaagtca

SEQ ID NO: 4989 - DNA, 50 bp, Homo sapiens; identical to SEQ ID NO: 4041

SEQ ID NO: 4990 - DNA, 50 bp, Homo sapiens
gcctcagtacagagggggctctggaagtgtttgttgactgaataaacgga

SEQ ID NO: 4991 - DNA, 50 bp, Homo sapiens; identical to SEQ ID NO: 4054

SEQ ID NO: 4992 - DNA, 50 bp, Homo sapiens
tgcctaagagcaaagcatcctctgcgacaaaagaaaattactgtagtggc

SEQ ID NO: 4993 - DNA, 50 bp, Homo sapiens; identical to SEQ ID NO: 4057

SEQ ID NO: 4994 - DNA, 50 bp, Homo sapiens
gacatggagcccccggaaaagcgggtctggacaccaagtcgatgtgtgag

SEQ ID NO: 4995 - DNA, 50 bp, Homo sapiens
acagaatcagattttgcaggtgtccaacctatagtggctaagaattatgt

SEQ ID NO: 4996 - DNA, 50 bp, Homo sapiens; identical to SEQ ID NO: 4067

SEQ ID NO: 4997 - DNA, 50 bp, Homo sapiens; identical to SEQ ID NO: 4070

SEQ ID NO: 4998 - DNA, 50 bp, Homo sapiens; identical to SEQ ID NO: 4075

SEQ ID NO: 4999 - DNA, 50 bp, Homo sapiens; identical to SEQ ID NO: 4077

SEQ ID NO: 5000 - DNA, 50 bp, Homo sapiens
tggagatccttctacttggctgctgtattcatgcattatgttggtttgag

SEQ ID NO: 5001 - DNA, 50 bp, Homo sapiens
atttgtaccaaatctttgggattcattggcaaataatttcagtgtggtgt

SEQ ID NO: 5002 - DNA, 50 bp, Homo sapiens
ggttttagcagttctttagcccgtggtatttcagtgttgggtttcatagc

SEQ ID NO: 5003 - DNA, 50 bp, Homo sapiens
gggagccataagaacgactccaaaaagagccccaaaggaggacaaggggg

SEQ ID NO: 5004 - DNA, 50 bp, Homo sapiens
tcagggtcttggatactcaagagaaaggagacttgtggttaatgtttgga

SEQ ID NO: 5005 - DNA, 50 bp, Homo sapiens
tccttagcacacgaaaaagccccttcccctggattcatgtttcttatttc

SEQ ID NO: 5006 - DNA, 50 bp, Homo sapiens
aagcaagtagacaccttcataactatgaatgaagctgctgaagtagtgtt

SEQ ID NO: 5007 - DNA, 50 bp, Homo sapiens
tccattaaagatcgcaaatgttgaggtcctgtagcctgaaaactctctgc

SEQ ID NO: 5008 - DNA, 50 bp, Homo sapiens
ctgattcaaacaggttccaacgtaaaacgttcacacttccaccatttcct

SEQ ID NO: 5009 - DNA, 50 bp, Homo sapiens
tgatgttggtatgcttgccctgttacttatagacagtctttgtcataggc

SEQ ID NO: 5010 - DNA, 50 bp, Homo sapiens
ggtctttgtcccagtagagttcatagtctatttagtgtgcatgtttttcc

SEQ ID NO: 5011 - DNA, 50 bp, Homo sapiens
ttgtgtccaaaagtgttaacgaagactacttaacccaatgattggcgcga

SEQ ID NO: 5012 - DNA, 50 bp, Homo sapiens
atgcgtggatattgagaacttaggtgtctaatggggaggattattgctgt

SEQ ID NO: 5013 - DNA, 50 bp, Homo sapiens
aagcatttccatttcaacgagtttgtcagctttattaatgttgggcaaaa

SEQ ID NO: 5014 - DNA, 50 bp, Homo sapiens
aaacctaccactttaagaagacagcgatgggtaattctttattggcaggt

SEQ ID NO: 5015 - DNA, 50 bp, Homo sapiens
attcagcattagtttctcacatcttcccccaggtatccccaacagaatta

SEQ ID NO: 5016 - DNA, 50 bp, Homo sapiens
acacctctcttagggctccatcaaacagaacttttagactgagtaacgct

SEQ ID NO: 5017 - DNA, 50 bp, Homo sapiens; identical to SEQ ID NO: 4297

SEQ ID NO: 5018 - DNA, 50 bp, Homo sapiens
accatgaacagtgtgttgcttcagactattacaaagagaatggggcaggt

SEQ ID NO: 5019 - DNA, 50 bp, Homo sapiens
tttttgaaaagtatgtttggtagaaattagttgtatgccctcaggacggt

SEQ ID NO: 5020 - DNA, 50 bp, Homo sapiens
gaaattagtgtgaacatgtgggaagcccgatgcatgtgggtcagggatct

SEQ ID NO: 5021 - DNA, 50 bp, Homo sapiens
tccctgggtgataccattcaatgtcttaatgtacttgtggctcagacctg

SEQ ID NO: 5022 - DNA, 50 bp, Homo sapiens
cagacagcacagcctgagggtagcagcagccacccatgttcaggtaagtc

SEQ ID NO: 5023 - DNA, 50 bp, Homo sapiens
gccatgaggtggaggacgtggacctggagctgttcaacatctcggtgcag

SEQ ID NO: 5024 - DNA, 50 bp, Homo sapiens
tctgcacccaaacaaataccttttgagatttcttataggcattcctctcg

SEQ ID NO: 5025 - DNA, 50 bp, Homo sapiens
gaagctctgccgcagcgccaggcacttcctacaccactactacgtccacg

SEQ ID NO: 5026 - DNA, 50 bp, Homo sapiens
cagctcggaccaccgccacctccctttttatttacagatcacccagtaag

SEQ ID NO: 5027 - DNA, 50 bp, Homo sapiens
ggtcccctcctggagactccctcacaaaatctttccccaagctgttcccc

SEQ ID NO: 5028 - DNA, 50 bp, Homo sapiens
tgaatgggcgtttatcttaatgaccagttattgaccaaagtgtactcaga

SEQ ID NO: 5029 - DNA, 50 bp, Homo sapiens
agcctattcctattctctagcctattccttaccacctgtaatcttgacca

SEQ ID NO: 5030 - DNA, 50 bp, Homo sapiens
gcaatgggcggccaactatgaaccctacgtggtggtgccacgagactgtc

SEQ ID NO: 5031 - DNA, 50 bp, Homo sapiens
gcctggagcttggctttgtatccaagtgtatggttgctttgtctaagagg

SEQ ID NO: 5032 - DNA, 50 bp, Homo sapiens; identical to SEQ ID NO: 1495

SEQ ID NO: 5033 - DNA, 50 bp, Homo sapiens
agcctacaagccacctcgccactgtgaacttgtcgtcactcttggatgtc

SEQ ID NO: 5034 - DNA, 50 bp, Homo sapiens
cctgctcacagaccaggaactctacaagctggaccctgaccggcagtacc

SEQ ID NO: 5035 - DNA, 50 bp, Homo sapiens
agcagttccacagtgtttcacactacaggatttaaatattttgctccaga

SEQ ID NO: 5036 - DNA, 50 bp, Homo sapiens
cctttatccacctggattttagggacaaacactgaaaacgaataagtcca

SEQ ID NO: 5037 - DNA, 50 bp, Homo sapiens; identical to SEQ ID NO: 5036

SEQ ID NO: 5038 - DNA, 50 bp, Homo sapiens
cagagaacgaaagtcaagtgcagcgagttgggtggaagctgatagagcaa

SEQ ID NO: 5039 - DNA, 50 bp, Homo sapiens
ccacaaaccattcagatcaggcacttgctgaccctggttcttaaggacac

SEQ ID NO: 5040 - DNA, 50 bp, Homo sapiens
aagaaactatgtagcatagtgtcttaacacctcagtaaagtaagctggcc

SEQ ID NO: 5041 - DNA, 50 bp, Homo sapiens
agcaggagacagcttcctgatctagatgtacaattagagtttaggttgga

SEQ ID NO: 5042 - DNA, 50 bp, Homo sapiens
tggaactagtcacaattgaagttcttcatccagtaggtgttaaacagtgt

SEQ ID NO: 5043 - DNA, 50 bp, Homo sapiens
cccacacaagtgcgccacataaatctgcgagactccacgacaacacaggg

SEQ ID NO: 5044 - DNA, 50 bp, Homo sapiens
gcaaacaagttctaaagttgtggagaaaaagtgatgtggtcaagagttga

SEQ ID NO: 5045 - DNA, 50 bp, Homo sapiens
gcaagaaagagaaacgtaaaaacagatagagattctgcctgtgctttggt

SEQ ID NO: 5046 - DNA, 50 bp, Homo sapiens
gagagttgctggtgtaaaatacgtttgaaatagttgatctacaaaggcca

SEQ ID NO: 5047 - DNA, 50 bp, Homo sapiens
ggttaacgcttctgtgaggaccttctggctcttgagataccctaaatatt

SEQ ID NO: 5048 - DNA, 50 bp, Homo sapiens
actttcattggtaaataagcctgtcttcctatctggatttttggtgtgca

SEQ ID NO: 5049 - DNA, 50 bp, Homo sapiens
cagttatttaaaggctgacaactgccttccagacccgcgctgtattaata

SEQ ID NO: 5050 - DNA, 50 bp, Homo sapiens
tggtgggtacagaaacattgtcacagggatcctggaacagaggaagagtt

SEQ ID NO: 5051 - DNA, 50 bp, Homo sapiens
ttctgacctaataattacgggaaatggaaagtctgggccagcatcaataa

SEQ ID NO: 5052 - DNA, 50 bp, Homo sapiens
tgggtcggcaaagctattataactttgaatgctaacggcatgtttgacct

SEQ ID NO: 5053 - DNA, 50 bp, Homo sapiens
gctgtgtcctttctggcacaatcggggattccattctttagacactggaa

SEQ ID NO: 5054 - DNA, 50 bp, Homo sapiens
ttgacaaagatgacatcgccccaagagccaaaaataaatgggaattgaaa

SEQ ID NO: 5055 - DNA, 50 bp, Homo sapiens
gtaaagatcagaataccaaggccagctaaggcaacgactccctccccaaa

SEQ ID NO: 5056 - DNA, 50 bp, Homo sapiens; identical to SEQ ID NO: 1668

SEQ ID NO: 5057 - DNA, 50 bp, Homo sapiens
atgctggtgtcatgtgacatttgttgagtctcgggcatgttcacggtggg

SEQ ID NO: 5058 - DNA, 50 bp, Homo sapiens
ggaaattgtgccaaaaccatggaaaatattactgtgtgtggggtgtctgt

SEQ ID NO: 5059 - DNA, 50 bp, Homo sapiens
tttgtgtgtgaaatataacattgattgaattgcagttacatttggttagt

SEQ ID NO: 5060 - DNA, 50 bp, Homo sapiens; identical to SEQ ID NO: 1868

SEQ ID NO: 5061 - DNA, 50 bp, Homo sapiens
taaggttaggcaataacttaggggtatattctcttcctgcatcccagtgc

SEQ ID NO: 5062 - DNA, 50 bp, Homo sapiens
taaggtgtttgctgggggatgttgtgtgtattaggggagtgtttcccttg

SEQ ID NO: 5063 - DNA, 50 bp, Homo sapiens; identical to SEQ ID NO: 3550

SEQ ID NO: 5064 - DNA, 50 bp, Homo sapiens; identical to SEQ ID NO: 3567

SEQ ID NO: 5065 - DNA, 50 bp, Homo sapiens
actggtgttggtgcttttgtctgtcataccatagtattttcaaaacttca

SEQ ID NO: 5066 - DNA, 50 bp, Homo sapiens
ccttgagaaacacccatctccacttcctagacaaaccaatgaacattagt

SEQ ID NO: 5067 - DNA, 50 bp, Homo sapiens; identical to SEQ ID NO: 3688

SEQ ID NO: 5068 - DNA, 50 bp, Homo sapiens
ctaagtcattgcaggaacggggctgtgttctctgctgggacaaaacagga

SEQ ID NO: 5069 - DNA, 50 bp, Homo sapiens
gccgttctttatagaacaattcctttctcttctcttgaatgtggcagtca

SEQ ID NO: 5070 - DNA, 50 bp, Homo sapiens
agcctacctccctaccccaagctgtctgttgagagcagtgctgaccccag

SEQ ID NO: 5071 - DNA, 50 bp, Homo sapiens
tttcataaacccactccttcctcttcacccacttgcaatccgcatgcttc

SEQ ID NO: 5072 - DNA, 50 bp, Homo sapiens
caagttggtttagttatgtaacaacctgacatgatggaggaaaacaacct

SEQ ID NO: 5073 - DNA, 50 bp, Homo sapiens
gactcgttacgccgtagtttgtcctatcttgtttatcaaatgaatttcgt

SEQ ID NO: 5074 - DNA, 50 bp, Homo sapiens
agccgcccagctacttaatccctcagtaacatctatctaaatctcccatg

SEQ ID NO: 5075 - DNA, 50 bp, Homo sapiens
tggcctgtgcttttaccacaccgtcaaacccttgatcatttctgtaaaca

SEQ ID NO: 5076 - DNA, 50 bp, Homo sapiens
acattctcatagtccaggggctcaacaactttggccttttccagcaccac

SEQ ID NO: 5077 - DNA, 50 bp, Homo sapiens
tcagcagttgtgccttttctcacagatccagccgtccttctcgctgtcac

SEQ ID NO: 5078 - DNA, 50 bp, Homo sapiens
tgcaagcaataaaatcttgctttaatcagtaaccactgtctgacaggaca

SEQ ID NO: 5079 - DNA, 50 bp, Homo sapiens
ggtcgtagagaagacagcaagggaggggataaaacccaggaaggacttaa

SEQ ID NO: 5080 - DNA, 50 bp, Homo sapiens
ggctcacgatgacaaccgcctacggaaaaactctaattcctaaacatcta

SEQ ID NO: 5081 - DNA, 50 bp, Homo sapiens
gacaagccaggtcagcccagattgccaaagcagcacttgcctacaccagc

SEQ ID NO: 5082 - DNA, 50 bp, Homo sapiens
ggttcccttgaagcagtgccaacctaaatctacctcaggtaagtagttag

SEQ ID NO: 5083 - DNA, 50 bp, Homo sapiens
gctgacagtatggaggctaaaggtgtggaggaaccaggaggagatgagta

SEQ ID NO: 5084 - DNA, 50 bp, Homo sapiens
caagtgtgccgggcaagtttgggaaggtgaagcaatctgtgacttaaata

SEQ ID NO: 5085 - DNA, 51 bp, Homo sapiens
gagctactcaaggggaaaaaagggcatatagtatgctctggtagtaaaagt

SEQ ID NO: 5086 - DNA, 50 bp, Homo sapiens; identical to SEQ ID NO: 4220

SEQ ID NO: 5087 - DNA, 50 bp, Homo sapiens
tggtgataatagagattgtttctgccctgggggtagttcaaggataacac

SEQ ID NO: 5088 - DNA, 50 bp, Homo sapiens
cttcaggtttggcccagcccctccttgaagactccttccatccagtcaag

SEQ ID NO: 5089 - DNA, 50 bp, Homo sapiens
cccaagtgaagtcaaagttactgtgtggttgatagggaacatggctggat

SEQ ID NO: 5090 - DNA, 50 bp, Homo sapiens
acccgcagaccagatggttgaaaggaaaaattaaagccttcttggggatt

SEQ ID NO: 5091 - DNA, 50 bp, Homo sapiens
ggagttagatcaaccttatggggaagggaaaggcagggcttgtgacaatt

SEQ ID NO: 5092 - DNA, 50 bp, Homo sapiens
gatggctgcttggttgctaaacccagacagggtccttccagtgcatctgc

SEQ ID NO: 5093 - DNA, 50 bp, Homo sapiens
catttgtgggtggagggttttgaatgtcctctttccatgtcaggcaaagg

SEQ ID NO: 5094 - DNA, 50 bp, Homo sapiens
ttctatgaaggtttccctggacaagaaactgccagagagcccttagctca

SEQ ID NO: 5095 - DNA, 50 bp, Homo sapiens
tgctgaatgtacctgagtgtatgtatttaaaaggactcacatgggcatca

SEQ ID NO: 5096 - DNA, 50 bp, Homo sapiens
tctcaaccctaatattcattgttccatgagcattgtcaggttttggatgg

SEQ ID NO: 5097 - DNA, 50 bp, Homo sapiens
acaagtggaagaggaagacagaagaatgggtcagggagatgcaaggatgg

SEQ ID NO: 5098 - DNA, 50 bp, Homo sapiens
tccttagggaaaagaagattttcaaacccttcgttagtttcggtagggcc

SEQ ID NO: 5099 - DNA, 50 bp, Homo sapiens
acgcaatttgttcacatacatacacatgcaaatcccaaaagaaggtttta

SEQ ID NO: 5100 - DNA, 50 bp, Homo sapiens
cccagccctctatgtacccgtgtcccagccagcaataaatgccatcttgg

SEQ ID NO: 5101 - DNA, 50 bp, Homo sapiens
agcctggaattctaagcagcagtttcacaatctgtaattgcacgtttctg

SEQ ID NO: 5102 - DNA, 50 bp, Homo sapiens
tggttactcatgtcctcaaagacgactcatgatgctggatatgaagaact

SEQ ID NO: 5103 - DNA, 50 bp, Homo sapiens
aggcaaaagtcatttcttccctatattttgtcatgcttatctcctgtctc

SEQ ID NO: 5104 - DNA, 50 bp, Homo sapiens
gtatgaaggcaagaaaatttcaggggaaaacaagtggttattttctggcc

SEQ ID NO: 5105 - DNA, 50 bp, Homo sapiens
gataccctcttcctaagactcatcgcgtctcttccagcctcctcgcccca

SEQ ID NO: 5106 - DNA, 50 bp, Homo sapiens
tctgtatgctgtggtctcatcaggaacctttctctgcactgcatttttcc

SEQ ID NO: 5107 - DNA, 50 bp, Homo sapiens
agagctggttccagaaggttcggatgagtcctgaatgtttatgtagggca

SEQ ID NO: 5108 - DNA, 50 bp, Homo sapiens
tccttagtctccttcaatttccacacactgaacatgacattttacccttt

SEQ ID NO: 5109 - DNA, 50 bp, Homo sapiens
ttttctgttttctgttttaagaaaatctggaaccgcaaggccgtcccttt

SEQ ID NO: 5110 - DNA, 50 bp, Homo sapiens
ccaaagcctttgttgtttggtggcgaggcccctttttgaatggggttttt

SEQ ID NO: 5111 - DNA, 50 bp, Homo sapiens
tgccgcccccaggattcttttaagaataaaaagaaatgagtgtggacatg

SEQ ID NO: 5112 - DNA, 50 bp, Homo sapiens
cctacgatatccttttcaaataggggtgggtccagcccccttgtgccctg

SEQ ID NO: 5113 - DNA, 50 bp, Homo sapiens
ctgggagaaaggtactttgggttagtggtagggatagggatgaacgggaa

SEQ ID NO: 5114 - DNA, 50 bp, Homo sapiens
agcataatcctaatgaggaactttgtctgaagtctgaggctgagttactt

SEQ ID NO: 5115 - DNA, 50 bp, Homo sapiens
ttttggaacccttagccctgtgcaaatcaaaggatgtgaggggaaaaagg

SEQ ID NO: 5116 - DNA, 50 bp, Homo sapiens
atttcccctacggatgggaccaagaaactgatgagaacggccaagtgttt

SEQ ID NO: 5117 - DNA, 50 bp, Homo sapiens
aacacccgaaaccgtcttctgtggcatttgtcagttgaaaaagaacacct

SEQ ID NO: 5118 - DNA, 50 bp, Homo sapiens
ccagtggctgggatggtgacagtgacatccacagtaaacagatgaaatgt

SEQ ID NO: 5119 - DNA, 50 bp, Homo sapiens
ggatttcagaaacagttgcagatattattgattagctagttggcagtggg

SEQ ID NO: 5120 - DNA, 50 bp, Homo sapiens
cttgttcccaggccagccccacacagtaggcagtcattaaagtttggtga

SEQ ID NO: 5121 - DNA, 50 bp, Homo sapiens
ttttccttcaactcttgcgactttcttggtctgcctgtgtggttttaata

SEQ ID NO: 5122 - DNA, 50 bp, Homo sapiens
ttctgttaatagcaaacattgcctttgagtgctactactaaacctgaggc

SEQ ID NO: 5123 - DNA, 50 bp, Homo sapiens
tctagggatctgcccggctcaaaatcccaggccgttaggctaagttgttc

SEQ ID NO: 5124 - DNA, 50 bp, Homo sapiens
cggacaagggctggcaggtaaatgccttcagtttgttgttaaatagaggc

SEQ ID NO: 5125 - DNA, 50 bp, Homo sapiens
agccttagcccctttaaagcacttaaagttactacttccaaatgtgattt

SEQ ID NO: 5126 - DNA, 50 bp, Homo sapiens
accttgtcattaacagctcactttgattgaacatctactctgtggcggtt

SEQ ID NO: 5127 - DNA, 50 bp, Homo sapiens
tggaacggctatttgccggtttaaaaaccaaaaaccccggtttttccaaa

SEQ ID NO: 5128 - DNA, 50 bp, Homo sapiens
gtaaggcagacgagagaggcggaggtctcacagtgaaccacaggatctgg

SEQ ID NO: 5129 - DNA, 50 bp, Homo sapiens
ttgcctgccatgcccttataagtgccctttaatgtcatagcatgtaaagg

SEQ ID NO: 5130 - DNA, 50 bp, Homo sapiens
gggtttgtgtccccatttagaatctgatgaaacggtgggctttccttctt

SEQ ID NO: 5131 - DNA, 50 bp, Homo sapiens
cagagcctccagaattatgtgaacttgtctcaaaacattctctaaatggc

SEQ ID NO: 5132 - DNA, 50 bp, Homo sapiens
gaaaggacccgagggtttgtatttaaaaagcctcccctgggcctcaaaaa

SEQ ID NO: 5133 - DNA, 50 bp, Homo sapiens; identical to SEQ ID NO: 4265

SEQ ID NO: 5134 - DNA, 50 bp, Homo sapiens
tgtctagaacagactgagagtgacacgcatatttgattgtgaggacagtt

SEQ ID NO: 5135 - DNA, 50 bp, Homo sapiens
gtttggcccccaaagtgtttaggagagctttctccctagatcgccctgtg

SEQ ID NO: 5136 - DNA, 50 bp, Homo sapiens
ccaggagggccagaatttgaaaattccttggggttgttctttttccaaaa

SEQ ID NO: 5137 - DNA, 50 bp, Homo sapiens
cagtttgagcaaaagcctttgaaatccaagacttttccccttggggtgct

SEQ ID NO: 5138 - DNA, 50 bp, Homo sapiens
ccagttggtttttggactccaaagcccaggacccttccaaatcctgcttg

SEQ ID NO: 5139 - DNA, 50 bp, Homo sapiens
aggcctttttcaaagaaaaacccctttggggaaaaagggaaagggcaaaa

SEQ ID NO: 5140 - DNA, 50 bp, Homo sapiens
ttttgcttgctgtcgggagaataaagcagggaacctttatgtagtgaaaa

SEQ ID NO: 5141 - DNA, 50 bp, Homo sapiens
gggtttggcccgattatattaggttgggtgggggaaaaattttatggggg

SEQ ID NO: 5142 - DNA, 50 bp, Homo sapiens
gtgaactggatcttgaggccgtgctggaaaccggaaggtacactgcttgg

SEQ ID NO: 5143 - DNA, 50 bp, Homo sapiens
caaaacttgagataaggttaaaactgtgcccagaggaaaactggtagtct

SEQ ID NO: 5144 - DNA, 50 bp, Homo sapiens
tgcagccagattgttccaaggttgccaattacctagtgggtaaatttccc

SEQ ID NO: 5145 - DNA, 50 bp, Homo sapiens
agtgcttatcatgaaatgtgcttcactggttcagctctgttgtttcctta

SEQ ID NO: 5146 - DNA, 50 bp, Homo sapiens
gttatttgggagacaaatggacgggcaggaagattgatgctccgctgttc

SEQ ID NO: 5147 - DNA, 50 bp, Homo sapiens
agctgaagggcttcaactttgcttggatttttaaatattttccttgcata

SEQ ID NO: 5148 - DNA, 50 bp, Homo sapiens
tgcaggctcattgtgctccttcttctgggtttcaattggatttcagtcct

SEQ ID NO: 5149 - DNA, 50 bp, Homo sapiens
atctctaatgaagcctaggatcagatttgtggcataccaacagcacatgt

SEQ ID NO: 5150 - DNA, 50 bp, Homo sapiens
ccacaagggttagtttgggccttaaaactgccaaggagtttccaaggatt

SEQ ID NO: 5151 - DNA, 50 bp, Homo sapiens
cgctttattcccacgaaacctaggacagtggccatcaaaccgagcgcttt

SEQ ID NO: 5152 - DNA, 50 bp, Homo sapiens
cctgttgtggctggctgcataataatttccaggaggctttcggaaatgtt

SEQ ID NO: 5153 - DNA, 50 bp, Homo sapiens
cggtccagtcggctgcttccattccctgaagaagaggccctaaagttaaa

SEQ ID NO: 5154 - DNA, 50 bp, Homo sapiens
ttagcctcaaaggggtggggaaaagcccatacctcctgggccagtcctag

SEQ ID NO: 5155 - DNA, 50 bp, Homo sapiens
ccttagaattaagttgaattttcctgccttgctaagcaagacttcctgca

SEQ ID NO: 5156 - DNA, 50 bp, Homo sapiens
cagccacggcccctcgcgtcttcgcggcacgttaattaaatgcggaaaac

SEQ ID NO: 5157 - DNA, 50 bp, Homo sapiens
ttttacccaaattttaaaggccggataaaagggtttttgtttggaaggga

SEQ ID NO: 5158 - DNA, 50 bp, Homo sapiens
ggaggttagggcctgaagctcaaagctccccctttttaatagtttttccc

SEQ ID NO: 5159 - DNA, 50 bp, Homo sapiens
cccctttgggccccccgggttttccctttttggtttcgggttgttttttg

SEQ ID NO: 5160 - DNA, 50 bp, Homo sapiens
acgtgggcctttggaccccttataagatggtcataagaccccaaaactga

SEQ ID NO: 5161 - DNA, 50 bp, Homo sapiens
atggctataaggccaaaaaagtttggcggcatgggggattttttgctctt

SEQ ID NO: 5162 - DNA, 50 bp, Homo sapiens
agagacggccacctgagaccaattagaatatccacaccagtggaagagag

SEQ ID NO: 5163 - DNA, 50 bp, Homo sapiens
gcctccccaacccctggcctcaatttccctttctataaaatggaagatgt

SEQ ID NO: 5164 - DNA, 50 bp, Homo sapiens
acacccagccaaagaaaagcatacctgaatccaagagagtatttacactg

SEQ ID NO: 5165 - DNA, 50 bp, Homo sapiens
ctcagagaagaacagtgtagaaacccgcgctgtgtgaagcgaggttgggc

SEQ ID NO: 5166 - DNA, 50 bp, Homo sapiens
actttccattgttgagctggggagttggattttgtccatttgtttttatg

SEQ ID NO: 5167 - DNA, 50 bp, Homo sapiens
tcccagtgatgattcgctccctttgttaattactcagtgtttcttgtttt

SEQ ID NO: 5168 - DNA, 50 bp, Homo sapiens
tgcgtgctgctaatacttaggtacccataataggtctttacactcagttt

SEQ ID NO: 5169 - DNA, 50 bp, Homo sapiens
cctgaccttgaggcatttttgattgtgcagttacctagggtatgcttgtg

SEQ ID NO: 5170 - DNA, 50 bp, Homo sapiens
gaggactgggaccgtgattccactaaccggaaaccgtcgcctttcgggcc

SEQ ID NO: 5171 - DNA, 50 bp, Homo sapiens
ggggaagtcaaggagacacacacgctctttcaacagaatcagctcttaat

SEQ ID NO: 5172 - DNA, 50 bp, Homo sapiens
aactagatcctgccttagaaaaccttttgccatgaatgacaaattcatgt

SEQ ID NO: 5173 - DNA, 50 bp, Homo sapiens
tgtcagcatctggaatagtgtaagtatgcagtggaggaaatctcatcctt

SEQ ID NO: 5174 - DNA, 50 bp, Homo sapiens
ttaacaggacctctgggccaccaaggagaaagggctggggaagccaagag

SEQ ID NO: 5175 - DNA, 50 bp, Homo sapiens
gttctgtgatagtttgtttcccctcatctccctcacctctgcctgggttg

SEQ ID NO: 5176 - DNA, 50 bp, Homo sapiens
ggcccctccttttgctggagagttttttataaactggagcccgatttcat

SEQ ID NO: 5177 - DNA, 50 bp, Homo sapiens
gggctttttcttcccctaatcagggtgacctgggccttttgggcaggatc

SEQ ID NO: 5178 - DNA, 50 bp, Homo sapiens
aaggaggggagtgaatgatattgctgtcatttctcagcaaatcatagtga

SEQ ID NO: 5179 - DNA, 50 bp, Homo sapiens
taaaattctctgtgggaaaaagcctgccaataaaatgggggtttttgggc

SEQ ID NO: 5180 - DNA, 50 bp, Homo sapiens
acagactaagctggtttggtggattcatctttcacttatgaagaaagcag

SEQ ID NO: 5181 - DNA, 50 bp, Homo sapiens
cccaaagcctggggggtttggcccaaaccttccccctggtttttataaaa

SEQ ID NO: 5182 - DNA, 50 bp, Homo sapiens
actgctttcaagaaagtgggaccagtggcattgtagccaccataatcact

SEQ ID NO: 5183 - DNA, 50 bp, Homo sapiens
gcccttggcaaatgatttgagaccccttttgaaaaccatgtaggatgaat

SEQ ID NO: 5184 - DNA, 50 bp, Homo sapiens
cacacagcagtggcttggggatgaggaaggaagggagaatctcaacggag

SEQ ID NO: 5185 - DNA, 50 bp, Homo sapiens
tttttctgtgagttaggggcatggaggcggcagtgttgggagctggagcc

SEQ ID NO: 5186 - DNA, 51 bp, Homo sapiens
agttggctctagtttaaagatataaatacgtacctcacttaaaccccatgt

SEQ ID NO: 5187 - DNA, 50 bp, Homo sapiens
cttcaggcccaagttcaacgggttaaagaggtccgctcccaaattattct

SEQ ID NO: 5188 - DNA, 50 bp, Homo sapiens
gtcccagtagccccatttcagggcttgctagttacatgggtttgtgttta

SEQ ID NO: 5189 - DNA, 50 bp, Homo sapiens
ggatgtgtgatgtttatatgggagaacaaaaagctgatgtatagccctgt

SEQ ID NO: 5190 - DNA, 50 bp, Homo sapiens
caatttccacctctaagggggtcgggaaaggcacgctgagggtgaatatg

SEQ ID NO: 5191 - DNA, 50 bp, Homo sapiens
gctttcaaatgaatttcagggctttctttgaagcagtcttgtaaagttgt

SEQ ID NO: 5192 - DNA, 50 bp, Homo sapiens
tcctttctggataccaggaatcacttaaaaatctgtgtataatgccccca

SEQ ID NO: 5193 - DNA, 50 bp, Homo sapiens
aaacagggaacgacaggaaaaagatgaccgtgatacactctgctaaaagc

SEQ ID NO: 5194 - DNA, 50 bp, Homo sapiens
cccccccggcttcccccttttttccccgcccgtttttttgggggaatggg

SEQ ID NO: 5195 - DNA, 50 bp, Homo sapiens
ggccatgccgggccagccccacctgaagctcagtgaaagctgattaaaaa

SEQ ID NO: 5196 - DNA, 50 bp, Homo sapiens
cgcaggactctaaagatccaagctcacaaaacactccaaatccacctcga

SEQ ID NO: 5197 - DNA, 50 bp, Homo sapiens
aactttacttctgttcttggcaggacatggagagagggagggattccaaa

SEQ ID NO: 5198 - DNA, 50 bp, Homo sapiens
gggtgataattgagggtgccgctgggaaggtccgagaatgggttttcatg

SEQ ID NO: 5199 - DNA, 50 bp, Homo sapiens
gttcattgctgttcagagtgttgctgctgtggtgctataaatgctcccag

SEQ ID NO: 5200 - DNA, 50 bp, Homo sapiens
tattccaccagtgagctacactcccggcccctttagtgttgtttgtaaac

SEQ ID NO: 5201 - DNA, 50 bp, Homo sapiens
ccgtgttgtggcaaaatggtccctggagtttttgaccctgtgtttaaaga

SEQ ID NO: 5202 - DNA, 50 bp, Homo sapiens
ttttttggggccgaaaacccccaatgagggggattaaagctgttttcccc

SEQ ID NO: 5203 - DNA, 50 bp, Homo sapiens
ggggttgtccttttcccaccctgatggggaatttatggatgggtttcctt

SEQ ID NO: 5204 - DNA, 50 bp, Homo sapiens
aaatgagtgaccaaaacacttctgtaccacttctgtgagctgaggtccag

SEQ ID NO: 5205 - DNA, 50 bp, Homo sapiens
aggaacctaaagaaactgccaagtgtagataagcattgagtatgttaccc

SEQ ID NO: 5206 - DNA, 50 bp, Homo sapiens
ggttgtccagttttcggtttttaacgccccccataggggatttggccccc

SEQ ID NO: 5207 - DNA, 50 bp, Homo sapiens
gttttggaatgaggaatgatttttctaagcctgacatcagatgtctgaca

SEQ ID NO: 5208 - DNA, 50 bp, Homo sapiens
gaaattctccccttttcccctctccttcccttctgctgacctgttctcag

SEQ ID NO: 5209 - DNA, 50 bp, Homo sapiens
cacagagggagtgtgcagggccagatttcatcctggggccacgctgaaat

SEQ ID NO: 5210 - DNA, 50 bp, Homo sapiens
tgataggacatagtagtacgggtggtcagacatgaaaatggtggggagcc

SEQ ID NO: 5211 - DNA, 50 bp, Homo sapiens
caatacctacccccagtggcagccgcctgctcctcatgacccaagtaagt

SEQ ID NO: 5212 - DNA, 50 bp, Homo sapiens
tgttttaacaactcttctcaacattttgtccaggttattccctgtaacca

SEQ ID NO: 5213 - DNA, 50 bp, Homo sapiens
taagtgtcaggtttgtggggaaggttattcttgccttgtgtattttgtcc

SEQ ID NO: 5214 - DNA, 50 bp, Homo sapiens
caaacccctatcccccattctcctcctatccctcaaccccgacatcatta

SEQ ID NO: 5215 - DNA, 50 bp, Homo sapiens
cctgcaacagctaaggccaagccaaacttaccgtggactcaaacactttg

SEQ ID NO: 5216 - DNA, 50 bp, Homo sapiens; identical to SEQ ID NO: 372

SEQ ID NO: 5217 - DNA, 50 bp, Homo sapiens
tcccaccccttttctactgaatttgtggggatcctataataaaagtgaat

SEQ ID NO: 5218 - DNA, 50 bp, Homo sapiens
actaccagagccctaggacttctgagcacatttagaaaataccagaggca

SEQ ID NO: 5219 - DNA, 50 bp, Homo sapiens
catgtcagagttcttaacagaaagcaaaggtttccaacagcacttgcatt

SEQ ID NO: 5220 - DNA, 50 bp, Homo sapiens
atgaaatctcatggggccaaactgcacatcagctactgctaccttcttgc

SEQ ID NO: 5221 - DNA, 50 bp, Homo sapiens
ccctgtggcaacttgtgggtacggtttaactggaccacgctgagcttctg

SEQ ID NO: 5222 - DNA, 50 bp, Homo sapiens
agaaatagtgtttctcggaagctcagtttggagctgactgcacacgttgc

SEQ ID NO: 5223 - DNA, 50 bp, Homo sapiens
gttgctggctgccctcccctgcactctccctgaaataaagaacagcttgg

SEQ ID NO: 5224 - DNA, 50 bp, Homo sapiens; identical to SEQ ID NO: 5223

SEQ ID NO: 5225 - DNA, 50 bp, Homo sapiens
acgtgtcagacacaatcctgagccttctacaagtgttccctcttactcct

SEQ ID NO: 5226 - DNA, 50 bp, Homo sapiens
aagccctgtttacccaggtttttcttaaggcgagaaggtttagggtggtg

SEQ ID NO: 5227 - DNA, 50 bp, Homo sapiens
gagaaagctcccagtctgtctttcccaacatcccttcagtttcaataagc

SEQ ID NO: 5228 - DNA, 50 bp, Homo sapiens
ttcaggtgagtgtgcctggaggtggagaactatggttttgataacttggc

SEQ ID NO: 5229 - DNA, 50 bp, Homo sapiens
aaggtgccatgtattgaaagtgtgcgtcaaagaacataaatatcagtgga

SEQ ID NO: 5230 - DNA, 52 bp, Homo sapiens
tgtaattattttctgtatgttcaagaaggtaaaggaaaggacagctatggga

SEQ ID NO: 5231 - DNA, 51 bp, Homo sapiens
atttatttggggttggtcccccctttgggccccccgggttttccctttttt

SEQ ID NO: 5232 - DNA, 50 bp, Homo sapiens
aaccataaaaggcccgtttggttagttttccctgtttcctggtttgggct

SEQ ID NO: 5233 - DNA, 50 bp, Homo sapiens
ttatggggtaactcactttgggcggcacgaagaactccaggcggaagcgt

SEQ ID NO: 5234 - DNA, 50 bp, Homo sapiens
tctctccccatcccaagtcatccagccctttttcctaccctcaataaacc

SEQ ID NO: 5235 - DNA, 50 bp, Homo sapiens
ccccctgatggacttcaaatatgtctcatcaactacagtattaaatgcca

SEQ ID NO: 5236 - DNA, 50 bp, Homo sapiens
cgagaatgcctagggaaaccagctacgcttacaagccagctacgcagccc

SEQ ID NO: 5237 - DNA, 50 bp, Homo sapiens
ggaaacattggcctgggggtgtcccccaaaagggggccgtttttaaaggg

SEQ ID NO: 5238 - DNA, 50 bp, Homo sapiens
tgggttgacattgttcgcacggggtgtttcttatattaaaaagactcact

SEQ ID NO: 5239 - DNA, 50 bp, Homo sapiens
ctttccacaaaataatcgataaccttgggggattgttttatggcttgaca

SEQ ID NO: 5240 - DNA, 50 bp, Homo sapiens
ccgccttggggagacaggtcttgattgtctttttcccagtgaacattgtt

SEQ ID NO: 5241 - DNA, 50 bp, Homo sapiens
tcccagactttcaggaaagtaactgtagcactgttaatatcacaacaaca

SEQ ID NO: 5242 - DNA, 50 bp, Homo sapiens
ttttagctgggagtggggggactatggggaataactttccttcatttaat

SEQ ID NO: 5243 - DNA, 50 bp, Homo sapiens
acatgtgtgtgttttccatgaggcactgctttttatgcatttccctcccc

SEQ ID NO: 5244 - DNA, 50 bp, Homo sapiens
ctgtatttgaagtcagcagggctcagcaggatttgaccgacagttacctc

SEQ ID NO: 5245 - DNA, 50 bp, Homo sapiens
tggtttatagatgcacttcctttcataggcagtccctggcactttcttgc

SEQ ID NO: 5246 - DNA, 50 bp, Homo sapiens
aggagctggtattattggagggtattatagatccagtgtattgtgactgt

SEQ ID NO: 5247 - DNA, 50 bp, Homo sapiens
gcagtagtgctaaggcgtcttttgtaggctttagattttgtcgttatggc

SEQ ID NO: 5248 - DNA, 50 bp, Homo sapiens
gcttgtcagaacagaagatatttccaccctgcctagtagatgtgtttcag

SEQ ID NO: 5249 - DNA, 50 bp, Homo sapiens
cccccgttttaggttagggccttgggcaggggtttgccccctgttacccc

SEQ ID NO: 5250 - DNA, 50 bp, Homo sapiens
ttggttttatttatccaaaactgagccttctcataggctttacacccgga

SEQ ID NO: 5251 - DNA, 50 bp, Homo sapiens
ggcaggctctagccaccctgtcggttcccaataagccatttattgaataa

SEQ ID NO: 5252 - DNA, 50 bp, Homo sapiens
tttttgaccagtctacatttcgtatctgtgggatctgcatttgtgaattc

SEQ ID NO: 5253 - DNA, 50 bp, Homo sapiens
tctggacaatgttgatgctaaccttgatgatatccatccctattactggg

SEQ ID NO: 5254 - DNA, 50 bp, Homo sapiens
aggacatgaaggtctgaaaaagaaacaggaaaatacagacatccccgctt

SEQ ID NO: 5255 - DNA, 50 bp, Homo sapiens
aagtcaaggaaccctctcgggtctctgagatccaggccaacagtaaacag

SEQ ID NO: 5256 - DNA, 51 bp, Homo sapiens
agggggctttaaaatttaaaaattgccttttgttttaaaaaaggcccatgt

SEQ ID NO: 5257 - DNA, 50 bp, Homo sapiens
ccccctcccacccaaagaaaaagaaatggtaactacctggacaaaacatt

SEQ ID NO: 5258 - DNA, 50 bp, Homo sapiens
cccttggctcttattgttcttgctggtgtggtatgttcccggctgaaaaa

SEQ ID NO: 5259 - DNA, 50 bp, Homo sapiens
ttccccttttttcccccttttttaaaaagccccttttttaaatggggcgc

SEQ ID NO: 5260 - DNA, 50 bp, Homo sapiens
aaggacagcttgcttgctgatgaacacttccacagtcttttgagctaagt

SEQ ID NO: 5261 - DNA, 51 bp, Homo sapiens
acatgagaattaaccatgtccagtagttaagttcattttcctacagtgtgc

SEQ ID NO: 5262 - DNA, 50 bp, Homo sapiens
gccagaatggtacagagtggagggtgttctgctaatgacttcagagaagt

SEQ ID NO: 5263 - DNA, 50 bp, Homo sapiens
gcacaacttctgggaatctagtggctgtatgttaaagcatcggtaaaaga

SEQ ID NO: 5264 - DNA, 50 bp, Homo sapiens
aaaaaggccccttgtttgttggtttttggcccgttggggaaaatgcctgt

SEQ ID NO: 5265 - DNA, 50 bp, Homo sapiens
tttaggagctgaccatacatgatgagtgatacagcctgtactttgctcat

SEQ ID NO: 5266 - DNA, 50 bp, Homo sapiens
ggtttcccacgaacgggaggctgctgaagagtcaaagcctgggcagactc

SEQ ID NO: 5267 - DNA, 50 bp, Homo sapiens
caggtcatgagtattccaagctcaggtggtgagtcctcctcaccgggatg

SEQ ID NO: 5268 - DNA, 50 bp, Homo sapiens
aaagggaaactggctctggcaccacctactggagaccaaacttcaccaaa

SEQ ID NO: 5269 - DNA, 50 bp, Homo sapiens
gacaaaatagttacctatgctttccttctggcaccccgaatgtacgcagg

SEQ ID NO: 5270 - DNA, 50 bp, Homo sapiens
atctgacctgagggagatcacaaatgccttctgtattgggtggtaatgat

SEQ ID NO: 5271 - DNA, 50 bp, Homo sapiens
tccgttgtaacacatctaatgtgaacgcattataaacatggacctgtact

SEQ ID NO: 5272 - DNA, 51 bp, Homo sapiens
acataactattccgttgatgaatagcatcaggacttaaatggtgaccttgt

SEQ ID NO: 5273 - DNA, 51 bp, Homo sapiens
aacgggtttgggtttgggggggtttgttctttttattgaatccatttaagt

SEQ ID NO: 5274 - DNA, 50 bp, Homo sapiens
tataggagatgggatactcattcccgctgctattgataaggtcggaggcg

SEQ ID NO: 5275 - DNA, 50 bp, Homo sapiens
cagaacgtcctcaaggacacactcctccctcgggcctcactctggagcac

SEQ ID NO: 5276 - DNA, 50 bp, Homo sapiens
ctggacatgttgtttccatgttcagtcccttcccggtttttgggtgtttt

SEQ ID NO: 5277 - DNA, 50 bp, Homo sapiens
aaagtagccatcctgagtctccagggtgatgagcggacttgggtgtggat

SEQ ID NO: 5278 - DNA, 50 bp, Homo sapiens
ccttccatctcatcggtggcctctcactgtggctcactgtttaacacatg

SEQ ID NO: 5279 - DNA, 50 bp, Homo sapiens
tgttcaaggtcacatagtttaggtaagaagctcaaacctgagttttaggt

SEQ ID NO: 5280 - DNA, 50 bp, Homo sapiens
cacctgattccccctcttgcccacaggactctgctgttgttttcattctg

SEQ ID NO: 5281 - DNA, 50 bp, Homo sapiens
tctcgtgaggtgatgtggtgctgcagacttaagctatctgccttgaagat

SEQ ID NO: 5282 - DNA, 50 bp, Homo sapiens
aacaagcctggaataatgcccccaaagattgagtggaaatcgcccctttt

SEQ ID NO: 5283 - DNA, 50 bp, Homo sapiens
caggaccagatggcccaggaggaagtggatgctttcttggtagggaatgg

SEQ ID NO: 5284 - DNA, 50 bp, Homo sapiens
cctcctgctagaagacagatttcttccttggctgacaggctgaattaagc

SEQ ID NO: 5285 - DNA, 50 bp, Homo sapiens
aatttccaaaaacaaaacaaaacaagcaggtttcatggagcccgagtcca

SEQ ID NO: 5286 - DNA, 50 bp, Homo sapiens
cctttatgcaagttgtaaggggttgaccagtaaagaggaagttttgcccc

SEQ ID NO: 5287 - DNA, 50 bp, Homo sapiens
agtattagctacaaacaagccttgtttcctcttggctgtcaggcactgct

SEQ ID NO: 5288 - DNA, 50 bp, Homo sapiens
aagccccagtaaggtgttcaggactggtaaacgactgtcctcaagtaagg

SEQ ID NO: 5289 - DNA, 50 bp, Homo sapiens
tggttcaggtagtaaatgcttttggtcacatcagaactctagatctgggg

SEQ ID NO: 5290 - DNA, 50 bp, Homo sapiens
gcctgggctgtttttgctatatgtaaataaagcccttgggtctttatttt

SEQ ID NO: 5291 - DNA, 50 bp, Homo sapiens
ggaggttaggaagcccttttaaagtacaaacccccggcatggggaatttt

SEQ ID NO: 5292 - DNA, 50 bp, Homo sapiens
aacgggagtgatcgggaagtgaacagtttcatcatctgctgctgctattc

SEQ ID NO: 5293 - DNA, 50 bp, Homo sapiens
ctggtatgttgctttgtaggggaaaaactaattttgttgggtcagggaca

SEQ ID NO: 5294 - DNA, 50 bp, Homo sapiens
ccggacaagccatttgatgttctagtttgcaattactccacgcaaagtgg

SEQ ID NO: 5295 - DNA, 50 bp, Homo sapiens
tttgggcatcaacttcaacaactactaccaggacgcctgagggtgctttt

SEQ ID NO: 5296 - DNA, 50 bp, Homo sapiens
tcgaagaaagtacctgtaaatgtagagtaattgcgaagctgtcaggaata

SEQ ID NO: 5297 - DNA, 50 bp, Homo sapiens
tcctagaccctgcattgtgaaatggggcttgaattttagttctgaatttt

SEQ ID NO: 5298 - DNA, 50 bp, Homo sapiens
ctaaagcagtgtctgacctggatttgctgccaatttgtaagctttcatga

SEQ ID NO: 5299 - DNA, 50 bp, Homo sapiens
ggagctgagcagggatgcaaaaccatccagtctgtaagattcacagagac

SEQ ID NO: 5300 - DNA, 50 bp, Homo sapiens
aaacggtgtttgagctgctttgggaaaacccatgttgcagattttcaggt

SEQ ID NO: 5301 - DNA, 50 bp, Homo sapiens
cagagctgtgtttcctcaacaagtgtgcgagcggtcgtgtgcgccatgag

SEQ ID NO: 5302 - DNA, 50 bp, Homo sapiens
aaatcgcttctgtattgttaatagcaatatatgacctctgctgtcctcct

SEQ ID NO: 5303 - DNA, 50 bp, Homo sapiens
gaaaggataatttcgaacccttgcatagtttcggtatgggccgtgccaac

SEQ ID NO: 5304 - DNA, 50 bp, Homo sapiens
ccctcttgaactgcactgcctaagaaatgttggttgcatggagacatatt

SEQ ID NO: 5305 - DNA, 50 bp, Homo sapiens
tctgccttatttggcttggaagagaaaccgataaacactcccgtgctagt

SEQ ID NO: 5306 - DNA, 50 bp, Homo sapiens
aaacagcagaaaagtaatttctggtgaactgatgagaattccctattgca

SEQ ID NO: 5307 - DNA, 50 bp, Homo sapiens
aggttgttttggaaaaattatttgttttgtcctaaggggtcctgcccacc

SEQ ID NO: 5308 - DNA, 52 bp, Homo sapiens
cctccggaacgtttttaaaaaggaaaaagcccgggttttcccttgggaaaaa

SEQ ID NO: 5309 - DNA, 50 bp, Homo sapiens
cagacctgtgggctgattccagactgagagttgaagttttgtgtgcatca

SEQ ID NO: 5310 - DNA, 50 bp, Homo sapiens
accaagtttgaatttgtcaaatcccaagtcaatccaggatgttcatttct

SEQ ID NO: 5311 - DNA, 50 bp, Homo sapiens
agtgatctgcctttcagcaactgtcttattttggttctttgaaactgtga

SEQ ID NO: 5312 - DNA, 50 bp, Homo sapiens
tttgaatggctgaagctaaggcaacgttagtttctccttactctgctttt

SEQ ID NO: 5313 - DNA, 50 bp, Homo sapiens
acctttgtgattctgtctagtgaaaatgggacatttttaatagtgccaga

SEQ ID NO: 5314 - DNA, 50 bp, Homo sapiens
gaacttgcccctaaactgggttaaatggaccctgttgagttttctggaca

SEQ ID NO: 5315 - DNA, 50 bp, Homo sapiens
taaattgggcaaagttttttatggaatttccggggcaaggttttgggggc

SEQ ID NO: 5316 - DNA, 50 bp, Homo sapiens
aaatctcatttgcaagttctcccattaagcaagggagtagtttactagga

SEQ ID NO: 5317 - DNA, 50 bp, Homo sapiens
aagaaaggcccataacagatggcaaaatagaggattggtgagggatatgc

SEQ ID NO: 5318 - DNA, 50 bp, Homo sapiens
aaaaccattccagcttaatgcctttaattttaatgccaacaaaattgggg

SEQ ID NO: 5319 - DNA, 50 bp, Homo sapiens
tgcaaccttcttaaaatgtgggctactggagatcatgccactgcactcca

SEQ ID NO: 5320 - DNA, 50 bp, Homo sapiens
agctcagatgggtccccaaaagaggcataggaaagcgcgacctcactgcc

SEQ ID NO: 5321 - DNA, 50 bp, Homo sapiens
caaataaaaaggctggggccaaaggtgggcaccaaaagtcctcctatgtg

SEQ ID NO: 5322 - DNA, 50 bp, Homo sapiens
tgcagctcccatttcctgagcgtctaccaggtactaggagaactcttaca

SEQ ID NO: 5323 - DNA, 50 bp, Homo sapiens
attatccttttccccaggaagccctcggcccccaaaaagggaaacagttt

SEQ ID NO: 5324 - DNA, 50 bp, Homo sapiens
catgagcccaggggtttcatgacaaacattactagcatgttcaactgccc

SEQ ID NO: 5325 - DNA, 50 bp, Homo sapiens
gcccggtttatggaaaaaccaggaccagtttatgtttggggttttgggaa

SEQ ID NO: 5326 - DNA, 50 bp, Homo sapiens
gcttggtactgtcatagtgattacaaatttcatggaatgcgaagagcaac

SEQ ID NO: 5327 - DNA, 50 bp, Homo sapiens
ttttctcccctctcttccccttccacgaactgcaataccagtaaccttgg

SEQ ID NO: 5328 - DNA, 50 bp, Homo sapiens
aagcccagatacacaaaattccaccccatgatcaagaatcctgctccact

SEQ ID NO: 5329 - DNA, 50 bp, Homo sapiens
catgtgttgactctgtaatggatttatgtagcccacttcagtctgcaaat

SEQ ID NO: 5330 - DNA, 50 bp, Homo sapiens
aggggtgtcccttttccccttcatgtaaaattctaactggggctaccagt

SEQ ID NO: 5331 - DNA, 50 bp, Homo sapiens; identical to SEQ ID NO: 4387

SEQ ID NO: 5332 - DNA, 50 bp, Homo sapiens
tgaagaaactgccctttctgtgatgtttttgaatactacccaacagccaa

SEQ ID NO: 5333 - DNA, 50 bp, Homo sapiens
cttcctagccctaagtttggcctttgggtggctccaaaaaggattaggtt

SEQ ID NO: 5334 - DNA, 50 bp, Homo sapiens
tccccctcgttttgtagggtttgtacataataaaacaatggggtggggcc

SEQ ID NO: 5335 - DNA, 50 bp, Homo sapiens
tgttaagtgtgaggttttctgaacccttagcagaaggacttttaatgttt

SEQ ID NO: 5336 - DNA, 50 bp, Homo sapiens
agttccactgctgttcctcttaccttgattaaatgcctatgcatgtactt

SEQ ID NO: 5337 - DNA, 50 bp, Homo sapiens
agttctgttgtgtaatctggtgctggttccctgggcatatgtattctgtg

SEQ ID NO: 5338 - DNA, 50 bp, Homo sapiens
cccccttgcttggttttaagtaggtatggaatgttattataggccatagt

SEQ ID NO: 5339 - DNA, 50 bp, Homo sapiens
tcagtgtaaacataattaggccgtgagtttttgctcttactcccaggttt

SEQ ID NO: 5340 - DNA, 50 bp, Homo sapiens
tgtaaacttgttttaacaactcttttcaacattttggccggggtattccc

SEQ ID NO: 5341 - DNA, 50 bp, Homo sapiens
tgctgaaagtggtcccaaaggggtactagtttttaagctcccaactcccc

SEQ ID NO: 5342 - DNA, 50 bp, Homo sapiens
ttcccagttgccacagaccgtttatatgaagaaatgctaaagaagttccc

SEQ ID NO: 5343 - DNA, 50 bp, Homo sapiens; identical to SEQ ID NO: 4387

SEQ ID NO: 5344 - DNA, 51 bp, Homo sapiens
agttctaaagccgggaattcctaaggatatactaaatgagattatgtgtgg

SEQ ID NO: 5345 - DNA, 50 bp, Homo sapiens
gcctgggggaggagaagtcccttcccattccagctcgatcaatcttgctg

SEQ ID NO: 5346 - DNA, 50 bp, Homo sapiens
ggagtagagagagtcttgctacatgcgggaactagaattacatcactgcg

SEQ ID NO: 5347 - DNA, 50 bp, Homo sapiens
aagaagtttcattgatatccactggtcacatcatacctgtctatagggca

SEQ ID NO: 5348 - DNA, 50 bp, Homo sapiens
tgcttcaagcacaggatttatggaatagttggcaaattaaacaacatgct

SEQ ID NO: 5349 - DNA, 50 bp, Homo sapiens
cggcagccttatggaatgagtttcttgtcatgaatgttgtccccaaagct

SEQ ID NO: 5350 - DNA, 50 bp, Homo sapiens
acagttactttggagctgctagactggttttctgtgttggtaaattgcct

SEQ ID NO: 5351 - DNA, 50 bp, Homo sapiens
tgtgaagaatccctaccattaataccctgggtgggataaataaaaatggg

SEQ ID NO: 5352 - DNA, 50 bp, Homo sapiens
cccaaaatttgtttaaagttccgacttccaaaaggggccaataaaaaggg

SEQ ID NO: 5353 - DNA, 51 bp, Homo sapiens
caccgcctctgcctccgcctcttccactggagagcccgaggtcaaaaggtc

SEQ ID NO: 5354 - DNA, 50 bp, Homo sapiens
ccctcacctagcagtactaccacaataatgctatcatggtgccagggaat

SEQ ID NO: 5355 - DNA, 50 bp, Homo sapiens
tctccttccccattgggccgcctttatcaattgcctgttttgttttgttt

SEQ ID NO: 5356 - DNA, 50 bp, Homo sapiens
tttttatctttcttggtgggggtgtggtggtggtgaagaggacctaaaaa

SEQ ID NO: 5357 - DNA, 50 bp, Homo sapiens
cgccagaggtcagaacatgtctattttgaattggatcgttacaaatgagc

SEQ ID NO: 5358 - DNA, 50 bp, Homo sapiens
gcaggcactgacatttttgagcaaagacgtgatgttatgagataaatatc

SEQ ID NO: 5359 - DNA, 50 bp, Homo sapiens
ttctgacacgattacacaacgaggctttaatgccatttgggtaggtgagc

SEQ ID NO: 5360 - DNA, 51 bp, Homo sapiens
ttttaaaggggaggggccggggtttggtccccggtcccaaaggtaaaagtt

SEQ ID NO: 5361 - DNA, 50 bp, Homo sapiens
gagtgagaagaggcttttaaggaccatgtgaagaggcttttaaacacttt

SEQ ID NO: 5362 - DNA, 50 bp, Homo sapiens
gggttgggataaactgcttagatgtttgcctacttgtccagtgaaattac

SEQ ID NO: 5363 - DNA, 50 bp, Homo sapiens
actgaaaagttgaaagacttttgcagtgaacatttatataactccccgct

SEQ ID NO: 5364 - DNA, 50 bp, Homo sapiens
attcataggtagtgcccagagagagtacaagctctgactcatatggcagt

SEQ ID NO: 5365 - DNA, 50 bp, Homo sapiens
acatgttacctggagtagctgtgtcaacagattaatatggaatgctacta

SEQ ID NO: 5366 - DNA, 50 bp, Homo sapiens
tggttcctgtgctcaccatagggctggtgtacattgggccattaataaac

SEQ ID NO: 5367 - DNA, 50 bp, Homo sapiens
acagatccctattgccagacacatcattctctccatccagaaagcaaaca

SEQ ID NO: 5368 - DNA, 50 bp, Homo sapiens
tctgggaaagacatttttaagctgctgacttcacctgcaaaatctaacag

SEQ ID NO: 5369 - DNA, 50 bp, Homo sapiens
agtcacgataaacctggtcacctgaaaattgaaattgagccacttccttg

SEQ ID NO: 5370 - DNA, 50 bp, Homo sapiens
aaactggcggcccaacaaaacagtgggttaaatgggtccctgggtgacat

SEQ ID NO: 5371 - DNA, 50 bp, Homo sapiens
agtgtttcctccacatctaaagaaagcccattttgaaactggatactgca

SEQ ID NO: 5372 - DNA, 50 bp, Homo sapiens
cccaggtggcccctctccatcagatgttattgctcttccccatttattta

SEQ ID NO: 5373 - DNA, 50 bp, Homo sapiens
aagatgcctaagcgttaaccaggtgaaacaggggtgggagagagaaagaa

SEQ ID NO: 5374 - DNA, 50 bp, Homo sapiens
gtcatacacctatcccccattttcctcctatccctcaacccggacatcat

SEQ ID NO: 5375 - DNA, 50 bp, Homo sapiens
gcaggtggcagaatggggtgcatgaaggtttctgaaaattaacactgctt

SEQ ID NO: 5376 - DNA, 50 bp, Homo sapiens
acagagaggcagcatttgttttccagttaaaatttgacctcactgtgatt

SEQ ID NO: 5377 - DNA, 50 bp, Homo sapiens
cccccttttgttgtggttttatattggaaccccctttttctttggaacta

SEQ ID NO: 5378 - DNA, 50 bp, Homo sapiens
ctgaccccttcctcacccctgccaacagtggtggcatatatcacaaatgg

SEQ ID NO: 5379 - DNA, 50 bp, Homo sapiens
tgttttacctcactgttggacatacattccaagcttttcaactctaggag

SEQ ID NO: 5380 - DNA, 50 bp, Homo sapiens
cagaacatgcccaaagaagcctatatcttgctgctgggaaatgtaaagca

SEQ ID NO: 5381 - DNA, 50 bp, Homo sapiens
caaacaccggcagttgaaaggaaaaggacggggaatgtgatggaaaagag

SEQ ID NO: 5382 - DNA, 50 bp, Homo sapiens
ccccctccctgccccggtgagctttggggaacccaaaaattagattttgc

SEQ ID NO: 5383 - DNA, 50 bp, Homo sapiens
cccaaatccaaggaccaatgctgttgtaaacaaggggtaaagggcctaaa

SEQ ID NO: 5384 - DNA, 50 bp, Homo sapiens
actccaccaagactgtgaactccaccggggtaggaagcatattttactca

SEQ ID NO: 5385 - DNA, 50 bp, Homo sapiens
gagaactcgtttcaaggaactcgatgtttccggggaccaagcccgcccag

SEQ ID NO: 5386 - DNA, 50 bp, Homo sapiens
ccagcgaatttccagcttttgaaactcagatttccttttgcgacccaggt

SEQ ID NO: 5387 - DNA, 50 bp, Homo sapiens
gatgcgcggcaagaatgtacctgtagatgtgtacataccacagtgctgta

SEQ ID NO: 5388 - DNA, 50 bp, Homo sapiens
tttatctcagaatcttgatgaactctgaaatgacccctgatgggggcatg

SEQ ID NO: 5389 - DNA, 50 bp, Homo sapiens
ggccccctgtccttacctgttttcggcccccttaattttttaaccccggg

SEQ ID NO: 5390 - DNA, 50 bp, Homo sapiens
gtcacagtgtagacacatggtgcttccatagtgagtagaatatccattgt

SEQ ID NO: 5391 - DNA, 50 bp, Homo sapiens
gtggcctggcctggctctcacagacccaaggcttccgtgtagaatatgtc

SEQ ID NO: 5392 - DNA, 50 bp, Homo sapiens
ggattgtggcaggaactgtttcccctcccagccttaaatttttctgtgtt

SEQ ID NO: 5393 - DNA, 50 bp, Homo sapiens
aaacccacacctcagtgaatttaaaagagtagatgttttaaaagaccgga

SEQ ID NO: 5394 - DNA, 51 bp, Homo sapiens
tgccatttggtattttttcctgaaacattacataataagaatgcagcatgc

SEQ ID NO: 5395 - DNA, 50 bp, Homo sapiens
gcctgaaaccatcctgccttctaggaagacagcaattctggaagagcaag

SEQ ID NO: 5396 - DNA, 50 bp, Homo sapiens
ggtggttccccagcccttttccctggccctgggttggaaaatttgttttc

SEQ ID NO: 5397 - DNA, 51 bp, Homo sapiens
aaaacctttcgcccggcttaaaatttaccggggtttggttttatttggttt

SEQ ID NO: 5398 - DNA, 50 bp, Homo sapiens
ctccttggtgtcatgcaactgaggaacctaattggctgggtgggttgttc

SEQ ID NO: 5399 - DNA, 50 bp, Homo sapiens
gtttgtaaaagaacctgccacatttgttgaaaagttagagccatcacagc

SEQ ID NO: 5400 - DNA, 50 bp, Homo sapiens
ctcttggctgctggccttttgttcttgtcatggctcattagctccctaaa

SEQ ID NO: 5401 - DNA, 50 bp, Homo sapiens
ccaggggtttttaaattttctgaagtttttggggccattttggttgttgg

SEQ ID NO: 5402 - DNA, 50 bp, Homo sapiens
ccccgcttgccttttatttcagaaccccaagtattacccaatatgttaca

SEQ ID NO: 5403 - DNA, 50 bp, Homo sapiens
gccgaagctcacagaggctaagttacacgcttaggtgttcttattcctac

SEQ ID NO: 5404 - DNA, 50 bp, Homo sapiens
aaccaggtttatgatgctgtaataaaccatggcattaaagagggcaagag

SEQ ID NO: 5405 - DNA, 50 bp, Homo sapiens
gggttaaggagggccgctccaaaattttcctttttcccaggaagcccttg

SEQ ID NO: 5406 - DNA, 50 bp, Homo sapiens
atgctgtgagtggtacacatggctgaggttatgatctgttaaaatatgta

SEQ ID NO: 5407 - DNA, 50 bp, Homo sapiens
ttcattaattcctcaacccaatactgtctggcttccaccaacaggagcgg

SEQ ID NO: 5408 - DNA, 50 bp, Homo sapiens
tggtttctattttaaaaacctgggttaggccaaggtttggggttcgccct

SEQ ID NO: 5409 - DNA, 50 bp, Homo sapiens
caacattgcctaccagttgcagttcattagccccgtccgccccagcattg

SEQ ID NO: 5410 - DNA, 50 bp, Homo sapiens
cctttggggtgggggctttttcctttttggccggttcaattaaggttttt

SEQ ID NO: 5411 - DNA, 50 bp, Homo sapiens
cccactccggctgttttagaagttttcccgaatccgtgatccctttacaa

SEQ ID NO: 5412 - DNA, 50 bp, Homo sapiens
aatgggcaaattttacccaaaacttaagcttgcctattccgtttgaggca

SEQ ID NO: 5413 - DNA, 50 bp, Homo sapiens
gaaggagaggcacacacaaatacacacactcacacaaaactcaacaacca

SEQ ID NO: 5414 - DNA, 50 bp, Homo sapiens
ggataccccctttatcccgagggaatttttaccctttggatgcctttaaa

SEQ ID NO: 5415 - DNA, 50 bp, Homo sapiens
caaattacaaacctaaaaatacagaacatcagcggagaagacaggagagc

SEQ ID NO: 5416 - DNA, 50 bp, Homo sapiens
ctcctcccttgggtgggacctgggttgggggtttgatagaaaaattaacc

SEQ ID NO: 5417 - DNA, 50 bp, Homo sapiens
ggttaaactagatccctgcaaggccatcacctccattccaagttgttact

SEQ ID NO: 5418 - DNA, 50 bp, Homo sapiens
agtgggttattttagatcttttcctggggttcaggtcacatagcttaact

SEQ ID NO: 5419 - DNA, 50 bp, Homo sapiens
tgtttgggtatattgtttgggttttgggcactaggatgggtgactcaggg

SEQ ID NO: 5420 - DNA, 50 bp, Homo sapiens
gccagtgaatctagttttggctattctgtattttgtccagtttttcccat

SEQ ID NO: 5421 - DNA, 50 bp, Homo sapiens
aaccattttcccccgggaacccgttttgcctggtttcggattttttaccc

SEQ ID NO: 5422 - DNA, 50 bp, Homo sapiens
ccgggaagcggggtactggctgtgtttaatcattaaaggtaccgtgtccg

SEQ ID NO: 5423 - DNA, 50 bp, Homo sapiens
tttttccccctcccaaattcactgcattacagtttttgaaacagaacggg

SEQ ID NO: 5424 - DNA, 50 bp, Homo sapiens
tacgagaagtcaggaagttttgaaatggcagtgacaggagacgggggaag

SEQ ID NO: 5425 - DNA, 50 bp, Homo sapiens
aagggcaggcaaatcaattaaaattagccgtaacaacaacctcgggggtg

SEQ ID NO: 5426 - DNA, 50 bp, Homo sapiens
agtacacggccctcaaaagttatatgtgctgaatgtaacctacttagcga

SEQ ID NO: 5427 - DNA, 51 bp, Homo sapiens
ttgttttaacaactcttctcaacattttgtccaggttattcactgtaacca

SEQ ID NO: 5428 - DNA, 50 bp, Homo sapiens
cttctccacctcggccaggtatagggccagcttctcgtctctgggatccg

SEQ ID NO: 5429 - DNA, 50 bp, Homo sapiens
gccaggtcattgtatagggagtaagatgaaggtgaatttgcagctagttg

SEQ ID NO: 5430 - DNA, 50 bp, Homo sapiens
tgtgttttgtttttctggtcccagggcaccgtttgttttgtgaactcctc

SEQ ID NO: 5431 - DNA, 50 bp, Homo sapiens
catggctctaaaatttggaattaacttctcttgccttaagagctgcttgt

SEQ ID NO: 5432 - DNA, 50 bp, Homo sapiens
gctggtgggaagttgagccatgtttatctctagtggaatccttaccttgt

SEQ ID NO: 5433 - DNA, 50 bp, Homo sapiens
catgtttacacaaattccttcaaagccccttaaacatggggccgggcccc

SEQ ID NO: 5434 - DNA, 50 bp, Homo sapiens
accctaatagctaggctgggtatattttcaaagtgtagcgaaaccccacg

SEQ ID NO: 5435 - DNA, 50 bp, Homo sapiens
cagttggcctcctacaattgggaattctaccaagctccaagttgacctgg

SEQ ID NO: 5436 - DNA, 50 bp, Homo sapiens
ggattcccgacaaaggcttgatgtgtacttgaagtgagcaaagggttttg

SEQ ID NO: 5437 - DNA, 50 bp, Homo sapiens
gggtgggagacaggctaatcctttccccttgttttccacgtctttatgac

SEQ ID NO: 5438 - DNA, 51 bp, Homo sapiens
acaaccttcttaatatattagagacccgcaggaaacatttagtggtgaaac

SEQ ID NO: 5439 - DNA, 51 bp, Homo sapiens
gtacatgtttgtgtgctaaattgctcatttggcagtgatagattgaaaaac

SEQ ID NO: 5440 - DNA, 50 bp, Homo sapiens
gggggtcaaagagggtacaaatgtatgggggtatattgaatgctaaacat

SEQ ID NO: 5441 - DNA, 50 bp, Homo sapiens
gggagcccgttttagaaggaagggcaaaagtagggtttttaacccaaacg

SEQ ID NO: 5442 - DNA, 50 bp, Homo sapiens
tccgtcccattcccccggaaaacaaggttttgaattggcccgtaaaaggg

SEQ ID NO: 5443 - DNA, 50 bp, Homo sapiens
acgtccttatacaatgcactgtttgatttttaaacaatacctgaagggct

SEQ ID NO: 5444 - DNA, 50 bp, Homo sapiens
actcaatactcgggaaaggcttcacatttctgggactcagcattatccaa

SEQ ID NO: 5445 - DNA, 50 bp, Homo sapiens
ttgagaggcaacacttaaacactagggctactgtggcatctatgtagaca

SEQ ID NO: 5446 - DNA, 50 bp, Homo sapiens
agccctttcttgttgctgtatgtttagatgctttccaatcttttgttact

SEQ ID NO: 5447 - DNA, 50 bp, Homo sapiens
ggggtatggtttagtaatatccaccagaccttccgatccagcagtttggt

SEQ ID NO: 5448 - DNA, 50 bp, Homo sapiens
aacaacaacagcaaaatccccttagtgcgtaacttgaaattcccttcggc

SEQ ID NO: 5449 - DNA, 50 bp, Homo sapiens
ttgtaagtgggtgcataagaagatctcttcaattaaatgcccccgctggt

SEQ ID NO: 5450 - DNA, 50 bp, Homo sapiens
ataattaagaaatcagccgtgtgcttctcacgtttgggctccgagacgtg

SEQ ID NO: 5451 - DNA, 50 bp, Homo sapiens
gtcagtctcctcacctgcctctgctcctcgcttagcccattgattgcatc

SEQ ID NO: 5452 - DNA, 50 bp, Homo sapiens
gggaagaagcccgtgcccccacccaataaatgttggttttggccctgatg

SEQ ID NO: 5453 - DNA, 50 bp, Homo sapiens
cagaacttctggcgaaggccatgtaagaactactccaaggaggaagaggc

SEQ ID NO: 5454 - DNA, 50 bp, Homo sapiens
ctctaccataaggcactatcagagactgctactggagtgtatatttggtt

SEQ ID NO: 5455 - DNA, 50 bp, Homo sapiens
actgctacagcttaaccattgttccaagctaattaaattacctttgggga

SEQ ID NO: 5456 - DNA, 50 bp, Homo sapiens
caattgtgatttggaaggtttaactgggtctgcccagatgtttacgaata

SEQ ID NO: 5457 - DNA, 50 bp, Homo sapiens
tccaagcaaaagttatgcaataagacagaatataaagtctccgagagcct

SEQ ID NO: 5458 - DNA, 50 bp, Homo sapiens
gggtggggtggggtgagagtgtgtggagtaaggaccttcagaattaatat

SEQ ID NO: 5459 - DNA, 51 bp, Homo sapiens
tgcagttcttattttcttttgcctgtgataattgcaaatccgtcaatagaa

SEQ ID NO: 5460 - DNA, 50 bp, Homo sapiens
tgcaagtttctgagactgtgaaaagtgttttgcttcttttgttacccaat

SEQ ID NO: 5461 - DNA, 50 bp, Homo sapiens
tcccagcgaatgtgaatcatttagtgtgctactcaaaattaggtgtccac

SEQ ID NO: 5462 - DNA, 50 bp, Homo sapiens
taagatgtaggggccaccggccagcagtacccagcaatgaccactatcag

SEQ ID NO: 5463 - DNA, 50 bp, Homo sapiens
ataaatgaaagcataccaagtgctgtccattccataggtacaactatgga

SEQ ID NO: 5464 - DNA, 50 bp, Homo sapiens
ctggtattctgaggtcagatgtaggctgttgctcgctccggctgggtctc

SEQ ID NO: 5465 - DNA, 50 bp, Homo sapiens
ccatcgggggtattggggttttgggctgaatttacttgattattggaaaa

SEQ ID NO: 5466 - DNA, 50 bp, Homo sapiens
gccagattgtggcaggtaaagagacaatgtaatttgcactccctatgata

SEQ ID NO: 5467 - DNA, 50 bp, Homo sapiens
tttaaaaaggagggaggatttctgggttaaaacttttatttggcccccat

SEQ ID NO: 5468 - DNA, 50 bp, Homo sapiens
taaaacccaagacttcagattcagccgaattgtggtgtttcacaaggccg

SEQ ID NO: 5469 - DNA, 50 bp, Homo sapiens
ctaagcatggggaagggggcagagtgaggactgtgccattgattaaagtg

SEQ ID NO: 5470 - DNA, 50 bp, Homo sapiens
gtacagaaacatattccatgctttgaaataaagggaagtgctctcctgtt

SEQ ID NO: 5471 - DNA, 50 bp, Homo sapiens
gaagccttttcttttctgttcaccctcaccaagagcacaacttaaatagg

SEQ ID NO: 5472 - DNA, 51 bp, Homo sapiens
accgatcgtttttaggataatatgcatgtttcaagtggtattgaaaccccc

SEQ ID NO: 5473 - DNA, 50 bp, Homo sapiens
tgagggacaggctgcctaaagtctaattggagagttaacctaatgtctgt

SEQ ID NO: 5474 - DNA, 50 bp, Homo sapiens
caccatcgtggctctgagaactgacgccgtgaatgttgacctgagtgccg

SEQ ID NO: 5475 - DNA, 50 bp, Homo sapiens
ggggagagaccaccctagacatttgcatttttgtaagttagccagccaat

SEQ ID NO: 5476 - DNA, 50 bp, Homo sapiens
tggataaatctgagcaactttcttctttgtgctccaggaacctacgcact

SEQ ID NO: 5477 - DNA, 50 bp, Homo sapiens
tgtgggttttgattgacatactgttgttcatgctgaagtttgagtgtcgt

SEQ ID NO: 5478 - DNA, 50 bp, Homo sapiens
ggtgtgcagtccgcctgaaagccttccctttagctattaggaattgagtc

SEQ ID NO: 5479 - DNA, 53 bp, Homo sapiens
acattggaaagaaaccctacaactgtaatgaatatgaaaagaattgtctaaaa

SEQ ID NO: 5480 - DNA, 50 bp, Homo sapiens
aaaaccgttttccccatacataaagaacaggggtactcccgccctgatgg

SEQ ID NO: 5481 - DNA, 50 bp, Homo sapiens
tttggtgaagtgaaagagagaagttgctctaaaaggttggaaaccagccc

SEQ ID NO: 5482 - DNA, 50 bp, Homo sapiens
tggactgttgtaatgttttgcgttatcaaaatgaaaactgccaaatgaga

SEQ ID NO: 5483 - DNA, 50 bp, Homo sapiens
gctttgagttttgggatggtcacatgacacaatccagcacttgaacctga

SEQ ID NO: 5484 - DNA, 50 bp, Homo sapiens
agagccattcccacaaagtaaatgtgcagtgcccatgtttcttgtgttta

SEQ ID NO: 5485 - DNA, 50 bp, Homo sapiens
gactctgagagagagcgacggccatcatagaacagcgaaggcagtcgatc

SEQ ID NO: 5486 - DNA, 50 bp, Homo sapiens
atcgatgagaagagtctgcaaaacacttcatcctcaggacgtgctgtcct

SEQ ID NO: 5487 - DNA, 50 bp, Homo sapiens
atatattaaaccacaggtattagagacatgaattgcacccaacacaagct

SEQ ID NO: 5488 - DNA, 50 bp, Homo sapiens
attcattcgggtcttcctttcttccgcccccttccttccattggcacctc

SEQ ID NO: 5489 - DNA, 50 bp, Homo sapiens
tcagttttgtggaatctggtgtttgcactataggttaagagttgccattt

SEQ ID NO: 5490 - DNA, 50 bp, Homo sapiens
tgtgtggtgggggtgcttttgaggttggaggaaagtagagacagcgaaac

SEQ ID NO: 5491 - DNA, 50 bp, Homo sapiens
tgtgctttttgcccaagtggtaattcatcttggtttgctatgttaaaact

SEQ ID NO: 5492 - DNA, 50 bp, Homo sapiens
ctttggggacctaaaccccaggtggtctcttggtgttaataatgctggaa

SEQ ID NO: 5493 - DNA, 50 bp, Homo sapiens
aaatcgcggtcgccttaatccaagcctaggttttcacacttttagtaagc

SEQ ID NO: 5494 - DNA, 50 bp, Homo sapiens
tggggcactttgaaaacttcacaggcccactgctgcttgctgaaataaaa

SEQ ID NO: 5495 - DNA, 50 bp, Homo sapiens
gacattcatctgtttccactgagtctgagtcttcaagttttcactccagc

SEQ ID NO: 5496 - DNA, 50 bp, Homo sapiens
tggcgaggataaatagaggcattgtttttgctactttgcatatcattggc

SEQ ID NO: 5497 - DNA, 50 bp, Homo sapiens
tggctctcctctttgtaatatacagggtgaactctttactgatacacaca

SEQ ID NO: 5498 - DNA, 50 bp, Homo sapiens
ccagtgtcctgcatgggtgctaggctgaattatttgtaattgtgcttagg

SEQ ID NO: 5499 - DNA, 50 bp, Homo sapiens
accgtcttttgtgattccctggaaacccttaattcaatagtcctgactga

SEQ ID NO: 5500 - DNA, 50 bp, Homo sapiens
agccctgggtagccaagtgattttcccattcccaaagttagtaaaccttt

SEQ ID NO: 5501 - DNA, 50 bp, Homo sapiens
gcaggaaagatggggtggtggactgtttttgcctactttttgtttttgaa

SEQ ID NO: 5502 - DNA, 50 bp, Homo sapiens
ccccctgaaactggcattttgtaaatgtggtttgactatttttgtatgtt

SEQ ID NO: 5503 - DNA, 50 bp, Homo sapiens
acctggagaattccctaaggccaaagcaaggtaacagggacttcagtttt

SEQ ID NO: 5504 - DNA, 50 bp, Homo sapiens
gcctcagtacaaagggggctttggaagtgtttgttggctgaataaaggaa

SEQ ID NO: 5505 - DNA, 50 bp, Homo sapiens
acccatgccaattgaagaacgtgttaaagatgaggaggagagatgtacca

SEQ ID NO: 5506 - DNA, 50 bp, Homo sapiens
gcacattccttccttatatcctggaagcacccagatattcttcatgtccc

SEQ ID NO: 5507 - DNA, 50 bp, Homo sapiens
ttaagtcatctgctgagcagtgtgctgtgtcaacctcctcctaggtaacc

SEQ ID NO: 5508 - DNA, 50 bp, Homo sapiens
cagggtatcagatattgtgccttttggtgccaggttcaaagtcaagtgcc

SEQ ID NO: 5509 - DNA, 50 bp, Homo sapiens
tggtaatagtgtttgactccagggaagaacagatgggtgccagagtgaaa

SEQ ID NO: 5510 - DNA, 50 bp, Homo sapiens
tcaagtataccatttaaaatatttcatcaggcagagccctgaccaggaaa

SEQ ID NO: 5511 - DNA, 50 bp, Homo sapiens
cttttccggttgcccgaggatgcttgggaaggaacccgtctcccttcttc

SEQ ID NO: 5512 - DNA, 50 bp, Homo sapiens
tccccaaacccccttaaaggtttttaaattgtttcaaatctgggcaagtt

SEQ ID NO: 5513 - DNA, 50 bp, Homo sapiens
gactcggagagccaggaggagaacacgcagctctgaactggctgagcgag

SEQ ID NO: 5514 - DNA, 50 bp, Homo sapiens
ctgttgtgaatcatttgtgtccttttcaactgtctttcagaggaaaggta

SEQ ID NO: 5515 - DNA, 50 bp, Homo sapiens
aagaagcaaccacagctaattttagaacatgcactctgacagaaaagaca

SEQ ID NO: 5516 - DNA, 50 bp, Homo sapiens
gcttttgaggacctttctggaggaaaggaaaagcctgttttggggagtct

SEQ ID NO: 5517 - DNA, 50 bp, Homo sapiens
aggctgcatatggattgccaagtcagcatatgaggaattaaagacattgt

SEQ ID NO: 5518 - DNA, 50 bp, Homo sapiens
aagactagagctacactaggccactatcttattacacgacagcacaacat

SEQ ID NO: 5519 - DNA, 50 bp, Homo sapiens
ttaagaaccccaaagattaaaggaaacaatgttaagggcttttgtgagga

SEQ ID NO: 5520 - DNA, 50 bp, Homo sapiens
cggaagtcgaaatcaaatctatgcttttaattgaaaccgtgcctgaaacg

SEQ ID NO: 5521 - DNA, 50 bp, Homo sapiens
tcttcaccaggttcaagctccgtgggccacactgctgctgtgccaagaag

SEQ ID NO: 5522 - DNA, 50 bp, Homo sapiens
gatacactgtccagcccaggtccaggccctaggttctttactctagctac

SEQ ID NO: 5523 - DNA, 50 bp, Homo sapiens
tggaatttactaaattgtgaaattaacgtaaccgaagcaacaaccggcaa

SEQ ID NO: 5524 - DNA, 50 bp, Homo sapiens
gcgggaggctgggactttccattacaaatagagacttcattcctgttgag

SEQ ID NO: 5525 - DNA, 50 bp, Homo sapiens
actcaggtggtgctggtgttagtgatgctggagaagagaatattactggt

SEQ ID NO: 5526 - DNA, 50 bp, Homo sapiens
caggttgctttcgtgtccctcttctggttgctttagaagtgacgtgtaat

SEQ ID NO: 5527 - DNA, 50 bp, Homo sapiens
aaacacagcccaccccatttcagaccgccttcctgaggagaaaatgacag

SEQ ID NO: 5528 - DNA, 50 bp, Homo sapiens
gctaactggataaagtttgtgcagacattcctgagtgtacgatattgacc

SEQ ID NO: 5529 - DNA, 50 bp, Homo sapiens; identical to SEQ ID NO: 5528

SEQ ID NO: 5530 - DNA, 50 bp, Homo sapiens
agctggcttcactgctcaggtgattatcctgaaccaccaggccaaataag

SEQ ID NO: 5531 - DNA, 50 bp, Homo sapiens
agtcaggactgtctaggtcagggaagccaagatgtctgaagagagaggaa

SEQ ID NO: 5532 - DNA, 50 bp, Homo sapiens
attcaaccagtaatggtacctgaggaattgaaatgggtatttgtttctgt

SEQ ID NO: 5533 - DNA, 50 bp, Homo sapiens
agtggagaggccctgttagtttacttttcatattgagtgatgcatgaggt

SEQ ID NO: 5534 - DNA, 50 bp, Homo sapiens
gcattctatttaaaaagggagtggggagcaaatgaaaattaaatgtgggg

SEQ ID NO: 5535 - DNA, 50 bp, Homo sapiens
tcaccaggaaaacatgcttgtgaattgtgcagtaaaaggtggtaatgact

SEQ ID NO: 5536 - DNA, 50 bp, Homo sapiens
ccttttctctcccatgaccctttaacagcatctgcttcattcccctcacc

SEQ ID NO: 5537 - DNA, 50 bp, Homo sapiens; identical to SEQ ID NO: 1754

SEQ ID NO: 5538 - DNA, 50 bp, Homo sapiens
tgagtgaacaaagctgtgaaacattctgcgtttatgcaacttccttgcct

SEQ ID NO: 5539 - DNA, 50 bp, Homo sapiens
caagaagacaagcatctgtggtgcggaggcaagcaggctaactaggagtt

SEQ ID NO: 5540 - DNA, 50 bp, Homo sapiens
ttggcccagtgtgattgattgctttatctttggtacttttacttgaatgg

SEQ ID NO: 5541 - DNA, 50 bp, Homo sapiens
catccagcactaattttcatgcatttatgaaaggatgcctgaggaccctt

SEQ ID NO: 5542 - DNA, 50 bp, Homo sapiens
agcctgaggcaaataaaattccagtaatttcgaagaatgggtgttggcaa

SEQ ID NO: 5543 - DNA, 50 bp, Homo sapiens
aggaccttgacaagccgtttgagatggaatgtaggccctgatgttatgct

SEQ ID NO: 5544 - DNA, 50 bp, Homo sapiens; identical to SEQ ID NO: 5543

SEQ ID NO: 5545 - DNA, 50 bp, Homo sapiens
agtggagtgtttacaccttgctgtaacatttgaactttcacaagagatgt

SEQ ID NO: 5546 - DNA, 50 bp, Homo sapiens
atatcatattatttgatgccattaggcggcctggatcaccaattctaagt

SEQ ID NO: 5547 - DNA, 50 bp, Homo sapiens
gccaccagacagaaggaccagagtttctgattataaacaatgatgctggg

SEQ ID NO: 5548 - DNA, 50 bp, Homo sapiens
tgttggtgagcaatgtgcagaggcagagccgctgaagtatggttcctgag

SEQ ID NO: 5549 - DNA, 50 bp, Homo sapiens
ggctgctgttgactgaaattcctatcctcaaattactctagactgaagct

SEQ ID NO: 5550 - DNA, 50 bp, Homo sapiens
ctttttagtaggcaaaggttcttcttcctcctcttttggtgcagggacgc

SEQ ID NO: 5551 - DNA, 50 bp, Homo sapiens
gcgtgtatgtgggatgccataggtgtgactgtagagtcattcttccttcc

SEQ ID NO: 5552 - DNA, 50 bp, Homo sapiens
tgtaagttgactttcaaaagtctctggaaacactggactttagctggtcc

SEQ ID NO: 5553 - DNA, 50 bp, Homo sapiens
gaagcgtggcagagaactatggatcaggcagcccctctcatctttaccat

SEQ ID NO: 5554 - DNA, 50 bp, Homo sapiens
ttggtccaaactctggagccttgtgggagaacatagggcataacgtgttt

SEQ ID NO: 5555 - DNA, 50 bp, Homo sapiens
cccttcttagtaaagagacatcttctacagtaaccacagagaagaagtgg

SEQ ID NO: 5556 - DNA, 50 bp, Homo sapiens
tggacataacctgggtcagaagagaaacttttgaagctacacgaacaagc

SEQ ID NO: 5557 - DNA, 50 bp, Homo sapiens
cggctcaaataaacctttaccggatttttggggttatgcccacacccttg

SEQ ID NO: 5558 - DNA, 50 bp, Homo sapiens
ggaccactagtactccagaaccataatataactagacatgcctggaatgc

SEQ ID NO: 5559 - DNA, 50 bp, Homo sapiens
aacaagccatgtttgccctagtccaggattgcctcacttgagacttgcta

SEQ ID NO: 5560 - DNA, 50 bp, Homo sapiens; identical to SEQ ID NO: 4387

SEQ ID NO: 5561 - DNA, 50 bp, Homo sapiens
gagaaacttccgtgcatgaaggtttcctccttgactcggcagcagcggcc

SEQ ID NO: 5562 - DNA, 50 bp, Homo sapiens
ccaagtaggttttaactctggtatggtctcgtgttttcatttgttgtgca

SEQ ID NO: 5563 - DNA, 50 bp, Homo sapiens
gttcccacggagctgacttctccggggtgcctgtgccctacattaaaccc

SEQ ID NO: 5564 - DNA, 50 bp, Homo sapiens
ccgtaactccgacaaacgcagaacttcttgaggctttcttcttctaagga

SEQ ID NO: 5565 - DNA, 50 bp, Homo sapiens
tctggaccctgcttgggttcacagcattggtggaggtaagtagtattctc

SEQ ID NO: 5566 - DNA, 50 bp, Homo sapiens
gaagaggaagctcatccgaagtcttccgacagagtgagccgtcatgcccg

SEQ ID NO: 5567 - DNA, 50 bp, Homo sapiens
agtgtgtattcttgatgtttattggctcatgtggacagaaatgtacaggg

SEQ ID NO: 5568 - DNA, 50 bp, Homo sapiens
agatgaggctgctctgaagattcagtaattaggatggacagtcagctact

SEQ ID NO: 5569 - DNA, 50 bp, Homo sapiens
tgggctttggggttcagtttgttacctttggagacttatttaatgaaacc

SEQ ID NO: 5570 - DNA, 50 bp, Homo sapiens
cagtggttcctgagagaatcttagttcaaaggactgcccccgccaacccc

SEQ ID NO: 5571 - DNA, 50 bp, Homo sapiens
accgccaaagccaatcatccactttcagtacttacctaaccaatctccca

SEQ ID NO: 5572 - DNA, 50 bp, Homo sapiens
caggatgttattgacagggtggcctttgtgattcctccggtggtggcagc

SEQ ID NO: 5573 - DNA, 50 bp, Homo sapiens
gccatttcatttgctgtgtggttagacttccaggaggctgtttagctcta

SEQ ID NO: 5574 - DNA, 50 bp, Homo sapiens
cctttgtgaaaagtcacctgtgactgtcaggggtatgctatgggcctttt

SEQ ID NO: 5575 - DNA, 50 bp, Homo sapiens
gatccactttggggttcggcggcagattattccgctggtagagccggatg

SEQ ID NO: 5576 - DNA, 50 bp, Homo sapiens
aataagggactcattcattatgcagcaaatgttgtttgttattggcttgc

SEQ ID NO: 5577 - DNA, 50 bp, Homo sapiens
cttcatggtctccagccaggactccatcagcgccacggcttcatccgaac

SEQ ID NO: 5578 - DNA, 50 bp, Homo sapiens
ttgatgctcatcatctgctcgaggtgattgatgccaggttgacgcaccat

SEQ ID NO: 5579 - DNA, 50 bp, Homo sapiens
tcctttggataaggtccaaaacctgtaacacatgaccctcagagcccttt

SEQ ID NO: 5580 - DNA, 50 bp, Homo sapiens
cccggcgacttcaccacccgctatctgggcaccaaagactatatctagat

SEQ ID NO: 5581 - DNA, 50 bp, Homo sapiens
cgcaatagtcctcgacaagtcgccaaccctcccacttcggtcgatcagct

SEQ ID NO: 5582 - DNA, 50 bp, Homo sapiens
cgtcgggtacctcgccgataaaatcgctgatggcctggtcgatcctgaag

SEQ ID NO: 5583 - DNA, 50 bp, Homo sapiens
atcttatccctctgttactcaatgtgagtgcatactttacattgcctact

SEQ ID NO: 5584 - DNA, 50 bp, Homo sapiens
ggtccttgaagatgacgcggatgatcgaggtctctgcgccgtaggcgatg

SEQ ID NO: 5585 - DNA, 50 bp, Homo sapiens
atgatgaagctgctgtccaacgccttcgtctgccagtttctgctggtgtg

SEQ ID NO: 5586 - DNA, 50 bp, Homo sapiens
tccttgccagagccttcgggttctacgatttgatcgacgacgctggtgtc

SEQ ID NO: 5587 - DNA, 50 bp, Homo sapiens
tcgaacatgggcagctccgtttcaagatggctcaagactagcggattggg

SEQ ID NO: 5588 - DNA, 50 bp, Homo sapiens
agtgatagagaccaaagactgctttttaattttgtgggggagggggtgga

SEQ ID NO: 5589 - DNA, 50 bp, Homo sapiens
cgggtcactcatgttggctactaacccttttcgtgcgccgggcattctag

SEQ ID NO: 5590 - DNA, 50 bp, Homo sapiens
cttgtccttgatcgcttccttctctgcaagggagagcttctggaccttca

SEQ ID NO: 5591 - DNA, 50 bp, Homo sapiens
cttgtttgacatcagcgccatctcgacagcgtattccgctatgactgttt

SEQ ID NO: 5592 - DNA, 50 bp, Homo sapiens
cacgaagccttcgatcagttgcagcacgcggccagagcggtcgatagaac

SEQ ID NO: 5593 - DNA, 50 bp, Homo sapiens
cattttgccatctgcgagcatctgggtattgacatgatccccagtggagc

SEQ ID NO: 5594 - DNA, 50 bp, Homo sapiens
caccaagctggtcaacatccaggcgaatggctattacgtggatgagatca

SEQ ID NO: 5595 - DNA, 50 bp, Homo sapiens
ttgctgatacggcctttgatcatgttttcaacgatgttttccggcttgcc

SEQ ID NO: 5596 - DNA, 51 bp, Homo sapiens
cctcgacaaactaaatgttgatttgaattggcctgttatcatcttgatcac

SEQ ID NO: 5597 - DNA, 50 bp, Homo sapiens
gtttcagatcgggccgctcccgccgggtacctatagcggaatcgaatttc

SEQ ID NO: 5598 - DNA, 50 bp, Homo sapiens
gaaaacagaaatgatgctcggcacattctcgtccagcacctcggcaacgg

SEQ ID NO: 5599 - DNA, 50 bp, Homo sapiens
aactgtattcgatcaccgtggcgctgatggtgtcagcagtcgccttgttc

SEQ ID NO: 5600 - DNA, 51 bp, Homo sapiens
agttgacatataacccactttacatacattccaaaattgcgagtagtgagt

SEQ ID NO: 5601 - DNA, 50 bp, Homo sapiens
atatcgtaccgagaaactagtgcggatatctgaccaggtatggcggttgg

SEQ ID NO: 5602 - DNA, 50 bp, Homo sapiens
gtggatgacctgatccaggtcggcctgatcggcctgactgatgagctgtc

SEQ ID NO: 5603 - DNA, 50 bp, Homo sapiens
atgatgaccagatgctctggcaccgtgtcgagttcgaggatgccgacatt

SEQ ID NO: 5604 - DNA, 50 bp, Homo sapiens
gatctgggacgcatggccgaagctgaaaagctggctgtagaagacctcga

SEQ ID NO: 5605 - DNA, 50 bp, Homo sapiens
aacatggcaatatttattggtcctaatactgtcactggcaaggttggtgt

SEQ ID NO: 5606 - DNA, 50 bp, Homo sapiens
gaggcagaggtgtagcgagtccaggctctcttcgaacgttgcacccgacg

SEQ ID NO: 5607 - DNA, 50 bp, Homo sapiens
gtcccacacgttcggccctgactctgctgtgttcgacgaggacaatctcg

SEQ ID NO: 5608 - DNA, 50 bp, Homo sapiens
catgacgttgtgctcgacaccccaacagatcacgtaatcagcctggtgga

SEQ ID NO: 5609 - DNA, 51 bp, Homo sapiens
taggctatagagatgtgagggattattattagtcacacctctagtcatgcc

SEQ ID NO: 5610 - DNA, 50 bp, Homo sapiens
ggctgccggatgtgtaggtcttcccatgttgtgaagtaacggtgctccac

SEQ ID NO: 5611 - DNA, 50 bp, Homo sapiens
tgccctgtatagtgttgtaaaaattagaatgtttcacccaaaccatctgg

SEQ ID NO: 5612 - DNA, 50 bp, Homo sapiens
gtctttcgaatcgctctttagctcgtgcgggctgttgtcccacttgttgg

SEQ ID NO: 5613 - DNA, 50 bp, Homo sapiens
ctatgcgctgcgctacaagctggacctgtattcggacttcagctactacc

SEQ ID NO: 5614 - DNA, 50 bp, Homo sapiens
ttcgaagcgacgctgcgtgcgctgctcgtccaattgcagcatggataagg

SEQ ID NO: 5615 - DNA, 50 bp, Homo sapiens
ccttccgctgtcccttcagtagctgtttctgttccctgacgcccacttct

SEQ ID NO: 5616 - DNA, 50 bp, Homo sapiens
caatgcagcggctgatgcagatcacccacgagatgcaggacgaaggcgag

SEQ ID NO: 5617 - DNA, 50 bp, Homo sapiens
tcattcagtctgagtaggaggaaagaggacaggttgttggagagttggtt

SEQ ID NO: 5618 - DNA, 50 bp, Homo sapiens
taattgccgctgaagcacgaatcctcgaaatgcgtcaccttcggattgac

SEQ ID NO: 5619 - DNA, 50 bp, Homo sapiens
aaatgtggtgacaaagtaccagcaagaactggactgtgtttctggagcct

SEQ ID NO: 5620 - DNA, 50 bp, Homo sapiens
gttcatcgtctcgcgtcgcaagaagtaagggctaggccatgactcgttcg

SEQ ID NO: 5621 - DNA, 50 bp, Homo sapiens
ctcttggcagccctgctctcgtgggtcagcatcgtcgcgtgctccggtgg

SEQ ID NO: 5622 - DNA, 50 bp, Homo sapiens
gtgctcgctgagctggtccagaaatccgtcgactgaggcgatggcggctg

SEQ ID NO: 5623 - DNA, 50 bp, Homo sapiens
catgaacaagggccggatcatcctgatgcccaacacactggacttcggtg

SEQ ID NO: 5624 - DNA, 50 bp, Homo sapiens
cacccgttgtaggcgacgagcgtgaacgaaaacgtgtcggacggcttgta

SEQ ID NO: 5625 - DNA, 50 bp, Homo sapiens
catatgcggctgtgccatagccggatgttcttcgtgcgtgcctacccccg

SEQ ID NO: 5626 - DNA, 50 bp, Homo sapiens
ttctttccgtcgcgcatcggaatgcgaaactcgtacttcgtgtagaactc

SEQ ID NO: 5627 - DNA, 50 bp, Homo sapiens
gccaggggctttatcacttccatggccgcagcgatgaccaggtcaagctg

SEQ ID NO: 5628 - DNA, 50 bp, Homo sapiens
cgccgaccaagcttaccgacttctcgccgatctactgcgacgaagaaggc

SEQ ID NO: 5629 - DNA, 50 bp, Homo sapiens
ggtagtgacgtgctgaatgacggtgccgtccatcatcgggtcggagtaag

SEQ ID NO: 5630 - DNA, 50 bp, Homo sapiens
ttcaggactcgtttcacgtaggcaacgctgtctaaagttcccaagggatt

SEQ ID NO: 5631 - DNA, 50 bp, Homo sapiens
ctctttacccggaaacaggttggggagatgacacgcagaaaatcatacgc

SEQ ID NO: 5632 - DNA, 50 bp, Homo sapiens
ctttggatatatcgagaaaggccagggcctgaacaaggaaagcttccagg

SEQ ID NO: 5633 - DNA, 50 bp, Homo sapiens
aaggctggtcaagaatcttgagacggaattgcacagtctcggcgtgatcc

SEQ ID NO: 5634 - DNA, 50 bp, Homo sapiens
gatcgattcgggggtgacatcggcgctgagcaccatcaccggaacataag

SEQ ID NO: 5635 - DNA, 50 bp, Homo sapiens
ctgagatcaccctgaacaccgacaaggacgagatcgcagtctgcaacctg

SEQ ID NO: 5636 - DNA, 50 bp, Homo sapiens
ctgaaggctttggcgacaaccaggtctatccgtttgaaattggcgagaac

SEQ ID NO: 5637 - DNA, 50 bp, Homo sapiens
tcttgtgccagcacgtcttgctgatagccgatgaatcgcgtccctttgtc

SEQ ID NO: 5638 - DNA, 50 bp, Homo sapiens
gaactcctcaaggaaatagtccaccgcctgctgcttggacgctgccagtt

SEQ ID NO: 5639 - DNA, 50 bp, Homo sapiens
gtgacctcggggtcccccttggtgagggtgccggtcttgtcgaagacgac

SEQ ID NO: 5640 - DNA, 50 bp, Homo sapiens
gtgttcgggcttcatgtcgccaacaccatcggcactggcatcatcgatcc

SEQ ID NO: 5641 - DNA, 50 bp, Homo sapiens
aggttgatttccacttcctcgggaggtttcgccacctcttcgcctttgag

SEQ ID NO: 5642 - DNA, 50 bp, Homo sapiens
gttagcttccacgctttatctcctgctctgagtgtgtacccgcgctgctc

SEQ ID NO: 5643 - DNA, 50 bp, Homo sapiens
ttaaagtggtaagggaggtttctactcctggggaaacattaaagtacctt

SEQ ID NO: 5644 - DNA, 50 bp, Homo sapiens
ctttctccgacttcgagatctgcccgtggtcgagatcgtggtagatgatg

SEQ ID NO: 5645 - DNA, 50 bp, Homo sapiens
aactggatagagcacgagccttctaagcttggagttgcaggttcgaatcc

SEQ ID NO: 5646 - DNA, 50 bp, Homo sapiens
gaagatcggcgcaacgaagaccgcttccacttcatcaactggaccaagaa

SEQ ID NO: 5647 - DNA, 50 bp, Homo sapiens
tgcttctgtgacagattagcttacatcttaccacctcaccgagaagagct

SEQ ID NO: 5648 - DNA, 50 bp, Homo sapiens
agctcaagagcttccgcgacgtacccagcaaagtaacgctcgacgaatgc

SEQ ID NO: 5649 - DNA, 50 bp, Homo sapiens
atcgaagacgtgatgctgaacctttgggcgaaggccgagaaggaaggcaa

SEQ ID NO: 5650 - DNA, 50 bp, Homo sapiens
cgataccctcactagacctcggatcgaaataaatcagagcgatcacatcg

SEQ ID NO: 5651 - DNA, 50 bp, Homo sapiens
ggggatacacaccccacaagccttcctgcggcttcatcacggttaccacc

SEQ ID NO: 5652 - DNA, 50 bp, Homo sapiens
gatcttggtgagaagctcggtcatgtagaagacctcgccctgggacacta

SEQ ID NO: 5653 - DNA, 50 bp, Homo sapiens
attttatcgccagctacgtcggcattggtcaggacgacctgaaggggaat

SEQ ID NO: 5654 - DNA, 50 bp, Homo sapiens
tgatgcggagagcgaggtagatcccggcggagttttcgtcgatgggaaag

SEQ ID NO: 5655 - DNA, 50 bp, Homo sapiens
gtacacttcctggatctgatccacgaggtaacgagcgagagtggtgatac

SEQ ID NO: 5656 - DNA, 50 bp, Homo sapiens
gtgacttcatgctcggggttgagcttggcgtccaccaccttttcccactc

SEQ ID NO: 5657 - DNA, 50 bp, Homo sapiens
ccggtgtccttgatcagcttcagcagtggcttgacgtagatgcgggtcgg

SEQ ID NO: 5658 - DNA, 50 bp, Homo sapiens
catcagtgtttctcctgctgggactgttgcatgtggtgcatcacggtttg

SEQ ID NO: 5659 - DNA, 50 bp, Homo sapiens
gcgaggcgaaacatagcttccattgtgtcttttctccttatgcgtcttgc

SEQ ID NO: 5660 - DNA, 50 bp, Homo sapiens
aatgagacccgccgtccctggagatgaagatgtcgtccgactccgtccac

SEQ ID NO: 5661 - DNA, 50 bp, Homo sapiens
cggatgttgtcgttccagaacgaaggatcggcctcttgggcctggatttc

SEQ ID NO: 5662 - DNA, 50 bp, Homo sapiens
ggcaccgacttgggcctgagagaggcgcaggtcatcaatatagaatcggg

SEQ ID NO: 5663 - DNA, 50 bp, Homo sapiens
ccatgctgaacttggccaggtccttgacggcggtgttttccgacagcacc

(The sequence listing continues in the following parts.)

What is claimed is:

1. A method of diagnosing or monitoring an autoimmune or chronic inflammatory disease in a patient, comprising detecting the expression level of a gene in said patient to diagnose or monitor said autoimmune or chronic inflammatory disease in said patient wherein said gene comprises the nucleotide consisting sequence of SEQ ID NO: 7238.

2. The method of claim 1 wherein said chronic inflammatory disease is systemic lupus erythematosus (SLE).

3. The method of claim 1 wherein said expression level is detected by measuring the RNA level expressed by said gene.

4. The method of claim 3 further comprising isolating RNA from said patient prior to detecting the RNA level expressed by said gene.

5. The method of claim 4 wherein said RNA level is detected by PCR.

6. The method of claim 4 wherein said RNA level is detected by hybridization.

7. The method of claim 4 wherein said RNA level is detected by hybridization to an oligonucleotide.

8. The method of claim 7 wherein the nucleotide sequence comprises DNA, RNA, cDNA, PNA, genomic DNA, or synthetic oligonucleotides.

9. The method of claim 1 wherein said expression is detecting by measuring protein levels of said gene.

\* \* \* \* \*

UNITED STATES PATENT AND TRADEMARK OFFICE
CERTIFICATE OF CORRECTION

PATENT NO.   : 6,905,827 B2
DATED        : June 14, 2005
INVENTOR(S)  : Jay Wohlgemuth et al.

It is certified that error appears in the above-identified patent and that said Letters Patent is hereby corrected as shown below:

Title page,
Item [54], Title, replace "METHODS AND COMPOSITIONS FOR DIAGNOSING OR MONITORING AUTO IMMUNE AND CHRONIC INFLAMMATORY DISEASES" with -- METHODS AND COMPOSITIONS FOR DIAGNOSING AND MONITORING AUTOIMMUNE AND CHRONIC INFLAMMATORY DISEASES --.

Column 911,
Line 49, replace "nucleotide consisting sequence of" with -- nucleotide sequence of --.

Signed and Sealed this

Twenty-eighth Day of February, 2006

JON W. DUDAS
*Director of the United States Patent and Trademark Office*